United States Patent 7,820,447 (COMPOSITIONS AND METHODS FOR CANCER) - sequence listing, part 2

SEQ ID NO: 1103 - DNA, 40050 bp, Mus musculus
  misc_feature (18524)..(18630): "n" at positions 18524 thru 18630 can be any base
  misc_feature (34289)..(34399): "n" at positions 34289 thru 34399 can be any base
  misc_feature (37380)..(38406): "n" at positions 37380 thru 38406 can be any base
gcaggaggatggaaagttggagggtagcctgactgtataacaagttcaaggccagcctgagatacatagtgaaatcctgtctcaaatacaaaacaaaacaaaacaaaacaaaacaaaacaaaacaaaacaaaaaaaaaaaaaacaaaaacccaccccaggcgtgatggtgcatgcctttaatctcagcactcaggaggtagaggctggagagtctttgtgagttcaaggccaggctgctctacaaagagagctccaggacagccaggggtacctagagagaccctgaccaaaacaaaacaaaacaaaacaatcaaaaaacaacttaacaatccttccaactctccaaacccaacgccacccccaaatcaacatcaaactctctcaagtcccggaaagcaaccaaacagacaacacctaaccaagctgagaagcggacagcactggagccttctgaagcactaacctcttttaaagagggggcgcagcccaattcaccagtgagcagattggcttagaaaggggcaagcgctccttgtgggacacagtcaccacttgttgatgaggttgcttgcagggttgacgccatggctcagcaggtagagtcacttgccaccaagcctgacacctgatctgcatcccaggagccacagggtgaaaagaaaaagcaaccctctggcttccacacaggcaccatggcatgggctccctgctaaacacgtatgcgtgcgcacacgcacatgcatatgcatgcatgcacattcatatgcacacacatagcgcacacatacacaaaattattaattaaaatgtaatttagattcggagtggacacggcggtcgccgcctctaaagagaagactcaccacatctatggctggggttctgagctcagtgtttcagaggcctccaggcagactgcagactgtgaaggaaggtgcagaatctctcattggtacagaatggattcgtcacacatttaccagttcaagaattcccgataaagtgtttcggcctagacctgaagatcatgaaaagtacagcggggacccccagaggcctcatagactgtacattgtcataagaataggaagtacaaagaggcatccagggctggagagatggctcagcgggtaagagcattgactgctcttccgaaggtcctgagttcaaattccagcaaccacatggtggttcacaaccatctgtaatgagagctgactccctcctctggagtgtctgaagacagctacagtgcacttacatataataaataaataattcttaaaaaaataaaagaggcgtccatactgggaaaaagatacgatcaagatgctcggactacagaaggcacacagccctcaaattcacaagaacatcccaccggtggatgcaaagctgaaagtggttaaaccctagataggcatccagcgcctggagctgccacagggacttcccacagaaaagaccatgtccagcgcgtgcctcaggggcaccggggagttggtcatgtggtggcatctgaagcctgtggagctggaagtgacgtcctgacgccacacagcttcagctcacagacacacttactgaggaagccgttctcattaaagtgtatgctcatcaaaaaaaaaaaaaaagtaacttaatttaaaaaaggatttcttgtaagcgatgtcagtaatctggtgagttggtgactctgtttctgggtaccctatctgctgttgtactaagtttttcctgtgcctaagccgtcttcctattagagatgtagacttgctgtgtgtctggtcacttgtacacaggtggggatacatcgttctgaattcattgaaatttctgagtgtgtggctcccctggccctgcccgaaatatgttaggtacatcttcctgggggtttgtgtgtgtcataagcacactggtatgagtcatgtgtggtttatattaaacacacaaacgtgtattctttacagggtctcatgtagcccaggctggcctctaactcatttagttcaggataacctgaatcccagagccttctgtctccgcctcccaggtgctgggttacaggtgtgtgccaacaaacccagggaaatctacgttttcagtaaattgatatctcttggcaatagttcccaagagagttcaaagacatgttttatgtacacttacaatccatttacttggaagagttgttctttctaggactgttctaggcacttccatggataataaatgcaagcgacctccagcccctgcaggcaggagttgctgaatgcttcctgcgtttcccccttatcttaactcttcatcagctttgatgcatcttgcaggcgtgctctgaacatgacagctagcacactctgggtatttaataagcagccgattcatgaactaaagctaccctcaaaggtgaaagcagtttatttaagctacaaataaacacaggtgggtctcagatttggcttgtttcttctctgaagcaatggatggggtattgttatcacctagtcaactgttgcccgagtccaccttgagcaaatagaatggacggatcctgtaaaagagaaactggggctaagagaacagggcaaaggccacctctatagcacagataagtttcgccacagtcctgaatggcttgctaagtcccaattagctagcttgaagtaatctcacttttattggtaggaggtgcttcctgcatgaaagaaaaatccacttgtgcatgagtacatgcacaacccacacacacactcacacacgtgcacataccacacacatgtactcgcacacaacatgcacacccgcgcacacacacatagatgcacaccacacatacacacacacacacacacacacacacacaggagcactcacatgcacacactcacatgcatacaccacaaacatgcacatacatgcatgcacacgcacacagactcatgactgtatgcatatggtcctgagcatcctgaaatgctgagatcctgtgctgggtttagtaaaagaattgatgactcttcccttatcttctgggatcgactatagcctttgacattctctttgcctttccccaggtgagtcacttgaagccctgcacccgcagcctgggctcaagcctccactctggccctaggagtattctgagcctggctgaatgccactctgatcattgtggttttgtgtggctttgtgtcctgtcaatttacgtgtccagcaggatggctttcccttggatgtatgtcactctacaccactcagacaccactcagatgaacacgccacgtgccccggctctgtgttgtgtgtccagtggtcttggttcccactcagccccacctccgcccacaggagagctctcctgagcatcccagcagctagcctgactgcttttcaagtgcacacccacgagactctgaggcctccgtccgctttgttccctcagtctggtgtcagaggtccatcctgtgctgtggctggatgcagaatagcccgttctgattactgcagtgccctccacagtggggttgctaatgcttgtgtgtgtcctagtcaccattctattgctgtgaagagacactgtggccaccacaactcttatgagagtttaactggggctggcttgcagttcagaggtttagcccattttcatgatggcgggaagcatggcggtgtgcaggcagatattggaccagtagacctacatcctgacagtgggcacagggagagagagagacagagagacagagacagagagagacaagacagagagatggagagagacagagaggagacacacacacacacacacacacacacacagatgtggagtctggggtaggcttttgaaacctcaaatcctacctcctctaacaaggccatacctcccaatccttccgatcctttcaaatactcacccccttgctactaaacactccaatacatgttcctataagggccatccttattcaaaccaccacagtggttgtgctatttgagaaatttgtgatttttttcccctaaagacttttgcttgttttcttttttttcttttttcttgagacaaggtcttatgcagcccagcttgtcctcaaactcactaatatagccaagcatggccttggacttctgatctccctgcccgtctcctgtgtgctaggattacaggcatgtacctgcatgcctggcttaggcagtgctggggacccaaccagggctttgtgtctagccgagagttttacagctacagccctgaccctccagggatttggggagcatgaaggaactggactctgcctttgtggacgtcctgccttcacttctctggggtgtgcttagcagctggcctgcctgacttagaggaggttccagctgtttgccaaagtgctttaaaggaatggcagtctcatccttcacgtggttccagcatctgcactgtcgttttataattctagtcatcttggagagtgacaacatcaccttatagtcagctcccctgggagatttggaccattttcttttctccctttcctttcctttcctttcctttcctttcctttcctttcctttcctttcctttccttcccttcccttcccttcccttcccttcccttcccttcccttcccttcccttcccttcccttcccttcccttcttttgtttttttgtttttttgtttttttttgttttttgttttttgagacagagtttctctgtgcagccctggctgtcctggaactcactctgtagaccaggctggccttgaactcagaaattcgcctgcctctgcctcccaaatgctgggattaaaggcgtgcaccaccaagcccggcagatttggaccattttcatcaggactctaggctgttctgagtgccatggctgtttaagctttttgattccccctccatttttccttccctccctcctctttcccctcctccctctttcctttctccctttctcctttccctccttccctccctcctttcccttgccctccccctcctccctctcctccctccctccttctccttactctgtcagtctttccctctctcctcctctttcagcttgcttgctggagacaagtctgtgcactcagggcttggtaagttaagcctacttaatgccgatactcctaagagggaccaactcagagttggcatttgttttgtgtccttttcctcacaaagatattttgagatcgttaatgacccccatagttggtcagctttgtgcaaataaataatttcgggggtggggcagaaaccctgaacacttgcttgggctagagggataacccacggatgcacagaggctgcgctagagacagacagtggctatgaagtcttcagactctggcctttgttgccagggttacaggattagtactctaatagcccagatgctcttgtgagccacagctgtctctgcatcgtgctccgaggaggtagtgttcaaacacatacgaagtggcttctgggatttgaccagacagaagtgattcttcttgggacgggaggaaccagcacgcgctggtttttcttctttcacggtgccggcttcggaactcagcgcccctgcttgggttaaacatggcctctaccgcggagctgtactacagctcagtttgtcgtttgtcttctcttattgactcacaggaattttacaaagtgttctgagtagaagtcctttctttttctttttgagacagaggctcaatgtgttccccaggctaaaagttaactcccagtgcgaggatcacaggcttgccccgccaccttggcctagccaatccgggttctggaatcccaggtgctgcctcgccctcctctggtttagccaatcctagtgctgggatcccaggtgttgccccgcccacctctggtttagctgctctttctagaccacttggtgtctctccagccttggctcctcccactactcagaataccaattcacactttttttttttttaaagatttatttatttattatatgtaagtacactgtagctgtcttcagacactccagaagagggcgtcagatcttgttacagatggttgtgagccaccatgtggttgctgggatttgaactccggaccttcggaagagcagtcgggtgctcttacccactgagccatctcaccagcccctggagagatggctcagccgttaaaggctaggctcacaaccaattcacacttttatcagttttatttattgtgtgtgtgtgtgagtgtgcatgtatatatgtgtgtgtgtgagtgtgcatgtgtgtatatgtgcgtgtgcttctgtgcatgtgtgctgtgcatatgcgggtatgtgtgtgcatgtgagtgtgcgtatgaatgtgtgtgtgctgggaaccccatcagactgcaggtggtagacctgcatagatgagaaaggctttgaaaaatgcagggttttttttgggggggggcacacatagagggtaacatgctcactggggagcaacctccctacacaggaaaggggttggcaaagcttgcttcagtaggacacaggggactttgatcacgaacaaagaggagtaagttggactacacactcacatacatacacacatgcacatgagtatacagacatacacatatacacacatacacacatgcacgcacacatatacatacatatacacacacacatgcacacagatttagaataaatttaaaaaaattaaagcatgaaatgtaatttttaaaagatatcagtgtggctggaatctgggttttttaaaattaaggtccatgaaggccggcataggaaagaggtcagaagctggatcttgaggagaaggaggtggtaggagaacaatggctccccaaagatgtccaagtcaaaatccacagaaccaagaatgatgtcagggactgatactcctcatctgacgttgactagagcaacgactctgggtcatccagctgaacccagtacagccacgaaacccttagtgcagtggccctcaaccttcccaatgctgtggccttttaacccagttcctcctgctgtgctgacccagaccatgacattattttgctgctacctcataactgtaattttgctactgatatggatcataatgtaaatatctgatatgcagacggtcttaggcaactctgtgaaaggggtcccgacctacaggttgagaaccgctgccttagtggaccagggaggttgtagagaagagccagggacatgaatgcacatttgctggctttggagatgaacgagctcacaagccaaggatttccctggacatggcctctctgagcaccgattctcctcagaaggacctgctgacacaagtgggtgaggagtgcctgtctttgttctagtggccatacacagtgagtggagaggaggcagtttttaggtgacaggaaggtgtgtgtgtgtgtgtgtgtgtgagagagagagagagagagagagagagagagagagagagagaaaggggacagggacagagggacagggacagagagagtgagacagggacagagatttggtgacagtacccatagcaaggaacctcagaaaaagcctgggtcacagcaacagcagcctggtctctctgggtgggggtgtgctctctgggtgtcttagtcagggtctctattcctgcacaaaacatcatggccaagaagcaagttggggaggaaagggtttattcagcttacacgtccacattgttgcttatcaccaaaggaagtcaggattggaactcaagcaggtcaggaagcaggagctgatgccgaggccacggggggatgctacttactggcttgcttcccctggcttgctcagcctgctttcatatagaacccaggagtaccagcccagggatggcaccacccaccatggtctgggccctcccacccttgatcactaattgagaaaatgccttacagctggatctcatggaggcatttcctcaagggaggctcttttctctgtgataactccaggttgtgtcaggttgtcccagagaaccagtcagtacactgggtctggaggacatgtttaattgcctcctctggagaggctgggaggtggtgatggactctctagaacacttcggggcctcttctccttagttaagccctgcacatgcctcttctcttatgcagtgatgtgacctagctccacccccgacatatgacttatgccaggagatcctacactgaatctctcctgagtggctatcgctggcgtgtgggaaatgtacacgtggctcacatgagacaccaccttcatagcttcaccctcaaagaccccatcaatattcagctgtgagtcagtgcccattgtaggtggcttgggttctcttaggtcctgagtggagctatttcagacttctaggaaaacagttagaaaaaaatagaccccactcacaccccgatgtatatggcttcaggacagttgtcaggcaggctgggctggtgtcttctagtgtgtacagagacacctgctgctaggaccagaagctagggctggtgtccctaatctctctctacctttagctaagaggcaggcacactgggtggacatttgggatctgttctgtgcctttgatatttgtaagtaggaaaatctgcatacgcttataaggtgcctatttgggaaatgaaaggggtataaatgcacacaggagtctgttgtagtaatctgagcgtgtctgacttctggactctgcccttcacagcaaacacttattaaaacactcccatattactattaaagaatttgagctggactatggtggcacacacctttaatcccagcccttgggaggcagaggctagcagatctctgtgaatttgaggccagcctggtctagttcggggacagccagggctacagggaaaccctgtcttggaaaacaaacaataaacccaataataatagtaataaaacaaatgagctttgaaaagtagttttcatttgaaattccttggctccagggaactccacttggcttttgactgttggatggtatttatcattgaactaatacccggtaatgtcttaagtgcctttcaggtataccacaatgctcatcaggataaactagagttagaaggttctgtttggaaaatccttatttgaattcgtatttatttgaaacctagccgtatacttcttgtatttgtggaccaatcaaaaattcttgtcgcggctccaacgttttcctaagtattttaaaagccagacgggtgagagtcctgtaagcgtggccgcaggtgtgtaattgggcagcctgcaacgaaagtccctctcgaccctcacctaaggctccccgctcccacatcctactcaggttgggaacaggctcgaccgggctcctgacatcactgggggacacaagggaaccgataatgcgtagccttcctgggggcatcccagcctcagcgctcgcgactcccctggtttcccagatttcctgcgcaatttcaggcggtcatcctccatccaggagggcgcgctgcaagtggctgtcacccagcacgcagctctgggactggtctttgctctgaaactccagcctgagcagctgacactcagggtgcccctggacacgtgcccgggacagaggctctccaaacctgaacgacaccccgaggatgatccgtgcatcaccagcctccttgaccttaggcagacgcccccagccccccggccatttttggggcagccccctcccccgccgcccccggagtaaagagagaaaaggactccacggggtcggggacgtgcaaaagtgatttctcggaaagagagcgcttcagagaaggcggatttggcaggctgcgctgattgggccgcgccagcgcccctcccgctcctcaattagctcgcgcgaccgtcgctctgcgcgcgggacccgccttctcccccgccccatctataaaagcaggcgcgcgcgtacgggcctccaggagcccgcgggcggtcccggaggcgcgggcagcgtgggaaccggcggcaggtaggacgcgatggggtgggcgcgggggccggggctgtggctctcccaccttcgcccaaacggagtgcacagcacgttagcaggtgcttgctctggctgctctccaaaaacaacaacaacaaccaacaacaacaacaacaacaaaacccaaccaaatgaacaaacacctctccctttaaaatctgcctgatggccaacttcataatgaagagaaatagatctgccaatcaccgcgcggcagcccggcttccatgcatgaactatccaaagctcgcgactgggctcgcccagggaccgactggctttgattctgactagtggcaatctgattgcccagtggcgctggacttctctgattgtccagtggcccagctggccccggaaggaaagtcttccgtgtgggtcccacacagctctcaagaccagatttgctgtgagcttggccccaggctataggggcagacttttcccctggtgagaaagattacttacccacagccgggaagggcgttcagggggtagaaactaatagaaaccattcactagaatcttaaaatggtagatcactgttttgtttgtttttgttttgtttctgatacagggtatcactctgtagcccaggctcattccaatgagctcccggttatccgcctacctcttctgagtgttaggatttcaggcggagcttggggggtgcccaggtgctcaatggccctgtttttttcttttaaagtcaaacgataagagcagtttcgtgacagttctaggtttgtccctttaagttatggcaggctccttcatgaagaactgggaccgattcagtgtccctgaggaagcttggggccagaaagagatgggtctgtgatggatttccgttcagtggtggtcagactgtggcccagggctgaatgaaagggattacggtgtggtgtgagccccgccaaacatggctggtgcagatgttgacagctgtgttaggcgagcctctgtcccctgccttgtgagaagcctgacctaagacacgttgctctagatgtaagttagctgtaggcaggattgggcccacagggaatgctgcctcaaaatcaagaagaggaagctagaatcatgtgagcgtgtttataaaccattaattgtccatagttgtaagagagtcaggctatgcctgtctaggacctcagattggcctccaaggcaatagaggagattgtccaggtgctgagagccggaccctgtcaggtgttctttcatctgcagaatgaatgaaagaaagcatcccttctgtgtgtactgtcactggcagggtgctggcagtttgtgctgtgcctgcccaggggatggtggtccctcccagtctctcccccttccgagtgtagaagaggctgggttagagaattttaacctcctagcttccatggtctgccattcacctttccttttaaacaccccttttctctgtcacccaccaagacatctgtctttcacagttctggggtgttgggtaccccaggatccctgacaagaaagtgccattcctgttctggaaaaaactccagccatgccagggaagtcccttcagatttcaggaggctcagggaccatgggggtatgggtcacaaatctatctccaggagctgagttgaggctttcaatggacacatcctcagatactctggacccctgaccccagctcccaccccaccctcatccttagaggccacacaagacactaccaaaccaggagagcctcctatctcctctccagaacaagctgttggagccaggactctacttggttttaggggtacccaatgccatttcagttctctccctaggtattcctttctgacttgtcacttatgaactcagtggtcttagaatactgggtttcttgagataacctttctttcctgcctttcttgtgagggtccttagacttaggagccaatggcttcccaaggtgaagagcccctgctgaggtcagggtttcccagccgtcttgatgatttgcttgagaggtgcctcaggtggcaccgcacttgcctagcaggcacaagctctgggtccagtcctcagcacgggggaaacggaggcagaaagaaagatcaggcgtccaaggccatcttcatcaaactagggagttggagatcagcctgcgatacaaaaccctgcctcaaaaataaaactcaaaactgactggagtctgactccgctttagccctcgctcccttccaagcccactggtggcagttagggctgctgtgtggctaaaaccagccctggagagacctcatctccctcctctcaggctgctgccgtctttcctggccccactaccacctgcaagcggcctggagtttctgaccctcaggcctctttccagcaatcctgactttgtgggacatgctggctctggatgtgactatgttcttggggatatcttgacttctcactgatgataacttcttttttttttttttttccctaccccaagaggtcattttagttggaagactagaagtgctgtgttctggttttcagggtgggcgtctgtccaactgctttggggatttccaggctgttctagtaaatgctggctgcaagtccctgtgcacaaatgccctctctccccacgctgtaggaaaagcagacccgagagtgtccaagtgtgccattaggtgtctggggatggcgggcctggatatggagtccctgagctggctttgtactgtccctttgttctcactgagggctgattgtaagagggactccctgtgttgttggaggagtcctctaggatacaggctctgattgcaggtactgtacacacagctcccagaccgaatccttaacactctaaggtttattggcttcaaggacacccagccagcacaggactccagctctaactccatcccagtgggaacaggaccctatactgtctgatattactattactatcctagctggcaaagggcaacctgcaagcagccttgagggtgtcctctttctcgggtggtgctgggatcaaactctgtgaggaacactggccccttgggtatcagtagtcacgctggttcttagagaggcgagcagctcagagaaagcacagcattgtaggagagggacttcttcctagcaggtgccctcagtgtctgggacagggggtcagggaagagctggacccagagccagagctgtgggtggggcacatctgtgaacagcctttcggttttcctttgggtttagggccaccgggcactgctgatttctcatggcactggtccagatgtcttcctgagccggcacctttgcgtggacctctgatcttccggcagtcagttccgggactgctctgactcacagagatgtatttgttatcctgaaagatttgctttctttccaaggatgtgtgaccggaacggcgggcggcggctgcggcagtggctgatcgaacagatcgacagcagcatgtacccggggctgatctgggaaaatgatgagaagaccatgttccgtatcccctggaagcatgccggcaagcaggattacaatcaggaggtggatgcttccatcttcaaggtaaagcctcctgcgtacccactcagtggtttttggtttccctctggctctggaggtatttagggatatcctatgactaaacagcccactatttcaagagaaacaaggaggagtgtctgattctggcacgttccctcatgaggttgagagtgactttcctgcccattccgctcttcttgctgcggtgtactgacatgctctgcttggtgtactaaggaaggctttgctctttcaaagtgcgactccttggcatgcagggatcagctataaagggcgacaggcttccacaactgcttctgggtcaggtttgagggacaccctgagcttgtgttttaatgtttcccctctgagaggattgagtgcgatcaccgagggcaagtcacacagctggcctgagaggagtcggcaccctctcatctcaccctgggtggcaggtgatgctcctgtttgcactctgtactgccacggagagaagccacttctccgggatctcatagctcctgtgtgatggagcctgtgtttgggactgggtggtccaaggtcttaaccctttatagtatagagaactagggtaatttctcattaaggaccagcccagcccagttctgcaggcaggcagggtcagacatcccctgagggttgttacactcatgtatgagtgtccctaaggttttaggcacctacattcgtctctgggagtttcagagtcttaggtcatggccagcccacacttctactttgtgaacagctgcagccttggtggtttgacccagagtccaggttgtaaaccactgcctttagctcagtatgtctggggcagggtggaaggttatgaggcccactgaactcagaggaccagaagctgactcaagaccgttttcaagcaggaagcagggcctgcagagactctgactaccaaaactgtcttggatgggtccctcctggggcacagtcttccctttccagtgagaactctgaaccaagcatatggtgactagcattgacactaaactcggaggcacagtgtgcttggctgaaaggccatcacgaatcttccagaaaaaagggcagagtcctggaccaggggcctcagttgttgcaggagacagcaggcctcgcttcatccagttccctgcttcagcaaagcaggagtcctgaaataaagccccagatttatgcatcttatgcaacgttcttcacggccagcaagccgtttcaacagccctgaggagaatgtgcaagattcccgatgtttccgttggttacgcagtcgctctgtgtggcaatctgaaatgagacatcaatctcagcaggaatggcgggagatcaacgggcgggcgggcgggcgggcaagtggcaggagattcagggcagagagggtcttctctgagctgtcctgagtggggcgggtacctccgcatcttcagtcagactcaacttgactgttgaaggaaccgtaggatgaggccttgggcagatagagccatcttaggggccgtctgcttaagtaagaaacccacttttctcagccagttaaaacctttaagaaatgtaggtgttaaggaaaagttatatgcttgcttctctaccagggaaagggattacaccagagagcccttgtgctgtctccgggcagcgtcttgcggcttgcttcctgtgtagaccgcaggggggagaatgaaaaagatcctgagcttacctcagccaggcaagggctgagattccttgggcctcgctcgagataggcctgaccgtttaccacttactctgtgtgcagagggtcttgaaggacggaataggggttaattttcactttactttattttgagtttggaacttaggtagttcaggttgatctcgaacttgctctgtagctgggtataaccttgaccttctgatcttcctgcctctatctcctgcgtgttcggattactggtgtgggccaccatacgtggtgtatatggtgctgaggattgaacccgaggctcttgcatgccggacaagtactcctttatcaactgagctacactcctagtattaatttttcaaacacagtgcaacacaatgtcagcagagaagagcttcaagcagtgggcgcccctgcgggtcccaggacaactcactctgtgccttcagccctgagagaccatgcagctaagatagccctgcagagatggtttctggccagatgtggcaaggctcagggtaggcctgtgctagtacccagtgctgtctcacgatgctccctgaccatggagtctgatttgattggtacctggtatctccaggctttcctccccgaggaagcatgagaccagaatggagggataaactgggcagtactgctgagatcccaccgttctggcatgcgccagctgaccgagatactgctggggtatctgtgctttctcgggtgccattggagagtgggttcacccaatgacttaaggggtgtggtttttcacttgtgtgccagatattctgggctgctacatccagggagaggtactgctggggaatgccttaccgtgtagggtggtcttcactgtgtctgtggcaaagaggcagaggtttccatgtagcccagccccaaagtcactgttccagtctgctttggagttcacaacagcccacaagtcaatgtgtagccagcagtgccatttacaataaaggccagaattggaactgtctacttaaaaaaattttttctaaaagtgggtttgcagccatgtcagagaggaagtgaccactcaggctcgggggtaggaatgttcctccagcttcttgctgagcatagatacagaacttggcatcaacagtgcagagagcattggcctggaacataagtgtccccggtaggtgtacatgtgtgtgtgtgtgtgcatttggaggccagaggtctatcattgtccacaaaaaacgatttcactgaacctggagctcagggattaggctaggttgactgccaacgaaccctggggatcctgttatcgtgaccccagggctggggtcacaggcacacatacccatctttttctgtgggcaccggggatttgaacctgggcctttatgtttacatggtaagcactgtattaagttggcccctgctttgaatttctggcctttgcttaaagcacaagctttggatgggtcagaaaaaagaaattaaataaaaagaaaaaaaaaaaagaggcacttaacagggacaacagttggctgcatcttaaagggctagaatcatgcaaaaaaaaaaaaaaaaagcccaaacagatgttctattaagaggagagaccggtggatacacatgtgttccttttcatgctggaggtgttatgtgacaaagcagaaagtctttgacggtgctggtgaagccatccacattttcctctttggacttcatgacctaagacacccctcttgcctcctccccaggtccttcaagccagaggactttgccaaagctgcatcctaggctgtggggagcctgggttcaaattccagctttgctgagtgttttgggggacccttacccagctcttgtctgttgagatacagtggtcttcctgaagtccaattgggtgctgaccttggacaagggttgatggccaggaaaggctctgggggaagggggcgggcggtatgcagccggcctttgagttgaactctgtggtttgtgtccctctgtgtttactgagtttctctctcgttcttcaggcctgggcagtttttaaagggaagtttaaagagggagacaaagctgaaccagccacgtggaagacgaggttacgctgtgctctgaacaagagcccagattttgaagaagtgactgaccggtcccagctggacatttctgagccatataaagtttaccgaattgtccccgaggaagaacaaaaatgtaactatctgttgggaccaggaagccctctaggaacctccttcaccccccccccccccacgcttagctcctgaagccctcagtctccacagggctagagcagacatgccacccacagggtttgggtgcctggttttagctcaccagagttgttctctcttgtgtaagcagacatagagagctgctctgctgacctcatacgccatgtgctgtcaagtggcagcttcctgcagagggagtggcccagtggaggcagggaagggtggtggactctgggtcatggcagccagaagctggagggagcgagtccccggagctcagcataaactcctccaaatgggtttgaggctctgctgaagtctgtgatgcaggattccctgctgcttccaggcagtctacagaggaggctggggaggagtgggcaaggcagggacgggcggtaaggtccagggaaaagttctccagttagacgggccggcagtggggacatcactgatggcttcggtgtgtcactgctggagaggataacatcaatgccgaggtcttttccagcggtaatgtcctaagagcatctgtaaaggaatgaacgcacactggccttccccagcagagcctcgtggctcccagggcctggtccgttctgtactgcttctggaaggccggctcctttgtcttcgcagtgatttgaagcaatagggaagtttctttcagagccctgctcccccaggaccagccaggcttgatctggttaatgaccctgacttgtttatagtgtgggtggagccccctcacctgcaggtttgggggtgaaggagaggcagaaggacatagcatttgcatggcatttgtcttggtatactgtactgtgaagttgagtggtttgcctgcctctctggctggctgggtgggtgggtggggctctcaacctctgcttgcccagccatggcttctaggtgagtctctccacctggatgaagcaatggggagagatgatacaggttcctgggggtggggagcctggcggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacaaagtgggtcagcacccatctgggaccaggtatactggccgatgaaagcattggtcccctggggaggcaggcagcaggctgtgaaatgtcatgtgtgtgacttccccatgtggcacgtatacacacacacacacacacacacacacacacacacacacacacacacacacgcacacacgcacacacgcacatgcacacgtataaaagggcaaaaagattttctgttacctggcactccctaccttccaggaaatctctgggtgtttgataaaaacccagcctagcaaacttaccttcagtatatgggccataaatgcctggtataaaatgcacccggtggggttcagatagaaggaagaagccaaagtctggcgcttgtccttcacaagccagtgtttacaacccctccaccacccaccacttctccctttttgacttggcagatcagatgacccggccatgagaagcaagggctgagcctttcccaaaccttccagcagctgctggtcaaaaccagcgaggacgctcactactcccgtttccttaattcagcattttaagaaaaggttgcagtgtgctcggctgccctgggtcatggtgtctgtcccctttcccataggcaagctgggcgtggcacctgcaggctgcatgagcgaagttcctgagatggagtgtggccgctcagagattgaggagctgatcaaggaagtgagtggagggggtctcaggcgtcttccagggaggatgggacattgcttctaaccctcagaggcactgagagcctcaggctctgcagggaagtgagggacaccccagctacctccccaggccagcctccctttactggtcaggccctgcccatccaagcatagttaaacccattgaatagcagctttgaaggtctccatggagtcttagccttgtttcttagccaagcttcatatggaggtctccatcgcttctggtcatcccgtcggccctcatggtaactagatggcttgcttttcaagacacaggttttattcctgagtgtgttataagattggatgactgaggcccgtaggatccactaaaggtggtggggaccagcctgtggctcagcgctcacctatcgtgtacgacagttcccagcagcatacacaaaacacacatcttagaataatcccccatcacatgcatggttggcagcctggaactgaaggctcagtgggctccgtttaagttaaacagatggcttttttgtgtgtctgtttttagcctttatattgtgtctgtacaaggtggggtttccatagctgaaacaaccctttaagcttatataagcaagatgaggtctctttagacggcagctggcccagaccctgtcacctcagctactcaggaggcggaggcaggaggggttaagacctgcttgagctgcagaatgaattcaaggtagaaaacttcacgagaccctgccttgaaatcaaaaggggaaaaaggctggcaatgacatagctccgtggtagagcgctcgcctcgcgtgcacaaagtcccggtttccatccccagctcagtgacatcataaaaataaaaccaagactgttgttagcaacgacacatcagctgtgtggtctgcagcattctgtggagcactgcagccggccagcatcaccttcccaagctgcccagctctgcggcacatggccgttgtgatgttctgggtggtcttggttctgtgtctcccccacccccaccttgtcttgttttcggtataagcctttactgccaacttgcctgagccagtagatggtgatgatgtcacaccagggtcacaagcaaaggaggtttcaggacgtctcctaattggacccatccaccactgaaggcccgagagccctgtggctctctgagtgagattctcagcacagtagaattggcttggtgtcaccccagagggttgccccagaactgggctatgtctcccagcatctgaaggccagtgaactctttcatagccaaggctagtcaggatgccagcccagtgggtttgtagcttagggtctgatgaattgcaaagggaagctctgcttttctctcatgagataaaagttgtggatttagttgtgtgtctgatattgggttttacaaacatggggtcaggtgagtgctgtgctggtgacccgggactcaactgctcttttctgtcacctgggtctacagccttctgtggatgagtacatgggtatgaccaagaggagcccatccccaccagaggcctgcaggagccagatcctccctgactggtgggtccagcagcccagtgcaggtgagtgtggctgtccggcactagcaaccactaggctctttatgttagggtaggaggtgcttgccactgctaggatccatgtcctgtggaagggtcatgagtcacagccggggaccgagacagccaagctgcagcctctcaggcaggcacaaaggtcttggtagtcatgcatggtcagtcccctcctgtagtccccggaagctgagaggagcctgccaacatccccaagcctcaagggaggtcccagctctcagccacctgtctcttcctggctcactgtcagggcagccccagagccagagagagccagggcgttaggagcgggaggggagctcagtcaggaataggcgttagtttggaaccactttgggcagttttcatgtcttggtggtgcctcttgtttgctcatccataaaatgggccaccaggacctgcctggtaggatccacaagttaaataaaggattcacccctttgatagtatctgggaggtacacccatgctgtagctacttagagggtcattcacctgggcccctacctcagtgtgtgagcaacttttatggctcacagacatcttggtttcctcttttgcctctctcctgctaagacaggaactgctgggaggtcttaactggccttgcaggactgtgaggtttccaggctgtgggtgttagtgtcctgcaaggggccttgcgctgcaggggtgtgtctttggcaaaactgcctgggactccagcttccttgtgagacaagtccccaaccattgtgtatggtccttggggtagcaaggaagcttagcacaaggacaggaacctgtagtgcagaggaagtcccctccatcatggtaggtttctgtgtctcacgtagagtgaggtctgcccactaatgttgacaccagcagtgtcagcctctcatctatagctcagggatacttgggtcctccctgcaccagcccagcaaggcatatcctttcttttctctgcttacaggcctgccactggtgaccggatatgccgcctatgacacacaccattcaggtaccagggtactctgggagagcatggcacaggctctgcttgaaaatagccccatgatgtagatggggtcatgaggtcccacagacaagtgtggcctaggggtaggctccagagactgattcttcttcctcgttctgtgtggtttgggagcagttatagtcatccaagagtgtcctcagggacagctctgcagccgggaatgtaggttgctggactgccttggcctcgcgtggtgggatctgacctcttggggcgtcaggttcatcatgtgtgaaatgctgtactattcctaacacggtctagtagggacacagctggccagtgtctcccatgtagggtctgtcacctcctctcacttccaactctgtagcaagagtcctagagatggttgtactgatatactgatggtgctgaggctggtgcagatgttggtggtgctgatggtgctgatgtagatgatactgatagtgcagatgttgatggtgctgaatggctatgatgctgcagatgctgctgatgctggtatggatgctgatggtgatgatgtggttgcatcagtgctgtctatagaagttggacctggttcctcctcccagcccccatgctcccagactcaagataatatttacagatacctgtatgaagctaggctcttctctgactagatcataacctaaaataacccatttattttaatctacattctgccacgtggctggttacctgtgctcagggaccatgtgtccctctcatcacaacttcccgggagaatctcccgcacttcgccctatcccagaattttctctccctccgggatgtctctcttcctatttcctgcctaagccataggccgtcagattgactgtttccaggaacaatgtccatacagatgtatgaagttccctctacagctgccttaatgagtgaaatgattctttctcctggagcactgtagatgaagagcgagccttcatctgaattctcccctccctcccgctccctccccacctgcggtcttctggctgtctcctctgcggtctgtgttattttgtctctctgttgtgtgtgtctgatgtctgtctgtccctgacaaagtgctttgctctgtatttatggaacagcacaataggtacagtatgggaaaggactaagggattatctttttatagagatctggagttttttttcaagttaagacgttactttgctgaccccggctgactgagaatagcgtgcggccctgcagacatgctattgatttatatcctcgtgtgccttccaactcttaggggatatttcttttgattatggttgcttttaacctattggctgttttcagcgaacgattaccatagtgtgtacaatgtatgcatgcacacacacacacacacacacacacacacacactactctggtcataggcacggaagggtatataatttgagatttaagctatgcatttagcttgtgttttaaaagctgattgagaatctgggaaactgaggcgacataaggttggttgcatgggtctttcaaaggcaggttaaacgggccgagaacacagtatggaggcagagcaaggacgtaattttaaatggtctcaaggccaatggttaacctggttgcagagcctgacaaaagttcagttgctgaaggcaagaggtgtttctggaaaaaagctatttctataggtgacggcgctcctgatggtggtgatggtggtggtggtgctgctgctgagactgatggtgctggtgatgatgatggtggtggtgatgttgaggatcctgatggtggtggcgatcatggtactgatggtgataacgctggcaaccatggtcatggtgctgatagtgatggctggtgtttgtagtgtgattttgggtgccagagtcaagggtgacattcttgtgggctcttgtctctttcccatgctattaacctcctctaggttatgaagacaggtcgtttcccatttcaaggccctgggcagtgtgactgatgggtctcagagtggggatctgccatcctcactgctgctcgctgtgaggcaggtggcatctctgtgccgtcctgcgagccaccgtgctgcctggtttcaggacaggctcggtggggctcagggagaagccctgggagctgtcacgaaggtagaggcaggtgctcaccaagtaagaaaaacacaaatagacgttcgcccctctctctagtgctggcctgtccatgtgttggggtccttttagatctggctgtggatggcgagcttagcttgtacagcttccacaagcatttgtcttctcgactgccctcaaggcttctgtaacccactcaggaggcccggggtcacgggctgagcctttggccttgtcagccccgggctgtggccctgagaatctgctgaccaatgcattctggggccacactggccgggccagacctggggccttctgagtgagaggtaaaggcaggctgtggggaggaagtgcccttgagccttgcacagctgcctcagcacaagtgagggaagcgaggtgccctcagccacagctgggagctcttcttccagaacccaggccacatgccccgtctctgtagatacgctgcagccgggcttcctgactgcagagatgacctggggtgagatgggtgaggcagggggaccacagggagtaagggagaccatggcactgtgcagagccttgactctgaggtctaacccatggtagctgcctccctgtggtaagcagtgttataggtcttgagaccaggctaggatagacttcctatttatcagaaaaacccagacctctggcttttaaattttattttattcattgatttattgatttatttttagaacaatcttgagagatgtgtagctcgagatggtcatgaagtcacaatcctcctgcctcggcctcgagtgctctggcatgaggcacccctctctgtatttgccacccacgccaaggctttctcagaggtgctctgctgtcagacctcttgaggctgccaatttgttcccagcctgtgtgcatctaaggaatgggtcaaacagcaaggctttttttggtgtgtcagcacttcagggtgaggcagagccagcctgctgtggagaaaaatgccaggctcccccagcagacagctggagtggcagggcttgccctttcacctcttcagcctgcaaaatggctgcggtgaccagcgatgtaccacaggggccagatgtatggatatgcccaacccccgcagaaccagggatttcagtacgtagtctcaggggtctcacctgtggaccatattttgtcccgtttccctggctcctgtggtctcacaagagacccccccacaaagctggcgctcttgtcatcgctaccttgctgatgaagagcaggcacagagaggtggagccgcttgcctcaagtcacacagctgtgaggaagcagtgctagaattcagtacgaaggcgatgcagatggcgatgctgatgatgctgatagcgattttaacggtgggcctgggagtgaatgtggggcgagctgctggtgtcacccacacaggcccacccaggcagtggtgcagttggtgactgcacagctttaggacaccatgagtttggggagctatcaacttgtgtggctccagagagaagcctggattggcctgaggtggcgaggcgaagcttaggatgcacaaggctgccgacagtggagaattcagtttatagcagttacaaagcttctccaacaacaagcctctagctctgggctcctggtgtccgagcttccctcccaggagtcccgcctctatgattccctccctggagccccgcctccacactagctgttagtcaggggccgctgggccctctgccttgtgtttttctcatctttccactttgtaaccttatctggaatccggttgtccttgcctgcaagaggacgtcagtaccttcagtaccgcctgctagacaggaagccagaggccggaagaaaaggaaagtcaacgaaagccaaatactgggttggcacgtttccagcctcagggttcaagttcaaagtctccctcccacccaaaaaagatcgttgggattattatggtcggttggtgccagactgaagcttttctctctttttaaaacttttttgttttttgttttgtttttgtttttcgattgatgggtttacgttgtggcactggggatgaagcctaggacttgagtgcgtgagggagcgcttcccctccgacctgcaccccagctcctgaggtgacagagagaagggttggctaggatgtagcctatggtcacagctcctgcctgtgctgctcataggtggagagaaggcttctaggtctttctggaggacaggctgtgtgtaggattgtacagaggctttcgatctgagtccaggtcacagtgtttgtgataatgttgataccttcacaggtgggtttcttcccatctctaatgggggctaccgagtgcagggtgactcgggaaccagagccataggcagctcatgagaattacattggcatgcttgtatgtcttgagcttggtacaggccttcctagatctctctgtgtttgcgcatgtgcatgcacatgtgcacatgtatgcatgaatgcatgttcacacctgtgctcatgtgtgtggagatgtgtgtgtatatgaatatgtgttcatatgtgtgtaggttcatgtgtatgtgaatgcgtgttcacacgtatgtacacgtggaagccagaggcaagtctcaggtatcatttcttgggcattgcccgtcttattttttgagacagggtctcctgctggcttggatctgaccaactaggtgagactggctggccagccagcctccggggtcagcctttctctgcctctcatgggctgagattaccagcaaacagcacttggaatgaggaatagactctgagcctttaggggaggcactggggctccccatcttctaggcctgatggccctgtgctcttggctcccacagctttctcccagatggtcatcagcttctactacgggggcaagctggtgggccaggccaccaccacctgccttgaaggctgccgtctctccctgagccagccggggctgcctaagttgtatgggccggatggcctggaacccgtgtgctttccgacggccgacaccatccccagtgagcggcagaggcaggtgacccggaagctgtttgggcacctggaacgtggcgtgctactgcacagcaaccgcaagggcgtgttcgtgaagcggctgtgccagggccgcgtgttctgcagcggcaacgcggtggtgtgcaagggcaggcccaacaagctggagcgggacgaggtggtgcaggtctttgacaccaaccagttcatccgaggtcagtaccaagtcacctcgctgccacccactgtccctgccttagaggtcacacccacctccttccttgtgcctcctgtatcatgggccaagtgcactcttgcatggctttggcagtggtatagctgggggaacccttggaagcctagcctgcctgtgctttctgagcgcctgggcaaccctttcctcacctccccctcggtataaggacagcagagttggagcctttccttttggagttgacgaagctgatggttgttcctagcctgggaacggcttagcaatgcagactccagggcctcagcctgcccaggctcggcttctttaccctgacagggtccctaggggatgtggcatgatttagtgggcaggaggatcatggagagagagttccaggccagcctgcactgcacagtgagatcctgtctccccaaaacaaatccagaccaacaaaaagttccccaaatcgcctagcagtattcgggagtgacaaatcccatgggtccttggttggcttctagctaagcagccttgtatcctaggcccctttccttggctgttgggggatctgtgacttccttccaagttctgtaccccagccctgggccctggctacacacagctcagcggttcactggtgtctgtgttcttccagagctgcagcaattctacgccacccagagccgcctacctgacagcagggtggtcctgtgcttcggggaggagtttccggacactgtgcccttgcgctccaaactcattctggtgcaggtgagagccggcagcagtgtctgcctgtgcccagggtgagaagagacagcaaggactgggggctccacctgggcagaggtcggggactagatcatacgtggctcttgtcacctctgtgatggcttcccacgttgggactctcttcatttgtgtttccttcttcccctctctgcttgctcctactttccctccctctgttctcctgttcctccctcttcaggaaatttctgcttgtccagtggccctaagatctaagtgacagatcacggtctatttgactatggtctgaacggtggcactcttgtagatgtaatggtgacagtctgaggagcagccagcctggttggagcagttctgggagaacactcttagccatgtgcaggaacgctgcccacctggctccatcttgtctcggaggggattggaggacctgtggtggaggatggccccagttcccctccaccttgattctgactttgcacatggcccttgcaggtagagcagctgtatgccaggcagctggtggaggaagcgggcaagagctgcggtgctggctccctgatgccagccctggaggagccccagccggaccaggctttccgcatgtttccggatatctgtacctcacaccagagacccttttttagagaaaatcaacagatcaccgtctaagcctcagtccgggcaccccacctcgcctgagctcaagcttcaagagtctgtgactaagagaattccgaaaggatgtggagccctctgactggggtgggcgggtgtcctccaaggggcctccggaagcccacagagggatgcgctcctgctcaggcaggtgtcagaagcttgcaggggctgtggccgcaacctgtgattaaagcattcctttcctgcgtttcccccttcaccactaatggctggcctttctgtgtgctgaggtctttcgacagttcaaatcatctggtggcagcagactcgcctttgcccttctgcggccgagggcggagatttatgactttctctgcttggttggagaagaagaatctttactattcagcttcttttctttttggccagaactctgaaaaaaaaaaaaactctttttaagacaatatttgtattctcacaggctcagctgtcaatcacttgagaccttccctgtaaagtggggcagattttaaatatgggtgtagatactgcttgcagccttcgcaggaattttggttgtggttcattgattcacacagactctgtgtcagctgacagggctgtgtggggcatcaaaggaggaccaggcactgtggagaagacccattcactggcatctcacccttccttgtccagctccatacccagtcctaagacccagtgaaaagccacgtccaaactgtgctctgggctcatcagtgcccacccacgtaccagggaaaggcacacaccctacccagtgggcacagagcggaatgtccccctaccgcaccatttgcgcccccaatctggctgtccaacctagtttgtaagtaatctaaatcagtgactatagccccgcctaagggacacttcccggaggagggagccgctgaaaaggagttagtttgagggtcagtacacaacaggggcagaaagccaagcagatgtgggggcagggagagtcatcatctgcttttgtctgagagaaggagagcttctccgtttgttcaactttgtaacaagctgggttacatgctccacgcagctagagaagcctaggtgctctgcattccctggggaactgcaggaaagccttacctgctgactgttgctctggggaaaagcctgagggtccagagcagctacaagctacaggccataccttacaacctgaaaagctaaggaccacggtgaccttcccggctactgtgtgaaggtgctgggtggggcctgctcaacagacagggtcgacagagtgtgtgatacatgcaaacagaatccttggagtgtgtgatacatgcaaacagaatcctgggcccctgcttctccccctcagtcaaagcaggagtgtcccttccgaagccaggacaacctgttcacaaggccccttgtcacatgtcaccttccacctgcctcaaggagtgctagtgtccaaatatttatttttgtattctcttaagaagtattgatttcatcctttattaaaaaaagttgctctttcacaaaagtaatgtttgtttctttttttaaaaaatcacttttgaatatagttttcattagattccaggatttttttttctttttaaattttgatgttaaaaaacgagaccagaggtctggagagatggctcagtggttaagagcactgactgctcttccagaggtcctgagtttaattcccagcaaccacatggtggctcacaaccatctgtaatgggatctgatgccctcttctgggatgtctgaagacagcgacggtgtacttatctacataaagtaaatttatttttaaaaagtctttaaaaaaaatgagaccagatctgactctgcagcccaggctttgaactcattgcaatcttcctgcctcagcctccttagcaaggggaggagaggtgtgagtcactgtgaatccttaaaggaatctttaaaataaatctttaatttacttttaagaaataatggattgagattttcaaggatttagggatttttttttcttctcttaagacaatagcagaaagctctggagaataacagacacaggagagcacagagggcgggcaatccacgctgttctaccagatgtagattagggtttcagtgagcccaggcctcgtgcagcatgggagggcatggaggaaggagactatgctgacagcacccttctggaagcttctagaagcattagtgggacggtcaccagtcatagcgctgaggtgtgatcttccattcgtgcacacatacttatgccagacaccggctcagaatgaccctcactggtgctataaccagcccaggggccatttcagtagcaactgggaacaaaggccctccccacccccacaccgcaggtgggcacagactgctagttctgctgtctctgaggcagtgtgcactgtctctgctctcatgggatctcagagacagggccagttagtcccagcttacccatgtggaaagtgcgggagagggccatgtttggcttgagtgaggcctcccttgttccgggagtgcagttagagcttctgcaagatccttggcccagaggacagctgactgcagagcaaagtaaagcagccatttctgcagggagtcccgttggcttcagagggctccaacgggggtcttgtgtataaacagctcctctctggatgtgcaaagtgaatccagtcctgtttgtgtctctcagagttcaacctctgggccaagagtggatgctgtctccctgaagtgcgggagggaatttggcatctctgaaggctggggcctcctgggacaggacttgggtcctcaaaggaatgtgactttctctgggtggagactgtttggtcctgaaggaaaggccagctacctaaccaccactcttgggatcatataaaacccttattaggttagtgtgtgttaacatgactctgagtggctacttagttccctaatgtctgcaaggtccacctgagcagaacaaactttctgcttcccttcataccagtcacagaagacaaggaccctagagacatcgagggaagagcagggtggggtgaggcaagtgccctggggtgcctgctgtgtgaggtattggctgggccggtgaaagacaagggttgattgtgtggccagaggacaggctagggttccactcatcatgcttctgtctcccatttccctcaccatcgagagggatttgataccacacacaaagaggcttaacaggcccgaagagcacagagcagagcctgccgctcagaaaatacccaaaataaccgtatttctgtttaccactcatctgtaattaagccaggagtgattagagagctgaactataaatattaaatagtccttgctgacacgctacaacgccaatggttaagtaagtgtgtgtgtgtgtgtgtgtgtgtgtgtgtgtcaatcaactatgtcaataatgtaattgttaatagggtgtggtggtgcactcctgtaagccaagcattccagaagctgaggcaggaggatggtgagttccagaccatgctgggctacacagtgaaacactgtctcaagaaaccaagctgcaacaatagtggaattagcactcaattgtttggagtgataaagaaacgtatgactgtgcagagttatatgttttccctttatttatggacaccgatttaattgaatatgatattaatgtggtcatttctgagccttccattgtaaacagtaatgaatttattaaacttctctcattaggttccttacacagagtctgtgctagcctagtggaagggctgccttgctgactccccgatcctggcttcccttccggaccagagcctggagttctgtagctttctcttttactattattattttgtttgtttgtttctgagaaagaatcttaatctatattccaggctgacctcaaacttggttttgatgctcacggcaggtggtgggacaggccagtgaggcgttgcctgtgatccacccaccgggagccctgtgatgggaagaagggatcagtggttggctcagggcttcggagagacttgagatcccctcatgaaggtgatcccatgttgctttaggcagtcctacggactcgcacatcctgcaggaggagtcgctgtgagcatcccttagaggacatcaaaatagtgtgcttttggtttagcctttcctatgcggtgggaggggaaggggcgggagagggaaggaagggcagaatctgggctctaggatcccttgtggtgaggtttggggaagggaataggctttcgtggatgctgcccggtgagcagggtcctcctgtcctgcccccccatcccgttagcatgtgcaagtggaggactgagctctgagtgaccctggcttggagctgtgttgcagattgggactgaactcaatatatgttggcattatgggtcatacctttgtgctgagggctatccctactatcccctactttgtgctgagggctatccctactatcccctactttgcttttgtctgaagtatatagaaaaaaaacttaaaaaattgcccaaaccccaaaagggacatgggaggtatccccttagcaggtccttagccagctttgggggagaaaaaccagtgtctcagccaccctggatccccttttccttcctgtccgtggcttctgcaagggtctctcagcctctagtgccatgagcggggcattggtcaatgcagggtagagatcccgaggccagaataaagtgactcttgccaaggcctctgagaacaagtcaaacatctgatgatgggagagtcttcttgattatccatgcaagccagtgtcacagggttgagtcagaactatgaagaagggacacgtgggtcagagccagagaagacacgtgacacggcaggacaggatttagttgggctgagatgactcttgaagctgaggactggcagggaaacacaggaggttctagaaggaaccaccaccccaatctgtagtcctgaccttggggactgtcagggaacgggtgtgtgctgtttttaagtcactgctacagcactgtccacagccataggacagtgacacagaatgttgaccttcagaggagaaacccaggactcccgggatgggagttagggatcctgggttggatggcgggtcacatcatccccttttctccggactcaacttcctcccagctgtctctctttcatcagcatcctgtccttctcacatgggagccacactgccccccagtacttggggacactggggtggaaaccccaaggttgaaaatagccctgtattattcttggttaagtttctgctctttccccgaggcagccggctgagaaagccacttccttctgccagcctgccgtccatactggcatctgtcttctgtcctgctgggctttcagccacctggggctggcccagaggtgggcttctgtggaaagattttccctgtgttcctgccctgactgtggcagaagttttggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaagcttgaccttaaaggaccggttgccactgagagatgtaaatgacgccataggacacagatcgccttaggtgtgggaggagaatgacacttttaaagaggggcttcccgaaggcaaagcttcagatgatggcttgtctcgctcaccacagagcaggccagagatgtttgtccagtgaaatggatgtggatgtgtaagcgaggagccgctgggtctgatgggacttgaaggttctagaacatatggtcaccctctctgctaagtgtgacccatgtgctgatcccttgaaatcattctccaggtggattacagtgcctcgagtgtcttctggactagaagacaacccggtggggacagcgatccattccagcatgctggattctacccacgatcctgagtggccccagtgatatccagggcaggtcccctcacccatgagttgcatgcctcagccacgtccaggggcaggtcacctcagtcatgatcaggaagactctgtgacaggtggtggaacccccatcccatctccctccacttcaagaacatcactctcactattcagatagagaaattaagacccagaggtgagctataaatggcagagccgcttgtagtggtcatgaggtggcccagtgcttagtggaagatgggaggtcagcagcctgacaggttccttaccacagaaccctaactgtgtcaggcactctgtctccctctgtgtgtttcaggggagggtcccattctcacccagctatgggccttgacatctctgaggcaatggttcttccagaagggtctgtgactggataacatccagggaatacaagggaaggctccactgggcttctgggaggttcttccagcccttcttagccaatgaacaggtacgaggactctccagccttgagtctccatctttactgcatcacacgggaaactccttcttcttaccttgcttggcctcctgtgatgtgggactctcctatatgtcatggatagagcaaaagggtgaggcatatgaagcaaggtgagtccgagagaccacctagccgggagaggttgggtgtcacccagctctcttgcaggtctgtttcagacactgatacagaacctagtgttctggagcagaactagaccaacctcacacctcgagcattcctggatgggtgctgggtggacttcctggaatgcttagttcatatcagaaaagagtggggattttttttttggccgctgtgttgtcttgtccacgagacccttatcatgggctgctttgccatcctggttcacctcctttagccgctcaataatgtcctgagatggttgtctctgttgacaccaaggaagcagaggaacagcagggtcataacgacttgctcagggctgattggtggtgttgtctgaagccagtctccttatccaccattgctgtcctcacagaggttcactgcagagcccacgaaggttacaacctgagggttacaacaaacattggactccttgttgcttggaggagatgaccttgttacaaagttgcttgctggagtgacagttgacagctaagtctccgcctctgtgtttttctggaaattagaggctaaagtccaggaccacatatcgtgaatagaatctcccaccactcaactcaagccatgatggacccagcccggggtggcctctgctcctgacacggataacccctgcagggaactaaccaaccttagcacacttttgttaatgaaatcccacacttttctggtatttattaaatgtctcctctcccttttacctatcttgggacccatcatgatcccatatcctagggtagtcacatctctttgactgtgactccttcagactgcctggcttgcatagccttgactattttgaggtgtcctacagaggctccccccagctgggactctgtagtcttttcctcctgtttaacggaggatactgagaccagacatggagatgcatgcctttaatcacagcattcaggaggcagaggcaggcaagtctctcagagttagaggccagcctggtctacataatgactttgaggacagccagggctacacagtgagaccctgtctcaaaataaataaattaaaaataaaataaaataaaaccacaagctgctgggatgtcaggcacactacacaggtggattttttatgggtgctggtcttggtctcccaggaaattgttccccctgttcacagaggattctccaagtccaaaggccaataacaatgggacagttcagggctcaggaacatgtgctctgccaggggatacaggctgagacatctttgtgacccccacgggtcccccccagttcctggggtctccagcagttcctacatactttacttttattttctattttttaagaatgctcttcagaaagtcaacctgaacagttttcccaaaggtccagagatgacacgcctgcgacactctggatccccagcctggtttctctctgagcagcttctccttcctgccacctcagccacgacagcttcctttcgcttttctcaggatccacacacccttccagtgatctcagagccagtgcacccaccacttcctctgcctggaatctgcttccttccctcgtaagctggttgacagcttcctccttcagactcctctgccaacctccagaataaaataaacaactccctttgcactgtgggagctcagtacaaagggaggctcctctatagtacactcaaggaaggcaagactccttccatttgtgttccctggtgtatcttcaggcctgcagcccagagccaggtggatgataaagggtctagtactcttgtgactccatccatccaccgatcaatccacctgtcacttgctcttgaattcacttagcacttatccacccaaacatctatctattcatccacccattcatttatccacttgataatgcatctattcatccactcaaatatccacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtaaggtgggggggaatgctggcctgcagtgtaaggtaggggggagtgctggcctgcagtgtgaggtggggggagtgctggcctgcagtgtaaggtgtgtgtgggagagagtgctagcctgcagtgtaaggtgtgtgtgggggagagtgctggcctgcagtataagaggggggagtgttggctggcctgcagtgtcaggtgtgggggagtgctggcctgcagtgtaaggtggggggggaatgctggcctgcagtgtaaggtgggggggaatgctggcctgcagtgtaaggtaggggggagtgctggcctacagtgtgaggtgtgtgtgtgtgtgtgttgctttcagtgtaaggtgggggtggtgctggcctgcagtgtggtgtgggggtagtgctggcctgcaatgtgaggtgggggtagtgctggtctgcagtgtgaggtgtgtgggggtgctagtctgcagtgtgagatggggtggggtttgctggtctgcagtgtgaggtgtgtgtgtatgtggagggggagttcctggccttcagtgtgaggtgtgtgtgtggggtgctggcctgcagtggaagggagtgggaatggggcttggacactacaggatgcccaagggagaagatgccttttgaacaggatgattgtggtgcgatgaaatacaggcagagagcagggatgatgtccagtcgtgaaatggctctgcgggagccccagagatggctgagagtggccaaatgtcccaggatgtgactgctgtgagtgctgcactggttatagggggctttaggctcaggaggccagagccatggctgtgaccactgccaggtgtcatgtgggcggggctgggatggagggagaatggtttctgttgctctagctgtgggagggagctctgtgccccatgctctaccttcctcctctgtaaagccaggatatcctgggactcctgtttctcagatccacgtgaaggagaagggagagtgcccacgtgctggtccccagtgtgatttccccacattgatgacccttgtccaggcagctaggtggatgcaagtgaccagagaaagccataggtcaaaggaacagggcatccagctggcatggggggggggtactgtgaaccccacagaatcagctctgcctggggagctcccaggttcagagtcaacccccgttagcatcctggtgtatgctgtgggtttggccaggtgaagtccttgtctcttctgggctttcttgtagatctacggttccagagtgaacttggatgctctctcatgaccatgtctgctcccaccacagagccactgatctgggctgacaagatccaaacctgctatcttcagtagcagtgtgaggcaagggacttgcaactgctcaggaacagactgttcagttctggggccccagcacctcatagctggtgtctcatcccaacctcgcctgcctcttgcctggttactgcatctctgctaaagtcggctgcagagatggaagcctgtgccattaggttcatgacaagctgctgtcatgtcctgtgggggctcattgccatgggtgcagaaggcagttttccctccagacatttggctgtgaatctggtctgctatagcagctcctagctcatctcctctgcttgg

SEQ ID NO: 1104 - DNA, 2878 bp, Mus musculus
ccggaggcgcgggcagcgtgggaaccggcggcaggatgtgtgaccggaacggcgggcggcggctgcggcagtggctgatcgaacagatcgacagcagcatgtacccggggctgatctgggaaaatgatgagaagaccatgttccgtatcccctggaagcatgccggcaagcaggattacaatcaggaggtggatgcttccatcttcaaggcctgggcagtttttaaagggaagtttaaagagggagacaaagctgaaccagccacgtggaagacgaggttacgctgtgctctgaacaagagcccagattttgaagaagtgactgaccggtcccagctggacatttctgagccatataaagtttaccgaattgtccccgaggaagaacaaaaatgcaagctgggcgtggcacctgcaggctgcatgagcgaagttcctgagatggagtgtggccgctcagagattgaggagctgatcaaggaaccttctgtggatgagtacatgggtatgaccaagaggagcccatccccaccagaggcctgcaggagccagatcctccctgactggtgggtccagcagcccagtgcaggcctgccactggtgaccggatatgccgcctatgacacacaccattcagctttctcccagatggtcatcagcttctactacgggggcaagctggtgggccaggccaccaccacctgccttgaaggctgccgtctctccctgagccagccggggctgcctaagttgtatgggccggatggcctggaacccgtgtgctttccgacggccgacaccatccccagtgagcggcagaggcaggtgacccggaagctgtttgggcacctggaacgtggcgtgctactgcacagcaaccgcaagggcgtgttcgtgaagcggctgtgccagggccgcgtgttctgcagcggcaacgcggtggtgtgcaagggcaggcccaacaagctggagcgggacgaggtggtgcaggtctttgacaccaaccagttcatccgagagctgcagcaattctacgccacccagagccgcctacctgacagcagggtggtcctgtgcttcggggaggagtttccggacactgtgcccttgcgctccaaactcattctggtgcaggtagagcagctgtatgccaggcagctggtggaggaagcgggcaagagctgcggtgctggctccctgatgccagccctggaggagccccagccggaccaggctttccgcatgtttccggatatctgtacctcacaccagagacccttttttagagaaaatcaacagatcaccgtctaagcctcagtccgggcaccccacctcgcctgagctcaagcttcaagagtctgtgactaagagaattccgaaaggatgtggagccctctgactggggtgggcgggtgtcctccaaggggcctccggaagcccacagagggatgcgctcctgctcaggcaggtgtcagaagcttgcaggggctgtggccgcaacctgtgattaaagcattcctttcctgcgtttcccccttcaccactaatggctggcctttctgtgtgctgaggtctttcgacagttcaaatcatctggtggcagcagactcgcctttgcccttctgcggccgagggcggagatttatgactttctctgcttggttggagaagaagaatctttactattcagcttcttttctttttggccagaactctgaaaaaaaaaaaaactctttttaagacaatatttgtattctcacaggctcagctgtcaatcacttgagaccttccctgtaaagtggggcagattttaaatatgggtgtagatactgcttgcagccttcgcaggaattttggttgtggttcattgattcacacagactctgtgtcagctgacagggctgtgtggggcatcaaaggaggaccaggcactgtggagaagacccattcactggcatctcacccttccttgtccagctccatacccagtcctaagacccagtgaaaagccacgtccaaactgtgctctgggctcatcagtgcccacccacgtaccagggaaaggcacacaccctacccagtgggcacagagcggaatgtccccctaccgcaccatttgcgcccccaatctggctgtccaacctagtttgtaagtaatctaaatcagtgactatagccccgcctaagggacacttcccggaggagggagccgctgaaatggagttagtttgagggtcagtacacaacaggggcagaaagccaagcagatgtgggggcagggagagtcatcatctgcttttgtctgagagaaggagagcttctccgtttgttcaactttgtaacaagctgggttacatgctccacgcagctagagaagcctaggtgctctgcattccctggggaactgcaggaaagccttacctgctgactgttgctctggggaaaagcctgagggtccagagcagctacaagctacaggccataccttacaacctgaaaagctaaggaccacggtgaccttcccggctactgtgtgaaggtgctgggtggggcctgctcaacagacagggtcgacagagtgtgtgatacatgcaaacagaatccttggagtgtgtgatacatgcaaacagaatcctgggcccctgcttctccccctcagtcaaagcaggagtgtcccttccgaagccaggacaacctgttcacaaggccccttgtcacatgtcaccttccacctgcctcaaggagtgctagtgtccaaatatttatttttgtattctcttaagaagtattgatttcatcctttattaaaaaaagttgctctttcacaaaaaaaaaaaaaaaaaaaaaaaaaaaaaaaaaaaaaaaaaaaaaaaaaaaaa

SEQ ID NO: 1105 - DNA, 1275 bp, Mus musculus
atgtgtgaccggaacggcgggcggcggctgcggcagtggctgatcgaacagatcgacagcagcatgtacccggggctgatctgggaaaatgatgagaagaccatgttccgtatcccctggaagcatgccggcaagcaggattacaatcaggaggtggatgcttccatcttcaaggcctgggcagtttttaaagggaagtttaaagagggagacaaagctgaaccagccacgtggaagacgaggttacgctgtgctctgaacaagagcccagattttgaagaagtgactgaccggtcccagctggacatttctgagccatataaagtttaccgaattgtccccgaggaagaacaaaaatgcaagctgggcgtggcacctgcaggctgcatgagcgaagttcctgagatggagtgtggccgctcagagattgaggagctgatcaaggaaccttctgtggatgagtacatgggtatgaccaagaggagcccatccccaccagaggcctgcaggagccagatcctccctgactggtgggtccagcagcccagtgcaggcctgccactggtgaccggatatgccgcctatgacacacaccattcagctttctcccagatggtcatcagcttctactacgggggcaagctggtgggccaggccaccaccacctgccttgaaggctgccgtctctccctgagccagccggggctgcctaagttgtatgggccggatggcctggaacccgtgtgctttccgacggccgacaccatccccagtgagcggcagaggcaggtgacccggaagctgtttgggcacctggaacgtggcgtgctactgcacagcaaccgcaagggcgtgttcgtgaagcggctgtgccagggccgcgtgttctgcagcggcaacgcggtggtgtgcaagggcaggcccaacaagctggagcgggacgaggtggtgcaggtctttgacaccaaccagttcatccgagagctgcagcaattctacgccacccagagccgcctacctgacagcagggtggtcctgtgcttcggggaggagtttccggacactgtgcccttgcgctccaaactcattctggtgcaggtagagcagctgtatgccaggcagctggtggaggaagcgggcaagagctgcggtgctggctccctgatgccagccctggaggagccccagccggaccaggctttccgcatgtttccggatatctgtacctcacaccagagacccttttttagagaaaatcaacagatcaccgtctaa

SEQ ID NO: 1106 - DNA, 42334 bp, Homo sapiens
acagaggtgtgaattagacacccctgctctggactgcgcctccactccctgagcaaagcaatgcagagcagtggaaagagtcttgggtttgaaggcaagaggctccagccccccgagcctcagtttccccatctgtcaagtgaggataaccacgcctgccctgctctactgggcagggcaaaggagatgatttaagagcaagtattttgtaaaagagaaagcaagctgcaactttaagttgctactcctagtgcccctcaaagctgcctagcaaattgattcttctccgtagtttcctgcattgagttctagaactcagtgctgggagtcaaagggtccctgttgactcctgggcctggggaacccactctgcctcggaacccttccttgcatccttcctttgtaggcaatcatttggtgcatcccagccaaccatgcacttacagagaaagaaacagccaaaagaaatagagagaagggaattacgacctggggtgcatttgactgcttcagttccgaaaatacttactaaagacctattaggtggcaatgaagttgacctcaaatcacagaaccttaaaattggaagggacttggagattatggattaagtagtacacgctcctgaaatcacacagcaacactgcaatcacctctaacaggcggtctagcatgtgttcccttcatgcttccagggacaggtggctcccacgtcaccaggcacctcattccacttgtagaaagattgttaaagcacagcccattattaagtggactgaggtaagcatgggggcaaattctgcccactgacacacaactaccatatgccaccaaagtccgaaatgaagcctgcttacaaatgaagacaattacaaaatcatccgtcttgtctctaagtgccagggtaaaaatggacttctaggattgcatttaaaaatatctctaaccacgctcaaagtttgtgattctccttagaggtaaattattgttgttgtattgatattttattgtgcttctgccatttgtttctcacagatgcacctgctgcacatctgcaaaggtaagctggagatgaacatgggtgagcgttctggattatttggcactgcttgctaagcacatagattcatgatgcactgagtcagaatccctggaggctcctcctgggaacctacatcttgataagtgtcccactgttgcttatttatgctaaaatttaaaaacactcatctatataatatacaataatatatattttgtaattgttgactttgtaattgtcttcatttgtaagcaggcttggagtcccataggtgaacccacctcccaggtttcagcaattctcatgcctcaacctcctgagcagctgggattacaggtgcctaccaccaagcccagctaatttttgtatttttagtagagacagggtttcaccatgttggccaggctggtctcgaactcctgacctcaagtgatccactgcctcagcctcccaaagtgctgggattacaggcgtgagtcaccatgcctggcccagaatttatatttttcacaaaccagtatttcctggcaatagccctaaatgttcaggatatttttgatctatgcttaagaaaccttttactcttaagtttttttttcctcccctgggactgtttcaagttcttccgttagtaataaatgtgaataaaaatttatacctgaaaggcaaaacgttattgaatgcttaatgaaattttttcctttacattaaatgtttacatactttgccactcctcggaggagggttatgaattaaatacctaatacattacagctgcttaataaacagccaataaatgaacgccaatgcatttaaaagtaatgagttttaggatataaaaaatagaaatctcaggtttttatttgtaatccttctagagtaaagaaacagattgcggcaatattagcaattcgtaaatcaccatccaaacccaccatgaacagatagagcaaactgactcagtgaaagagaaatgactggaagcaaaatggggtcaaagttcatgtctttagggcagatacattttacccagtaatatttctcttcccaagtcccctgagtcggtcccaacttactgccttttagagatctcacttttattgtaagatagcttcttacacgaaaacatttaccacttgtgcacgtatatatatatatatctatacatatgcacacacatcctttgtattcaactgcctgataaactgtagtcatttgttctgtgttgtggagactgataagtgaatcttttccttatctgccagggtaaactgccaactttcaaatactctttggttttcccaggtgagtcatgcaccttccagtgtctgtagccccagggctgctcatgcatgtgactgggtcttagttttttgacctagagaaggcataccaaagtctgcttgagccaacatctttgccaggtgccctcattgtgtttatttttgtcatataaaccttaagtggatggcaggattatgtttccacatgtgcacacctgtttacagaccacccacatcaggtagggcaatccctctgaggggccgcagcagattgtgaggggcttcctgttttcattccaaccttcctctgaaacactggtgtgtagtggcaacgttgttcttaagcttgagccccccgaccaagtgaagcatgagaaaatgcagcttaccttagtcacaggcagctaagcacaggtagttaatggcaggtaaattagccacaggcacctttggaaccagcagcaggtgcggcagaccggaccctcctcggaacgaggagcatgtgcagaagagttcgcacggcaggctgggagtgctgcctccaggaaggcctgtgctggggttgaaccttagctgttgtccgggaacttggatttcaggggggttcctgccaccctaacggataaaagtgcctcactgtgtccaaactatttgtgcaaacagtgtggtttatgctgaacacctgctttccttctgggatctggagttttttggaacacgccaggcagaaggtgcctatgtggccagcaccccccataaaaacccagggctctgagtctctagtgagcttctctggttgacagcatctcaaatgtattgtcgcaacttgttgatggaggaattacgtgcgttgtctgggattccactggagaggactctggaagcttgggcctggtttcctccagacctcaccccgtgtatcttttccttgtgctgatttcgctctgcatctttttgctgcaatcaacggtagctgtgagcgcaactatatggcaagtcctgcgggccctcctcccgcggaatcactgagcctggggagttattggggcctcaactcagacaggtataaaaattaatacacctcctagagcacagagatgagcaatgttcttccagctttctttccttttgccctccctgagattttttttttttttttgcaatgagcttataccttgtctatttaaggcatttttaatttagtgttgggataagtaggggcactgaaatagcataagattttcccccttacctcaagaataattcagcaaaataattcataatatagagcaggtaccaaattatgttataaagatttcagtatagctggagtccagtgtttttaaaatgtgggtcagtgaaggctggagtaggaaggaggacaagatttaaggtggatcttaaggatgatgcggtaggcagattaatggcccgcagagaggtccaagtcacagcccatgaaacctgggattgtgttaggctacatggcaaagggaaattcatgttgtagatggaatgaaggttgctaatcagctgaccttacaatagggagatgatccaggtggactcaatataattatacggtccttaaacgtggaaaagggtggtgcacctgcagtcccagctactcaggaggctgtggtgggatgattgtttgagacaggagttcgaggctgcagtcaggcatgattgcagcactgcactccagcctgggagacagagcaagcccttgtctcttaaaaaaaagagggggcaggagagaagggcagagtgatgtgatgtgagaaagactcactcgccattcacaaagccattgtgggctttgaagatggaagaaaaggccgtgagccaaggcaggcagctggagagaagctggaaagacaaggagtggattctccgctgcagcctccaggaggagccggctctgacgacaccttcattttagcccagtgacaccgtgttgcacttctgacccgaagaactataagattataaacttgcggccgggcacggtggctcttgcctgtaatcccagcactttgggaggccgaggcgggtggttcatgaggtcaggagatcgagaccatcctggctaaaacggtgaaaccccgtctctactaaaaaaatacaaaaaattagccgggcgtggtggcgggcgcctctagtcccagctactcaggaggctgaggcagaagaatggcgtgaacccgggaggtggagcttgcagtgagccgagattgggccactgcacttcagcctgggcaacagagcgagactctgtctcaaaaagaaaaaagaaaaaagaaaaaaaaagattgtaaacttgtgctgttttaagccattaagtttgtgataatttgtgacagccaccataggaagtgcattgagatttgtagtattttgcggggtgaagaggagggtgaaaaggaatggacaagcctgtcaggtccctggatggagatttaatgacgatgccaagactatggatcctagtgagaatcctgcatcccccatgccctacagctaccagggagatgaggcactgggagagttagtactcggctggtggttttgtgccctctgggcctagaaagtatgtaatgctgccatccctgtatgcgcagaaagatggttaatgcagccccactcagggcagtttgggggcttacctgaatttccccactgggagcctctctcctgacttaacctcaacagaggcatcttcttccaagtgctgcttgtaactcagcccccaatgcctgaagacacaccttcagcctctctcctgacgttcccctgcctttccaggaggccctggagggaaggaccccacactggctctctgctgagtggcccagctctggcctatgggacacgtgtgcgtttgccttgcccagcacacgctggggctgccaccattcccagagcagtgcaggctcttggcgccaccacccaagtgccctgtcaatttccagggcaggagtcagagccccatctgcaggtgactctggctttctcaagactgagttgacacctgtgctctcagcaaacatgtttctgagcactcttgaactcacttgctaagcttggcttggaaagtgtgaagggagagctggggtccgcagctggaaagactctcacctcctgcctctctcctgaacccatttgatgtctctcctctggccaaggggtaaatctgcacatgtaagtctcatacactttggctcttcatggaattggtccctgtagaagccgggccagaaagaatctagcaccctcttgcactacaatttattgagcctttactttgtgtcaggcaccgttctaagcagtttatatctaagattggatggatttccaccactcctattcccatttcgagaaagagtaccctttcccaagacaggaaaaacagccagggccataaaggagggccttttgtgacatcatcagaagtggagaagaggtacccagatcccattagcaaagtgcagccgaagagtcatgctaagttcactgtgtcccttgcggcattgccttcctcagtgctggctgccatcatacaaccccatagcttgtgtggcttaaacagcagacatttattttctcagtgttctggaggctggaagtctgagatcaggatgccaacatggtcaggtttagggagggctcccttcctggcttgcagacagctgctttctcactgtgtcctcacatgggcagagagtgagtgagagcaagctctctggtgtccctagtccctcatcgaaacttcattaccccacgaaggtcccatctccaaataccatcacgttgggggttagggctcaacatatgtatttggggggacatcatctggtccatagcaggcactgtccgggtcagaaggcctcccagggatttggtcctgaggctggctgtggaaggtgcccttgcttcatcacctctgcacctgctccactgtaagaactgggcagacagattggcagcttaggccaagcaagatagatggtacggaggctcgacaggaaggtttctggagatcaggaagataggaattaaggaaggtgaagaggaagaaaaaaggactccatgaagaggagagggtctctaaaagctggaaacataagtgaggaggtgagaaccagtctgaagcacccacctgtgacctggtgggggcaggaaggtgttagaggagctagggagctgaccagacgggaggaacccttcccattcttcatggaggcagattatcgctggtctgcaactggcattcttagagttaggaatcactgtgtccatttttctagacttctctcattggtgatgatttgaccttttcctcttgcactaatgagcaaggtggaggaaagagatctctctctctcacacatatactatctcactcaatgcccaccaatcctaagaggcaggaacaattgggttacgccatagtgaactgcccttctgtaggtcaaaatttaaatgtaggtgatgtcacagagtttaacctagtattaccatcaatgccattatacagattaggagactgaggcttcggaaggttaagtcatttgctcaagctcacacatttggtgagtcagggagcttggatgtgaactggggcctaactcccaaacctgctgtggtaggctgccatccatggaaacaggggttcctgcgggaatgtgtaagagatgaggttggtaagtatgacttttagatgccaggagttgacctgtgtggctaccaatgggaagcccctgaagacagaaaggtagggtagcaaagtagaatcaacagggaagggatgaggaggccggagggtaagtaggccactgcgagatcaggacgaaatttactgggatcgtgagatgctggaaggaaggatcagagaatctgggaccatgctctgcatctttttgctgcaataaatggtattgcatgagataccatttattgccatgtgtcctcattgtagtcatttttgtaatttatatgacaagaaaaaatgacagggtgatttttacatatgtgcatacctatttacacaccttccagatcaggagtggtgatctgagctcactagatatgctcaattaggtaataatcaattcaggtcatcaaattgatcacccaaatcaatttaggaaattgatgacctcaattaaggcaaatatatacaatgaaatatatgcagctgttagaaagggctagatcccatatactaaaatggaaagaaagccctttgaaacctaagaaaactgtgtttccattatgtgagcagaaatcttgtgtacacagaaaaatggtctttcttcttcccctcccctcccctcccgtcctctgagacggagtcttgctctgttgcccaggctggagtgcggtggcgtgatctcggctcactgcaacttccgcctcctgggttcaaactattttcctgcctcctgagtagctgggactacaggcgtgcgccaccatgcccagctaagttctttgtatttttagtagagacaggggtttcaccatgttggccaggctggtcttggactcctgacctcaggtgatctgcccacctcggcctcccaaaatgctgggattacaggcatgagccaccgtgcccagccagaaaaatggtctttcaattggaaatgtaattccagagaataaagaatagaaccacactgtaatatgacaagtaataacacacacaagcgctaaaggattttttttttttttttttttttgcctcccgatatctgaggggcaggctccgtggagcctccaggctgagaggctgagactggcagagcaggctgggttctggattctgatactcctgggcaggagtgtctcaaagattgagacattatgttcattctttggggctcctgttcttggcactatatctagcacatagtagttgcctcataaatacccattaaataagagcagaactaaacacatctggttagaaattgttcctaggcagcaaggaaccaacacgtggaaaatatggggtttctggagcagtgttaatgcaagccagttcctgtaatgtacatagtgacacctactgccaatgacacgtgctggagcccttccactgttgatttcctatattcacttacccttgtctttaagtggatgttggtggaaacttgaggatacatctttgtgcagcagacagcatttgtaagtaaatctgtgtaggcttagggccacattgataaaaatatatgagagtaaacatatacagaagctgttttaagaacttctgatgtcctagatgctctgatttctggaagctccatcccacatcgtagcaaatatattaaaacactctcatattctctaaatactcttaaataatgtgagtgttaaaacaatagtttcatttgaaattatttgatgttgcggaactcactttctaatgactatgacttcccggcaatcacggcattagggaattcataccaagtgatgtctaagttatagtttcaaaatataatgaaacatttatccatcaatacattacaattatgaaattaacatgttttggggaccttcatttaaacatttattaatctcagatttgcagtatactttttgtattgtgcagtcaataaaattttcagtctcaaacattttcataggtccctgaaaagctcaacgcaaaaaacagcccccatgtgtgattctctactgggcaataaaagccaatcgcgaccctcattttccccccattccagggcttccccaggatagaacgcggaaacgcttctttttccgtttccagggatttctttctttttccagtgtcgttctccctctcccccacttcatttttacaataaatgtcagtgcacacccaggagcgggtggtcccacaggggacatcttaacgcccacccaggagcggctggtcccacagaggacctcttaacgctgacgctttctggagaaaaggatttgtgatgaaaatttccccaaggggaccttctagcgcctagcaccttcgatgctcctgtttcagtcgcggtctcagcgggcagtggcctcctttgaagctgggattctcctgcccctcccgggcagcgcaggccaccggtgacccgggacggtctgtaaacgaccttcgcgtccccgtccccgtggaataacgcgcggcgggcatcactgcccaatatccagcgctcgtgaaggcggagaccggcggggcagctagtttctggttgtggattctgattaatgggccgcaggcgcacggtctgcaccgtccggctcgttgctagtggctcgctcgggagccgccgcactcccggggctgtccgcccgagccggcctggaaggcagaggacgcctccaggtcgctccgcggggcctccggaattcctgggaaagcccccctgcagcgccgcccctggaccccaggtgtgaggagcggggctcggccagcggctccagaagaggcccggaccccactgccgtggctgccgggggcgggaaagtgatttctcggaaagcagagcacttcgaagaaggcgggccgcgcgagccaagctgacgctattggtcggtgtggccgtcgctctgcgcaccgcccgtcccccccacgaccctttttaaggccgcgcgaccgctggcgcatcgcctggagcgcggcagcaagcgtgggaacgcgggcggcgagacggcggcaggacggcggcaggtaggcacagtgggcgggtagggcgcccgtgtcccgcgcggtccggtcccgcggggtccccgacgccaggcggggcgtgggggtggaactacctaccgtaatgtccccgggcgcagctcagtggccacccgtgtccctctctgctttttgcctattttccagccacctaagtccaatctgaatgcccaagtcgttgattgtcgtttgcctgtttccaaagattggtagatagatgcctttttaaaaatctcatttttctttaaatctggtttacatggaaaacgttaggagagctcatataatgaacggcaatagcaaccccctatcttgaaacgcgctctatcatcccactgaaattctaccacgtggaataatgcttggagggtcagagttgtggaactgcccaataaccagtcgttactgagggttagtttgtgaaggaggggacagactgcttctaaaattctgtttaatgacagtcaattaagatttctgagtctggcttgagggcctttgcttccatcacagcccagtcgtccttggcaagagagtctgtatatgggccacagctcacaaaagcattgtttgaaaaaatttattgaaagaacattgtttgtaaaatgagtcccaatacataggacagactttcctaaggtgagatgtgttacttacccagagctgtgaaaggctttacggatggaaactagagactgaattttccagaattttaagaagtctccccaaccaatggccccccactttctttttttaaaccaaaggtaagaactggtagttaaaatgacagttcaaagcttgtccttttgggttacggcagcttcctctatgaaaagatttgggagtgattcagtcacttgaggaaggttggtgccagagagagaaatggctttggtgctttctggtctagtgatgcgggtatgctaggccagagcgagtgccctgggccctccgaggcgggggagagggtggggtctgctgctgccagctcaggtgtgacctgtaatctggattaggtgggcccagggcaacctcttatcacgtccctcctggaaagcctgactgctgtatacatttctagggctgcagatagggcttggccaatagattacctcaaaatcaagaagaggaagttataaacatgtgattagacttattaatttttcctggctgggcatttggtggaattcgtttgttaatgtttaataaatcattatggatcataactgtagtagaatctcaggcttttgatgttacttagaatcttggaggagaccacgaaggacacacagacgtggctgcacatgtgcagagatcttgtaatgtaactatggcttttctctgcaccatgtgtgaaataagctgccgctggcgttggggcgccggcctgggttccaacacagtccgctggctgcctcggtatttgccgtgcctctctgggcctcagtttttcctctcttaaataaagaggggactggattagatgatttctaaagtattttccagctttcagatgctatgacttactcttctctttttccttttaaaatttctttttcctgtaaatcaccaagatagttgtcctgaacagtttagatgttatgaatccattaggaatcctgataagaaagtgttgaccctctttctagaaaaatgcgtgtactaacaaaatttttgcttttggttgcaggaggctcaggaactgtggattctagtttaagaaacttgtagcaaggaaatcaggggagttgaaagtctcagaagccaacccctatgttgtgttctggccacctctgtgcagctcattcctcaatctaggagaaatttttctaccttgccccaggaaagagctgctaacttgttttcggggagtgtgggggggtctttggtattggtgttccatttctcttctcaggtaccctctcccaagtctgtcccttctttatgataaacacagtggcctgctttagaattctgggtctcttgagatacagcctctcaacttacaggtgaggaagcctcagggagaggttcaagtgacgtcacaaggtctggttagagaaaagcctttgccagagttcagagttttcaaaccaaggtctaatttgggtgggcgcagtggctcacacctgtaatcacagcactttaggaggctgatgtgggaggatcacttgaggccgagagttcaagaccagactgggcaacatagcgagatcctgtctctaaaatgtatatctgggtgtggtggcatatgtctgtagttccaggtactcaaggggctgaggcaggaagatcgcttaagcccaggagttccaggctgccgcgagctatgatggcaccactgcactcctgcctgggtgacagagcaagaccctgtctctaaagaaaaaaaaattgaactcatccccttttaaatccataaacgcacaactgaggttgttggatggggaatttaagaaatcccacctcctcctccctgggacctggccctgtttcccgtctcatggccacctgcagggtggctgaagtttccagaatgcgtacttcttgtgaaggttctgattgatattttgctttctggaccagtgtggctctaccatattttgggatgttatgtcttgttactgctgattgtttcaaactcgtttgcccaaagaggtcacattttaatcagaagaacaaaaatgctatttttttttttttttgggtgggcgtctatccagctgtcttggggatttccagcactgttcttggaaatgttggctctaagtcgataggtcatgctagttctctctctctttctctgtgctgttggggaagctgtctgcttgggtgagagtgttcttccaaaggatgtctttgggtgccctgggatggttaggtccctagagtgggacatgttctggaagaggagcccagtgaactttgccctgttcggtagctgcagtttatttcctcactcttgtccctatctttcagttggtcgtaggagttgcccaggaaggaagtttggataataataatgacatctggcatgtaaggtccaggccctgtctcagttgctttccgtgtagcatctgaattctcttacaaccagtacaggtagtgttttgttagctgcatctgggactgggtagctgatgccctgagtttaaatgctgatccagcgtctcccagctgagcggtggcgggacttgaatgagatcgcggttctgtctcattctcaaactgctgctcttatcactgtgaaggaacagctatttagatgggctggcctgagggcctcctctttcccagacggcacggacgcagtattctatcagggaatgtggggccagctgggcatctggtagcccagttggttcttcggataatgggctgctcagtgaaggaacctggtgctgtaaaagtgattccccctctccttccagtcttgggctaaaactggagctgttcactgtggttgtatctgcctgaaaggaaagggcagatgaaagctggaaggagcacagccagcacagtgggaggggcctgcagggggctgctggtggctgcaggtggctgcaggtttcccacggagctttcagtttgcactcagggctgtgaggtcatggaggccagcattgccttctcatggcaggtgtcccggagtccctgaatctgtgggtttcccccaagccagcacctttgctgcaaacctctgagtttcctgttagcagtttttgggttgctgtgatgaatgagacaatatccgtaatatcacagcgtgtatttctgtctttccaaggatgtgtgaccggaatggtggtcggcggcttcgacagtggctgatcgagcagattgacagtagcatgtatccaggactgatttgggagaatgaggagaagagcatgttccggatcccttggaaacacgctggcaagcaagattataatcaggaagtggatgcctccatttttaaggtaaagagcccagctcccttccccactgtgggcacagtgtctcctttccctcatggactagtggagatgttgagtgacatctttctcatttacttaaaaattaatccagttttttaaaagcaaacattggttcaggagtgctgaatgtgtctcagacatgtacatgagctgatttcacatctcttgaattacggagtcacttttgtggtcgcttgtattctgatgaggagatcgaaggctcttttcttctcttttctgctgcttccttttcctgatgagccaagtgggagaaaatacttcgagaccttcacgctaagacctttccccacgggcttccattagaggcgatgcatataccagggaaggtttcagtccttgttctttcaaagctgatacttctgcctggcattgtagggccagctcaggagggtgagatgccatctgtcattcctttgggggctgggccgtgtggggggttgtgaacctgcagcagatgtctaaaaatagtctcacctcccttgagagtaatcggttccccatgcgtggagagacgtgatggagggtttgttctgtgccaggcctggcccacggcttgttttctgctcacatgatcctgtgtggtagatgctgttcccaccctcattctatagaggcactgagaggagaagtgacttgttgaggtctcacagctcttgtatgacggagccagcattcagatgcaagatggcccaactgtgaacccttggtcctaactccagaatagctgatcaacagagatttcttgccattacacctagattcagacagaggaaccaggaattagggcagcccagctctgcagaccagctgggctatcgaatcccttgtgggtcatcagagtcctgtgtgggcatctctaaggctccagatgtccaggtttcacctctgggagattcggagcccaaggtcaaggtcaagctagacttccacgtttgccagtgtggacactacacgtagtctgagtcctagcccaggttataagccattgccatgtgtgcttattctcttgcatttgggggccagagatggggaggggagagtgagtgtgggagaggggtgaaaggggctgagttgttgggggccagaatcagacctgagaccacaaacaaggtgtggagggggtcaaggctgtaggagcccatgacagtgctggactcccagccacagatgactgtcccctgacaccagagaacaaaaatgacaaaagatcacaccttaaccccagagtggaccataaataggtcaaaggtagcttaagatgcattttggtcctgcacgtctctgcctgaccgatgtttgcagtggggctgtgcgtttcagtaattctgttaaatctgcaatttgaggttgctgatcttcttgagaatctgatgcccattactgaccacgccaaggaatatggggacaagggaacgctttgcactcactttcgaggggtcccttggtgcccccacacgttccagattctttctgatcaaggaccccaggtcagggagcctcagcaccaagaagttttgtgatgccactgcctgcctcctcacccttagtgccattgtggatttctctcttgtttgattgcagatcttttttttttttttttttttttttttttgcctttggcatcatggtgaacttctcttgggaaggactgcaaatgtaaacagtgccagagtcccattcagtcggttgggaactctgcattatagataaccccaaaagccggaatttctctgcctcgccactgttgatgtctgggtctgggcaattctttgttgtaagggttccctatgccttgtgggatgtttagtggcatctctgacctctacccaccagatgccagtagcatcccctcccctactgtcacaatcaaaaatgtcttggacattgccaaatatctcctggtggggcagagtcttcccctccccattaagaaccctgataagagctggccactgccaggatcaacagacttaaccagaggtgttgggtgctgaaggcacagttgcaggttggacatcagtaaaacatctttaagacatggcagagggtgctggactaggctgtgtagccctgacatgtggcatgctgacggagacgaagcttctcccttcaccccattccctacttcaacttgtgctcggggggtaatgaaataaagccccagatttatacatcttatgcaatgttcttcatggccgtttcaacagtgttgagaaaaatgtgcaagattcccaatgtttccgttggttacgcagtcgcctgatgtggcaatctgaaatgagtctaccatctcagcaggaatggggccaggagggagacgcgggtgcccactggagcagggaggccatcgggagggccaccagtgccggtggagacatggcgccagcaagagcccatcatgtgcttccctgagctatgcttcttcccatccatcctctgagaggcctgtctctgtgacgttggccggatagatctttggctgttggatgaagtcaacctcggtcaggtagagccatcttagggattttccggttatgtagacacttgtttctttcaactgttcaaagaaaacctttcaacaatttaggagttaagaaagaaatttatgagtttggtttcttccgtaataagtggatggtaaaaggggccacttataccagaaaatccctcattgtctgcaggcatcatcctgaggccggcctcatggtatagatcacagaagagaaattgaaaaaacattgagctcattttgtaccgaccctgagtacactgatgaggccctgatagcaactcatttaatttttaaaaagtactttaccttcttgacatgacgacaaggggggaaaatctagttaagtgaggattatgattcatggttattccaggcatcgtaacagtcctgaatgagttaaagctcacttagtagcacagatatttctcattcagcaggccttgaagggaaaaatagcatttaattaaaaaaatgcaacatgaaacaatcatattaaattaggaagacctcctggtcttagttcagtgctgtcagcctgagttgtgcgtcaacaggagaaataagttatggtggaggctgaatgagccatagtgactgttgctggcggcaggggtgggggggccctgaaatcactctcatgtctagtttttgctctagctcaagaaggatctcgagagatcatcaagctaagttgaccttttaatgctggccagagaggctgggagagggccaggtgcctgctgtgtcacagagttcagggcaggcggcaagccaggtacccgatggtggccctggatgcttcctggccgtgggccctgctgtgatggatgatgtggcctggacttgctcgtggggtgagtgtgagcttggcgtgaacgagtgagtatggcagtgccttgcaggcaccgcggttgcgtatgtgtaccagcggatcacaacgttgccatgaaatctgtgcatttcaaggcccgtttgggatgtgggttaactcagtggttctcaggtgggggaggtatcatgatttaccctccagggaatacttggccatgtttggagaccttttttggttgtcacagctaggggaggggtgctattggcatctggtgggtcaaggctagggatgccgctgaatattctacaatccacaggaccaccccgccacaaagaagggtcccagctgatatgtcaggcttgccacggtggggaaaccctgatttaaagtaataaaaatttgaaactacagttgatttagtacatggtttgctggtttatttctttaaaaataaacaacagcaacaaaacccaaattaatgcccggtcagtgatgcagtcaatgaagagagcattaaagaccgtgtgctttaagaaatagttttagaggggagttttacatcaatgtcacatgaggaaactaccacttatgctcactaatgggaatgttcttccagtctctttaccccaggtagaggtgcaacattttgcatcaacaaagtaggcagcattggccttgaacagtaagcattcttgtcttttttgagaggaaaaacagtctgggctattttaaaggagctgtgactcatgggggcatgatggagtttctggaagtgtggtctcctgggtagctaaatccaaatccctggaatactggctaaagacagctacctgggccgggcgcggtggctcacgcctgtaagcccagcactttgggaggccgaggcaggcggatcacgaggtcaagagatcaagaccatcctggccaacatggtgaaacctcgtctgtactaaaaatacaaaaattagctgggtatggtggtgcacacctgtagtcccagctacttgggaggctgaggtaggaggattcgcttgaacctggtaggtggaggttgcagtgagccagattgcgccactgcattccagactggtgacagagtgagactccgtctcaaaaaaataaaaaaactaaaataaataaaaataaaaaataaaaaaagacagctaccgagacccaacctcccttccccagtgagaatcttgaggggcaaggcccaggaatctgcattttcacaagcttcccaggggcagggggttggtatatgcattaagcctgagaacacttgctgtggtggggaaactgttgggttggaagtgggtacagctggcatttaatcccagactgggtggccttgggaaagttacttacctcttggaattgcattttcctgaagtgggtacagctggcatttaatcccagactgggtggccttgggaaagttacttacctcttggaattgcattttcctgaagtgggtacagctggcatttaatcccagactgggtgaccttgcgaaagttacttacctcttggaattgcattttcctgaatgggatcgggatgtccctacagatctcctatcattttaggctggaggacactgtctgatttttcctgaaaccgaagataattctcatctgactgtggttacctcctagttggtgtgtctgtattccaattttgcaagcttaaaatctgtccattcacctgtcttatttttttaaaatctgtactgccccattctacattatgactttaagatttcagctttgaatttctggtcctagttcagatcctaaggtttggaaaagtcagaaaacagatctattaaaaaaaacacacacacattaaagggaaagtacttcattacattttaaacagcacctggggggaaaagtctagaataaatgcaaaaatgcaaaacaaaatttctattaaaagtaacagggcgatggatgaccattttgactttttgcaaatgttcccttttcatgctaaattttaggggttgatctgaaaaagcaacaacttgttctttgttttgaacgctctggtgaaaccatatgcaacttcctctttgtgctgtgtaaacctcaggtgtctccagctcttcagccaggcaagggcttggctaaaaggtgcactccagggttggaggagccttcagcctgggttcgacttctgactcagctgtatgaacctgggggaccccctccctggcttgggtctttccacatctggtccccagatgtgaaaagactcaagacatctgattggagtctctttgggtcctgaaattgaatgagagttgatggccaacaaagattcatgggaagggaaggatgtgtggggtcctggtcatggtgacggatatttgtgattggagtcggccatgaatttaatgtgcttctgtttctttcttcaggcctgggcagtttttaaagggaagtttaaagaaggggacaaagctgaaccagccacttggaagacgaggttacgctgtgctttgaataagagcccagattttgaggaagtgacggaccggtcccaactggacatttccgagccatacaaagtttaccgaattgttcctgaggaagagcaaaaatgtaactatcctttatgggcatgaaaccttccagaagctgccctggcctgtagccttcaccacagaacttgggtctggggtagacacagggtctggggcacatagtttcagttaaacaaagcagttctctccttcgtgtaagcagaaattgagatctctttccagtgacctcagagggaagggcggaggagattgggtgctgcccaacctgtgccccacttgctgcctgaccacagacatttgtagggcctccctggacaggaacaagcatcctccagcagtttctgatgaggaatcctttcattttccagcagcttgcagaggaggccaggggaaaatatggtgaccacagaaggcctggatcatgagggttgggagtaaagctctcagatgaagttgtcaaagatggcaccatggccttcgttgttggagatgggatatgcctcagtgtgttactagatcctgattgttatttgggaactccgggatgtgatcattcctgaggtttcttccagctctcaaatcccaagaaagcatttgtgacagattaaagcaggacagcaaaaacatgccgcaccctggtcctacatcactaaaataaatcccaaagtactgagctgggatctggcctcagaaggcttctcaaagccctgtgctgtgccgctgccatgaattgtagctgatttatgagataaaacctaattaccagcgctggtttagaacatgcttttaacacattgattttcttagccacttgatgaggcttttagaataacccactctggctttctccttctaagcttctgagtagtccacgaatgcctgtaagaaacagaaacccccaaaacttcttggggctgtgcagaagtttgaagtttgcactcttcccgctgtgggggtgttgacttagaattttttaagaagttaaaatggtgattcaaacaaatctatagtgaatctgtgtcagagagttgtgtaatcgtcatgaaggaggcagcatgatggtaaagatggtggacagagaatccgaggtgctggtgaatgtggcccatgaacgagaaagctgagccaaagccgatgcccgacccggacagtacaattgcggtttggggcgtttgtagcctaatcgtctgcaattagcacctaactctactgagcgtgaaccctagtcaatactaaatagtaaggccaacaaactgaccttcccttggagaatcgggtgccctttaggaggaaacctctatataatagtctggggtgaccctgaaaggctaagcagtcatctttttgcctcatttcccagttttggacaattttttttatcaccaaaaagtaaagtgtgatttgaaggaatagagaagtttcttttggcccctactgccacccccaagatcagtcaggcttgaaccggcaggtgaccccaacttgtttatagcatggggtgcagccagcatcacctgctagtgatgttaaagaagcagcaggaggttctcaggggtgaagcaatgtagcatttgcataattgcctacaggggcccactcgcctctaacctcagtggtttgcaggctccatggtgggcgccccacctgctccctacttccccatcagtagcttctcagtgaattctttaatctatcgaaatggaatcaaaattcagccgggaggaaacagtgggtaaattctgtaggtcactgggaataatgaatttttgtaagtgttggttgtgatacgtctcacactgataaacttcataaggtaagttgtcgactgaggaagcggcatgagaagggaaagagcagaggctggcccagcgtgcccctgtggacactgtgcacctttaggcggtttgtgattacggctggtgcccactgggcatcagtgagggtgctgcggtgtgtgtgtgtgcatggctgtgtgcactgatgcacatgtgtatatttggaaaggccaaaaagagatttcctgccaactggcaatacaaaaaagaccccaacctgccaacacgttttgccaggaaatcggtgagtgttttcaaatgccctggcttataaatgtaaccttcttaagttagcaaatgcttgctgtaaagtatatctgatacagactcattttggatctcagaaaatagaagaaagagaccaaagtgctgtctttatcctttaaaagtgttagcagaaacaaccaccaccaccaccaccaccaacttctctcttttgactttgctgatcagatgactgaagcatgggaaaaaaattctgtgcctttcccaaaccaatgaagacactcactaacttaacgtttccttaaactcagcatttacagagtagattatggcttcagcaaaggctgtgatgcctccgtgccatgtgtcatggtgtttgtctggttttctgtaggcaaactaggcgtggcaactgctggctgcgtgaatgaagttacagagatggagtgcggtcgctctgaaatcgacgagctgatcaaggaggtaagcagaggcagcatttcaggggtctggccctgccaggaggagtctcatgtcttctggcagggaggggcaccgttcttgctgtatgaaggcagccagaccctcgggctcgctgaggaagtggcatctccacctgtacagatctggaacggaaggactggctgggcgccccctccccaggccagcttctgccgacaggtcaacccctcacgccagatccctccttcatccctagggctgggcctgagctgccggttatgtgtcagtgaagttccttccagctccaaactgttcgaacactttggacagcagtcttttaaatggcatcgtgaattcccttgccttcctagcaggctacagagaacaaaatgtaaactttccttgctgcctgcgcttgtcatgatggcgggtgttgttgtaccagctctcatggctatttgattgcttcctttttaatgtgcagtttttattccttaacggattggaaagctggataaccaagcatgttcacattgcacataaattcctaacaggctacaagggagagcataatcggggcctccttaggcaagaatacatggcttttgtatacccatttcagctattgggatgcccttttcttctgtctttggcctcttaactatgcttttcatgggtattacaaggtggacatttgcatgactaaacctcgtgcagcctttgcaaaaggttgtgtgtgagtactgcataaattcttcttcttaataacatagcaataatggaatccttaagagtagcttggctgtcagagaatgaagataacagaatgtaacctacccgaacggccttgctcttctgcacaggcagctgccaagtgtctgggtggtctttggcagccgactgagtgaattcttggcttcgtggccctccaccaatgtcctgttttctgtagaaggcttttctgctgactcagctgagagagtgagataatcggattgccacaccggggtcacaagaaaagcaatttcaaaacatttcataattggatttatcagcctcctttaaggaatgggccagagactgaacatctgcatgtggctcgttgagcgagattcttgaaagcatggcagcctttggccagcatcactgttcactggtgtctcagagcttgtctgcgtgtccagggcgttgagggcaattggataacctggaacactgggtctgcaacaggcaggtcctggaaagggccaggaaacttattagtggcccccaaagagcctagtaatttggccacatggtttgaatgctaagcctggtagatttaaggcctagggcctttcaggttgcaaagtgaaacttgacttttgtctcctgagataaaggtgacaatatggttttacttacacatgaactgttcatttttacaaacactggagccccaggtgggagatcagtgactgagctgccctcctctccctcccctgactgtgcagccttctgtggacgattacatggggatgatcaaaaggagcccttccccgccggaggcctgtcggagtcagctccttccagactggtgggcgcagcagcccagcacaggtgagggtgggtggcctagaattgtcaccaggcatggcctgaagggtttacggcattccaccagccagggacggagtgggggtggttgttgctatcatgatccatgtctcattaaaggtagctcagccctgagaggtgaagaacgatggccctggtttcccaacatgagggcagagcccagctgtgcctttggccctgctctccgctgcttctcaggagggcacaagctgcttgttccctaggtgatgtccatgccagctctccccacgctcctgggaaagtccagggaagagggtctagtgaacttgtgtaaggccagagggaagatgcagctcttggccacgctggcgccccctccctgggtactcccttaggtcggccagtctgttacgacattaaggaccccctcagaaccaaagagagcccagggcatttggaggagaggagaactcagaccaggaacaggaagtttgttcagagccctagatttgaatcccacgctgggaagttacagatcttgagcctcagtttattcatccgtaaaacagagaaaccaggacttgcgccatggggtcacgagggttaagtgaggcattcatcctttgattctcttttgatgagccactcagaacccccagctgcttgaaatgcccccgcccccgccaggcccaggcttctgcagcccgtgaatgtgtttgcttcctccctcggcgtcttccccctagccctacatcccctgtgggagtctgggaggtggcagctggccccggaggccttgaaggttgccaggccttgggtgtcgagtaagaggtccctggaaaggcacctctgtctgtgctgcaggaacaccatccggaaagctagcttgcacccccaggctctcccccagagataagccctgggtggtgggtatgcagtccagtggtattctgggggcaagtgcttgaggtgggaaggaaatgtggccccacagtgtcacattgacacatggtcagaaatcccacagcatagaggaagtccccccgacttgccactctggttttctgcatttgtgaaacaatggctctctgctctggtggggaaaagcactgaattcagcggaagcctgtgctccctggagcctctggcacgccatgtgcagccttttaagggacttttggagaaggagcgattggggttactccctgtacaccacacctgggtggctctgagcttgcttttctgtttctcctgcaggcgtgccgctggtgacggggtacaccacctacgacgcgcaccattcaggtacggggtggtccgggctgagaggggcgtgggcactgtttgaagacaaagcccagataacccaagcagggttgcggggtttcgaggatgagcaggacctggtgtggaagtctaggcctggttccaaggatgagcaggacctggtgtggaagtctaggctccgttccgaggatgagcaggacctggtgtggaagtctaggcctggttctgaggatgagcaggacctggtgtggaagtcgaggctccgttccgaggatgagcaggacctcgtgtggaagtctaggcccggttctgaggatgagcaggacctggtgtggaagtcgaggccccaatttctcctcctcaccatttggtcaggagctggcgagtggcctcttttgaggccacttttcttggactggaccagcaagtagacagagtactctttgaggctgtaactgtgcaggagagacagtgagggacaggccagcgtctgtcccagcgctgcctctcttttggggctgcaggtggagtgatggagcctctcagagcctcatctcaggctcccctgcccaccacctctaggtggatgcagctgttcccatttcgcgggctcaggtggtcacgtacttgtgtgctccagactgggggcctccccgcggtgggcagaggtggcctttgtgtgtagtctcagcggctaaggaccctggctgcacttctgccagctgcccctggaagtgacgctcaggcgtggtgacggcatcttctgaacaaggaagctggggcatcttccagcattggctggttctgtgggaggcgagcagctggtctcatcagatgggccacagaacgttagggctgggcctctgggcaggggaggaaatggggcagggatagaagcgtgctggctgaggactgcatgggacagttttgtgggtagcagaggtcggtgctcacccaggcaggaaaactgtcgagatggcaatgccctgtccatgaagctcttgtctatttcctggcagccctttgagctggggggttgttttcactccggcttcacagatgaggagactgaggctgggaggttcaggatctcatccaggtcgcgcaggcctctggctggagcctgttcttgaggcctccttgtgcccggcagccgccatgctcacagggtctcagttctgggaggcctgggtcatgaggctaagcctccgggctcgccagccactgggctatggcctgggagtctgctgaccagtgctttccgggggctgtggagtagccaggcacagaactgagccatctcggtgagatgcagaggcacaatttggggagagcatgtccttgaattagtccagcagggtcatagccactgcctcatgcacagaacatccttctagaagctgtgagctttggtacctctgtccagccccgcccccacctctatgtaaatccatgcttcagtttccttacctggaaaatgggtataataataatctaccttacagggttaaatgtgctggtaggtcccaagccctgggcacagcacctgatatgagctgtgtagaccatagtctgtggtttataacttcaggagtcttgtctgtgtagataagcatttgtcctgttacccagtttctttaactggtgcttacctgtgccgagcacaaatacaagctccgataatcctcacagcagcccagtgaggtggatgctgtttttatctctactttgctgatgaaaagctgaggcacagagtggggaagcggcttgccccaggtcatccagctgggcagcagctgggctgggaccgcacgtcaggcaggtgggctgcagggtctgtgctgcgggtgtctttgttgctgcctctgtggtcaggccgttccccagcaaggctgttcttgtgggtgagtggctctataagggcagggctgggtcgcagcaggcccttactgttgcagaaggctcacctgcctcaccttggcagcccttggtgagctgcttctcacctgtcaggtacaagcctgacagctggaaccttctcttagcataagacgttctggggtgtgtggtcactaagacactcctgcttaggcgtctctgaagcacttagctgttccgggtgaagctgccagttcacatgactgagaggtgctggtaccaagataaggccccggaaatgacagggcaaagggccaaaggggtgacggagttgcctgaagcgtttcattcatttggaacaaagttcgaaagttgcttcagggtaaagggaggggagtgtgtggagtccgcaggcagtgcagaagttgcagacttggcgtggggggaagatgatgagtgaggaagagcgagaccagcggggaagatggtgagcagggaagagcgagaccagtgctgccatttccttctgggtgaccctatctaggattcagtttcctgaagtgtcaaatcaatgaggtggaccagagcttctgcagctctagcttcctaccctgcatgattctagaacctgcgtaactccagcatggctggaaatggagcccgtgaatggtgggttgtcaaataataaggcagggagcagagcccaatgggagggtccaaggagttctgagtgcccagcagtgtcagcagggaatgcagatggactcagggcctccccagatgtggtcagccttgcacaactctagggggcgccgtggagttaggcacctcacaacttgtgtggctccacaaggcagcctcgaaccggtctggggtacttagaaggagctgcaaactcactaagctcattgctagcgtatgtaattcttttggtttaaggcaattaaaatgcagatacctccctgcatttacatgttatctgcattcctaccttagattagtgttttccaaactttggtcacttgaggtccagtgtcacaattggttttcacagcctggactgttactaacatcatgtttttcctcaaatcttaatcttaaaataaaacttaagtttattttaaatgagaacccactatcattggctgtaaaggaagacctgtggcacctggtataagtaggtaatactgtctggctagaattgattaagattgtatttgtctttcattgaatttgtcttgacctctgacaatgccctgaatttggagccctaagttcagtgccattattcaaaagggaggttgacaggtgttaggtgttagagagctatcagcaccaaactgaggcttgctttttgaggtaatcagaggttggaagaatattgaagatggaataatcttgtgattacatgtatcacccctcccccattattctgtgtgtgccacttttggggaacccctgctttagtttgagtgtttttcagactctttcctgagaacagatttggatgaagggttttgcagagattcttaatctgaaatccaggaaataccaagggcgctgtgaatttgttgagaaaaagattatgtctttattttctttaacttcaggtttaaattgagcatttccttttgttatgaatgtaggcagcagaccgcagtgcccttggcagtgcctatgagacggagtattgtcataagaaatgagttgtcgaaacatcgtttgccctcagcttgacgtgtaaattacaacagttaccagaccttctctagaccttgtatttaaagagtcagtgaagaagtacagagaacactgttgtagttaatatgttcagtcattggtttccttagtcattctgtgtatttattcatgcatataaaaacattacttctacaagcagtacatggatttccccagaatatcaaagtggttcaagacacacaaagagttacccgtgtaggtgtgagacagactgtgcacttgggcaggagggaccctgtatgtctccccgcagcaccgtcatcgtgtccctcttgtccacagcattctcccagatggtgatcagcttctactatgggggcaagctggtgggccaggccaccaccacctgccccgagggctgccgcctgtccctgagccagcctgggctgcccggcaccaagctgtatgggcccgagggcctggagctggtgcgcttcccgccggccgacgccatccccagcgagcgacagaggcaggtgacgcggaagctgttcgggcacctggagcgcggggtgctgctgcacagcagccggcagggcgtgttcgtcaagcggctgtgccagggccgcgtgttctgcagcggcaacgccgtggtgtgcaaaggcaggcccaacaagctggagcgtgatgaggtggtccaggtcttcgacaccagccagttcttccgaggtctgtaccgtcgtcaccttgctgcccccacatcttagagatcacgcctcctatctgtgtgccatttgcagctcagggtggccctgtggtctcatggagggatgtggaggaggagtgaggggcatggtgtggcaaggaggtgctcctttgaatggcactctgccctctccactgagcgatcctggggtgcttctctgtgcctcaacttccccatgtgtacagtgggggtgcagaatcagtaccctcatcaggtgattgtcgggagggtaaaggaacttaacctcatgtaccttggagtatgttccaaggatggtccctgagcgctggctagagacacagagtctgaggccctgctccagccacaagatccgaacctgcatcttagcaaggtccctggggatctgtgtacaggttttgagacacgctgactttccgcacactaagtgctcaggatggcagctgcacacactaagtgctgcctgttagctttcgttacgctgtagggaggatgtgtaggataccagcctgggtgtctcctggagggttaggatggcgtctcccttctccacgtccccatgctctctgctcctctccctgtagcagcacagcccgagatagtgtcaggtctcagctgccactggcctgagaactgccagaggaggggcctggaagggcgggtgcaggggtatgtgtgagctcaggggcataagccctgaggaatccccctagtgaggaggtgtgaggccgcggttatcacccctgagcaggcagagcggcacagaagtgcgtcctgcaatgtacattcccgggcctacctcacatcctctgattccatgggtctgaggcggggcccaagattctacatttctaatgagctcccagggaaggcgactgctgccggtccaccggcccactttgagaccctttcagttggctgtcagagattcgggtgagggctgcagccctccctgggtgtcctcaggtcggggttgccaactcagttgcctccaagggccaggcaggtaagagcaatgcacgaattgagagataagagagagcactgggcagctgtgcccatggagaggcgttcaaacgaggcattaaaatcccggcaacaacctggaatggccaaacgaacagctccttgcttggaatttggcccaagggccaccagtttgagatcccatggtgccctggcctaaatgctacaagccctgggcctcctgatcccccagccctgctgctgcgggagttggaggtcatctcggccttgcttgcaaacaccctctgcctgtgtcattccagagctgcagcagttctataacagccagggccggcttcctgacggcagggtggtgctgtgctttggggaagagtttccggatatggcccccttgcgctccaaactcattctcgtgcaggtaagtatgggcagcttttttttttttttttttttttttgagatggagtcttgctctgttgcccaggctggtgtgcaatggcgtgaccttggctcactgcaacctccgcctcccgggttcaagtgattctcctgcctcagcctcccgagttgctgggactacaggcccgtgccaccacgctcagctaattttttgtatttttagtagagatggggtttcaccatgttggccaggatggtcttgatcttgtgatcctcccagcttggcctcccaaagtactgggattacaggcgtgagccacctcgcccggcagtctgggcagctttgagccctgcatccaggtctcctggccctgtcatgtaaggatcaagttttgggctggagaagaggacacaaggacaagtttccacctgtgtaggaggcaggcctgggcaagaccttcaatatgcgggaagcggattcttgccatctccgagccatcttctggtgtctgggacgcgcacagtctgtgtgtgtgtgttttcttttttcttttttggtttttaaatctaagcctcttctccagaaagattctacctgttcagttgcccgaaggtctaagtgacagattagggcattgccagcccttatttcatgtagtcaagggaatgaatctctaatggtgggatcctgggtgctggctgtcccagctgggacagtactggggagtatggaacagttttggcaggagtactgcttgcccttccttggcattctggctcattcacttgggactcacgtggcactggggtcatcagaggacctggctagggtcaaagacagtgcccaccccctttggagcctccgcctctgcctctgactttctgcacctcccatctagattgagcagctgtatgtccggcaactggcagaagaggctgggaagagctgtggagccggctctgtgatgcaggcccccgaggagccgccgccagaccaggtcttccggatgtttccagatatttgtgcctcacaccagagatcatttttcagagaaaaccaacagatcaccgtctaagtgcgtcgcttgggcgccccaccccgtctgcgtcctgcatccatctccctgttacagtggcccgcatcatgattaaagaatgtggatccctctgtctggggtgggatgccttactttgcacttaatttaataagggcattctcggaggagtagacgtttaatacgaagtggcggcatagccctgccgagatgtcggtgatggcctggatgctgtaaccacaacctgtggctaaaaattttattttctatcctttacccgtcattatcattagttgctatgattctttctgcattttcggttaactatcatttccaaagacttgtcattcagtaatattagcagatagctgcttcgataaaggaatttggagtttaaaaatcaacttgtgaaaacaaggttgtttttgtctttatcttttgttagagttatagatttatgatttcataggcttgattctatgtgaaatatctttttacttttatgcattttaataagatttaaaaatatttagattaaagccccctttaatgagtacaagaaaaactcttggcttgttagaagaaagtatattctttctagaatttggtgcaggaatatgtgttcatatccaggcaaacgggtgtgtttttatcttcagacaatgaaaccttctcctctggggctttgttgccaggaagattagaactaaatttatttttttcatttctgtcatgaaatcattccagatacctcttttcttctttccaaatggttttcacatgtgtttgaaatatttgtactttgaattgtcggattttccatgtcctcctttctcctttgtgcccagcctgagtcagcaccatcccgcattcagaacctcccagtgaaagggcagccttcattttgagaaggtggaaggtgttagggtttgggagacagctcatccaatctcccaagtctcatggtggatttgtgactgtgagagtttccggtttaaaatctgaaaagccagatatgcctgtttccttttcccagcaccatgcctgtggaggggacagtcagacccagaggtcctttacgtgtggatggagttcacaggcgaatagaggagaggaccaggggacgtggcttgtcccttttgtccaacaaagcattatatttttaagaatggcagacctgtttgctgaagtgttcataagataacaataggcttgaatctccaattcaaatgaatgtcaaagcacatatctttaatatgctgaatgaatatttatttttgtatccattaaaacagtatattgatctcttttattctttattaaaataaaatgctcttttttaaagctgctgtgtactgtatttttttagtcactgtcaaatatgatgtaattctcaccagattctaggttctgtaaagggggagttactgctgcaatgtgcagtgttaattcagtgcactggactgaaacaatatcgcactgggattttaaggatttttttttttttttgagacaaagtcttgctctgtcacccaggctgaagggcagtagtacgatctcggctccctgcaacttccacctcccaggttcaagcgattctcgtgcttcagcctcccaagtagctgggattacaggcatacgctaccacatctgcctaattttttttttaaaattagagttgtgatttcaccatgttgcccaggctggtatcgaacttttggcctcatgtgctctgccccaacctctcccccagcctcccaaagtgctgggtttacaggtgtgagccacctcacccaactcctgttttaaggatttttctttttcaacctatcccttaaacaacagcaaaaagatacggagacttagactgatcctatggaatgaaaacattggagaatgtttttattccgaatggggggctgtttgggtttctgtgagctgacagatgagtgtgcggaagggtgtggaggaagtggggtcttgtgctgatttcatcctcctggatgcagctggggtgatttgtacgaggcgtccctggttgggtcagccacacgtggctggagtgtgtgtcctatttacgcacatctcgctgtgctaggccctcaggatacagcaaggacatgagggacccaggttggcagtcacagagatgacttccagcctagtaggacattcccatccatcaacacaacaaaacccatcaattctgggaggtgcagggctggccaacccaggtggagagaagttccccagcaagcttcatccgcaaggccatgtctgttctctcctctgccctcatacgagcccagtgagactgggcctgttcttcatttctagcttacagatgaggaaactgaggcacaggctcatgcgtggctgactgagagccatctatgtcccaggaggacagcttcgcctgagaggcttcatgagcagatctcgctgccatccttgagctggtgggcttcctaacaccccacgcaagaggtcagcagctgggtgcgtcgctcactgtcttaggcatctttgccatgagtcacactaatgtccgcacgctgcaagtaggaattttgtttacaagcaagctcttctccatcctgtggattcaaggccaaatgtggaaagttgatatcgtctgttgtctccccagagttcaacgctctcgtgcagacggtcgacaaatccttcctactcaacttcttgcagcaagctcggggagaggcgggagaggggagtgttttcatttgcagaggaggaaatttgggaacaggatgcttctttaagaagtcgggtttctagagaatgctgtgagggccctggatgtgaactgacttttgagatgctgaccccacactggccagttagctctgggccctggagggaagctggtggggatgggctgacgggacatcctgaaaaacaagccatctccactcttggtagtttaaaaatgttttaagaagttaaggtatttcaacaattcctttctgagtgattgccacttagttcattaacttttgcaaaatcccactttgggaggccaagacaggtgggtcacttgaggtctggagttcgaaaccagcctggccaacatgatgaagctctgtctctactaaaaacaaaaacaaaaacaaaacacaaaaattagccaggtgtggtggcaggcacctgtaatcccagctacttgggaggttgagacaagaatcacttgaacccagtggggtggaggttgcagtgagccgagatcacaccactgcactccagcctgggtgacagagtgagactctgtctcagaaaaaatgtgcaaaatccatctgggacacaacatttttgcttgccctcgtaatgtccagaaggctggagatgatgacccctgggtccaagcatcctcaggatccggtgggtcctagaaatcctgggaaaatcttcctgaaagggcttcaccgggcagccacccatgcctgccacagggacactttctctccataaagaagcagctgtgggaatcaggaagaaatgactcctgtgcatgattcagactctccataatagaaagttttgcaacccaatgactcggaaatgtttagaaattctaaagaataatctataattaatgactgtaattttaacaacccagtgggctgagagtggggtgtggcagtttctcagtggaaaatctggctgcttttactacaagtaggaggagaatgacaaatatcctggccccagggcacacctgatctcaggctttctcttcaagcacaccgttcattaatctgttaaaaggcctagctcatggtaagaagcccatttaaaccagcatttcccaaacttatttgacttgacgttttgccttgcagcgtgtctgtggatgagaggtgcccacaagcgttcagtcttttatcacaatccgactggaacatcttaggagttgagaagagtgtgtacattatttctttcctattttctttgggctacctttcagtctggatggagtctgccagggatggggatggcttcagtctcctctttatatgtaactaactattcctaaacttagtggtataaaaaacgctttattttgtgggtcaaaatttagacagggtacagtggtgttggcttttctctgctctgcaatgtctggaatgttagctgggaacagctgagagtgacttgaagtcctgcagatagaaccacctggaagctttttcattcacatgtctggtgcttgggctggaaggaggtgaggctgggcacagttgggataccgatgagaatattgactttggcctctctatggagtttgggcttcctcacaatatggcagcgtcagggcagtcccgtggacacaggggaagctgaatggctgtttgtgacccagccatcactcaactggacaaacaagccctcctaggttcaagaggaatggacagaaacaccacctcttgaggaagaagtgtccaggaatttgcagccatgctttcaacctgccacgggagccccgaagcctctcctttgctgcaatcccacctgccttttatccccctgacctctccttgggcatcctgattcctttctgaccctattccttgagtcccaggcagatgggccttttcctcactttgtcttgggagtatggcagtggactctgcctacttcataatggagcctttttcttgtccattttgatgacctctcagagcagggctctgacacgttactgggttacaaagacccctccctgccagggccagcgtgcagcacagggtgcttttgagttccggtgaacggggtgctctggctggagcctagtgcgaagtttccccttctccgcccattcctcatccctcagggcacacaggtcacctttcctcgccttctcgtccccacctctaaggcttggccaaagtttcttcataaaagcaagaaagataacgaaagagccccccatgggttatggtttttgtggggccaggaatgcccagtttgaacctccagttccgccacctgtagccgagtgaaagaggctgggttattcagacaccccaagcctcagtttccccacttgttgtgaggcttgagtgtgctaacacatcaaggcaacccagaacagcgcttggcagagactcgcagtttatcactgtgaactgtcgttattggaaagtgggtggagtcgggtttggattcccccaggagcagagacagaaacaaaaggattcaaggtaagcggcctgtatgggaggtgatctcagaagtgctgggaggggaaggggacctgtggctttaatggtgaccctgtgctactggaggcctgggatctctgaggaatgctgaggcccaagccctgcagagccagccccgggttgttaattacttggcactttcctcttgccttatgtgcaggggtgggctcaggcgactgaagtctcagacactgctgcaggtgctggcagggggagtcacagctgcataaactggaatggggcaggtggggtggggcgggtaaggggttgtgtttgcttcggagagggtttgtcagcactttgaaggaaaatttgtgtagtggccggaaccacagatgacccagggtttgtgttccagcccagggatcattagctgtgtgcgtcacttaaactttctgttcctcagtttcttcatctgtaaaaaaggggcaataatgttacctattgggaggattaaatgacttaataagtatgaggggcttagaacagtgcctggcacgcagtacatactaagaaagtggatttgcacatatcattaatgcctccctccctttctttctttcttgtttatttattattaaatagttataagtataaataattacaataatttatgtcaacgaactatagtgtcaacaataactataggtaattatttaataattagtaattataaaataattgatactaaattaactatagaattatatagtgccagagttgtttggctatctttaattatacatgtagttatttaatttcacaaatagttatatgaattatggaagtgaaggtacgatggtataactatacaattattagataacttatcatagtggtatacatatttatcatgcagttattaaataattacaatggaatgacttattcgctctctgcgtttgtgcaagggcaaggatggccacgtcccagctctatccagcccctggcccagtgcctggggttcggtggcgctcagttcacgcttgcagagcgagcggcggtgagtggatgcggtggggtcgggctgtggtggtaaaggtggccgtgaacaggaggggccactagagcacacagacgtgaatgacatggggctccaggaggggcaggaagagctacagaaacagcatccccaaagctgcctggcacggaagaggtgctgcagaaatgggacttcccttcccatcctcttctcctgataaacaactgaaaacataagagcgagatcttggggcttctgtgaggttaaatgaacgaacaaaagtcttacagcggaaatcactgagaatctcccctcccctgtcttccaaggagaacatgattgtgagcctgctcctcccttcctgggggggttgcttcctgctggggagaggctaagttgaactctaggatcaagaaagggaaggaggcagagaaaggtgagaaaggtgagaaagatgagaaggtgctcgcatggagcgtccgggcagtaccaggctggcccgaaggaggtgcggatgagggggaaaggctgtttacagatgtggtggcttctccgtgtgcattcacctcctgggtctcaactcgtgcagatggagggtctgagttaatctgaggttacatttgtttgctcagctatgctttttcaagaggccattcctctgagactgagccccatggctcctggctttacatgagttacacgcatcttcttctccttttttctaaatagtaaggggcagagagagttagaaataaaaaggaaagctgaaaacaaaaacctctcagaagagactctggctgttttttgtttttttttaatttttaagtttttattaatgctcatcttccctgaagagccctggctgttttcttgaccagcttctggagagaaaaatcacagtgcatttgagtagctccagatgtgatctccccattcagcatttcccttcctgtagcatctgccgagccttccttctggcttctctgctctccgtgcctgaaaggagacattgagcaatccaggccagttcgaaatcctgagcccagaaataaagtgactgttgcttttgcgtccttgcacgtttgccccggctctcagcagaggcagaaggtgatgtttggaggaagcagatggcccggtctactgtacatttcagaacatttcaactgcaaggctggctggggctattgcatcactgagcccgatagggctgcagggcagaggcagggatccctgtgggtggaactgctgggtggcaggacggggtgggggagctgagggtggtgtttggagaggagggggagaagggggagacagtttggggaacgtgcctgaattcctacccaggtccagtgtgggttgatgcaaatggtgcacacgggctgagaggtcagctagatctgggttccgatcccgactccttactgatgagttgtgtccttggaaaatgacttcttctctttgaatttcagtgtccttgactatatacatgatggattcttcccacatcgcatggatgttgtggggattcattgtcctgacctcctggggtgttggtgaggattaaatgaaatcatgatttcgtttgacatgcttggacaagagccccacacactagaaaccctgggtgtgtgttagctgttgggaagattctcctgaccgtgatgatgggagaactcggcatagccctgcgggaggagtgttggttctcaacaactgcggctgtttgggggttgttggcttgtactccctctttgtagaggctcctcgctcctggctcagggctgctcccaggtgcactttcggtggcaaggcattcaattgtacacgctgactcaggcgtggtgaaagccagctggccctctggaccctggccttggtcctcagccctattggttgtccccgctgcccgggattggttggcccacggggaggggctctctgcctaaggatggtctccccagctcagtgacagagggatgcttaagccacgccaccaccttcgttcaactgccagcatacctgagtgtttgagtcagcctctctccctgtggcccagtgacatgggcagcaatgtgggaggctgcccagtgggtggggagtcgatcagacggagcgaagagatttctcgaaggccctcttcaccagcgtagcttacgacagtgctggagcgcctacctgagcagaccacgctctaagcttgttttgctgaacaccttcctattgtcccagaatccacctgctctcccaggaagactgatctcttccagggaccataagcagcttccccaacaggtgccccagcgggagaccagagggagggaggagacaggtcagagtgcctactcccgttttctccctgagtcaacgttgttcctcctgaggcaccggcccccataccgccctcctcctgggctccagcagccatgctctctcctggcccccctggtcccctgcctttagtgacagcttatcctcgttcctgctctgtctcctttggttcccttagaccaggtgtcagcaaatctggcttgcagaccgaatctggccacagagctgcaacgacagaattcagcgactgcagcagaggccgtgcggccccccaggccgaaaatattcactatctgcctctttccagctttccagagaaagtctgtgacctctgtgtgagacccacccacacccatgagattagtccctttgcaaatcccttccttgaattaacctgtgttgagtgtgccaatggctgtctgggacctacccggcacgcattctattatcctgacgtcctcttagcctggcaacattctcgttctctccattttgcagatgggaaagcggaggcacagggaggctaaataactttgatgagattaggcacacaatcagtagggggaggtcagttccagagtcaaaggcaggtgccaccagcaccccatggcacttcctgtcctgagctgctcttactcgctctcgggacggtcatgccaaggaagtcccctgtccacagccgggacgccctgggtggtgctcgtggcggcagggccagtactcgaatcagtgtccctactttgcttctgtgcccgggtcccccttgattgacacacgacctgtcatctattctggtctctgaagggcctttgtgcgcctcttctgtgctgcacgaggcgctgatttttacggcctgtcctttgcagaggaagcttctctcatgaatttctcaatttttgtggcaaggagggtccccaaagcctggacatgtcagcaacactcctgtcttttccaaacctctccacgcatcgccaccaggaagcggggcagcaggctgaagctgggaccctcactctgccccttagaatgtgagcaagggaaagtcccagagcagatcccagggcactaccgggcccttccctcatctgtaaaggagctccttcctcccagggccagaggaggcagcgtgtggtaagtgttgagcaggtgtaattatacatttaattactgccctcactaaggaaagtgtgcagctgtgtccaccggtgggtggttctcaaccaggggtggtttggcctttgggacatctggccatgtctggagacatttttggttgccatgatggaaagcaggtgctactggcatctagcgggtcaaggccagggacgccgctcgacaccccatagtgtaaaggttggccttcacctgcccagctagaaggatccaaccccgaatgtcagaggcgctgggttagaggaaggccggagtggccgtctgtctttgtggagggagggcctgtgtctgtctcgctcactgtcacatctccaacacgtagtgcgggtttcacaaatggttcttgacacatgggcgtgtgctggctgcccaccggagctggtcaacacggttcccacttctaaggcaggcagtgacctgtgctggacctgacacgggctttaggggctcagaggatggggacgagggctccatagagtggggggggtcagctcgtccctgat

SEQ ID NO: 1107 - DNA, 1538 bp, Homo sapiens
atggatgggggaaccgggcggcgagacggcggcaggacggcggcaggatgtgtgaccggaatggtggtcggcggcttcgacagtggctgatcgagcagattgacagtagcatgtatccaggactgatttgggagaatgaggagaagagcatgttccggatcccttggaaacacgctggcaagcaagattataatcaggaagtggatgcctccatttttaaggcctgggcagtttttaaagggaagtttaaagaaggggacaaagctgaaccagccacttggaagacgaggttacgctgtgctttgaataagagcccagattttgaggaagtgacggaccggtcccaactggacatttccgagccatacaaagtttaccgaattgttcctgaggaagagcaaaaatgcaaactaggcgtggcaactgctggctgcgtgaatgaagttacagagatggagtgcggtcgctctgaaatcgacgagctgatcaaggagccttctgtggacgattacatggggatgatcaaaaggagcccttccccgccggaggcctgtcggagtcagctccttccagactggtgggcgcagcagcccagcacaggcgtgccgctggtgacggggtacaccacctacgacgcgcaccattcagcattctcccagatggtgatcagcttctactatgggggcaagctggtgggccaggccaccaccacctgccccgagggctgccgcctgtccctgagccagcctgggctgcccggcaccaagctgtatgggcccgagggcctggagctggtgcgcttcccgccggccgacgccatccccagcgagcgacagaggcaggtgacgcggaagctgttcgggcacctggagcgcggggtgctgctgcacagcagccggcagggcgtgttcgtcaagcggctgtgccagggccgcgtgttctgcagcggcaacgccgtggtgtgcaaaggcaggcccaacaagctggagcgtgatgaggtggtccaggtcttcgacaccagccagttcttccgagagctgcagcagttctataacagccagggccggcttcctgacggcagggtggtgctgtgctttggggaagagtttccggatatggcccccttgcgctccaaactcattctcgtgcagattgagcagctgtatgtccggcaactggcagaagaggctgggaagagctgtggagccggctctgtgatgcaggcccccgaggagccgccgccagaccaggtcttccggatgtttccagatatttgtgcctcacaccagagatcatttttcagagaaaaccaacagatcaccgtctaagtgcgtcgcttgggcgccccaccccgtctgcgtcctgcatccatctccctgttacagtggcccgcatcatgattaaagaatgtggatccctctgtctggggtgggatgccttactttgcacttaatttaataagggcattctcggaggagtagacgtttaatacgaagtggcgcatagccctgccgagatgtcggtgatggcctgatgcg

SEQ ID NO: 1108 - DNA, 1281 bp, Homo sapiens
atgtgtgaccggaatggtggtcggcggcttcgacagtggctgatcgagcagattgacagtagcatgtatccaggactgatttgggagaatgaggagaagagcatgttccggatcccttggaaacacgctggcaagcaagattataatcaggaagtggatgcctccatttttaaggcctgggcagtttttaaagggaagtttaaagaaggggacaaagctgaaccagccacttggaagacgaggttacgctgtgctttgaataagagcccagattttgaggaagtgacggaccggtcccaactggacatttccgagccatacaaagtttaccgaattgttcctgaggaagagcaaaaatgcaaactaggcgtggcaactgctggctgcgtgaatgaagttacagagatggagtgcggtcgctctgaaatcgacgagctgatcaaggagccttctgtggacgattacatggggatgatcaaaaggagcccttccccgccggaggcctgtcggagtcagctccttccagactggtgggcgcagcagcccagcacaggcgtgccgctggtgacggggtacaccacctacgacgcgcaccattcagcattctcccagatggtgatcagcttctactatgggggcaagctggtgggccaggccaccaccacctgccccgagggctgccgcctgtccctgagccagcctgggctgcccggcaccaagctgtatgggcccgagggcctggagctggtgcgcttcccgccggccgacgccatccccagcgagcgacagaggcaggtgacgcggaagctgttcgggcacctggagcgcggggtgctgctgcacagcagccggcagggcgtgttcgtcaagcggctgtgccagggccgcgtgttctgcagcggcaacgccgtggtgtgcaaaggcaggcccaacaagctggagcgtgatgaggtggtccaggtcttcgacaccagccagttcttccgagagctgcagcagttctataacagccagggccggcttcctgacggcagggtggtgctgtgctttggggaagagtttccggatatggcccccttgcgctccaaactcattctcgtgcagattgagcagctgtatgtccggcaactggcagaagaggctgggaagagctgtggagccggctctgtgatgcaggcccccgaggagccgccgccagaccaggtcttccggatgtttccagatatttgtgcctcacaccagagatcatttttcagagaaaaccaacagatcaccgtctaa

SEQ ID NO: 1109 - DNA, 22444 bp, Mus musculus
  misc_feature (781)..(1359): "n" at positions 781 thru 1359 can be any base
  misc_feature (4375)..(5965): "n" at positions 4375 thru 5965 can be any base
  misc_feature (18075)..(22444): "n" at positions 18075 thru 22444 can be any base
taaaccaacctcgtattaaaaaaaaaaaaaaaagaaaagaaagaaagaaaaagaaaaggagaaagttaaactttatacaggatttgtctttgaagttatgagtcgctaaagaagtaattcatttatactaaagatcttgccattcctaaccgtactttagatgagtatctcgtatttatttacgaagactctattgagtaattaaagccacggacgtagtgagtttaggagcacagaatttatatgacagagtgctttcgaaaggtatttattcgcagtagcatataaaattttttaataatcctgtcaaatatgttcatgaataatttattaatctcccaattgttaactaccgggcgtgcacacacccgcctgtgtcctgcacatcacgcagaaatctactgccatgttcctgaagtgacaaagacaaggtaaaactggtatatttaagatgtcctcagcctcacaaaagggcagcgctgcgggtcaggctggcgagttaacacacgcactcagtctcccgttgtcccgaagcccagcttctggccacactcgcggcggcggggttcccgcgcctccctgcaccaggcccagtggggacagagctggtgcggtcccaggtgagcgccaagcgggaccaatgggcgtccgcgctcgccgcggccgaggccagcgcctcccagaccgtgcgagaggccggcgcgtcccgcccgaggcccgcagggcggctgagacgagaggcccagccgccgcccgagcttcacccgaaccctcccgaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacttggacaacaagtatgaaagtggaagctgttcttaaagcccccccccccccccaattaaccactacctggtttatctcgaagctgtgtgtgtgtgtgtgagagagagagagagagcgaggagaggtggggggacttgaagatattaatgggattttgatatttctgttgtgcatgctaatgtatgccctcctatcaagcttctttgatgtatttatgttcatggagtcaattgctctaaaatgtcttttgaaagttgttcattttgaaatttactgtgtaaactaccttcagtttctcctttgctttcagtccatccagcaaccactgccccccctttctttgaggtatttaaaaaaaaaatactaagacgaaataaaagaaggtaattgaaaagagagtgacagcagattattgatgtattctctttattgttttgcagttaaccttgttcatctcatccatttacaattgaatttttgttatattttctaaagaggaagttttaccaaaaccaaatattcctcttaggaacaggggcctaaaggatttgtaatcattagcaattaatttattttagatcacccatacttgaaacagatcgacccagtggttttaaagcattgtcatgcagcagctgcaacttgcatcctggaggcaggaaagcaccaagttgacaagtctactctaaggtacagactttatctaatgcccgcttactttgaagtggtatctttgtcattgtaatttcagtttttaaagatagagactaaaccttgctttatttcccccccctcctgcccccttcagcacttatttagaagactgtaaatttgaccgagagcgaatagaactgttttgcaccgagtatcaggttacttactttaaacttttaaattaacaattagtacccacccccttttttcctgctgtttgcaaaactgtgttttctttctccttccccagaacaataagaattctctagaaaccctactgggaaggtaggtactgtgttaggtgtcaagctgcggagcttttcccttgtgggtaaggaatggagtgtgctgatgggaaacaaaactgagccaaaaaaattgggatcctgacccaaaataaagggccaaagggcaagtggaataattgaagttaagctaatgtttttttcaagatagagcctgacataatcttagtaggtgtgctttcactcttttgaacttgaagatgaggttcaacagtctttaagttcagagtggaatgaaacgagttaagaagagaaagacaccattgagaaaatcctgaaagtttttctgtagatactacaaaattatcattgtctttcagtataggcagatctctccctcatataactgatgtttcttggcgcttggagtaccagataaaggtaaagataacaagcttttctgtagagggagttagaggaacttttttttaaaaaggttagagttaaagactgatgttttgtgttgttttagaccaaccaacttcataagatgtaccgacctggatatttggtgaccttaaatgtagaggtatgtatagatccttgtctaaaaattatgtgtaataaaaattttcatttcctttatataaacaaacatttttttcttccatagaacaatgattcccaatcctacccagagattaattttagttgcaacatggaacagttacaggtacagtattaggacctttaaatgtttctttcagtgggcatttgagaactgttatggagactttataatattcccagcatcaggtaatgaaggttggtttaggttttaatggcaaagagagaatggaaagcagaaatttaacatagatttcacttttaaaagtaacatagtaacatccccagtagcctgcatttactggtgcccctaattgaaaaataactttaaagtttgagttcagcacactttctttcattccatcatgcatctgactcataaaactgagcaaaagtaagagattggagaatgcctttcacaaattaaacttccaaagttttaagcaggagttttaaattaccctataaagggaaagttcacacaagttcttaaaactgttaatattttcagtgtaaaactgaagaaattaaagtcttcgttgattgatggatatgctaacgaatttcttaccaattaaataaaatgaagatcattcctgaaaatttgaatgaaattaaatgttccaaagacatctgtagtcactttagagtaaatattagcgaaactttaaacagaaaatgtgtgtgaatcataaccttccttagagaagttgagagataatttagatattctcagcctgcaaaaattctgttagaaattcccttttaactagaacttgaatacctgattggaggaccagatccagcagaagaagcgcttcttttccaaagggctttgcgagctgttgagctcccgtggactccttaggtgttcttccttccgactgtgttcttgcagctgcttcagagttgctgcttcctcacttgtatgcccaagttgtgacatgattgtacatcttttaggacttggtggggaaacttaaggatgcttcaaaaagcctggaaagagcaactcagttgtaatttggggaggctgatgaccccaggagcctagaggaaaaccagacgcgccttgtctcctgctggaccatcgttcgcgcgagctggatgtcattttcagtggaaaaagagctagcacccttttgaagtgatgccaaccatcaattttgacactttttttacacatgtgaaatggttaagagggagactcttaagcatctggattttcagtattactcttgcgttccttctatcttgagcgtcttcaagccctattaaagtatcgtaccctgaataaatacggtggtattcccacaagaagggcggcattctgtttggagtttgtgtgtgactttgacgactgagtgtgccaagcacatctgccctgcgtgggctcggacgcctgccttgccccaggttaagtgtttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncacttgtgtctccagcctgcgcggctcccgcggccgctgcgccctttgttgagaggtagactttgctgaaacggggacgggatcccgagatcgggcgctgcctgggtccagtggcttccctcctctcccgaagaaagggctctggaggtctttgaacctccagggaacgcccccattttatagggatgggtactgtggggaacagcgatcccgacgaggtgggtgttaggctggggggagccccgacaaaaatgttattaacttaagttggagggacacttgtgtgaaattggatggctggtaagatggcggttcccagttgtttccaaggtcttgtgcatttgtgttggaaagggtaaagttttcaaggtggtatttgttgggagtcgaggacaggggttccatacgtacttggggcgagctctcaaggaggtgggcatttaaaatttgagctttgttttggagtgaagccggtgactgtacgttagccttgctgagcgccctttctctctccactctcacccctccttttttcttcttttctctcgaagacactacaactttcccctttgctgtgggatgagctgagacttaggtccattgcattttatagattttgctaaatgtcagaataggtcatgaagtaaggggatggatgcttcggagaaggagcactaacgcgttgattgcttatgtttacgtagtcatttggacttgacagcgctggagcatgatcgtttccccagagctttacagttaataattggaaataaacaaggagagagactttgatcattcccaattgcaataaaaggatttagtgggcttagtggtcacggttcaatatctgaaagagaattgagcattaaccccttcgctttaaagtaggcaaaattccgggcatatttaccctaatgcagatgtgtggtggcagttcaagctatttttataggaactcccccaacctttagggagacgttgtaaaacgtagtaaagacttgatactagagattgtaaattgttgaccacatgagtaaaaccaagttctgagactatgtacatttgggtcctaagtacactagggagataaaggagatttaatcaagaggttgatttttctgtaaaattattattatatgatgtgtttataatctacagtaaattgtatttatttccatgtcttctatgaaagggaaataatttacaataatctatgagggcaaattatactcttgtaataatatctttaaaactatgtaaaagattgtttatgcatgtgtagacactcaaatataatcacatacaaacttttgcaaggcatgtaagcatttggatatatttgatgtccagtctaccactaagctcatgagggtatgttaagtgttcaagtaggcaaagttctccccatcagtcaagtcgcccccaagtttacccacgctttcctttgagcagtgagccccaagtgggattatagagatcatttgcatttcttaggttgcagtgatcaagctgattgtttatcatcagagcttgcttctgttttccttcatattgacattactgtccttaggcctccaactaaaaactgacagctccaactgactaagctgtagcttgactattgagtattttcagtgttttatgcttgttgcatttttatgatttatagggagtttctatggtgcaagaggttgtttcttaagtctgaccaagcattctagaaagtctccatgaggttgtcagtactgtccaataggataaaagaatgaagaattgatatttgtatcaataacaaagtaagaattgattagcattatgaatggttgtaggaatagggccagattatttttatttgagggaggacagttgtgtgaattccaatttaaagtgaatttgagagactttgatcaagttcatgtgactgaaatgttcaaagagaactaactagtggtcaccttctattgaggtttgactgctcttttgggttagtgtttgcaattttataatagaatgtaacatggagaggaggaggcaagatagagagagccctttggtgggaacttgatgatgtgtgagtattggatatggtttctttcatatgcagagcatcagcctcactctttttaggaaagagcctgtggtttcacaagagagttgcctttaatcactaagtatggttgaatttacagcttgctccttttgagagtcataatttcatttactccttctcagcctgctttccttggattgatgctacttgttgacagaattccgaacaagtaatccggagcagctctgattgaagtcactagtttccccttcagtcactttcagagaggcttggtttgggtttggaccatctttagtacccattcctgttaattgcagccattggggcatgctggttggtagttccctcttgtgtattaaattttccttagaataaatctcccaggtgcatcttattgcgaattatgcaaattcctagattttgcttacagcaactttggggcttaacttttgtcaggtgtagaaggtcagcctgggtttagattctgtgaggaataaaagggacatcccacagctacatcacctgaggtactttctggtgtggcattgctgacaggtctcaactgtgagtttctaaaatgtatctgctgggattatcctttcatcttgtgatactgtatgggagttaggtgagaaaagacatttgcccttccccccatctttactctgcatttagttttgggcatgggctggtctcatggctctttgtaccttgttactataccacccacaaaagtagtttttcttgcctctagcatagtttattcaaatattcagttcagtattcagcccttccaaaaactttccatggctcatccaatctactggaggacttattagagaagggagccttagaagttcagttcaataaacgtctctgcaactccagtcttgctgggcaggggctaagtgtacagttggcaattctcaaaagatctctaagtaaaatttctgacatcgcgattgataacaggacagtcagaaaaaggcaagatgagaaagtaattcttccctcccaatggtcatgaaagagatccggagagtgcctggaatggccggtgcactctttttggggttgggactgaggtggcggtcacgcgaggatcggcaccctgcttccctgccccgcccctcccctcccctcccctcccccgcgtccgccaccccgcacgcccgcagaggctgggctcggccagctcagcgcagagttgcagaggtggccggatgccaagtgtaagtgtaagttgctatggaaaccccaacggaggcgagttccgaatccggaacaagacctagcccggggcacttcgggatccgcccctcacatccccgctcgtgtccgcggtgcccaggcctcagccgaggcccacgaggtgcttctttcctccctacccagtccggaaatgccggggatgcaggaggctcactgagcgctttccctttgtggggcctgagccctgccaggttctggttgcttgagccgtcgaaacaagaatcacgaagtttttgactagagtgcaggaaattccacagtaaattcggagacttagatcaatagtggctactgaatatctgtggcggcggcctcgtggtagccgcagcagagctgcgtggtgtctgcagagctggaggacagctgaagagagagagagcagaatctactcagttctcagccccagcccccagccctttttatctcgctccaggaatgacccgaaaggccagaagtaaatttagttggatccttttacaccatttaacagtggaggttattctgatctcattagtaaattccttttgtggaaaacgtttagagaatccagctgtccagtgttaaatgagttttataaaccgctcagcattcagggtatacagttacttggagttgtggagataactcaattctcgttttttaattatagccaatacttttttgtgtcttgcaggatcttttatcaagcagaaatgcatcgaacaaccagaatcaagatcactgagctaaatccccacttaatgtgtgtcctgtgtggagggtacttcattgatgccactaccataatagaatgtctacattcctgtaagtacacagtgttcgccttcttgggtctgtgcatttcacagctcatccattaaaaccaacaccatttccacattccttgaaaatgttagttcataactgtgaggtttactttcttttatatgtagtgatttgttacagttaggcagtatgtagttttcaagttattaatcggtttcacttttctactttgagaaaacctagtcatttcccatccttgaattttcagttctgatacaattaacctttgaacctttactttctaaactcacaaaacctttttatgttcctatttctagtctgtaaaacatgtattgtacgttacttggagaccagcaagtattgtcctatttgtgatgtccaggttcacaaaaccagaccactcctgaacataaggtaggaagtgctgttgtccctggtgggaagtgctgctagcattcctggttttgctttgcaggacgtttatttctgatatgtgtgctttatagggggtagaactttaatttcttgttattttaattaccctgtttagacaaagtttggttttgttcaagtatttaaaaggtgtctgtcttttaaaactgagttagtttcccttttttgtgcataactttattgacttaataacaggcaagaagagatttttttccccaacatttccttattctttattcttgctagtgagagaattctctgttacatgaaaggcctacctctctttactcttggatgtgaagagttaattactgcagggcatctgcagggtggagaacgaggcagagctctcctctctcctcacaggacactcttacactccaccacaacacctcatcactgtgcctcaacaccagcatgcctacccaaaccttagaacagttctaggtttgccatattaactgtttcttactttttcaggtcagataaaactcttcaagatattgtatacaaattagtcccagggcttttcaaaagtgagtaaatggattcagtgaagtttttaaagtgttggttttacctattatagcaaattctacatttcccttctcacccatttcagatgagatgaagagaagaagagatttttatgcagctcacccgtcagctgatggtaaattttggggggcaaaagacattttatgtcaggaagaaaattatttagtaatttaaattattttgtttaaattctcccttctattctcttataggtaaaatattcagtttctaaaattgactttcaaactgtctttatagctgccaatggctccaatgaagaccgaggagaagttgcagatgaggagaagaggattataactgatgatgagataataagcttgtctattgagttctttgatcagagcaggtgagtgctcctagaaagctactgtgtgctaatgtagttgctaggtactttgtatcactttgtatttgtattttctctctcttagattggatcggaaagtaaataaagagaagcctaaggaagaggtatgttctacttgggagtttaagttgtcctttagaatattaaggagttatatgatattattaaatggccaagttgtgttaggagtttgttgagttagtatttttaatagtaagttcaaaatgtaactagttgagagttgttgcatattggtgtgactattagtatctttttatcatatttaggccattcagacttttttgttttacctgaaagttaggaattggaagaaaattacttttgtaaatgtgcttctaggtgaatgataaaaggtacttacgatgcccagcagcaatgactgtgatgcacttgagaaagtttctcaggagtaaaatggacatacccaatactttccaggtacctacctcatgcattttgtgcagattttcaaatttaaatgttttttttttttcattctggaccttaagaaattttaaatttggtagcaaagtttaagatacctcttaaaatggttggtgaagatgctttttaatcgttttgggttagatcttgacgacagaaacatacatatttatctttgttcttttgccactgaatacttgaaatatatttcaatagattgacgtcatgtatgaagaggaacctttaaaggattactacacgctaatggacattgcctacatttatacctggagaagagtaagtagctcgttacctggaggctatgttggcccagtacatataaagaattgagtggtttttctttttctttttaatgttgtagaatggcccactacctttgaaatacagagttcggccaacttgcaaaagaatgaagatgagtcaccagagggatggactgacgaatgctggagagctggaaagtgactctgggagtgacaaggccaacagcccagccggaggtgttccctccacctcttcctgtttgcccagtcccagcactccagtgcagtctcctcacccacagttccctcacatttccagtaccatgaatggaaccagcaacagccccagtgctaaccaccaatcttcctttgccagtagacctcgaaaatcatcactaaatgggtcatcagcaacttcatctggttaggactgttaaggaaaagatttttcaaccccctgatttagataccttcattcattacagctttatagatgcttaatacatgtgactgtcgtccagtttgcttccttttgtagtgactttaaatttggccataaatgatggactagatgtgatacttcatatggatgttaagtggaaagattgattctttctctaaagaattggattctgagaaggattctgtgttaggaaagatgtgaaatgatttctgtgaccactgtttggatctggaaatgttctacagtgggtagacattgggccatagtttgttaatctcaattaatgcctacattacattctctttgattgttcttgttattatgctgttctgtgaacctgtagaaaacaagtgctttttatcttgaaattcagcaaatggaaagaataagcatagaatactgcattctgtgcagccacgtcactgtgaataacaatttcttgcatatttagccattttaattcctgtttgatttttacttctctgttgctacacaaaatgatcaaaggaaacttgttttacaatctgtatgcctaaaaagcgggtactaccgtttattttactgacttgttgaaatgattcacttttgtaagaatcagatggcattatgcttgttgtacaatgccatattggtatatgacataacaggaaacagtattgtatgatatatttataaatactatgaaaatattgtgtttcatgcattcaaaaacagttgtaaacttctccaaatgggttcgacctttgcggatatcacagtgcacccaatgctgaggcttaccaccagcacagaatttgttttaatgttgataaccagtttcaaattctttttcacttagaagcaaatggcagatcttcatagttctggcttttctccaataaaactttcaaaattaatattgcagtaatgaaaaattttaaccaaggcaaatatagtgttttaattttccattggttaaaatagaattaatgtttttaaattctgtttatcagtggaattctaaaatagattttaaagtcaaccagctaattgctgaagtaaagcattttatctacaattttattttagtgtatgtggcacaagtgtaatttcaaatttaagagttgttttcatagttaaaggaatctgccttcactgtaacgtctggaaacagaaacaatttgttatgatttctacagggatttttaatagagcaaacatgttgaatttaaaatatgaatgacccctccaagtctcagttttgctttggtcgaacttagcgtgtgtttatcagccatcagttatttgtgaggatgttaattccgtatgaatattgtttcatgtttgtatgggaaactgtagctaagcatttcattgtctgcagtctgcagaagaagcacaattgtattgctttgtcttgcttgtagccattaaatcattacttttacacacattgctgttaacttctgctttctttaaagatttagtaaatgatgttttatgaagccacaagatacatatatttttattttgacctaaatttgtacagtcccattgtgtgtgtgtcatttctaattatagatgtaaaattaaatttcatttttaattggaaaattcaataaaaagatattcatttagaaaatactatgctctttaattaaaattttgctatgaaaagcacagtgtgcagaagttttgggaaccctgtagtggattgtaagagctaaaacctaaggaaaatactttgttgtcttcaaatgatgttgttagtaaatgctttgttgtatattgctcgaaagcccaatgaaagaagtatctgcttatttacaatctttgaagcaaaagttaccaatgtttgccaattttggtgaatttaactcatttttctagacttttctcgaggttttcatggtgttacctaagacaaaagacatctcaccctctatgatggacttacttctgagagtgcgtttgaggcacttatggcttactaagcagtgtgtcaccatacttgaaaacacttccatttattgtatctgggatgaggctttttacccttactcaatttgaaaattgcttaagcttaaatgatatttcagtcaaaatttgtcttttaataaaacaacagaaagatgcatcgtggtttgcttcttaaatgacgagtcattgctgctcttaccgttaagatttaaaacctttcccaactttttaaaatcttcaccttaagaaagccccaatggaatctcctttgtaatttaccacattagggtacgtgaaaagttggctttaaagtttgactttcactcctaaaggtattctagcatcctagaatacaaagataataaccaagtagtctacagaaaatgcctaaattgatctcacagatactagtttaaaagtagaaagagaaatggggcccactgctgttgtgtaaatagtgatctatcttgctttacacatgcataatactttacaagtacttgcacctcctaaattgccggccgttaattgccctgagtagaaaggggttgcccttcagttgacttaactagttaagcacattgcctcatttccatatgcgcatgttcagatgttagggtctctggaagtaaagtacaacagaagcaaagctttccttcatcttttcctgttttcccaagcgttggaattaagctcctggtgacttctttcattgcactgtactcgttgtgtgggcccatcaagaacaaattctcttctgaaacctttaaatgcccacaggaaatactccttgcaaaggtcagcaagaagggaagacaccgtcttgtctgtgtggtttatgacacaggtttagggggaataggattcacctggcctgtggcaccagggacccagtcaacacccccaagaagttgttttcgctttgtgttcaaaagatttaagacacttttcctccccttgctccaggaatgacagaatgacagaagttcttatagtgcttacatgagagagactgaaacaacaaaaggccgtagtcaaattgtacttaaactagctttccatcatgttagaacccttctcaaaaagtgcatatcccttaatacacccaatgaagtggaacttggaccccctgctctaatttacagctcttagatatatagcacttaaggaagttatcttcttgtataaacaggtggttgtttccaaaatctgtcgtcccccccccatcccgacatctgcaatagtggcacccccacccccaatcccttgtttccaagtgtgaccaaggatttatgtaaggaagagaaacaagttatcacacattccagcctccagtaagcctggtgagaaacagtccggaggagtccttgaaccagagaatcacacagcaaatcgcaagatcacccatctttgattatgaaagtctctgaaaaatgtttacacagtcgagtgtttcctgcttccgcagttaatttttaaaactttttttttcttttggttcctaaaacggatttcctttatttgcatcagtttctttttcttagtgtgtaatttctggaggtatttgtcacacgaagaacttcactaaaactgccttcaccaagacagaaatcatctatcactccaggatccttatgggatttctgaaaacgttcaaagtggaaagctcatcttggcatctcatttagcctcttgaataaatagtaaaacacccaataaaaacttatgaattaaattcccttctctctgacccttgccaaaaacaaaacaaaacaaaacaaaacaaacaaacaaaaaaacaaccaacaatctacttccagagattatcagaagaacttttttaaaaagctgctcttcccttggttacctacatgtcaataaaaaacatccctggttggtattaacttggggccatgatgaaacccaaactacgagctccaactctgttctaaatcaggtagaagccaagctgacaggagtgacttgacttagaaggctatggatcttggtatgggggaaacacgtcgaaaattgggactagcaacagagattgctgcagtgtttcttccgaaggacccagaaaccgggggagatattccaataaaagaaagtagtagcggaaaataaagccagggaccagaatgattgtcacacctgtctcctccacccccccccccccaccaaaaaaaaaaaagtctccagttaaaggatggaggggagcgggatgactgtggaagcagcttcgcttggacggcagcgccgcgttccacgtcagggggaaggtttgaggtagtgtccctctgtccgtctgagctctagctctccccgcacgcacgagagagcgagcgcaggccgcgaggacccgggaggccattttgcgcgtgcgccgctcatctcgcaccgcccccagctcggcggacgcggctcccgccaaatttgaatgcgagctcgtcaggccgggccgggctcccgaggccgacggaccctgcgggcttgcggaaccggagctccgggggatgggcggccagagccgcggggctgcagcctcgaaacgcgaccttctctctgaagccgtccacgtccaagggccgcgcggccgttagggcgcggaccggagtcccgcgtggacccctttaccccgaggctgcaagacagtcacccctttgtcccctcctctctgcacgctttagttgcaaagccacttccccttcaccaaggtggtgtctttggagcttggagtcccgttgttgttggacggatttgaagcaaagttactaacagactggaagctgcccaggtcccccgcaggtgaccaggaccaggagtatggcgtgctcactttgagcgtgtccatctcctgggtggacgccctgatggtggagcgggcgaggacgacacaggcggggcacctcgggctctgggagaagggtcatccaaggggacacccaatctctacgtaggtcgtggagccggcgagaggggcgcacggatgcgagggcgcacgggcgcaagcgcttctctgatccgggagaagcgaaagtggcctgccggcaggcaaggcaaacaaaccgatccgctaatcagtgcagcaggctgcagaaaccgccatttggggacggatttcggcgagtctgtagcacgctgtgtgggaagtcataactgactcgcccaagaacacccccacacaccccaacacacaccattttagcgagtaaaagttctccccctggctttcctcttctggggcctgggagggacctttcctcggacctttgtacccaggggccggtgtgacagagaatggagcccagctgtcctctgcccactactgaaggtcttatttcactgttgctgaggagcatgtctaggtttcccgcccgtgatccccaccccagtctcccacctcacacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 1110 - DNA, 2959 bp, Mus musculus
cccccacgcgagtctgaaatcataatcgtagtattaaaggcagagatcgggagagacaatggggaggttggcgagggagccccgcgcaggcttagcaacacctcccggccccgcagaataatacggctcggcccctctgcgcgccctcccccgagcgcggccgggaggcggcggctgcgccgaggaggaggagaggccccgaggaggcggcggcggaggccgcgcggaggcggaggaggccgcgcgggaggaggaggccgcagcgcgcgagcaggaggccggcgggggagcggcatgagcggagcgcggcggccgtggctgctctcggccgcgctcggtgcccattgacagcggcggcggcggctcgctccaagatggccgcttggctcgcattcattttatgctgaacgacttttaactttcattgtcttttccgcccgctcagatcgcctcgcgccggccgctctttccgggatcttttatcaagcagaaatgcatcgaacaaccagaatcaagatcactgagctaaatccccacttaatgtgtgtcctgtgtggagggtacttcattgatgccactaccataatagaatgtctacattccttctgtaaaacatgtattgtacgttacttggagaccagcaagtattgtcctatttgtgatgtccaggttcacaaaaccagaccactcctgaacataaggtcagataaaactcttcaagatattgtatacaaattagtcccagggcttttcaaaaatgagatgaagagaagaagagatttttatgcagctcacccgtcagctgatgctgccaatggctccaatgaagaccgaggagaagttgcagatgaggagaagaggattataactgatgatgagataataagcttgtctattgagttctttgatcagagcagattggatcggaaagtaaataaagagaagcctaaggaagaggtgaatgataaaaggtacttacgatgcccagcagcaatgactgtgatgcacttgagaaagtttctcaggagtaaaatggacatacccaatactttccagattgacgtcatgtatgaagaggaacctttaaaggattactacacgctaatggacattgcctacatttatacctggagaagaaatggcccactacctttgaaatacagagttcggccaacttgcaaaagaatgaagatgagtcaccagagggatggactgacgaatgctggagagctggaaagtgactctgggagtgacaaggccaacagcccagccggaggtgttccctccacctcttcctgtttgcccagtcccagcactccagtgcagtctcctcacccacagttccctcacatttccagtaccatgaatggaaccagcaacagccccagtgctaaccaccaatcttcctttgccagtagacctcgaaaatcatcactaaatgggtcatcagcaacttcatctggttaggactgttaaggaaaagatttttcaaccccctgatttagttaccttcattcattacagctttatagatgcttaatacatgtgactgtcgtccagtttgcttccttttgtagtgactttaaatttggccataaatgatggactagatgtgatacttcatatggatgttaagtggaaagattgattctttctctaaagaattggattctgagaaggattctgtgttaggaaagatgtgaaatgatttctgtgaccactgtttggatctggaaatgttctacagtgggtagacattgggccatagtttgttaatctcaattaatgcctacattacattctctttgattgttcttgttattatgctgttctgtgaacctgtagaaaacaagtgctttttatcttgaaattcagcaaatggaaagaataagcatagaatactgcattctgtgcagccacgtcactgtgaataacaatttcttgcatatttagccattttaattcctgtttgatttttacttctctgttgctacacaaaatgatcaaaggaaacttgttttacaatctgtatgcctaaaaagcgggtactaccgtttattttactgacttgttgaaatgattcacttttgtaagaatcagatggcattatgcttgttgtacaatgccatattggtatatgacataacaggaaacagtattgtatgatatatttataaatactatgaaaatattgtgtttcatgcattcaaaaacagttgtaaacttctccaaatgggttcgacctttgcggatatcacagtgcacccaatgctgaggcttaccaccagcacagaatttgttttaatgttgataaccagtttcaaattcttttccacttagaagcaaatggcagatcttcatagttctggcttttctccaataagactttcaaaattaatattgcagtaaagaaaaattttaaccaaggcaaatatagtgtttaattttccattggttaaaatagaattaatgtttttaaattctgtttatcagtggaattctaaaatagattttaaagtcaaccagctaattgctgaagtaaagcattttatctacaattttattttagtgtatgtggcacaagtgtaatttcaaatttaagagttgttttcatagttaaaggaatctgccttcactgtaacgtctggaaacagaaacaatttgttatgatttctacagggatttttaatagagcaaacatgttgaatttaaaatatgaatgacccctccaagtctcagttttgctttggtcgaacttagcgtgtgtttatcagccatcagttatttgtgaggatgttaattccgtatgaatattgtttcatgtttgtatgggaaactgtagctaagcatttcattgtctgcagtctgcagaagaagcacaattgtattgctttgtcttgcttgtagccattaaatcattacttttacacacaaaaaaaaaaaaaaaaaaaaaaaaaaa

SEQ ID NO: 1111 - DNA, 750 bp, Mus musculus
atgcatcgaacaaccagaatcaagatcactgagctaaatccccacttaatgtgtgtcctgtgtggagggtacttcattgatgccactaccataatagaatgtctacattccttctgtaaaacatgtattgtacgttacttggagaccagcaagtattgtcctatttgtgatgtccaggttcacaaaaccagaccactcctgaacataaggtcagataaaactcttcaagatattgtatacaaattagtcccagggcttttcaaaaatgagatgaagagaagaagagatttttatgcagctcacccgtcagctgatgctgccaatggctccaatgaagaccgaggagaagttgcagatgaggagaagaggattataactgatgatgagataataagcttgtctattgagttctttgatcagagcagattggatcggaaagtaaataaagagaagcctaaggaagaggtgaatgataaaaggtacttacgatgcccagcagcaatgactgtgatgcacttgagaaagtttctcaggagtaaaatggacatacccaatcatttccagattgacgtcatgtatgaagaggaacctttaaaggattactacacgctaatggacattgcctacatttatacctggagaagaaatggcccactacctttgaaatacagagttcggccaacttgcaaaagaatgaagatgaagtcaccagagggatggactgacgaatgctggagagctggaaagtga

SEQ ID NO: 1112 - DNA, 24873 bp, Homo sapiens
  misc_feature (177)..(258): "n" at positions 177 thru 258 can be any base
  misc_feature (3886)..(5552): "n" at positions 3886 thru 5552 can be any base
  misc_feature (9179)..(9198): "n" at positions 9179 thru 9198 can be any base
caaaagcaaaatccagttgcctgagatcggagcttcccgcaggattcgcgcagagcgaggagcggggaggacgccgtttgcgggaggcgggggccgggatcccgacaccgtccgcagtctccccggggtctctcagggaaccgagctggtggccgtcctaggtaagcgccgaaccannnnnnnnnnnnnnnnnnnnnnnnnnnnnnnnnnnnnnnnnnnnnnnnnnnnnnnnnnnnnnnnnnnnnnnnnnnnnnnnnncgccgccgccagccgccccgagccgcgtgcgcgcgcggccgcatcagctgagcgcgcggcgcgtgtcacgtggtgtgcgtgtcgaaggtcacggcgcgctcacaatggagctctcggagtctgtgcagaaaggcttccagatgctggcggatccccgctccttcgactccaacgccttcacgcttctcctccgggcggcattccagagtctgctggacgcccaggcggacgaggccgtgttaggtaagccgctcggctcggctcggagctggatccgccggggtggaggggcgctcggagaagaggagccggcggagcgagaaggggaaagccccgggaagaggaagtctccgggctttgcccttcgctccggacggagtgttggggacgtggctctgccaggactcggagcagactctgagcattgttttggccccacttggcacctgcatagagccaactccacgttcctggcccggtttccctcccagtctctttgttcttttgtaaagccggtgttcaagtcttgtttgtggcctaaacatctaaggtgtttagccttgtctgaggctgcggctgttttgacagttggacttcatctggggagctccctgcaattcaagcttccagggctaggctagcaaaggtttaagggtctgtttccgaagtaattactaggtcagacagtgttgacatttgccaacttagagcatacctcaagttgctatgatcactccagcgctctagttcagcatgtttacacaggttctacgcctagaaccttaaactatgatgcacaatactttgttccgccccagttaccaggatgcgagtgtcttttaagcgatccggtcagtgactgcggaggtgcagtgtcagtatggattgaagacatattttaagaccgatcgcttttagatgattttcttaaatataaatatcccaacaattcaaatttttgttttttttctgtagtttcatgaactaaacacttgtacaaaaagtatgaaagtggaagttcttaaacgaaaatagtaaccaccacctgggttaatctcaaaaaaaaaatgactgtcaaaccctgaaagtactaatataattttgaaatttgtatcttatattctgaactcatgccctaccttctacccccttgatgtatttgttcatggagccggttaccctaaactcatcatttttaggatggaagtttattctaaaattgacacaatgtaaaatatttatcttgtttttcctttgaatttactccagtgttagaatgaccattgcattgttatattttctttgggggctataatattttttaatagtaaaaatattaaggcaaaataagttaattgaagctagtaatagtagagttcttgttgtgttctttttattgtttttcacttgatcttgttgctcatctcatttacttataattgactgtccttatagttgatgtttttaatcttgttaaagggtttttaaacccaaattaaaatatcctttttggaacatgactgtaaagaatttattatcataggcatcactggaagttaatttattttagatcatccagacttgaaacatatcgacccagtggttttaaaacattgtcatgcagcagctgcaacttacatactagaggcaggaaagcaccgagctgacaagtcaactctaaggtacaggatttatttaaatatccatttattttcaaatactaccttaatgatttcaatttcagttttaaaaatggagacagaactttggctttttttttctttcttctagcacttatctagaagactgtaaatttgacagagagcgaatagaactgttttgcacggaatatcaggttacttactttaaaatttttaattaacagtactatttttcttttactttgtttgtaaagatgtttttttttctttctttcttgctttcttttttctctccagaataataagaattccctagaaatcctactgggaaggtaggtactgtataaggtgtcaagctgaggcacttttcacttgcaggtatgaatggagagtgttggtgtgaaacaagatcttcgggatcttgacccaaagaaaaggagccaaagggcatgtcaagcaattgaagttaagctcatgtttttaaagatcgtttattgagatgattttgaaatgctcctttaccattcataatttaaaaataaagtttaacaatggtttaaattcagaatggattaaaatggagttgggggtggaaagtagagccattcttagtaaatataaataactgaaaagttcttctgaggagactatgtacgaagttatcattgcatctttcagtataggcagatctctccctcatataacggatgtttcttggcgcttggaatatcagataaaggtaaagtttaagaaacttctctagcgggggatttagggaacttcttaaaacctagagttaaaagctgttgcgtgtttgttgtgttattttagaccaatcaacttcataggatgtacagacctgcatatttggtgaccttaagtgtacaggtatttatagataagtcttatccaataatgaaatttataatttcattgatttaaataaacagcgtttcttgttgcgtgttttttttcctgccctagaacactgattccccatcctatccagagattagttttagttgcagcatggaacaattacaggtacagtattaggatctataaatattcctgtctttttataaatgtttacttgagagttatactcttgggaagttcaaaagaaaattaatctaaccatttgtcagcagataatgaagattggttaaggatttaatgggaaaggggcatcaaaagtagtattttaagataggcttcacttgaaattaagatgttattaatagagaattggtctgtatttgctgttcttgctgattgaaataaacttctgtagtgtttagtgtaaatttcttctattcatgatgagtttggtccaataagataaacaaaattaagagcatggctttgaaaatgtctttgctttcagaaattgaattaaactgtcaaaattggattttgaaactttttaaatgactttataaagggggaagtatacataacattctaaaactgtttatattgcccatttaagactgggaaaattcaaaactacatttattagtggatatgacaacgaatttatttcatagtttttaaaaaatgaagctcattactggaaatttaagtgaaattgaatttttcaaaggcatcttctgcagagtcgttttaatgtaactatgaatcaaactttcaactttcagaaaatgtgtatacagcataacctttgttagataacttgagaaaattcagatgtatctgggcggttaaggatccggttagaaatcatgtttcagtgtgagggcaaataaccgatttgaacatgaggtatttccgaggaaacgctttttttgcccgatagtagtttgtcaaaagttaaaatcttgttgaattttaaacttgtttggaaggtgtgtcctgattttttttcttgcatctttcttgagcttggatacttctttccatgttttatcctaaaaacgtggtattgtatacacgtcttttaggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgctcagccccggcgcgccgcgcgcggccccacgttttagttccccgctcccccgggcgcccctccgcaccctcgcgacgcacatggcccccgagaggagtactggtatttccagcctcggcggctctcccggccgcagcgccctttgttgagaggtagatttggatgaaacggggacgggttcctgaaatcgggagctgcttgggtcaagtggcttccctcctctcccgaagaaagggctctggaggggctccagcagccagagaacgcccccattttatagggacgggttgcgtggggggcggccatcccgccaaggtgggtgttaggctggagagagccccgacgaaaatgttattaacttaagttggggggacacttgtctgagattggatggctggtaagatggcggttcccagttgtttccaaggtctcctgcatttgtgtttaaaatgctgaagttttcaaggtggtgtgtgttgggagtcttggataagtgctctgaacatcgcttgggaggtgctccctgggaagtgggcatttcaaatttggagctttttgtggagtgaagatggtgactggacgttagctttgctggaggcttgctttctcactacttctttttctcctttttcttttttccccttttggagactgcaacttttctctcgacttctactaaaggatgcactcagcatcatgactccagtccactatcttttacaggttttgctaaatgtcagcataggtcatttggcaaagggatgctttagaaaagagcactaaaaagttgattgcatatgtttacgcagtcacttgggcttgacagtgatatggcatgatctttttcccagagatttacagttaataattggaagtaaacaagtagagagactttgatcattaccacttgcaataaaaggatttagtgggcttagtggtcacggttcaatatatgaaagagaagcatgtattaaccccttcccttaatgtgggcaaaattccgagcatatttatccaaatgcaagtgtaggttggtggtgtgtacaacgttatgagtagttcaacctatattttataggaaccttaactcccatgttctggaaacacattataagctacactaaacagttgatatttaaggatgcaaattattgacagtatataacaagttatgagactctatatgttaacatttgagttttaagtagaccgatcagaaatccctgggattgattttataaacaaaattataagtttttagatttgagttaattccatacatctaccccaaagtgtagtcagaagtgtttgaaataacctacttgtgtgagtcttatgcctagtaaaatatctttaaagccatatacaagtcactttgtatgcatgtatacacataaagcttttgtaagaaaattaagcatttaattgtacatgataaatccattaatactctatcactaacttcttggatgtatgttaagtgtgcagataggctttctccccaggagtcaaattaaccccaactttacccatgcttatgttgggctgtgaaccccaactggggctatggagttcatttgcatttcttagattgcagtaggcaagctgatggttaacataagaacttgcttctgttttccttcattttgacattcctggtgttaggcctccacctaaaaactgacagccccaactgagtgtgttacaatggcaagttttaacggttgagtatttttaccatgatatgtttggtgcatttttgtttgcttaactggcagtttctgggttggaacctggaaggttttcacttctgaggtggaagagattgtttctcaaatcttatcaagcacgtcaaacactttggaagtcttcattaggttgccactactttcaaagggcataaaaacataactgatttttatataagtaacagtggtatttattagcattataaatggtcacaggattgtggccaaattcttctgaactgaggtagaggaattgtgtgaattaagacttaagatgaatttgaaagacttttggtcaagtacatgtgacttaaatgctcaaagccaaccggtagataaccctccactgaggtttgattgttctccttgttaatacttgtctttgtgtggtgttggttttctgcaagctagaggagaaataaaggcagctatttttattggagccccttcatgaacttcgtgatcggtggttttttagtgcagtatgctttcacaggcaaacagaaatatcagcttgctatctttctaggaaagatcctgtggtttcacaaggagaattttctttaagcaccaagaaggctgttctttaatttaccaagtataatttgatttaaatattgctactctttagggtcattgctctacctacaactcctccgtgccccgcttagatttatgttaatatgttgacaatattctccaaaacaagtaatccagagataactgaggagtcagtcacacaagaagttttctggtagaggtcgccagttgccactgtggtcactttcataagagaggctttgttttgttttttaccattttctagaggttagctcttaatttcagccattgagctgtgttgattggtgtttccctttactgcattaatacaccttaggaattaaaaccgcaggtatatcttactgcaagtttcaaaaggtcctggatttccattcaaggaagatttgagaatgtacttcagtgaggtctggaagcttagtcttatatcaggttctgaaatgaatgaagaaggggggttgaagtttatttttcaagaatactacacgaagtatttgacttccctgactgtcggctggtgtattgttgctgacagttccccattgtgactttcctgtaatagaggtatctgttgggaatatcatttcatcgtatggggggttttacatttgtttttctctcctgtcgctgctttgggttgacaagctgttgatttagcgttggaaatgggctggtcacatggttctgtacatattgtcactattgtaccgattaaagtactttttcttgcccccagcatagtttgtccaaataaaacactgggctttgccctctcctcttcttgtaaaacagatttcagttttcagcctttccaaaactttgtatcgctcatttaatctacaggagagcgtcacattagagaaggaagttttaaagaggttcggttcaataaacatctctgcaatttgagccctgacggtttcgggctaagtgcacagttggcaattctcaaaaaatcccttcgtgaaatttctgaccgagtgattgcagacaggacagaccgagagagtcgagatctgaaaccagctctgcgcaccaagtcgacgtgaaaagaggcccccggagtgtccgaaatggccgggagtgcggtttgcattttcctttcgcgggcgctgccgcaggctccggggtccccgccgcccaggactgggtccccggtccccgatccccgctccccgctccccagcgctgtggcctcgtggggctgccccgcccccccggcgtcgccgcacccaccccgcccccgcgccggccccgcccccgcggcgcgccgcccctcccccgcccgcccgcccgnnnnnnnnnnnnnnnnnnnncccctcccccgcccgcccgcccgcccgccgccccgcacgcccgcccacgctcggggctcgggccgggctccgcgcggagttgcagcggtggccggatgccaagtgtaagtgtaagttgctatggaaaccccgaccgaggcgagttccgaatccggagcgagacggagccccgggcgccgccggatccgcccctcgcatcccggcccccgggcgtccgccgcgctcaggccccggcccaggccgactggaggtgctcctcctgcggccccagcacccggctccggaaatgccagggatgcagggagggcagaattgttttccctgcgcgtcgcgtaaaaacgtgccaggttctgcttgctggaaccgtctaaaacaaccggaaccccggattttcacttgcagattcttgaggaagttttataataaattcggagacctggaacaagccctagtggttggtaaatatccgcggggattgtgtggcgtctgcagcagccttggggctgctgggctggaggacaaatggaagaaagagaccctaatacgctcagctcccagcccccaccccagactttcttctacctacaggaatgatctgagagaccagaagtaatgttagttggatccttttgcatcagtttggtagaactgattccgatctgatgagtaaattccttctgtagaaacgttaggacagcccagctgtacagtgttaaatgagttttataaattcagtgtttcagggtttgtgattactagatgatctccattcttgttctgtgaattatggccattatttctgtgtcttgcaggattttttatcaagcagaaatgcatcgaacaacgagaatcaagatcactgagctaaatccccacctgatgtgtgtgctttgtggagggtacttcattgatgccacaaccataatagaatgtctacattcctgtaagtaccgagctttagctctcttttgtatcatgcgtatttcacagttcgacctggaatttgaaaactgttaatgattcctgcaatctgtggaaatgttggtacaaagtggtgaaggcattttcttctcttgcatctaatgactttttgttaatatgtattgattgtattacaagcatgcaatatatgtgttctcaggatatgaattagcttatttagttggaaatgcctttcaccatcttgttttctactagttctgggtttctaacaccaatgatttatccactcatttctaaacataaaaaaacttcacatgttctacttctagtctgtaaaacgtgtattgttcgttacctggagaccagcaagtattgtcctatttgtgatgtccaagttcacaagaccagaccactactgaatataaggtaggaaactgttgaaattccttgtttgtaattattattggagttgtataatttactgaaggcaaccctctttatttcttcacagaaaatttactcttgaatacataactaatatgtgtgtgctttgtggagggtagccgtttaatttcttgccatattaatggtgaccaagtttagacaaagtttagtagtattcaagtgattttaagatttttttttcctaactgtcctttaaaaactgagttagttcaccttttttgcattgctttatggacttcatgacaggcaggaataaatatttaaaagggcttccattcctctttattccctattcatattagctagtttagtaacttgaaaggcacacttcttttgacagagcaaatgtgaagaatttattagtgaatataaaatatttttctactgatttaaaaagtgctatatacagagaacttttattctcatagtttttatcttatcaataatagttatagacagcatcacaatcaagtaaaatattatagcacaaaagaagactatagaaacttatgaacatttttagttcttgccatctgaattcatagttttctattttaattatttttcaggtcagataaaactctccaagatattgtatacaaattagttccagggcttttcaaaagtgagtaacttgcttagaaaatgaatttaaagagattattcattagttctttgtgttatgccaaatgtttacatcttttttccccattcagatgaaatgaagagaagaagggatttttatgcagctcatccttctgctgatggtaaaccttttaggggagggaagacattttatatggggggagagcttatctaggaattaaaatgtattaaaattgactttaccacttccatcctcttatatataaaatttattaggcatctgatttttaaaaattacatttcactatatcgttatagctgccaatggctctaatgaagatagaggagaggttgcagatgaagataagagaattataactgatgatgagataataagcttatccattgaattctttgaccagaacaggtaaaatctttaggcaatttattttatgctaatgttttattagattgtttcactaataaattttctctttattagattggatcggaaagtaaacaaagacaaagagaaatctaaggaggaggtatgtttcatgttacaaaaacatatagaagaaacattgtttggaatccagattttatcagggattgtgttgccctttagaatattaggctgttaaatagaagaaaatggtcatgtttaatgtttaagaaaggtctacatgtgatatttaataattagaatttattttatatatgattgttagtcttacaaaatattttaagtagttcacagttaatactttggtatgcttgaagattatattaggaatctgttcatttagtatttgtaatgatagtaaactcagagtgtaattagttgagaggttggtcacctccaattttgtttgatactagtatcttttatattcaagcaatcaaattgaaactttcttcatatcttaaagtaactgaaaaagttacttttctaaatgtacttttaggtgaatgataaaagatacttacgatgcccagcagcaatgactgtgatgcacttaagaaagtttctcagaagtaaaatggacatacctaatactttccaggtatctacttttatattcttcttgcattttacatagattttacaattttaattacatttttcactttggattttgaacccaaaaaagcaatagaaaaaaaatgtgaagttagtgctaaagttgaaatttatcttaaaacatttggtatacattctcttttatgctatgaaaacaaatcccttaacactctctagaaataattttttctcatttgaagtttcaggagtctttctttgttaaaatgtttggagaatatgtttcttaaagcacttttggattatatttaaatgacaaaaaatgtacatttacctttgttcttttattacttaataaaaatatttttcactagattgatgtcatgtatgaggaggaacctttaaaggattattatacactaatggatattgcctacatttatacctggagaagggtaagtagcatatctgttgttagattatgatggtaaactatatttaaagaattaagagtaatttttttccttttaactttgtagaatggtccacttccattgaaatacagagttcgacctacttgtaaaagaatgaagatcagtcaccagagagatggactgacaaatgctggagaactggaaagtgactctgggagtgacaaggccaacagcccagcaggaggtattccctccacctcttcttgtttgcctagccccagtactccagtgcagtctcctcatccacagtttcctcacatttccagtactatgaatggaaccagcaacagccccagcggtaaccaccaatcttcttttgccaatagacctcgaaaatcatcagtaaatgggtcatcagcaacttcttctggttgatacctgagactgttaaggaaaaaaattttaaacccctgatttatatagatatcttcatgccattacagctttctagatgctaatacatgtgactatcgtccaatttgctttcttttgtagtgacattaaatttggctataaaagatggactacatgtgatactcctatggacgttaattgaaaagaaagattgttgttataaagaattggtttcttggaaagcaggcaagactttttctctgtgttaggaaagatgggaaatggtttctgtaaccattgtttggatttggaagtactctgcagtggacataagcattgggccatagtttgttaatctcaactaacgcctacattacattctccttgatcgttcttgttattacgctgttttgtgaacctgtagaaaacaagtgctttttatcttgaaattcaaccaacggaaagaatatgcatagaataatgcattctatgtagccatgtcactgtgaataacgatttcttgcatatttagccattttgattcctgtttgatttatacttctctgttgctacgcaaaaccgatcaaagaaaagtgaacttcagttttacaatctgtatgcctaaaagcgggtactaccgtttattttactgacttgtttaaatgattcgcttttgtaagaatcagatggcattatgcttgttgtacaatgccatattggtatatgacataacaggaaacagtattgtatgatatatttataaatgctataaagaaatattgtgtttcatgcattcagaaatgattgttaaaattctcccaactggttcgacctttgcagatacccataacctatgttgagccttgcttaccagcaaagaatatttttaatgtggatatctaattctaaagtctgttccattagaagcaattggcacatctttctatactttatatacttttctccagtaatacatgtttactttaaaaattgttgcagtgaagaaaaacctttaactgagaaatatggaaaccgtcttaattttccattggctatgatggaattaatattgtattttaaaaatgcatattgatcactataattctaaaacaattttttaaataaaccagcaggttgctaaaagaaggcattttatctaaagttattttaataggtggtatagcagtaattttaaatttaagagttgcttttacagttaacaatggaatatgccttctctgctatgtctgaaaatagaagctatttattatgagcttctacaggtatttttaaatagagcaagcatgttgaatttaaaatatgaataaccccacccaacaattttcagtttattttttgctttggtcgaacttggtgtgtgttcatcacccatcagttatttgtgagggtgtttattctatatgaatattgtttcatgtttgtatgggaaaattgtagctaaacatttcattgtccccagtctgcaaaagaagcacaattctattgctttgtcttgcttatagtcattaaatcattacttttacatatattgctgttacttctgctttctttaaaaatatagtaaaggatgttttatgaagtcacaagatacatatatttttattttgacctaaatttgtacagtcccattgtaagtgttgtttctaattatagatgtaaaatgaaatttcatttgtaattggaaaaaatccaataaaaaggatattcatttagaaaatagctaagatctttaataaaaatttgatatgaaaagcacaatgtgcagaagttatggaaaacctatagaggattacaacaggtaaacgttaaagagaatacattgctgacttatagtgatgtggctaagaagtacatgctttgttgtaaaattgcttgaaagcccattgaaagatgtatctgtttatttacagtctttgaagtaaaagttaccaatgtttgccaattttggtgaatttaactcattttctaggcttaagtttttcatgatgtttaagacaaagaaaagttaatggaagtgtcaagtgatatttttaccttggatgatcatttgtataaagaatgaaaaaatatttttaaaaggctaaaaactttaaatgctagtggactgtcatttgacttacataaaaccaagttatcaacatggaattcaaattttacatctcaatctctttatgatgaatttatttttgaaattgcttattaatcagatactgcagttatggcttacttagcactaaccatatgtgaaaatgtttccatttatttgaaaaatgattttttttcctcctcaattagaaaatggcataagcttaaaagcatatttcagccaaaattttttctgttaatgaaagattataatgttttgtattcttaaataagcagctattacagtttgacaattgagattaaaaacctttgctaaattaccatgttagaaattttcaaccttatgaaaacccatatcaaaagctgctaactttgtaacttttagtagtcaaagcagggtacaggaaaagtcagctttaagtttgacttttgcttctgaaaatattctagaacacaaagttagtgctaacaaaatatttcagagaaaatgcctaaattgattttacagatttttagcttaaatgcaaagagaaaaatgaggctggttgctgttgtgtaaatagtgatctatcttgctttacacatgcataccattttacaagtactttttgcttttaaaattgccggccgttaattgcactgcattgaaaaaacaactgcccttcagttgtctcaaccttccaaccatattgctatttccatatccatacgtgataatatttggacctctggagggaaaatgcaacaggcagagtaagctggtaggaactttccttcatcctttcctcttttccgaatattttgaaggtgcagttaatttgtgaagtcttgttacactcattgtatgggcctattaaggttttgttatgaaaacaataggaacttaaatacccatgtgaaatgcgccttgcattgaccaacacgaaaggaggacgtttggtattttaaaatagtttattttatggtatcttttgaggggataggatttacttttagaaacaatctacacatggaatccagtctcttaaaatcctggggtgaagcaattgttaatttttccatttctctttgtattttaaaggtttgataaatgatttagatctttttcttcctaatacacgaagaatgatagttggaaattctgatttagtttagtacttagtcagaatggaggccccataagatttttaaaatactttggctgttttccccacacagtcttcattgcattttatccaaaacaaaaaggtcttgatcaaattacatgaaaaacgactagacatcattttagatctgtgctgcatctaacagtatactaattaaaacctttcaaaaaccgtctatgcctctaagacactaatttggtgcaaagatcactgaacccagctccaacttaaagctcttgagatacatgatttcactttaggatgtttcttcatgtacaaaatgaacacaaacacaggtgataatttctaaggttgctctaaaaaaattgactcctcaaaaaaaagcccttgaactaaattaggaccacaaacttcaaagcgaggagccgagttctttacaaggaatagaaggagatatccatatattccagccttgcagagaatcagatttgcaaatacccaccgcgaagaccttgagccagccgatctccctgcaaatctcaagatcgcccagttttgattatgaaagtcttcgaaaatgtttacacagttgagtgtttcctgtttccgcagttaattttttttaacgtttttttcttcttttggttcttgaaacggatttcctttatttgcaccagtttctttttcttagtgtgcaatttctagaggtctcacatgaagaacttcactatcaactctgtcttcatcaagtcgacgacatcagaagtcatgttatatttatcactggaaagactccgctgtagcactcttgtgagaagagttctggagaagttcaagtggaaaactcattcggaagtcgctttagccctccaaataaatagtaagcgctcaataaaaacttccaacaaaggagttagaactactctcattcttcagcccctagcctttaaaaatgtcccttccgggactatccgaagtcactttcataaatagcaggtgttgttccctacatttcagtaaaatgctacttcttgctctgattgtcaggtcatcatggaatgcaaacttcaccgtggacgtgatttcaacgttggtgcggatttggagatgtccaactctgtcctcaattagccagaactcaagttgagataagagacttgggaggctgcagacccaggtgatagggaagcgcgtcggaaagtgggatgccaggaatgggatggtggccgagaccgacaccgaggttagtgcaggtggagaagtaggtccaaaagcccaagtcacaggtccgaagtcctcaggagcggaagatcttccaactaagccggagagcggggcgcaccgcacggcgtggagcataacgcccgggcgagggtgattggggtgggaaactccactgctttccaaaaaacaggtttcttaggttctagtgcccggtggaaagggcacagtacaccggcctgggggaaatcacctgacttctcctttggtaaaggcccccttaccaacgctgcctctctggtaagggggtcctttaccaaaagacaccttaaagaagaaacagcctctctccttttccttattttctaattagcatcttacagaggagtggaaacagctacagcccagtcccctgctcaaaactgcgccaccccagttcggccctgctgggcgcgcgagccaaggccgcggggcaccgggaggccattttgcgcgtgcgctgctcgcctcgcgccgccctcggctctgcggactcggatcccgccaaatttgaacgcgagattgtcaggccctgaggggcttgaggggcgggggaacgacgccgctctccaaagttggaccccgtggcgagcggcggcgacagccgggtgctcgctgcctcccgaggtgctcccttttcccgccgaagccctccacagcggcaggccgaggcgcagcgacgtgtccctgtaccccgagttcagcgcgggcgggaaaacgacctgcacccggggaggcagcggcttcgcgggcagagcccacgggagcgcgccctgctaggagccaggccggataatcgcctttctttgtcctcctccctcttcgagtccaatcaatgccctttctccttaatgaacgaggtgtccttggagtttgaggttttgttggatgattttaaataaaattattaagttataaagtggccaccctgaaggttcccgaaggcgacttcatgtctgtgactggaaaggcctagaggagagggtcctcccgctgggctcgtttaatagaacgcgctcgaatcccctgggaaagagccttgactgggtgacagggctgaggaggggtggctgcgcggcgggaatctcaagatctgggcaaaggctcgcgtctcgggacgcgaagtcgacgccaaaatgggtccccggacaaggcgaccctgggagtgccggcgcccccggccgggcagaggagcgggtgggccgaggctgggacatcgcctccgaaagctgccgggacgcggcggcttcctgcagagcctgcgcctgccggatccccagaacacagaagcttctcggacatgggagctccccgtgcgccctaaaaccaggagaggaagggacgacttgggaaaagggactggggaaacagcggagaagtgaaagcggcctaaaatgggcgacggcgggcgagtcctctttatcagtgcagcaggctgccggagccgccatttggtggcggatctcggtagttcagtagcacgttgtgctgaacgtcacaactggcttgtctacgtggcatcgtcatttcttaaccgcggttttacgaaatgcaaatttccccctggccttcctcctccgcggccgtcgacccccctcggcgctccgggtggacggctccggggcgcggctcgtccctcgggtggtgcagcccccgcggcccgagacccggggagggccgggggtactttctgcgaggcgccttccccgcggcttctgcccgcgccaaagcctggtggaatccagcgcagacctaaagcacgcttgacaccccgatttttcgagactaggacgactctctgagccagcagctttcctctccctctcggggagaatctcatttccttggggtggtgagggtgacgggcactgtcttttggccccgcgtgtccgttccccggtctcccgcctcacccctctgcgaggtgaggaggggaaacggcgagcttaggcctggcgggaaggagcctacccgacgagagggctccgcggggagggtcggttggaatcccgccctagcgcctcctgctctgcccggtccccaccggggacggggaatgccagtcatttctgttgagtgctagcagggccggtgtcaccacctcgggtggccgaggcttcgaggttttcatgaaaagcccccgaagcgtgaggcgcccgcccagtggagaacaaagggccgagggccgaaggcgaggcgaggcagcgcgcgcggctcccttggctcgacctagctgggagtcgggggcgcgggcagggctcactcccggcctagaaactggagcccgccacccccgccccgcaggcgaccgcagggatcccattcttggagcccgagctgccatgttgccttcgcggaggccgccagtcacttgacgcttccgagacagcgaagcccccaacctgagagcccttcggccgtctttgccgcacagctgcagtcaaggcccggagggactgcgggacgcgggcgggagcgagagccctgtgggctgccaagccggcgcggccgcgccgcggcagccgcttcccttgccaccttcgttccaggggctgcggggctgcgcgctcggcagaggctcggttgccagtagcaaccacacgacggcgatttgcagccagggccgccgccgcagccgctggtacctctgcctcctcctacacctcgggctcgagcatttgaaaccctgggggttgccttcggtgacatctcccgcccccacctccagtcctcagtctccaaaatcctcagctctgctcaaaagccagcgcccccggctgggccctgcccccaccgcagacaataggagcggctgggagcgcacagggcggcgcgcgccgcgagcagcgggcacctgagcccccaaatccgggcgcgtcgctgagtctcagccccaggtgccctcttcgcggagttgatcagcaattctttttcagtggccaattagaaagcttttcttgacatcagaaataagggtggtgccaaagaaagaagtcaaacgcccactccctttctaataacatcgacacaaagaagagctcatggttgcgtctgcgcttggtaacagtggctttcctctgggttagagccacaggcacaagcacccgctgctatctttcttcttcgcctaccatgaatattttgcatgaaatccagaatgtaaccatttgcgttgacttaactgttgcatctggatactagttatttatcagtggatggaacacttttttttccatttcattggatgatccgcatcaacccttggcagtgtggactgcgtggtttgaaacataaagaaaacgactggtattaacccttgaggatctactttttctgtggctctagaacaccaatttaactttttttaacaagagaactcttgttaatgttttaagcaggttttattgaagaaaagtccttagagtatctagctaagtcttttatttagctactaggataactcgggaaatatgtgcattgccaaatttcttcgctcttaataattgtcccggctttgttagctgagtggtcttaatgggttaaaatttcttgtaaatcacaaatgtgctgaaatttccaagtttaaagctccctgaggataagcacctgccttattcatctttgtaagcgtcagagtcctttgaacataacaaatatttgtcggacttccagggaatttcagaagtctcaacaactcttattaggaaaaaaactaacttactgataactagcagaaagcttggatatctttaatgaactcaatgaaaagctaaacaatttccaagctggtagcattatcagatattctcattcatgaatatttaacttaattatatttcaaatgccatagattgtatgttaaaatatctgacacatgttttcaggattctaaggagaatgacaaattgtacataagaacttgaaactgctaatttctcatctagtgtctaaaaatttggttaaatagccacaagtaaggtgcaactttaaagtgctttcatactttctgatagcacagacatgtcattaactgtctttacagctggacaggaatgcttaaggatctagcgttggatattgcaaatctactaagacaaggcaccttgaaatatcctctttaatttaaataagctttaaagcatactgaaaatagtatgtctcaatcacaagtgatggtaaactcaaattaatgcctcctgaaatgactcttaggtatattattaaaagaggttcacctttaagcttcacaaaatatcaagttcattaaataagacagtttacctaaaagaagaaagcactgcttggttcctagagggagcataacgacctgtagcttgccaaaccacccccatcagcaccttaaaaataggaaagcaaggctttagtgaaaagttccttgctacggtctttcaggaaagaaaagctccaacaacttgctttggaccaagttaaagagattatctccctttttcattacgactgtctttcaatgaattgaaggataagatcaaagtgcattcatattcatgtgaattatcgctattgacttgaataatgatggatttcattgttttatttaaactgaaaccaggaacgctgctgcttttgaggctacacccctaaggctgtagaatttcttctctgagaactcaaaagccaagcaattaggtctgacaaccacgtcatttccataatgtacttccgtacagaggactttttattggaatcggttacatttctatagaatcttattaccactcaatttttgacttctttccaaccttctcaacaaaactcctaagttcggcaagtacacttccaaaaaacttatgagtaaattgtactgagaagatacagtgatgtttcagaagcttttattaatagctgttcatgaatcagacaaattaatgttatcagtaattacctcaggagagtgtttttgttttgaacatgatacattacagtttttctagggtaactgaagaactcagttacagtaagcttgggaaaatgtgtttaccagctgtttctttctaaatatgcctcatgacaattttcttaagacattttcattggggttttcctcaaactgtcccatcattttctaaggagatggaagttactagattcagtggaactccccctcactttcaccaagtgatcactctgctcaaataattcttattacaatgcttatcagtttggagaacactttttaggaaattcattacaataaagtaagcttgtcattgaattctgcaagcaacctttaaaatagacttaggaaactgcattttcctgaactttaatatacacaatttatatagcctctctaaacctaaaaagagactctagtgcaacaaaagtctattacattatcatggtctgcagtgggttctgggaatatcctttcccagaaagagaactgattcagttacttggtttctctcttaaacttctgccatacatttaaggcattacacataaaccacattttaaaaaaaattcaatgtttttctattcagttgggctacaagagatctctattttcatttacccattgtgtgtttttagtattgcaagacactctttaagccaggaattattagtaaattgtttctctttgggatatgaccatatatatattgaaattatttgcatacgttcagctttacttgtaaatttctaagactgttacccttgacttataagtaaaatgataagcaattgcatattatttcactagggcaaaaaaaaaaagcattccttgaataaaaagcatttctttataattcaattccttaagaccagatttgtcttactgatgggaaaagtattagtattttcttcatataggcagttcatcttttatatcgttcatataggaacttttattttttcaccgtaaaaaaattaggtaatattggagtaggaggtaaagtaatccagctttagcaatatttagatgttttctctgaaatgtcaaaaagcaagggtccaaactgtagtgcaagcatctcctctgaaagaatgagatgtagtgccaccgtgtcctcgaatttagcctacgttttagcggagctcactctcggctcagataatctctggggaaaaaacggacagatagagtggttaaacaggaaacactatttttttttttcaaacgtttgagaaaacttgaaaaccatctctcggtacttttgcagtaatttccaggagtcagaacatacagtccattattcttcagagtaaccaacgcacaagacattttggcttgggacttgatatcgcgaaatgacgtcaaaaaattaaaaaaaaaaacgaagctcgcacatgcgcaatgaggtacagctgctttttatttttttgtctgtatcagctattggctcctatccccgcctctgggatccggcctgcgccgcggggtcctagggggccagcagctgtaaagcggtacgggattccgcaccctactccagcaagaaagagcctgaagcccctccccacctttcccggccagggcgctcttctacgtcccgcgcgcggacagccggggcgaagtaggccgaccggcgcggccgcagcgagttttctggcagcgctagcgccgcggggcctgggttcccgggttccggtctccgccggctccgggctcgcccccgcgagttggccgcaccgttcccccgcccgcggggcagccgctcctccgggaggctccggcagggaccttcgccccggcccccgagcggcagtgcggctccagctggaggcctggcccgggaagcaaagtgaaaggacagaggcctccttcctcgccagccgcccgccgcgcctttcccagctcaggccggcggcccgcggcgcggagggagcgaaagagtcggggcctgccccctccaccgcccgcatctcggccgccgcacccgggtccgccccgggaggccccgcgggagggaacccccggcccgctgggcgcttccgcactgacgccttggggccgcgcgcccccgccctttcctcccgctacacccgctgggcccccgcccgcgctcccggcctgctcccagcgccgcctcccccgttagaaacttcgcagacaccgcgaagctgctctttggagttggagaaacttaggaagaatgggaaaagccgaggaagtcggggaggaccacgttcttcccttgccctcggcccgacactcctgtccacattggacgcggcagcctgccagcgcccaggagagccgacccggtggaca

SEQ ID NO: 1113 - DNA, 3203 bp, Homo sapiens
gagaggcagagatcggggcgagacaatggggatgtgggcgcgggagccccgttccggcttagcagcacctcccagccccgcagaataaaaccgatcgcgccccctccgcgcgcgccctcccccgagtgcggagcgggaggaggcggcggcggccgaggaggaggaggaggaggccccggaggaggaggcgttggaggtcgaggcggaggcggaggaggaggaggccgaggcgccggaggaggccgaggcgccggagcaggaggaggccggccggaggcggcatgagacgagcgtggcggccgcggctgctcggggccgcgctggttgcccattgacagcggcgtctgcagctcgcttcaagatggccgcttggctcgcattcattttctgctgaacgacttttaactttcattgtcttttccgcccgcttcgatcgcctcgcgccggctgctctttccgggattttttatcaagcagaaatgcatcgaacaacgagaatcaagatcactgagctaaatccccacctgatgtgtgtgctttgtggagggtacttcattgatgccacaaccataatagaatgtctacattccttctgtaaaacttgtattgttcgttacctggagaccagcaagtattgtcctatttgtgatgtccaagttcacaagaccagaccactactgaatataaggtcagataaaactctccaagatattgtatacaaattagttccagggcttttcaaaaatgaaatgaagagaagaagggatttttatgcagctcatccttctgctgatgctgccaatggctctaatgaagatagaggagaggttgcagatgaagataagagaattataactgatgatgagataataagcttatccattgaattctttgaccagaacagattggatcggaaagtaaacaaagacaaagagaaatctaaggaggaggtgaatgataaaagatacttacgatgcccagcagcaatgactgtgatgcacttaagaaagtttctcagaagtaaaatggacatacctaatactttccagattgatgtcatgtatgaggaggaacctttaaaggattattatacactaatggatattgcctacatttatacctggagaaggaatggtccacttccattgaaatacagagttcgacctacttgtaaaagaatgaagatcagtcaccagagagatggactgacaaatgctggagaactggaaagtgactctgggagtgacaaggccaacagcccagcaggaggagttccctccacctcttcttgtttgcctagccccagtactccagtgcagtctcctcatccacagtttcctcacatttccagtactatgaatggaaccagcaacagccccagcggtaaccaccaatcttcttttgccaatagacctcgaaaatcatcagtaaatgggtcatcagcaacttcttctggttgatacctgagactgttaaggaaaaaaattttaaacccctgatttatatagatatcttcagccattacgactttctagagctaatacatgtgactatcgtccaatttgctttcttttgtagtgacattaaatttggctataaaagatggactacatgtgatactcctgtccgtcttggttcaaaagaaagattgttgttataaagaattggtttcttggaaagcaggcaagactttttctctgtgttaggaaagatgggaaatggtttctgtaaccattgtttggatttggaagtactctgcagtggacataagcattgggccatagtttgttaatctcaactaacgcctacattacattctccttgatcgttcttgttattacgctgttttgtgaacctgtagaaaaacaagtgctttttatcttgaaattcaaccaacggaaagaatatgcatagaataatgcattctatgatgccatgtcactgtgaataacgatttcttgcagctatttagccattttgattgctgtttgatttatacttctctgttgctacgcaaaaccgatcaaagaaaagtgaacttcagttttacaatctgtatgcctaaaagcgggtactaccgtttattttactgacttgtttaaatgattcgcttttgtaagaatcagatggcattatgcttgttgtacaatgccatattggtatatgacataacaggaaacagtattgtatgatatatctataaatgctataaagaaatattgtgtttcatgcattcagaaatgattgttaaaattctcccaactggttcgacctttgcagatacccataacctatgttgagccttgcttaccagcaaagaatatttttaatgtggatatctaattctaaagtctgttccattagaagcaattggcacatctttctatactttatatacttttctccagtaatacatgtttactttaaaaattgttgcagtgaagaaaaacctttaactgagaaatatggaaaccgtcttaattttccattggctatgatggaattaatattgtattttaaaaatgcatattgatcactataattctaaaacaattttttaaataaaccagcaggttgctaaaagaaggcattttatctaaagttattttaataggtggtatagcagtaattttaaatttaagagttgcttttacagttaacaatggaatatgccttctctgctatgtctgaaaatagaagctatttattatgagcttctacaggtatttttaaatagagcaagcatgttgaatttaaaatatgaataaccccacccaacaattttcagtttattttttgctttggtcgaacttggtgtgtgttcatcagttatttgtgagggtgtttattctatatgaatattgtttcatgtttgtagggaaattgtagctaaacatttcattgtccccagtctgcaaaagaagcacaattctattgctttgtcttgcttatagtcattaaatcattacttttacatatattgctgttacttctgctttctttaaaaatatagtaaaggatgttttatgaagtcacaagatacatatatttttattttgacctaaatttgtacagtcccattgtaagtgttgtttctaattatagatgtaaaatgaaatttcatttgtaattggaaaaaatccaataaaaaggatattcatttagaaaatagctaagatctttaataaaaatttgatatgaaa

SEQ ID NO: 1114 - DNA, 981 bp, Homo sapiens
atgcatcgaacaacgagaatcaagatcactgagctaaatccccacctgatgtgtgtgctttgtggagggtacttcattgatgccacaaccataatagaatgtctacattccttctgtaaaacttgtattgttcgttacctggagaccagcaagtattgtcctatttgtgatgtccaagttcacaagaccagaccactactgaatataaggtcagataaaactctccaagatattgtatacaaattagttccagggcttttcaaaaatgaaatgaagagaagaagggatttttatgcagctcatccttctgctgatgctgccaatggctctaatgaagatagaggagaggttgcagatgaagataagagaattataactgatgatgagataataagcttatccattgaattctttgaccagaacagattggatcggaaagtaaacaaagacaaagagaaatctaaggaggaggtgaatgataaaagatacttacgatgcccagcagcaatgactgtgatgcacttaagaaagtttctcagaagtaaaatggacatacctaatactttccagattgatgtcatgtatgaggaggaacctttaaaggattattatacactaatggatattgcctacatttatacctggagaaggaatggtccacttccattgaaatacagagttcgacctacttgtaaaagaatgaagatcagtcaccagagagatggactgacaaatgctggagaactggaaagtgactctgggagtgacaaggccaacagcccagcaggaggagttccctccacctcttcttgtttgcctagccccagtactccagtgcagtctcctcatccacagtttcctcacatttccagtactatgaatggaaccagcaacagccccagcggtaaccaccaatcttcttttgccaatagacctcgaaaatcatcagtaaatgggtcatcagcaacttcttctggttga

SEQ ID NO: 1115 - DNA, 96597 bp, Mus musculus
  misc_feature (1)..(1119): "n" at positions 1 thru 1119 can be any base
  misc_feature (3198)..(3392): "n" at positions 3198 thru 3392 can be any base
  misc_feature (5213)..(6798): "n" at positions 5213 thru 6798 can be any base
  misc_feature (22501)..(22528): "n" at positions 22501 thru 22528 can be any base
  misc_feature (58897)..(59240): "n" at positions 58897 thru 59240 can be any base
  misc_feature (63007)..(63085): "n" at positions 63007 thru 63085 can be any base
  misc_feature (75913)..(75966): "n" at positions 75913 thru 75966 can be any base
  misc_feature (85888)..(85907): "n" at positions 85888 thru 85907 can be any base
  misc_feature (94748)..(94767): "n" at positions 94748 thru 94767 can be any base
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctctctctctcttatacaccgacttctgtcttcttcagtctcgatcaacagctggcttcattccagccccaggcagaaaaacttaccatttttaaccgtctcctttggctacattgtagcaactaggatcaactctgcttgctgactggagtccaactgaatagcaaccttaactactgtaaaaagccctccgtctgttaactgttctacaaccagctcatatgggttcctctccctcactgttctgtttagaatggacaatcttaagagtctattttaggattcttcctcatattcttgcttctgcttcctaagttgctggcagagtaattgaatctctcctggttgaggataaatgggggtgtggaaaggggccaaggattgcatactgaggaatgttgttctacatagaaacctgaagccaggggaaggtggcctcttaccaacctcaccctccatcattccaatgctgagacaccaagtatagttcaaaggtcatctgggagacatggagaccatgatgaagtattaggataatccatgagagggaatctaacctgagcaagaaagctgacacatcccctccgcaatcagaacagggagggtgctccatagtcctgcagcacagagctgaagagctggccctgggttctgggtatgtagagatgcaaggttagcagaagcctgctagaaggactggtgtagaaaagctgtgggaatcccttgtcagggtatattcgtaagaaatctgacaagaggtcagagaattagccctggagtgggagcaattgggatgggcatgggaagaggagagaaatcataacaaccaatgctaaaaaaaaactactcagaggacttagcaacaaaaggaagggagacacaagtaagtccatgggttcgaattcagagacttggtgtaactacaatgaaagcggcagcggcaaagccagcttgacatgcaggacacaattctcaagtgttctctctctctctctctctctctctctctctctctctctctctctctctctctctctctctctctctcccctccagtcacctatacacttttggtggactaaatttctaaattacccactcggctaggctgtatccttggatgtagtggaacccattgtcttcatattgaggttcagtcctctcagcttatgtgagataccacaccccaccctccaactcagtctctactggcaatggcacagtgacctgaattacaagtgcctagctttgctctctacgatcctcctccctggagcacctttgtccagctcacctcagcctctctagccccttctctgggattcagaaggtagaagctctattcatcttctaagtcaaggacacatcacctgtgttagcaccaaaacctcttctaagcatccccaggtgctgctgccccgtcctcccttgtcccttccctcttgttctctggaccatgcacacatgcttgccagtagccatgataccccatttgctgtctgttatttgtcctctgtcaccaataagcctagaaccctgacacataaggaccattctaggaaggctgggagaaagaaaatcaaatatttcatgctctcagagaatctaggagttaccatttggaaagactaaaggtcagaaaagactaaaagcctattatagattttaaaatctctcaaccaaatagcgattgcctgtccaaacactctcggtgacaagaaataactacaggatagaaattctacatatctgagattcccacatgaagaatttttgagattttttttttgacaaaatatctctgcatagccctggctgtcctggaactcactctgtagaccaggctggcctcgaactcagaaatctgcctgcctctgcctcccaagtgctggaattacaagaaatgaggaggaaagaggggaaagaggacatactaacagttaaatttttctcaaagctgtcaattgtacctaagaagaaacatagttggtccatgcctgtggctgtgcatgggcttgtgtatgtgtgtgagtgtgtataccagtgcctgtgtgtgcacgtgtgcatgtgtacatgtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtgtgtatgtgtgtgtactcacatctgcatggggtatgtgtggtgtgggggtgaatgtgcatgtctgtgcatacttgtgcctgtgtgtgcacactaaatctgcatgtgtacatgtgcgttcatgtgtgtccacaggcaagtttcctaagctccctaaaggggaggctcctggcctataaaatgggagtgactataggattcccaggattaagcagggagacaattcaatcactgctggttctatgatggcatacagtgggcaaggaagggagatcatgtcctatctagcttccattaatgagtatgtagcctctcgtctctctccaagccccagggtggcatcttccccagctcctggaggtggaaatcccttcataattccacaggtttgcctttatctataagtgtctgttcactgagttcagccagtttccctgtgtcctcaagctgatgtcacccaagcgcagaaagttcttcacagtaacacacagtcctctccaagcacagtcgcttttgccacgttggcttttctctaagaattgtcgaagtattaagtgtatacatagagatctgcgctccattctgcttttccaaccactcagcctgagatggagaggtgtctctgggtctcaagagagaatgtccagggggttggctctaccaggtctctggaataaatttacctgtcctagtcagtcctactgggtcagtctgttaggtccaatgctcaccagttagaaccaagcttgccttaacttctgagtccatttgttatttcttacctcatcttaccttaataattagtgcaaatcgttctgtccctactgtgttcaaaaaaaggaaactttatggagcttttttatgcccttgtaaaccaagatcttttaaaaattattttaaggttgttccttggaggccacacatttaagtccctcagtctgtcattagaaggcaaccctgtggaagcctttcctattttatttgctcttttttgcttttgcaaaaaatatatgactgtggagctgcaaaccttgacctcctgcctatttaaacagcgtctggaaatctgaagtaattagctctcttcttcttcctcttcttcttcttcctcttcctcttcctcttcctcttcctcttcctcttcctcttcctcttcttcttcttcttcttcttcttcttcttcttcttcttcttcttcttcttcttcttcttcttcttcttcttcttcacaacatcgttgataagccgtcttgtcctgctatggaatgtgactacccaaatcctaaggcattgagaccgaccatgtgcccttactgtcactgggtgctgaccactgtcagtgtacaaagctaaggaagggtaatttctaactcacattatctgtaaatactcaagggaatgagcacagttttggtgtgggcttccctgtaccttagaagcagcagactgcagggaggaaagtgtcttcctgggatcttagcatatgctgatgatttccaacaatatttaaggctgtgacatttcaagaacgagtggtgtcaatgtaaacaaactgctttcctagctgaaaagaggaagggagagggaggggagggaggagggaaccaaccaagggggaggtgtttctgaaatgatctaccactagaggaaagcaattggaacacagaagcaccaggtaatctcttttagaaaatgtattctgaattgtttatttggataaatactggctttaaggaaataaattgttggaatgatactcagatttttttttctccttgtgcttagcctctgccatgttactgattttaaaaccattttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntattatatattttggagatgatttcatagaataagcacacaaaactttcagttttctgagaccacttacagttagccagtcacgtaaggatgtagaagaataagtcaataaaaccgctccgccctccattgaaatggttgcctgcctctcactgaaccaaacactacttttaaaattcatggtagaaagtccaaatcctgttgtgctcacttttaaacttccccagcaacaaatttgtcagactgtcacacagtagcagcttaaacaaatctttccctcgcagtttttttccttttttttttttaatcatgtaaattttagtgtcactctgggggaagcctggaagtgaaagttgtaaacctttcctttagctcttggtgaggcaagcgagagaaagtgtgcattgacagtgaaatgcgcactctgggtgggaaggaattcctcatttccctctcccgctgcaggacttgcatgaactctgtccaaagccgcaaggactgcgcgttcatggtgcccctcggtagagtcccagctgcgcgcttgctgattgctattttgcagcaaagacggggcgatgattttgtttgtctgtgtttttcaagtgcgtgtcaagtggctcagtgacaacccacacaggtccagggatgcccgaggccggatttttgcagtttttcgttgctttatcctgatcgagcttcgaactaactgagttactagcagtaactcagctgagcagcgctcaaggtgcgaaccttgaaagccaaacttggtgcctgtgttcatgtaactgtctttcctaggcttctgccagacagacaaccctaaactccatgcgcagtttgaggtttgaccccaacgcgattcctttaatcttttgaagggccagagagacaccctttcccctggagtcaaggtcgagcgttgtctctgccacactgttctgatgatgccctgtctcggttggtctgtgtggatgtgcttggctgtggctccaggagcactagatctgaagtcggctgctcagaaaatgcatttgaggggagtctagctagctatttgagggagtctcgcttccactggccatgaactctccagtaaatacggcacaccagaacctggctgcactaggaagctgtggccctggcaggggagcgcaggcagcgggattcgacccctgaattgggacttctttaagattcgttttaaaagaaaagcaaggaggaaaaaatgtcttcccaaagctccggatccccccaaacgccaggggagcactgagctttgccctgctgtcacgatctttgtgctgaaggaggaaagtcgggcccactcgggaaaatacagaaggctggagaagttgagccttcgctgacaatcgctggacacctgaggaactcatggtcctgaactagcataaggcggagcccaggcaaagaggctttgagaagagatgagaccctaatttgggtggatcacgacagtagagacccaccagccgggggattcccatgcaagctggaccggctggctaccaccggtctgagagacgggggcgctcaggtgggttctggtggccacttcctaatgtctgtccccaaactcacaagatcgaccctaaggacctccaggtgagactggtcctcgcgccgtcggggcgtgcccagtgccctgctccgcttcccaggacgcctaacgagggccgctgctgccccctggcgtccggtctgagccccgacatgaccgtgaaaggcctgcctgatcctccatgccgccagctcctacccgcctggggcaagagaagccaccccaaacttcagacaaggcctccgtgccgggacctccacagcttcttcctcttccacggaacccaggctgcgcagatgcgtgtggaaggaagacacacgcggggaccagccagggacccgagcacagatgaaagtggaggggttcggtcaatatgtggacagtagcgggctccatggagtgggtagtaagaagttccggaggaagcaaggcccaagagaagtaagggaccccggagcacaggccagctgctccggctggggacagtagccggcagcgagccaagcaggaaggagacccttaaagctcttcggcgaaaatgccctcggcgccgcggggacgaacaaggtgggggaggtgcccctacattgcttaagcggagtgggttcgttgcctgaaggagagctccggactcccgccggagctggagggtggattcgagctcatgagttcggggtggcctgagtcccccatgctttcaactttttttgtagtctagagttctttgaggccttggttagaaaactatctcctctccagccgctgcgcacactcagaacgcggcgcgctgcgtaatcaagccgcagcccagccgcagagaaaagacactaaataaagcaactctgcgaaggagaggatgcttaaaacccaaaacttctgcggtggagcagtggctggccttgtttaaatgactcggtgccacttctcctcagctgctagtctggcccagggaggcgctcagagcttcccccactcggccatcagccctccaaccctcttgcggccgaatcccaccctgtcctcccaggaccccaagccttggctcatggactgcagtgcaaggctgcctagggaccattcccggatgccagcccaggtccctgaagcctcgcggtggcagctttgtgtccagggagcacagggcgtctccctcccgctgatctccaggcccagggcttctccggacgcagccctcggtccccaagcccgaccggtctctcgattcctgtttcggggtctccaggaccgaggccaccagtggcgccgctgcgcccggcaaacccacccagggcgagtgcagcaccgcgcgtggctgcctggcgtgggatctgaacctgggcctggcttcgggcaaacatggcagcgtgtgcctgtgggtgcggggtcggcgtgggtgcgggagctggggacggtaggggctgccaccgagtcccgggccgggcagcgtacagtagcgcgcgggggcgcgcgggccaattccaggagcgcggcagccggccgcgcccaggctgataccggaaaggcctgtgattggccgtcggtctcctctatgcaaacgagctgagggaatggaattcctcgggtcgggcttacagtaaaagcacgttcatttccaggcactctcattcatagagccagcgggcgcgggcaggacgggcgccccgcggccggacccagccagggcaccacgctgcccggccccgcggctggcacttccatcctgagctccccgagacgcaagaaagtcaccctttgcggctctttctagatctgcgttggaccttcttgttttcctttcctttcctttttttttttttttaatttttatttttattttccctttcttacttttgaatgaaccggcttctaggctttggatgtttcaacttctaggctgtgaacttttctccgattgtttcttttgacaactgcgggagaaagtgttccggagttccaggcgagcggtgaagttgcgtgtgcgtggcagggtgcgtgggagtgagcgtgtgtaactcgagcctactggtctacggtgcctcctcccaggcccgctccacctgctgcggttacacggtgctcgctcgtgggtatttgtgcgccccagcagaaaaccagccaccgccgggcgacgttggaggaagatcatcttgccagactctgggctgactcactcaaccaatgtagacagtggctgacttccgaagagtgcgagtctgcctgtgtgtgtgacccaactgcggctcaactcccaccaaaccacaggatcagccacaaacttaaccagcgttcccaaaccagagtcctcagctgtgggaagctctaccctgagtgtcatcgagtttgacttttttttttttaagattagctacagatctttgtaaagcactgaccatttatttggccagaatttattgagtaatgacaagtgatcctatcccagccttccaactactgaagctgattttcaaggctacttaaaaaaaaaaaaactgcagcaaacattaatggatttctgttgtgtttaaattctctacagattgtattgtaaatattttatgaagtagatcatatgtatatatttatatatacgagcacatacattagtagcacaatcttttaaagttacggctcttgcttttgagaaacgaagtgagtttttcatggtaagaggggcgctctgtatggaagacactcctaagttttgtattttgttgagactctaaacaaaactgacccgcaagaaagaaaaacaaactgacaggcaactaactgctggaacttccaaatctagtttttgctggtcattttttggttgttgttgttgttctgcgcataaatattttaggacgcgtatgggaattttgcctccgggaccgtttgtaatagccaaagactgaacttcaactctcaaagcgaggctctgttgggcatttgactttgaattctggttgcccactttttaacgcactaagcggccagttgctaaccctgcttgggtgtgaggccgatccgtgtaactagatctcagtccgggactgatggtaatttagtctcctacccccacaaccctccggtagtaataaaggcttctgaacttgtatgttggtctcccgggagcagcttgcagaagatccgagcccctgtcgccgtctagtaggagctgttttcagggtccttactcaatcggcttgttgtgatgcgtatccccgtagatgccagcacgagccgccgcttcacgccgccttccaccgcgctgagccccggcaagatgagcgaggcgctgccgctgggcgccccggatggcggcgccgccctggccagcaagctgaggagcggcgaccgcagcatggtggaggtactagctgaccaccctggcgagctagtgcgcaccgacagccccaacttcctctgctccgtgctacccactcactggcgctgcaacaagaccctgcccatcgctttcaaggtactcctgcctgaagagggtggcgggaggagcaggtggaggtcagccgatggccagagtgagcctagggggcagaggctaaggcggcttctagagaagggtgctgcctgtagtagaagtctctggtccttctcactgagtttgggatggggggggggatgctgcgttaccgtggcgaccctcgggagggtcagcctcagaggtatccaagagggagtttttttaaaaaaaaatcaggataatttcagagcgcctaccaagggccttccttatctttgctacgaaatagaaaaagttagaaccttggatcgggccagtccatcttccttaaggttccccgaacctctggatgaacacccagaccgttttgtatctctcaaatgaaagcatcaggaaataaaataagagatgctttagtaccttcaggtcagaagaaaaaaataaataaataaaccaagggaaacagccagggatcacacacacacacacacacacacacacacacacacacacacacacgccccgccgccttttttttttttttttttttttaaatcgcgctataagattcagcgtgtccaaagtccgcggcaaggagtagttggttaagtttgccaaagtccggagtttttccgagcctgtagcctgctcctgccagaagccgcaagtattgaatcctgttgctttttctggaacctccagaatattatcgctggctcacctaaattaagccccaggcaagaaaggtgacaaggtgtctaccgacacccaaaaaggtccaatccagcagcttttctgtttgagcaaggggccttgtagacccggcaacttcaggtgggcagctcacgttggtcaggtcgcttttcaccctgatcttgccctagctttgtgttgcgtctaaaacttggctttcagaagctatatataaacaacctcgggcggtttaaaaaaaaaaagaataagaagaagaagaagaaagaaagaaccaccctacaactctggcagggagctggaggaatttagattctcttctttggtcttctcctgaggtgggttttaaaaggtacagctgagagcaaaaagactctgtcaagttgtgtttttaaaaggctaagaaggcgggacccgagctgaaaagggaagctgctctcctttttcttttttctttttttcaatttagctgaataattgtctcatttaggagggagattaatttaatttaagcttttcgtagttccaggcctcagctggatcttgatctaattacaatgaatagcgctcactttttgacaagtgctgtccggttccccttttcatgctaaaaagaccatccacattaaaaaaaaaaatcatagaagtagaatttgctgctgactctgtctgtagaattgccacctttaccactgttgtgaaagcaactttttaaaggggtagaggtggggttgagagtctgaaggggagccaggcactcgggttttccttcccttccaagtattggggaatccgtcccaattcctttagaaaaacaaatttagctggtgttgtcttctgtttaccctgagagggacctatctgggctcagccctaaggtcactttcagagaacagagagaaatcaaacttattgtagtcaaggaaagggccagttaaggtagatctccctgccagcctagctaaagggactgtggcttccttgagggaagaaattgggtcttttctgagctttgttgctgtggttgttgttgttgttattgttgtggttgtggttgttcttcttcgtcttagtctaccagggaatcccagtttatcaagacactaaataactgatttttaaaatggtcttcaggagttgacgtggtcccgtcttgagctaccacatggaaatgtttatttttcttttcaaaagaattaaagaccttacacattgcctttacaagccacgaaaaataattttttccttttaacaaaaataatcactgccgtagagattcccctttacaaatgattttggaaagacctcagtgtgtttccctgagtgacagccaggagccatgacaaaggtcacggtggacagggaagttgaaaaatcagacctctggattaatatctgtcaccacctatgctgtcccacagagggacggctgcttcaaggagctcaccagtcagtagatagaatttgcggagggaaaggagatttaaaggctgggtttaagaggaagctggacttggaaacagaccatcttccttgctgtattttctatgggccctggcccctctgtgtgccagctcctaccaaacacacagaagcagtttctaccaacagtctttacatttacatgtgaattaagattccggaatctctttaggggttaaccctgcaggacttatcctattccctgctgccgccaccacccccagataaaaatcggatgatgtgaagccctgttcagatcacttgtagaagagcatctcccggaaccttccggaatcttgttaagtcctccgctttaatcttcagaattatcaggagacttacaatcatgaagtcccttgaaaattgattaaaattatgctaattagtcctcccatcctccacccctctttccacctatagactgtttatctcagcatagaagaaacacttaatttcactgccgagaaactgggaaatctgctccatactacacaatatttgcagataccgtctacaaagttgtctaggtgacttgcagtagattttataatactgtaataaaagaatttgtttagcccctggtacaccagagcacaaaaatataaacatacctttatcagggaagttcaaagaccatgggtgctgatggaatatgctttccaataaataaataaataaataaataaataaataaataaataaataaaattctggccggaagaccatgatccctagctatgtgttaaatgtcatctcagataaattctacgttccattccacagcctctttgaaactctggaagattagagaatttgcagtaactaagttgttgctttaatttcaacctgtaaaattgttggaaaatgccagtttcaaactaagaataggctagccaagaacagtgctgggaagtcctcagagcagagaagacagctgacatttggcccaacttcctgatacttgaagaacaggagaagttcaacaaaatatgagctatcttgggccagcaagtcccttcttgtctgtttggtctgtactaaatgtaaatgtttctcttgccttacctattgtttatagctttttactgcagacactgctttgtatttctgtttgaagtttgatttcttttcattatttctatatcatctctcagtgacaaaaatctatatcaaattggaagacatcttagctttaaataaaacaacaacagtgctagtaacctagccctaagtgtgcttgtcattgttttaagtacagagttaaatgtccctggatttaattttgtctccttcccttctccatcaaaactctttggagataaatcaaaaagcccaagaagtagtaaccgagccactggatgcccccttcctgcttcctttagaaatgggggtgatgcaatttaaactcctaatttttagacttttgaattccaacatcaacaagcttttcttggccaccatggtcctcttgtgctgtagacgagggggcctcatgggtttgacctcttggtaatgagggatccctggaacaaccatggtaaactgaggcacggtggggcacagtgggaattcatgacttggcgtgcctttgggcgctctggaacaggatttattcattttggcctcttaggagatatgggccccaacagtcaggcattcagactggaagcccggatgtcgattcagtgccctcggagcccagtgggtgttgagatgaactggaaaggcctaggtctccacagggagatgaaggcaaggaagtgaagcattttcacagagggtatctcatccttgtgagcaaactgtgcagagggaaatgaaaacattgatgagagagatggggggaaaaatagacagaaaacagaatttacaggagtaacattttgtaggaatagaaagaaaagataataatgatcaattaaccgagcaggggaatttatttcaatgatgttctttgaaacaaaagagttgtcttattaccactcctaattaaaggcatcaaacatttgtggtgggatagaaacatctaattacatattgcttggagaataagcgtttttaaaatctcctttgtagaaaacacgtccaacagttgacatgaaagggttaaaagcagaggcaaggggccgcagggtccttgtttcacaaagcaagtgagtgaaaacagataaaaattaaagagatagcaagatacatacccagtcctagagagcagagtgtcctagtgatgtcctaggggtcccctctgtccatttctcagggtagctggggcaatttcctgacataggttctttagaacgcaggagatagagcagccacaatgaataaaatcgcccagatagccatctgcaggacatcgaacagcgggaaggagacatgactaagcacccagtaagaatggcgagcagagagaccagaccttgataccagattagcagatctgcggcggggttatttcatacagaatgagaaatatccctctgatagattgtgaagcagccagtgtacaaaaactgagaaaaacaaagtggcagtagaagaagagatgtttctgctgccatcccgggaaaacctgcccgaggatgaccacacaactgagataaataacagacatctcaccgaagactgacagcatgtgtctggaatggttggaacaaactgaactctcggggcatggcgatttgaaatcctgtggtcgctttgaatatggaacaaggcaaacataaccgatatcaagtcaaaactggaaactttagctgaagtcaaagaacggcaggcttggtggtgcacacctgtaaatcctgacctcgaaggctaagaggactgggagttcaaggccattctaggctccatcgtgaaaccatagctctctaaaacaaaaccaaaaggaccaaagagcagccaagcagtgggtaatgttttgtgaagcactttcaaggcttcagagtgttttaatctgaaattactactttttttggttttctggatataaagtaagctcatctacaagttgtctttccaaatatactaagcccttaccttttcagtggcagtaacggaatcccccagaacacagttcatacagatgccagacagcagtctggttctacctttgatttgaggagaatgaccacactggagcacccgtagtcactgaggtcatcccgcttgtaattaataataaagaagtggcccgtgtctagtttttctccttgggtgcaagagtttgctgctggtgagtgtccaagagcggcaggaagaggtgccagagattagctgcagacagacagtttaagtatttccgggtcatccttggaagctgcacactgggtggcacacacacctctaaccccagcactagcagagaagagaggaagatcgggggttcaagatcactcaagggttcaagatacagtgaggcgggggccagcctgggctatctgagaccctgcctcaaacaacaacaacaacaaccagtaacaaatttagagcagaactaaatttaaatactttcatccaggtttccttaggtgcaccaagaaggggccaagcaagtaaaaggtggggccagagagatggctcagtggttaccaacatgattcatgatacagagaatgggtctgattcctagaacctatgtcaggtggctcacatctgcctacaactccagtcccagggtaatttgctcctctggccttcatggcctgctctcaagaaaatgcccacccacatacacttaattcaaaatgccaagataaatctttttttgaagtggattagatcacaaatctacaaacacaagactttctgtctttcgaatatgaggtcttaagagataactgtaccaatgagaaacagtagtagcttttcagaattcctgtccccgcttgtcttgttcccactgtgtcctgtgaccttctgtggcttttctcctttaatctctgtgtcttccttatttgaaaatccacacctgtctctgcatcgcaggactcacagcaagctgtttctgtcacgatgatcaaatgatgacggacggctcttctataaactagaaagtgtcaccattaagcattaagtttaacatcagcgcaattgccagacaaatgacacagccaggtgcctgtgacagcactgatgtctgcatttgtcccttggttgacgtctaggtggtggcactgggggacgtcccggatggcactctggtcaccgtcatggcaggcaacgatgaaaactactcggcagaactgagaaatgctaccgcggccatgaagaaccaggtagcgagattcaacgacctcaggtttgtcgggcggagcggtagaggtgcgtatctgtcacggatgggtgtgaaattcgaacccgggttttccaaatagtagccgtttcttattattgatgcagcataatgatatttatttaaggtaatgtttatttgatacctaacaactggatattatcacgttttgatgactaaattggcttacaactgacttggaacgcacagcgtgtgatggacttggaacgcacagtgtgtgatgcgtgaattgtgaagttcaataaaacattccaccgttttcctaaactgagataagtgagcgaaccaccccagaatgaggactgagattgtataatgggtggtcactatgggataatcaaagccatgagcctttatcatatggtacttacgctccctcgaacatgcgacagggtttcagttggtcacatcaataattttgggggaacccttattgatatagttttaagtaagcttatattcctaggattaaaaaaaatggactcttactggtacatctgagagcagtgtgaccttcactatgcattctttgtgtatggtttggtgggagaagccaggctcacttaacatttagatactgctcatgtgagagaccaaattatttccttagcccagctggacatgcagttattatgcctcacctttaaccagttattaaactattggagtagaaagaggacctgctctcactgtaggcttgtctgctttccagttatcttccgaggtatgtgttctctcttcatttcaaggagctacggcacattttacaaacatcagcaggccgtgtgagagtctaggagcaaggtcttcgcttaaaccctcacctttgtaatgtagaattgaacgatcttagccgtaaatgatatctctagcttaatcaaagcggaatgacatatatctaagtcatacgatcagttctcagagaggggaagacacagggaggggctagtcgtgtccatcgctcagtggtagagccttccgtgtgaaaggcctttagtttgatccccagcaccaagcaagcaaaacaaagcaggtagactggcaacagacaagaaatgtcaagcaaagggattgttactactgattctgaaggcgttcagaacagtggaaattccgtgttcatagtgggaaagaggagagagttgagagtgtgagcctggacttctgtgtttgctcccctacccctgcccccagatgcccagggcattttcagaatgatgtcacagctggagaaaaaaatgtagagaacatataatgttattgaaaatatgtgttcgcgctactgtgctaataatagggtgattgaaagaagagtctacccacttatcgaaggcctgggagagcctgcgcccttaagtggatccacttggaatattgaaagtctgcctttcagcaaatggaattcgcattacggttcagaggcatgtgtttagaaaatatcagggaggtttcagatgagtcgctggccgagcgggtgggaagccaagaagaaaggaagaccccaacagccaggcccacgcccacctgcctagcaataagcttagttcgtaggatctagctgggttgccagagaacatgtccccatactcctaggcgtctaagtgggtctttttgtcatgtttggctatggaagtttcgaagactatttaatggactattccagtgacattttcccgtagggagttgcatggtggctttgtgacgaccgtggcagccagttgatgatgatcaagagtggggttctgaaagcagcgtgcctgcctaccttggtggtgctatgtgctggtcgcctatccctctttggccatttctgttttgagtgggtgactaagaggtgctggtgtttacctgaggaacaatggactgtttccccaaggcgtggagtgtttgcactctgctgtctgattcgtgccagtgtgcacttgagtttgcataaccgccccccccccccaggaaaacagcagcacccaaggcgaggctggtttcccataccctggaatgaaaaaaattaatcagatgcaaaaaattggattatatttgacttgagcaggctctcctcttcatgaggggtaacgagtaattaaaactcaggaggactaattgaccacttgacccagttatggtttctatatataatgttggtcttgagtttttatggtttaaatttttcatgtcaataccaagacaagtgagctgtcggtgtaataaacatggttttatctcataatttcactttgtagtcacaaaatatgattttattttgatttttcatgccatcaaagcctgctggatattccccagcccagcccaccccaccctctctcactctctttctctccttctctcttgcgatttgcttcccattagaaactgaagaaatgactctcactaattctcacaattagccctaatctccctggctgaaccttatcctttaaaagttgcattatgctttatggaacgatcttaagacccgactatttcatttttcatttttttaaatgtgcctaaaaatatgccctcagaggccacacactggcccagaaggtcctggccttccaacacatccacattccgtaaggtcagtttgggattctgtcagtgatggcttctcggaggggcctgggtactccgtgtgggataaagggtagagatgacatgaatggacaccctcctttcttgttaccagatgccagattttgaggattgtgaccctcacagaaactgccagttaaccaaggaaggatttttctctgttccaagaaatggatctgtctgggagctggctgatgctcagctctaacctcaggttcagcctgtgactgggaaaacctgcctgtctggcttctaagccctggctgcctgctggcccctgtgaaaacctggtgaaggcagaggaagctcctgcctgcttcctccatgaccatggcttccgcctgctctcctttagatcagctcgggtgtatctcctcataggaatgtttctccctttgattcccaatctgcatgttgattatctgaggggctctacaaaggaaggagagatagctgctcccggttgggagtttagggtggggtgaaaatcagaggggatcttgggagaccctctctgaagtccagagattaggagggcgctcaggaggctgcccagaacaatgcatgctttagtcacagggcctgagattatcagtcatctccgagttcagggtcaaaaagagatctctttcatgagggaggtcaattagctgagcctttttctcggtctgtaacttgctcccatgagctggggtgtgaggtgacaaacatttaagaaaccttggcagtgacatctgcaaacacccatttcctgctggggtgtttcaccagctgccgaagacttgatccatcagtgaacttagctttaacgatgcctgtcacagggaaacagatcacgcaactaccaaacatgacaacagccgtgtggcaaatgtgaggagggagaccagagccaatgctcacttgttccaagttggtgattctttaaatctctggaagctgtcatagataattctgaaaatccccccaaagatttcctaaggtccaaaaaaaaaaaatgcacacgggcccagatttctatagtgcagcttagtttcgggattgtttatggatcttcctgggacgtgctgatactaaaacgtgcgaatctggaacgtgtcttggactgctgagggtcagttcaatgccaagtcttaaacacagcccatactcagaagataaatatacatgaggacccacaaggttgacattttcctgtgcttctctgttgtgtggatggcggtgatatctgtagactcaggacctggttggtagagggtaggaaggtatagcaatttaaaaggccagggcaggcatccggtggaccactaggcatatggctggatgtaatcgtctgtgtgggagcgaagccaccattggcagagcagtctcttccctagtgactgtcagtcctggctgcagtgacatgcacgcacatccccagaagaccagtagtctgctgcttgccaggaacaggtctcctttcttagtggaatctgctgtttacgctgacatcctggcagctcagaacttgcccagtttgtgcttttctgaagtgaaattccttcctggannnnnnnnnnnnnnnnnnnnnnnnnnnnaatatttatcccgtcacagtctgggctccttcatatttgtgtagtgtcggtttctttaagcatttccattccgcttttacgtgatttggggtacagtgtgggatgttgtctctctcggctgagcggaaggctgtggtggagacgcgttgcgggaaggataaactgttctggcgctccaaaaagggagggccgccttggtgtgcggcttttccgggagagttggtcttagtgactcatgatgttatcacaggatccatatcattctctatttgatcacaaattcatagaggaagaagaaatccaactgccacccctagggatgtttctcggagagcagtccatgtaagcactagaaactgattgttgggtctcctagggagaacaagaagaaggaaaaggtgtgcgctatgttaaaatccaatgtccacttttcttccattttctttctgttttttttttggttcacggtttgtaatagcgcatgtagtaaaatctgttttcttcggatttaactacaaacaaacaaaaataaaatggtacaaaacaaaaataaaaactaagcaaaagccaacaaaactaagggaagcctgggcccctcagagaacaagccccggccggtcctagcaaacacttcctttccacagcaggccaacaagcttcaccccagaaccaacagcactgactcagaatctgcctgtaaggatcaggtttccccttctctttattccacaataagagggttagcaacactttcctcaagcaagcttctccctgtccagcttaaagcgtggggtggccggagcctcagcagggaccaggagctgcccgctggacgctgtccctgatggaaactgtagtgtcatgctctaccccagcgggctttacaaagtgccaggcatggcggcaggtagctttttgtagctgaggttatttgcatgcgcaggatttttcccatgtggggcagaagcagccctccagccctcctatggagccccctccatcccttccccagcagctaggctttccttatgagccagccctttttggtcaggactaaagactatcaatcagaaagtacctgtgagaggaataatggttgagtgacttttagaatttcctgtttgacagcatcatagacataaacagtgatccagctagccactcagtgagaatagttctaacaaatcaacctgctagctcgctctttcttcttcttcttcttcttcttcttcttcttcttcttcttcttcttcttcttcttcttcttcttcttcttcttctccttcttcttctccctcctcctcctccttctcctcttcctcccccttctcttcctcctcttcttccttctcttcctcctcttcctccttctcttcctcctcctcctcttcctcttcctcttcctcttcttcaccttctttttggtactggaagtaggctagttatagaagaatatattctgtttcaggattttttttttaaagaaaaattacttgttgaagcagagagatggtgtaatgtctggtgcgtgtctcctccctgctgttgattataaaacaagctgagaacagtagggggtgtttaagaatgactgcggagtcacgctcgatgtctatggaaggtcggtccagaaaccccctccattcaattcagacatctgcagctgctccagccacttatacaaaatggcacagccttagtaactaaccctcaggacaccctctaacataatttacatcacacctagattgcttatgaatctagctaacagaatatcgcttgcacattaatagttgctgtggtattgtttagggaatgataataaaaaaaaataaaaataaaagaagtccacatatatgttcagtacaaatggatttccccacagatatttgtgattgcaacttcttgaacccaggggacccatggacataggaccgactcatggagtggtgtgctgtttgtagactctgttgggccgttaggcagaggagcctctactttcattgagagagttcttggactaaaatgttcttgaagccccagtgcacatgaagccccagtcaagcaattaacaagaatgggtaagcaagctgtctgtgaaaatgtcccagcgtgccagccacctatcagggagcgggtgggtaacggtaatctagctgatcacttcatgcctgtgtttgtaaacatgcactagtgcgtttcaggcaacccctctatgtcctccgtgcctggctctgcaacgaatctcacatccacacatgtttggggctgtgtggagggtggagctaacagtaccgtccagttttactctgcactgcgttggggttccagcttacagcccagcctctattagcctatattggacagtctatccagtttgggaactctatttgctatgcccagacactctccagccagcgagccaggctacatgggtccccacgagtgtacagaaatcccagtggtctcctgtgacaggctcaggctgcagtgctggagccccagcacgttgcctctggcttcctaagccaaggaggaaacactcaggagccacgcaaactccacgcctctcagagaagatggaagtgaattggaggcaaattatctgactcatagtactccatgcttttagaaacttaagaccctcttcatgaacacatggacccaaaggtaccacctccccaacacctgatcccaggaggctcaggtccagagaatgggagggctggccagtgtcctctagagaactgtgtgcctctaatccagtcactttatgcaaaggaaggagttgtatggaattcatccgcatccgtatcggatctttgtggataagacaagaagggagggactgtctggaggtagaaaggactcttgtttgattacagtattggctgtgggtcttcacagacatttttatttctatttgagatgtctgtatggaatatattcagcctctatcagtttctgcctcttattaatgagaagctatctgagtctggatcattcataaggctctttgtctttttaaacgatgtctgcagaacctgcatgcagtaagggccccattttcatccttgtatttaaaccacccaagaggcaggtccccttccctcttctttcctaggtcagtgattgatcagttttgatgagcctcttgcttagtttgtctctgctgggatgagttttgacccctaagggacatttaatgaggtctgcagatgtttttgattgtcacccacggagcctgaggggtggtccctactatccagtggataaggcccaagatctgctaaacaccctattatgtgcagaatggcccctcccacccccaacaaagaacaattctaaaactttaatcgtgccaggactggagaaagccggacttgacccaacacttccagaagttgttagatatctatctcccttgctcctcctccttccactcttttccttccttgaaaaaaaaatccgcgaaaattttaattcatggtattcacactgagtcaaagaggaaacagacaggaggctcagaagttcaagatcacccttggctttgtgttgagttccaggccagcctggcgtataagaaactgtgtgtaaaaaacaaacaaacaaacaaacaaaaagaaatagtaaatgaataagaacgtgtccagaagcccagacgaatgagctttcgtgatatctcccccccccccccagagctgcccagtggtaccctcagtggacaattcctgcctggcaggtaggcactcactcactccttagatccctgcttaaatgttcaactctaggcgcttagcactgtttaacggctctaggctgtagaccttaccatcttcttaacagagagcagagaggatgtctcccattgacacttaagagcacccatttccttgaggatgcctttccatcaggggaaaattggagaatgcttgtgtcatgctttgttgaatgtttgacagcaacccccaccttcctcatggtgacaatctgaaatacctgcagactctatcaaccctcctcgcctgagggtggagaacttcagaacaacttccctctgtgcctgtcggctctctgccgcttttgcccaagggaggagaaggaggagccttgaggatcgatttcagagataaacgctggatactggttaggttatgccttccctgggtcagaacaagctggctcaagtctccatgctgggtcaggtctcagcagggacagtatccctagaggagacagggacattggcagggtcactgatagacctgtttcttgtggctccttgtggatttctgagagagaaagcctcctagcctacccttcctgcccaaccagcctcctggagctctgagggcccgaaagggttatattcagcgggcactgagattttagattagcaatgggagagaggaaattaaatatggactgtaatatgaagcactgtttttcatgggaaaagaagttctcccaacttagccagtccaactcttttgtccaaccgttaatagcatgcaaatatttatgaatcatacatgccccttctaattcccgtgtgtattttcacaataaacagtgcgtttcgacaatggggcagaataatccctttgtcccgtagcagagctgtgcaggctggcacccggcagcatcgcattcttcccgagtggtaactgctgtctccacccaagcttaggggaggtttatgtctgtgtgacccgggtggacgggctctggacggtcctccaggcagtgctccaggccaccccgtgttactagaagctattcttatctcattgtttttaataattttcaagggagtgctcacacttgggtcttctctggtggacacagagagttgatgtgcactgaggtttgctgccacctcttgctgcaccgttgacttctattctggccaaattcctggactccgggtcacactaaagccacctgattcctctgattcatcgcaattccacagaaacacgtatctcttcagaatgattcggcgggtctttggaaggcggtgtgagggaggctgagaagtgctcaggacgccctgagatgtgtgagccttggtttttcctcctgtgtagtgggcatggtggtgcctttcactcaggcctcacagggttgttgttaataataatagcaataataataataataataataataataataatagcaagatggtgtacttatgaggagacttaggagacgaggcatggcggctctttctactgaagggtgggattgttggaagagaagggaggagatgacaggaagttagggaaggaggtgcccctcctactgcctctcatccacgacaggggacttttatccctttgttctgctaaggacctgataaaacggaggcgtcacaattactcataaatcaatgcatgcataacagtaataaacaactaatcattttcagggcccagtctgggccctgtgtgttgtgcatatgcaacctacctcccttccctgtgtctgtttgcttaccccgtctcctaaaggcatttagggagagcatttcattcattcattcattcattcattcactcattcattcttctcttttgcttttttggaaacagagtgaacactgttcagcccaggctggcctggaattcacagtgatcctcctgcctcagcttgccatgtccccgttcatctatttcttgattcatcatcgcacatctgctgtgcacctattgtgtcggctagcactagaggaccgtgagtccgctgaagaggcgttctcaaggtcaagggttcatgaggggcgacagtgaagcaggccttcactgttctgtgtagacgtctctgtgacaaaggacaggtgcaacgggggcaaatacaagttgtgtgtaacctagcgaagggcagatggtttccccgggcaactcgtcgtctctcttgaaacctatgggaggcaacagagtgtgcatttggcgggggtgtgggggcgcgacttgtctgtcgaggaaccaagagatacaagggtggcctgctctggaggccttggcatacagggggctgaggatgctttaagggccttgacatccatcctgggcactaggtctgatgccagtgacctggcgagcagccaacagatccttggcagagacgtacatcgacacacaggtgtggtgcacaaacttagactgcagtgtgcagagtagggaacttgtttgggggttctggggtgctcagagaccagtcttactagtgtctcctctcaggcagcctcagatctgtgcatggagagctcgcaaatagccccatttagcattagcgcccacctcaggctggtgtccagctttcctctcttccattagcatccagtccacctgccctgcctcctttcagagcagcaaaggttcaagaagatgctgagcaggaactgcagaccccaacactcccctccctcctgaatgcccacacccatacccagactccctgctgctcctgcccaggttgctgtgggcatgatgctctaggccacaggtacaggcgggggattagtcaggcagccttgggaagccaccttaggctttttccctgcatggcccctacacaaggcagatagaccagcacagcctggggaatctgggcatctatcaacgaaagaagtcgctgagtggaaggacagaagagcacgcggccttaatctaaagagactcttgtgcaagtctgggctaaaaacaggctagtcatctgagataatgtggggctaggattccaagtgagtaagacaggagagaacatgcagcgtgaagaaagaaagcagagtccctgggactctcttggtgctttggtggggtgggcaagcgatataagtgtctgatccaattttaggatgtttcccaagatggcagaatctatagacatctccttaccttattaaaatgggcacaggtatagcatttgtgtgcaatcccctctctctcctcttctgtatctagtttgtgtcatctcagaatgactttaccctacctgtcgcacagcagatgccgtatctctgtcctgtatgtttgagcggtggtgggccggaccctcagagacagagacaggacccactgcgttcattttttccctaaggttgttttcaacccagcacatcaagtacagccatgcttcccaggcaggggcagccatcgctgaaagtcggcagaactcgttgattcactttttcaagcttgtatgtgtgtgtgcacatgtgtgtgcaggtgtgtatgtggaagcagcagctgctgtccacactctttcatcacttgggattttttttttttttgaggaaaggtctctgactgaacctggagttcaccatttcagttggcagcccccctcccccaaatccatttgtatcaacccccaggaatagggtataggtgcctactgcccactggcatttgacacaagtgctgggcgtccaaacacaggtcttcatgctagtgcagcaagcaccttatctactgagcatctcccagcccatcagccctcctttttttgttttgtttttgttgttgttgttgggttttttttttttttttggttttttgtttttttattttgtttgggtttggtttttggagctttctctgtgtaacattggctgccctggaactcactctgtagaccaggctgacctcaaactcacagagatctgcttgcctctgcctccctagtgctgggattaaagtggggtataagcgccctgctctatttaatttaaataacattagaacaaaagacacaaatagggtccaagcccagcccctgagctctactgagtcacttccagagaactccagagaatgtcacacatggctttcccattctccaagtggatggctcactctcaaactgctggtcactccgcacaaccaggcaaaggttgtttctatggagaactgagttctgtgcttcaagttttcagttaggctcttgaggcttggacgttggccaagagcagagactctggtctgcattctgcctacatggacacagacaggacagggtcaggccagctggacacaggggctcttcgcacgaatatcagtcagcctacagaagctgtgcaagtccaatgggttgtgtcctgcctataagtccctaagtaaattatgcaactctaccgtcaacagatcatggtggaaatagcaagaggaagggaaatggaacggacacacgtgtaagtgccggctgttaggaagcaccggtgggaaaataaggggggaaatgctaagtgcatgctgggaatatcctgcaaacacagaagttatccctggaatctgggggagagcattcatttccttggaaaaaaaaaagtccccaaccgtgtgtgtgtgtgtgtgtgtgtgtgtgtgtgtgtgtgtggttaggcttgcacatgtgtacacatgtgtggatctcagaggacaatttgtgggaaccagtctcccctttttcagtataggtgccagggactgaactcaggtggctgggcttggccgcaggcctccactcactgagccctgtcgctggcctgggtgcgtgcatttccatgctcagagttacttgtacccagaattggacatggcataatctacggtcccctgtaaccttggagaatcttcggggatttcctgagtttgtgaagagcagacctccctcccagcccttcctggctgttttgatttttcaaaggcaacattttaaaaagaaagtttccttccacttgctttggggtgcctaaagtagcaactgtgcagaaggttccctcagagagacacaaagagagggatgttaccggtactgcttaaggaaaatggctaccccacatcccccgggcagaagatcctttgcatgtgtaatcttccttttcgtgacaaagggcaagtttcacatccccagaaacagtccccaaaaggagaagatgactcatgtgtcccaacctacaccaaggagaatgagagttacggagccactgagaactgggggtggggggtggggatagagcagcccacccacaggccaagaagggcagcgggctcccagcaagagactggaggccaacgggcttggagggcggggcaggggtcaagctggaatgtagtgatgtttagagcctgggcaagcagtgatcttcagccacctatcttcttgcttactttttgcttcctgccctcagccctcctaggggaagccatatacagtgttatagtatcttgatcctgcagtttagtcatttgctacatgcaaagggaagcagtgtgtctcaggctagacagagaggcagggtcctgctgattctgtattagaccccagggctgtcagtgtccaccactgagtcctcccctgaggccctgggactgcctggccttgcaaagcatgccccacagccccagcaagtgtccaggaaggctcaccccgtgaccttctttccaactaaataaagcagttcgtattttgttctgccctttggatgggcagactggcgtcgaggaggacgccacatgttgctgtcttggcttgtttatatagtggatcagcccctcgctgtcatgccttaaagggtggccagctggtgatgcagccatgaaccgccaagttcaagtagaaatcagtctgagcagcaattctgacacctgttgagcgttcctcctcttccccaattcctcccccatcaggtgtccttgggcagctcacaaaagctgttaccactttgtattttgcagaagagaaagctagggctgtgagacagtaacaaagttgcccttgagtatgactgtacaggcaacgagtgggattcgaacacgggtatactgggttgctgagctctcacacttagccctctccctatgtacttccagctctggaatgttctgagcaagctttgtctctggatgcttggctgagtccagacttcccccttcttcccctggtctttcttttttgatgctccttcctcttgccttcagccctcttgtcactcctgtcaaatatcagtcctctgggatcacagccatccactgaagctgatgcggcgggttccttcagtaccaggagcagaataaagatttcgaggcttccccctctctgtcggccctctcactggctggatgattcagagcatcagtggcttaccgcttgcccctctaccaccaaaagcctctgcctccagccaatgcccctgatcagcaccaaagtgatctatgtcctggccagccagggtttctgggaaagtggggtctcccatcaggcaacagactaaaacatgaagtcttggacagcccagtctctctgccctgccttagaccctgaagatcccaggaaagcgagtgttattttgctgaccggtactcctctaggtcggtcccttgtgagtctctcctctcctggcggctgcaagttacggcggagaaaaacacttgagagtgtttcactctccacgcccatgtacttaaaataccaagcccataggtcattttaataagggaatttggctaacaacacatgtgcgctggaggccctagctcccacgtctgcaggtgctggccaagcagggctgtgtctgagcaaccacgggcctgggtgggtggagagcagagcttgcagcttctgtaattctgagcaccgagatgtgcctctggctacctggaagccgttgtcagggacgggcctaaacccagctggaaaaatacaaacaagaatggaggtcaggttagaaccagggtgacaaaaaagtcaccatggtctatagatcataagcagatgtccttgtactcaaagctcttaccaggactggggaggtggctcagttggcagaatcctggcagcacaagcaggaggtcccgagttctatccctagagcccaggttttaaatttttaaatttgtaatgcatgtttgaaatcccagttctggggaagtggagacagacacatccctggggctcactgctcagtggcctagctgaatccatgagttccagaccagtgagagatcctgtctcaaatcacaagatgggcagagcttgaggaatgatgtctaaggctgacctgtggcctccacataaaactgcacatgtgtgtttgtgcacacacatacacacacacatgcacacacgtcagctgcaacccgagcccatcgtggggattgccaccagtttatctcctcccaggtgaaccccattacagacatgcagtctccctaatctccctccctggtgggaatcactaagtggaattcctcgtattgacacattaaaggatgaccataaagtcataggaaccatggtgctgagcagtggccataccagttgggggtcacagctgtatttctttcctaagtcagctagtctctggctaagccgacactctcacagtcttacaccttctggaagcgccagtcagctccaggagagactgccgctgagtcctgaacttgttcgtaggcagctgcctagaacagcttgcacattagagtcacaggggcaattttcactttggaggatggtagttgggcagtgggtgggagatggggtgagtggaggctcctgagtttagattttgcacaggtggccatttatacgccaatggtggaagcacaaaggttgtgagtgtaaagtttagggtcattccctctgtggttaagtgaggtggttaatattttatgtctgtctgtctgtctgtctgtattatgtatttgtgtgtgtgtgtgttgtggcttatctatggaggttcaaggataacttgtgtgagtcagttctgtccttccactatttggatcccaagagtgaaacttgggttgtcccgtttggcagtaagtccctctgcccactgagccatcttgccaacctgagctgagtgatttttgaggatgcaaagtcacctgtttaagtctttgccttacactcttttaagaactggtaaaaatccatcttgctcatttcacgggtcttctctgacaaccaaatgaagtaacttccatcggaatgtgtcggaagcattggaaggtctgcatacacctaaacatgtctacattgtgaaaacgagattcctcattgtaggcagagttatgaaaggagccctggtgagaattgagctgttctagagtcgagaaacccttgcaatgctaagcccaggatgctctgtatttgtgccaggatgaagaatgtgcctggatggtctccacccacccaggatctctgaacatgttcttatttagaaaattcgccgatgctgtgaggttaaggccatgcatgaagaccttcatgtggagaccatatgtgttagccttcatgtggagctcacctatgatggccttcatgtggagctcatgcatgacagcttctaaggatggggagattcagagacaagggcatataaggaggcagcatacaaaggtagaagcagtaattggggcactgagaccacagcgcctccagaaggtcaatactgatgacaatcttaggaagtcaggagaaggagaaggaaggagccaaccacccccattgccacctaaggtgtcttacaggcaccttcatcttggccttgtggcctccagaacaagagactgagtctgtgtgcattaagccatagcactgtattacatcagccccaagattgcttgaactcagtgttcttgaagtctttgcacttccgaggctgaaagcaacagatgacatgattctgtgtgtggtgacagtgtgctagatagtcacaggtttggaagacatcattcgagaccttcatgacgcatttcaggcaagccatggctgaagccagcattggagaatgttagatgctacagtactccccaaccttgagctgttaccgagctacaagctcccatgtaggcatcttactgcctcgggctcagaagacactatcagaaaagatctgtgagctattccacaagtagctactcttgacctgggacccagattggcaaaaatgtgggagaatccaactcttcgaatgctctatatagaagcacctgatcttattgtctgttcactctcctcacactcgcgcatgtacacacacacatacacacacacacatacacacacacacatacacacacacacacacacacacaccaagggccagctcaggaccaagctatgtacctatcagtcactggtgtcttcaaggtcctttacctatttcccctttggctttacaatcttccattgcctgagagcctcttcctgttctcctttctcacttctgaggaatgcgaggctttggagaaatgggccctgcccccaccctcacccccacccccaggcagattaagcttggaccatcacaaatgctgtcaaagcagaaggcctaattaatcaaggtgaaaagtgatttatggggccaatcggaactagtcacaagcagactcttccttcggggaaggtcacctgggaagcaggtcagtgggagactcactgggccttgaagttgggaagacttgagagagtgaatctgggtggctggagaagtggggttgagtacagaagtcccagagtctggaggcactacttaaagagctgagctcatgagctgcagaaagagggacgggttctagggagaagattctggaaactggctctaggattccatgttgatgataccaaggtctcgcccgtccatcatgggtgcttggtgagaaaggaagacccattgtgaggtgtgcagggtgcttaccgtacagcagcaggctcggcactgcctttacacagtcaaaggctacagagaacgatgagcaacttcctcaggttacacatcagcacaccattcttaacatgcccaccctcagcctctgtggaccatccctccaagtctgctagatgctaaggtagaaaaccatatggaatatcccctgatggtgtatccgcaggtgtctgatgcaagtgccagagcctggcagccttcttcctggggaagctggggaaggattcaggtacaaagtctcttgggccgtagaaccccagtctccagaaaccactcctgtctggtccactgggcctctcaagatgcacaagaggcctcctcctgaaccttgcctgacactattgttctctttggcagagactagcagacagacttcagaggctctggggtctttgggaaactgtactcttgatagggagtgctgcttgctctggttataggttgtattcttgggaaatgtctcagtggccttccactttcagctggaagtggtatggtttttctaaggaggttaggcgggtaagcagggttttgcagtagccagtgccttttggacacagtttgttcccatttcccttgagtttcattgtgtactacgtaagaggagagattgtactagctaaggaactaatatttaggtagaagacttaatattgcacccggccaaatacgggcattccatacagagctctgagacggggagaggtgcgtgcgtgcatgtgagccttcggacccccatgggcagacaccattacaatgctttacctcatttatctttctctcgggcccaaaaggtagaaatttgggaaaattgcctataccaattttcaggcaagaacaccgagcctgaacaagaacacagagaagtctagatctagtggcttgtctgtcaagcatctggaatttaaaccagaatccaccccctgaagcctgctctgtctgtcctgtctatgtcccttgctctgtcctatcccagccatgctttcgtagcatctagtcattgggtatttataaatactatttagcatcaagcatcaatttctaataggtacagagaataacatctaatttagcatgtgctgtgttaataaaaagatagagaataagaatatgttctatggaggtgtggtgaggtatgggggtagaggcatcccctccccctgaagtaccagccacatgacggtataacatagaatagagtttattcaggccatgggaaggggagttaagagggtagcagagacagaaacgcagagagagggagagagtagagaagtagaggctgaccatgaccacgtggaaagagggggcagggaaaggggaaggaggggggaagggaagagcccaagagggcaaaagagaagcaagggagcatgagaacaagagagagaggaggggacaagcaaccccttttatagtgggtcaggcctacctggctattgtcaggtaactgtggggtggagtttagacagaatgctaacagcatgttttcacacttagaaactcagtgtttgttgatttggttggcctgctcatttgttttgagacagagtctcatgcagccgaggctaacctcacactcactgagtagctgagggtgactttgaacttttgatcctcctgcctccgttacctgagtgctgggattacaggtgtgcagcctggcacgcagtgtatacaatgctggcatagatccttgggcttcatgcttgctagaccaccaccctaaccgctgacctacccctggccccagaaagtcagtcttctctaatcctcggaagtacagagtaaagagagaaatgtgtgacggtgtcttttcttattcttttgcctggattttacaaatatgcagggaagacagagggaggttagcagtagataggtatgagtcccagctgtcaattcccaaagtcctgatatgggagtaaattctgatctcctggatcttattggtaattaatgattgacttatagctatgtgactatgcactatgccccacctggtgaaccctctgtgtgcattacagatcagaaataactggtgaacccactgtgtgcattacatggtgaacccactgtgtgcattccagattggaaacaaaacctaggtgtaccaggagaacaagtcctcctgccccagctctgttgcctttcaagcttgagggctggacagcatagactgacataaggtagagaggctcagaccacccctcaatatgttctgttctgtttcctgtctccacaggcaagagcttcactctgaccatcaccgtctttacaaatccgccacaagttgccacctaccatagagccatcaaaatcacagtggacggcccccgagaaccccgaagtaagtgagcccccttggggctggtaactgtctgggctggtgtacacaaagacccaccaggtctcacaatgtatctgtggcttcagcctctttcctgaagagatgtcaggcccctgaagacaggagaagtttccaggtcaactctctcacctctcaaacgttgtttgtgtgaactgggttctttctaaagctttggcttacacgtcaaagggaaattaggccaactcagatgagttaagaacactttgggtttgtttttgttttctgaggcaaggagtagacccccacatatacagcaatgttcagtgtgctcagacacaagcagtggatagacaattggccaagtacagggtgtgacaatgaagacctgaaggtcacggtggacaagaagagatggcttaccatccatgcttgtgttaatttgttaaggccagagatgaaatctgtgaaaatcatcctctctttttcccttgaagggatcttattctaggattgtttaaaatagagcctgggccgggcgaagagtactgggggaaaccagtaaatatagaaagatagcctccaaaataccccgaaactcctgtgaggagagtgtttaaaaaggagtggggttgtttagtctgaaggaaagatgtcttcagagtgacttaaggactatcttggagtaaacacaggagtgacactcttacagggccacaccccggcccaggagctgcagctgggccacagtccaattctgtaggcagatgagcccggaacgaagagcagctcacctccaaaccatgtcaggggcccctgggaagtgataccctcagaggctgggatgcgaaaacatggggtccctcctgcacccagaagctatggtgcagagagattatttgataagaatgaaggtactgagaacaggggccctagaacagtctcagagcctcccagaaccccagtttcttgtagaaaatgtatgtaaaggtgacagccgcattgtgaaacttaactagatgaagccaggtgcccggtgcagggcatgcgcttacagaatgtcaggaatctccgtggagcttccttgcctcgacccctcgtttcagtgtggtggttccattgagcctgctgaggtagttccctcaacaggcagccctgtccacacaggcatctcatctgggctctgaggtagtagcccttgggaatttggctctctgaggctattcagtggtcactctggctatggcagcgtctcctgcaatcatggtcatgacttctggtatctggaccacccttggaaccagtcacctctctgcctccatttccccaattttccctgaagcagtaatacacagagaacagctgcagtcaccagcaataccacagggcagagtgttcaccctggctgtgcttccctcccctccctgggctgggcagctccctccactctgcccaccctgttcccatttttattccctaccaaaacctgttgagcttttccttgttaacgtccttgagatttcctagctgtggtcaggttcagggaactctggggcttgtgctggatagcatgccctactcctttagagtgtgaacagcagaccaaggtagcacacagtcctcacacagcccaggaaacctcttggcactccctggtttcccagagtagacagtcatgacagaacacccgagggccatggcccagtgcaggggactggagaggaagcaagccgaggtgatgacttagcacagggccaggagagggggcgaggtgtaggaagactgatgctgagagtgaccgtgctcataggatggctcctttaggtgtccgtggctctctaaagcagctgctgcctccaggacagattatacaatggctgtgcacgaggaaacagctgaaaatggggacccatgagaagccttctattttccttattcttccacacctaagagagacaggctttcaccttgtgtgtattttttttcctggaacattccagagaagtgaggggggagctgagccttagaaaaagcaaacggcaggggaaagggaaacggcccccatattggggcccctgcttgcctgatgtgtatagatcaagtactcagataaagcacttgccgcctctgctattttataacttgtaagaacagtggaccattagtggttaattgtactattatcgtcctattcttttttatttatttttgtgctttgagttgagagacaggctctcactatgctgtcccggtcggccggaacttgctatgtaagccaagctgactttgaactcctgcctccccagaccctgagtgctggggttacagcgtgtgccaccacatctcataccggttctcatagcacacggatcatttccactggcactctgcccatcaccacttttggatgcagtgagaagtgaggaccccgtgtgcccgtcagggtggccagactggcacagccgtggagatttaggagcgctgtcccacccctcattaaggaaggatcatagattctggatgagtctggcccaagaaccctagtgtttgccacactgagcaacatcgctcagttctcccactttagcaaatcaaagactcagagagaaagaacctctctgatccttccaagaaaaggaaaatcagccctagagaagggaagcaaccttaggtttaaacaagatgatgaagccacagggtggagggggagtttttcactgtctgactttggtgtctgactttggaacacacatctgtccatctgtccatccataccatgctgtctgcacttcacatcctatgagttctctctcctgcctttggaatttttgtgtttaattgtggactggctttcatgatttctcatgtgggacccagctctgaggctgccccatagggcacaaggtaacctcgacgctgacatggttgtcaggactgaagctgtatcgtagtaggttgtgtgctccagggactccccagccttttgcagttcagatggttactggccggtcccagaaaccctctgcccccgagtaagtcaaaacttgcttttcacacagtccatgggatccttctacatctccagccaatacagaaatctgtgagcttgggggaattcagttccttagaggggaagagtgccaccggaaggtttttgttttcaggcagtaaatagaccatttgatgacttgttaacatactggaagatagtgtggtagaagatatactaaaagggtggtggtatatgtgtgtgaggggtacatatgggtgtgtgtgtagtataagtgtgtgtgtttatgggttcatgtggaggtcaggggtcagaggtcagcatcaaccatcatcgtcttcaactctacttgttctttaacacagggtctctctgtgaacctgtagctcatctgctgagcgatgctaactagccagtaagctgcaaggacctgtatgtgtctattctccaacactggggttagtgcagacataccaaatcacccagccaattacactcgaggtagggatggggacatgagtcctcatacctgggtggcagacactctactgactgagcaatctccttagcaccagcccctgctccataaaagggttttctcttcacaaacagaattttaagagtgggtttatgttgctttgatatttctagaaacatgtaaaactccatctctcaacccactcgtgatgagtcttgggaagtctggtacctgtgacttggggaatagacttcattaaaattcaaaaaggtcaagaaaccaatgctggctgtgtctgcgacagcttctgccctctggtaaagctgtccttggcagtcactgttcaagctctgagattcacagtgacgagaacaagatagagctgttccttagaactcagagccatcaggatgcaggtctcagtgtcttagttggggtttactgctgtgaacagacaccatgaccaaaaggacatttaataggggctggcttacagcttaggtccaagcctcaaatcctttgcatgaccctttcagtcctgggctgtcaactgcaactgaggctgcaccttcaccaatgacctaacatggcctctcacagtgccaaacctctgctgctcttcatgcccccttcatgccttcaacaccaataccacctgactgactcttacacattaccaagtaccactgcagcatgaggcacaaccttggctatctctggaacacagcttctttgtactctcagaaaacacttctcagaagatttcacctcagtgatgctggtctcttcttaatcactgctaattttgtagctccagctcacgagcatccattttcccagtagccccttctattcttgactctaaagcttgagcccaaactgctgagttctgctgcttgctggtgctggaacatggcccccttgttctattacattatcagtgctgggattaaaggtgtgtaccaccacacctggacttaagcttttcttcaccaagagcttgctctggtcccaggctggccttgaactctgagatcttcttggctttatctccaaggatagccccatgcctggatctaaatttagctgagtaggatcttgccccaaagtcctactcccttaatccgatatctcctagaacatgggagttggctccattctgcttcctggtgcccctttactatttaaaccatatattttacatttttcctttctaagcttgctatgcttgcttaaaatgctcttcatgagactcaaccagagaacaaagtctctgctgggtgtttctggacttcctttgccattgcaattaatctgagtctcttctccttagcctcaggcagactcttctgacaagggctaaagccacccatattcttcatcaaaataccataaaaacagcctccaggccatgtactgaaattcttttccactgaaacttcttgagccaggtctgcacagttcaaatcactctcagcaaagaagtcttccatattcctaataggatggcccattgagccctagttaaagcattccactgctttccaaatccaaagtcccaaaatctacattttttccctaacaaaagtatggtaaggcctattacagcaataccccattccctggtaccaacttttatcttaggcttttactgctgtgaacagacaccaagaccaagccgggtgtggtggcgcacgcctttaatcccagcactttcgaggcagaggcaggcagatttctgagttcgaggccagcctggtctacaaagtgagttccaggacagtcagggctatacagagaaaccctgtctggaaaaaaacaacaaaagagcaaaacaaaacaaacagacaccatgaccaaagcaactcttattaggacagcatttaattggaactggcttataggttcagaggcagtccattatcatcaagccaggaacatggcagcatccaggcagacatggtgcaggaggagctgagttctacatcttcttctgaaggctattaagagaatactagcttccaggcaggtaggataagggtcttaaagcctacacccacagtgacacacctactctgactgggccacaccttctaatagtgccactccctgggccaaatatatccaaaccatcacattcaccaactgatcgtttctagatgaaagtatccttagaatggatcaactcaagggcctgtcagccaactgctttttagagagttttgttgaagtcgtcctgggagtaaatgcacgtgcttctgtatgtgtgtgtgcatgcatgtacacatgtgtgagatgtgggacacgcatgtttatgcaggtgtgcctacagtgtgttcccacgtggaagctagaggttgatgtcacgtgtcttcgtccttcgctctccttctgccctttcgtttgtctgagtcagggtctctcactgaacctggaacctactgagcttgaaattctggctagattggctgatagtgagtctccaggattcttgtatgttgacctcaccagtgctagggttataggtatgcgctgccacacccggcttttagacagggatgctgaggatctaaattcagttcctcatacttgtgcaacaaacaccttactgactgaactgtgtcccagcctcatgaatttattttcttctttgattttgaagggacatagcagacaataaacaaacaaacaaacaaacacaaataaataaataaaatcttacatgtgtatgtatgcatgtatgtatattaaacagaacctttatatttgatgaataatttctaatgaaaaagcaaaatgcatgaaagacatctgtaaacattcggtgataatggactcaaaatcgagactgttagaaaagagtgaactgggtgtttgtggctttatttcttaacattgaaagcagtgcagatctttttcaagatattcttttctctggataagaagagttactaataatagtggctgacattatatagcactcattatttgcccagcacctttcaaagtgctgcaggcatattaatttataaaatcttgggagaaacagttaaggtagttgaagcaaaagctaattaagaaccctacccaaggtcacccagctaatcagccagaatggaagctgtggaatccagatgttgcacacctaggtctgcttctgagcactaaggtatttgggcctcgctgcattgtgatgctgtatctttgataaggaaggcttatcacttgggtgtgactcacatgtggttttcctatagctttgaagctgccccagacgtttgactggagtcagtcttcctaccggtgggtgtactgagttacccacgtgcttcccagggagttcccaatgctgcctgctgccacgtgtgctaacgattggctctgagggtcactgaggtctgcttgaggacatggtggcaatgggacgtaaaccagggataatgcaaaaacctatatgtttcccaaagagaagagtacgacagtgaccgactggagcagccctgagggcaggtgtctaaacggggatcccctttagcaaagggtcccaggtaaagcttggacactcagtgtgtgctcttggggttgccatggctagtcatggtgctcacagggaaccgtgccacgtggctcccaggtccttggagtgttcagatatcaggcgtgtccatcagttcaaggcagaatcatggtgcataaaggaaaatggagagtttttccttccttccttccacccagatggaaagcaaaagatagagcgtcaagagcagtgctctgtatgcctgctcttcccctctgaaggcatttcaggttaagcagaagattctggggggcttcacccaagtattttagttcccactctgctaatctctctaactacctagagacttagggaagcagttcttaaaagcattaataataactgtgcctaagtgtttctaaggaatgttagaatctcttcctgtttattattttagttattggacactagacctagaagagttttgtgagcatcaagatttccctgaattcaggctaaggcctagaagtttctctggggcaactgaggatgtgggagaaaagatcatacttctgtctttgtgaacagcagcagtccttcatgacactacccatgaacagcagtccatcatgacactgcctgtgaacaagagtctatcatgacactacccatgaacagcagtccatcatgacactgcctatgaacaagagtctatcatgacactacccatgaacagcagtccatcatgacactgcctgtgaacaagagtctatcatgacactacccatgaacagcagtccatcatgacactgcctgtgaacaagagtctatcatgacactacccatgaacagcagtccatcatgacactgcctgtgaacaagagtctatcatgacactacccatgaacagcagtccatcatgacactgcctgtgaacaagagtctatcatgacactacccatgaacagcagtccatcatgacactgcctatgaacaagtctatcatgacactacccatgaacccagcagtccatcatgacactacccatgaacagcagtccatcatgacactaccccatgagcaacagttcactatgatactacccatgaacaacagcctaccttgatactaccccagtgagtttttagtcagtgccccccttctgtgcagaagttgttaaagtttaggtggctcttgctgcctgaagcaggttcttcccaggtaccaggaagactatacaggcataagcaagacacctcctcagtttggcgcctggaaaagagagaagaaacatataatgaatggaagctaaaccatttctttgaatgtatttctttgagttagagcactgcaaaatcatattgctacttagaataccatcccagtgaaactggggtctacgctgatacactgtccttgttaggaatgattgtacgaagcgcagaaagagagaaaagaacccaacaatgtaatactgtctctggtgaggcttccgttcttaatcttaaaatgtgtaaaaagatttcaggatccttaactccgggacctaggctttcaccctggcgccatcgggcctgtgggtgtgaacttgggcaattatcttaagtactttttagtccttggtttcctcttgggtcaaactaggcaatgagacgagataatctctaaattagttcccactcgagctggggtaacaaaatcttgtcagcaaaacagaggtatagcttcttcacaaacagggcccctttacaggccacaaccctgagctgaggtgatcatccttcatgtcctcaaccagggcttccacagtggttttcagattctccctctccctgtccctctctcttcccctccctcctccttcccctctccctttctctctcctctttttcccttcccctaccctctctctgttcttgaatgggctttgtacttcatcttcagtttctctagctataagtaacaagcctaatgtccgaacagccctgatctgatgcctctgccactcagcttgggatgctgcacgtcatgcttgccctgcttagctttgggatgctgatacctggctctctgtccaacagagacaatggccatccatatcagtgtcatggggtccctgggaaccttccctgggacacagtatacatttagaagacgtcggctattgtttgtatttaccttggagtcttgtgggaaatgagaaaggacttttgacagaaacaacaaagggatctgtgaattcctaaatttaaaaattcatgaagtggccttaatgttgcgtttttttgagatgtaattaaacatttatgcattttgattttttttatttcagatttttttttatttaggcccagtaaatttcttttctggcatattatggccccttaaaatattctgggcactgttcctaagtccctcacggttccaaaagacttgtccccaagtgtcgtactttgtgaacaacttgaagaaaacttatgtcctggtaacaaagaagctcacacctgacactcgggcctcagtgtatgcacgagacagctgatggagagtcttcacattgttctagaaaagaacagaatccccccgccccccatctgcccttgctgaccttagggcatttgttccaggaaccaacacctcagatatctgccacacggaagcccctgatatcaaatggcagattatttgtagataacttgtgagcatcttcctgtagactgtcagtcacctccgggttactgaagtactggagacaaggctggataaatgaatacctgtgagactgtgttgttagggaagtccgtgtgtgctcagtgcggcactttttcttcctcaagtattttcagcctggatttggttgaatccggttgtatcagctgcagatgtggagggatgaaagatgacagacagacagtactgggatcatcactccagggtgcctgtagactctagcaagacctgtacgcggtgcacacacagaaagcacctagcctagacaggtttctgaagggctccctcccattgtgtgtatgagagagagaggagggggctctcctgctacctgtggatgttgctctgggagactcagctgttgtgcatcttccgtggggacaaatgacctcccagctagctgaaggtctgtggcagacagcccctgttgtcagagcacactaccatgcctacctctcccctttccctttccgaggcaatttcaattctttcaaggcctaaccactttcccttttccgttttgaaggaactcgggagttttcccgagggtttaggttttcctgtaaagctgtgtgctgggaaaggccattaggaaaagcctggtacacagtgtctcaaaggacccggccactgacacacacacacacacacacacacacacacacacacacacacacacacaaggatttttttcccccaaagctttgatcatataagtaaacttcatgctcctcattttagatctgcgtctaagttcactgtagctaatttgaatctgcctctttttttcgtgtcttgcgtcggaaaaccttttgtaaggtgtcccgccttggggctctggcagcattagatcgtgcccttaggaagggggtaaattaactccaatctacctgtgagtgtttctgctgtcctcagacccgggaaagcaccggctattagccaggtgccaaatgccctcttagtggctcagttttcgtcaaggtcaatcttaaggttttccctgggagaacttgcaagtgtatcaaactttctcagtctctgtccatagtgaaagccaaggttagaaaaaatatttaagcacccaaagggaagtccttttcctgtgggttcccccacacacactgccaccaaccccccgcccccacgccacccttaaagcaacacagtggaattaatctgcaactccccaggcccttgtgaagtccattaatggtgatgcattaattttgtgctcctaggaattccatatgcccaggttccattaaagcaagtattgactaaaaccctctctgttactgaaaaaaaagtccagcgtacttgcctgccctgaaatgccgaacagtgggcattttatttgcttgctggatctttttacttttgtacgccgtggctggtaagtcatattctagtcatttgaggcaaaaatgtaaacatttgaaataagtcacttcgtaagttcaggatgacttaatggtcccttttggaattctgacccgagtatctcagccttacttgcctgtggggtggcttcacggcgtttctggtccactcattttataatgctacgagcaaacgtacaggagggacatttttactcctgatctgaccttgttcctggggccccagtcccaaatttcagaaaagaatcagagggttcgacagggagtaagagagggaattggagtcagacctctgatacatactggctgtgtgcctgtttttccctctgtagaaggggtttccagatgcccaccttccaaaggggaagatagaccaggtgggcgccattgctctgaggctagctgcctgactccagctcccgaactgtcttggctctgataacaaaccttcgtcacagggattgcaagaccatgcatggagacttccatgtgagggtgcttcacatagccctgcacatagcaccctgtaacatttaaagcacaaaccaggaacacaggcaagtcagtctccttcatccccaaccttgtatttaccaaaggaatcacatggaattctgccgaagtgttcaccaaatatttaccaataccaagttatttaaagatgagggggaaacctggcaaattggttccacaggactcagcacttggagccttttctctttcaacttgacctcacggtcactttaaatcccgaagcaccagaaaccaaacccaagccttaccaaggcaccaccttgtgaaacctgcatcgcgcctgcctcttcagagaacaggcaggtgggtccagatagaggctttatctgtcatatgtagctctgtttcccagcagaacattgggcatccatgttgctgtcacctaccaaagctcctagcatctagaaaattctactgggtcagctatgagtaccatgggaggggagtctctctactgtatagggtttcgtcttatttgagtggtatatatcaaagtgtggcttatcaactaagtaagagaaatagcctatccactaagtaataggaatacaatagatgtgaatgagatatttgcaaacaaagcaacctgaaaaccgactgctaatgttttacaggtattgggcaagatccttagtgatcttaaggaaaataatgattgttctcttaaagataattttggttttgttagacttgcttgttttatattttgtgcatgagtgttttgcctgcttgtatgtttgtgtaccacgtgcatgcctggtgccctggaggccagaagaggtccttccatcccttcaaactggaattacagttggttctgagctgccatgtcggtgctgggaaccaaactctggtcttctagaagagcaacacgtgctcttaactgcagaactatctctctgcctgaaagataggttccgtctcgtctcgtcagattggtgagaatgcaggagaagtccgcatttaaattagccacccctgttaagctggacttggagaggcttttccctcctcgtttgcctccctccagaaactttttaaggcacttggaaacaaaggaagcagcctttatccacagttcagagttttgcttaaattcattttcttttccaggaccaaatagtttttcttctgcatacggctctcatggcggcaaaaccataggagagaacagcgtagcctgctgcttctgagtctatatttcctgtgtgtgtgtgtgtgtatgtgtgtgtgtgtgtgtgtgtgtgtgtgtggtgtatgtatgtatgtatgtatgtaagtatctgtgtgtctatgtatatctgtgagggtgtatgggtgagagacagtgtgagagtgtacgtctgtgtctgtgtctctgtatgtgtattcatgtctatgtgtgtctgtgtatgtttatgtgtgtctgtgtgtgtctatgtgtgtgtctatgtatgtttatgtgtgtctgtgtgtgtctgtgtgtgcctgtttgtatgtgtatgaatgtgtgttagagagtgtgtgtgtctatgtctatgagtgtgtctgtgtgtgagtgtgtgtctgtgtgtgtctgtgagtgtgtgtctatgtgagagtgtgtgtttgtgagtgtgtatgtctgtctgtgtatgtgtatttatgtctgtgtgtgtacgtctgtgagtgtgtgtctgagtgtgtatgtctgtttgtctgtgtatgtgtatttatgtctgtttgtgtatgtctgtgtgtatctgtgagtgtatatgtctgtttgtgtatgtctgtgtgtgtctgtgagtgtatatgtctgtgtatgtgtatttatgtctgtgtgtgtgtttgtgtatgtctgtgagtgtgtatgtctgtctgtgtatgcatatttatgtctgtttgtgtgtttgtctgtgtgtgtgtgcctgtttgtatatgtgtgagtatgtgtataaatgtgtgtgttacagtgtgtgtgtgtgtgtgtgtgtgtgtgtgtgtatctgtgtctctgtgtgtgcctgagattcagtttctgggaggtgaaccgatccaccctgtgccccgtgcctgcctcaaacccttcagctacttgatgctgaggctctggaggccactgggtagtccgtgcatctgccaacacactggctgggggcaggatcagagaatcttttctgctctgagagtgattcagccattctcaaaataaataagtagcagagtgcagagaggaagaagtggaaaacattgaaatctgagtctggagggcggagttcttctcagcagggctcctcaggggcagtgcccaatggaaagccctcaggccctgccacctggctctgtgcaattctcagcttctgctggaacttcagttttgtcatctacaaagttgggaggagggtgtagtgagggctaaggcactgatgaactcaacgcttgattcaatgtttccaggagcagttgaacttgcaaggcatcctcttccagcctctagcaggtgacctgctctgaggagtgtgtccaaagggggatggagaagagatggccactgggggtgtggggggaggggctagtgaggagcaagatggagtagggccagagggaggatcgacccatccagcccaagctgctgcaaagggacaggaataaatgcagagtggagtggcttaagcaggggaaatcatcaaaactatatttcccatgactttggcagccttagaaaaaaaaaaagaagaaaggggaaaaaaatctgtaaacacacaaagtgctcaattgtccgagcctaatggccaacttcccaaagctggccggccagagaccttggtgttaattcctcagccaactggaaaaaaaaagatggtgtgagttctgttgacttaattgccagagcgttgctgagtgaggctgcaccccccccccttgcgtatgctaggcctttcctcattacctgccctacctatctccacaatctagccacaaacagctttggttgaccacaccacttccctattgaaagttaatactgtttgactcattcggtgctgcttaacccgaagccaaagaaaacaaggcagagaatagctggcttgtatggagtctggaaagccctgctcggccctgctttcaaagtcctatacagtagccttactatacctcagctgcagctgcacagaaaatggaggaagcagaggtgaccctctgtgtgtgtgtgtgtgtgttggcgagggaggtgggggtgggggacggagaagagaacaggaagggaatggggtgccccccctggggggctggaagagacaacagagcaatctgcccagttccgggattctctttctgggctccaaagtgtatcctaacagacagcagtttctgggctgaacagatacactaaaaagaaagactcaaaaacccattggaaaaagcgattttcctatagaagacagcagagagaggggagttggatctcacctgaccagcttcccataggacagtccctaggtgaccagggacaaggcccaccactgccaaatgtgggaaggactcagaggcagaaggttgtcttgggttgatagggaggtagccacactgctccctactccttgcctgagatgaggtcaccaggggggcaaatgggggtgaggggtggggtgtgcttccaaatttggaatgagtagaactctccctttgtaagtgaccaggccggtgctctgcaggtacatggccgcttgctgatgggtacttgtgactggtagacaagattctgctcactcggccattcctggattgtagctgccgcccctcctcctccccagtcacacaccccagtggctgagagacagagtcacccccaaacaacttgaaagtaaccttttcttgagtgtggcactcagccagtgctttgctaaaacacaactgtgaactcacaggtgctcagcgtctgccctgtgctgtctctttggtcccttttccttgaggccagcctagagctccaattggctctttttttcctcttcaggtttagggattgatggagccttttctttacccccttttcctaagcacggagggagaaagatcgttgttgatgctgcgagccgagaaccccagagaaggacatccaatcaatcactcactcgctcgctttctcactcctccgtccagccaggttttacagggacatcactcagcctcctccaagaggcctctgtttatctggactctgtgcaaacatactcagcaccactgccaatcacatgtagcatggcaggaacaggagaaggacagctcattaggagaagtgagagatgcaggattgctcagacccagcgctgagcatggagatggaggtgggggcctctgagtgtcttctccttcctcccaggcccgtgcaacctagggcttgccctgctgaaggcccgagtccaggtgcatttcagagactagagagctctcctgcctctgcctgtgtcctgcagtcctcccatggctgtcttccctgaagtctatccgtgtcagagctgctccggtagatggataagaacagttacatcagcttactttttaattacactttacagagggggggtcctgagaccgtgctttcaggagagttagataacagttgagattacaggctggcaaaggagcaggtcttgccgtgtgagttccctgcagttctcccacaggcagccacccccacggaggaccactgcgggtcaggagcacaagataaccagacggcttctgctctaagctacaattacctccttagtcaccagacaaagcaggaggtgagggagggtgatgaccacagagacaaacccctctactctcaggacaccagggtcccatgggagccaccacacctgaagtctgtcactcaaggcccagaatggagaatgactgatagagactgctgctttttttttctccctgaatcctggggctcaaagagggagagaggagtcctggggcctcagggagcaggagaggcggggcctgtcagcctgttgtctgtgactgtcaggcttggtctggatttggcctccgctggctttactgttccgtgtgtggatcaaggaatagtttgtgtctgattgagaaatgtgaatgtgtatgtgtgcatgggtggatcacacacaggtacacacacacacaaatatatgacaaatgcatacatatatgtgtgacttatatgtgtgtgtgatagatataatacatatatagaacatgttatatgtatatgtgatataaacacattgtatgtacatataacatatatatgtgctatcgtgtatatgtgtgtagtagacatgtgctacatacatgtgtgtagtatatataaacacattacatatatattacatatatgtatgatatgatagaagtatgtactgtataccagcatggtgaagatatgagttgataggaatatatagacatgcacatgtgtgagtatgtggtacgtgtgtatgtagatgcatgcaatgcacatggtataagcatgtggcatatgcatgtgtggcatcagcatgtgtgtgaacacacacacgtgcatcagagaaaagcagaatccactctggctgctgactcatgccagtgtgctgtgcttggctctgcacaaggctcatgccagtgtgctgtgcttggctctgcacaagggacttgtcttacttttccgcatgatgaaaagaatggtttggtgacagatttgactctgacaggacagttcttcagggagccacactgcccagcctgagactttgcctcagcaggtatcttcacagcagtcatactatgtccacacagcagtcacactgctcacacacttagttctggattcctttgccccaaatgaattaattctactttcctctagtcttgggaaggaagggtggatggtgctgatcaagaatatctgtttgctgggttaaagctggttgtttagtcagcatttagccttagccggatgtgtgcccggagccttaggtactaaggagacagcaggattcatgtctccatagactcaaggttcagcaggcacagacacaccacagtgacacaatggtgctgtggaaaaagccagatgctgagggtgaagccagtgggtagagttcatgcttagaatgcataaagcctggagtttaatccctagcaatgtgtaaacttggtatagtgtagatacatgtctctgcagtactcagaaagatcaggagttcaaggtcatcttacatagtggtttcaagacgagcctggattacatggcagcctgacacacacacacacacacacacacacacacacacacacacacacacacacacacagagagagagagagagagagagagagagagagagagagagagagagagagtcagagctctaaagactgtcttaatggttaggttggggacaagctctaaagaccaggtatttgcctaaaagaaacactaaggaaatcgagccaaggcatcccatgaagttgttaagaagcagcaagcttagagccatccagtcagccccagccgaggagatgcgggcggtcgggcggcagacgtaattgccatgggtgcccttgggaggaatccaccttagtcctttaattccagacttgcagataaggagcccacagaagagtctgcaggaagcacagacttagaacaaggggtgccagatgggtagtggtgtctcctagtgagggccgcctcagcggggaggagtcagaggctgcattgacaccctggccctcaggggcactctgagctctgacctgctacatgtcctaaatagaacaataagctctgtatgagcaccatggtccctgctgtgctcacactccctctgacagtaaggcaggtcccacttctcccgcaagaattctgaggagtctctaactccatgctactcaacctatgggttgcaatcccgctggcaaccgtctagctccaaaaatatttacattatgattcataacagtagtaaaaaggtagcaatgaaaaacaatgttgcagttggggttcaccacaacgtgaggagctgtattaaagggccgcagcgttaggaaagctgagaaccactgttgtcaccaaggccatctagccacagcaggagatatgacaatcagcaggaagagcctctctgcatatacctaacaacggtttaaaaacagaccaaaggatcgccagtcttcacaccgaatggggccatcacaaagtggccatgaacttagagtacagccagtcttcagtaaatatgagccctgcacgtgccaattcattcaacaatgaacagaaatgttcttcttagaacaaacaaacaaacaaacacatgtctattaagtgggaagacttttcttcttgttgttccccaaaagatacaatgtaaaaaaaaatctgagtttcagaagatggaaagaattcaggaagacatgcgtgggttgtaggtacaaatatggggccgtttagatcagaagcttgaatgccaccggcttggtagtatacagaaatcaagcagtcacccacatatactgaggtagggattgtaagtggtattttattctccagctctctgcaaagcagaagtctgtaggagaagggaagtcatggtgctcatgggaaattcacgggccaggagggggagcccctcccccctcctctcacacatatacctggcaccagcaatagcggcagcacacagatcttcctagaaactgaagttatacaggtctttactctagacttcctagcaagagtttccaagtgctccgggtatagagatccctcagagggctgcagaccactgtgcccctctggccctcctcacccatgggtcatactggggacagaagtgggacaaagaggagtgcatgacctgtgatctaaactcaatttggttgtgtctctgtatttcttcacttaggcagggagggggtcaccaaaatcaaaacaactcattctgggtgctctgggtgtcggatgggaggactggggcactgagggtgggttgggacccgtattcttcctccatctggctgcgtgagatgggcaaaacgttagaacctctctgaacttggcttgtcatctgtcattttaaaagatatggctgatttctctggcccttttctagttcttcggtgtaacagctgtgtcctgttttctttgcatgatggcacgagaggaaatgaagagacgagatgaaaccatctaagttcacataacatcagacaatctgtaaaaacatacatatataaaatgtattagggtatatattagcatacatcatataatatcattgcatgttttaggtatagtacgtggattaatttaaatgtagtttaattaatttaaatgtttgctaaactgaatttctctctctctctctctcttcccccttttacgatgctagcactgagacttggggcctcgtgaatgtttggaagcagtttctcactgagctacatgcccagtgctttgtaatatgtgaataatatgcaataggagacagtatttctcaacatttaattagctgggagatagccggtttgctggttggaaggcttgtcttactgcaagacagttcaaggaagggacagagctgagttcagtgcagttagccactgactgggacacaaagaagggggaggggttctctacactgcccttccatagacataaaactgccccaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatatgccatgtgatctatccaagaaaaccagaaaaactgcggtcagaaataggagctgacaggttggctaatcaaaggtttccaggaaaatctggcaattccacctcattgccttgatagagaagcagatgctctatttcagtcatttacagccgcagaccacagtggtgccctggcaaaggcagctgaggtggtagtgagttgtgcatgctattctgctctgtttttaacagaaagaagatggcaactgaccttattatctaccataaaatacaataacgcttaggggtgctctgatgggcagccacctcagggaaatagagagacctgtctgggatggagccactgggcagagtagcatgagtttactttattatatctttctcttcccattttttgttgttttctaggctgtgtgtttataataacattctgagcagtgttttctcgaaatatgtaaaaataataatagaatatctgggacctcctttcagctctgtgtgagcttcagaaagatgcacccagtaccttgtggtcacagcttgaagccccactctggaaaccttcacgatggactcgcagtgaacttgaaagcccaggttaccagaatgtgtgtgtttagtctatgttacagtcctccggtggtttgatccagtgttgaattccctgttaccctccagagcccagtaatcagtaagagtgaagcagggatttcagagtgggcactttccatactcctgcatttaaaattcagggggcaaattgatattttaatagcatacagatccaggaaactaaagacataaagcattcattttcccccagcctgagagtttccatcggaagctcctatgttccatgcaaaatattgctgtttggcacacaaagcccaatggtttcagaagagaattaggtgctcttgattctaaatgcacttggggccacgccttgaacatgatgatgccctgcgttccctgggtgtcctggtgttgcaactctctaacaccctgtggatgtggggttcaagctttctctcaggcagaacctctcctaaagactcccagaatgcacacggagagagcatggaatgaagtattccctaatccagagcactagacccagctcgggactttctagactcatggggcttaggaagcagctctgagaagccaggcccaggcattcctgccagagcaggcagtcatcagttaatctctgtaaatgactacgattctggcaggtgtcagctgctacgaaaacagatcacatattaggagtccttttttttttttttaactgagtaacgagggaagagaaataaaaataatatgtcacgtgtgttggccacataggggcttgtccacttgccacaaacagcttattcctgtttgagttctcagtgatcaagtccccaaattcacagagccagatactcagatagccattcttcaaaggctggccagagacaccaccattaactgatgctctgactttagaatgatcatgcacacaagtgagggggctcatgcgcacgcgcgcacacacagacacacacacagacacacacacacacacacacacacacacacacgcattcccttcctatggctacacactgtccttcacggtgttcttccaaaatgccactgggtgcctcaggaatgcgaggctgcgacacagacaaagcctgctgcaagctcttgctgacccacattctttctgagaccatacaagctatccagcgtcatgtttcccaccttcctcttccttgactggcatgagagaccacggcagacacttaaaaggggccgcatcacgctttaaatggctttagagctcagattgtttttctgtgagaaagcctgaggtttctcaggtgggatgaggagtggggactgattgggtcgcaaagaaaagaagagggaggatccagagagggctgcacaccgaactacatatactaagactgagcaaggtagaaggctctagaaaaagaagtttttgtacttctgctggtaaaaggctggagggggtggctcgggaacttggcctcttttgtccatagagctttaaatactccggctacaagaggcctctcccatgcgccccggccgagcctgcgtgactcagggtgtttgtgtttgagtccagtgttgtgagctctgaatgacagtccagatttgccgtggcgatacgtggaaagagcgagcgctgcatgtgaactacacaaatattatgcttaagctttttttttttcctccatttggagccaaacaggtcttgtcagtgataaaaattgctgcaatatagtgggccctttttctggcctggaatctgagaccgtgtcggcagtgccaaggaggcccatagcaggaagaaatagcaagccgcggggatttgaaaccataacacaacttctacgacataattttataattgtagcaatcgggaactaggtggtgggcggggtagccttgtaaccactcctgtgctggaagaatggtccagggtcctccgtgtagctctgggctgggctggggtagcagcaacagcatttctatgggcagaagccaacggcttcccctgtcttgttgtgaggctgtgtacaggaggatgattgtggctcaggctgtgtaaccattgacaggagaatggccctggctcagtcaacggttctagtcaaacaaaccttgagaacgaggaggaaacaacaaagtcggcctcttaaaaggaggaatggatctctactgtgactgtgtgggaggctgggctcctctacaatctctagtctgcataatactttgaaggggatggagaggaaaaaaaaaaaaaagcgggaggcccagccctcctgactggcccacgtggatgcccctacttgctgtttcctggtaacagagacacctaccacccttacaagacagcaagcatcccaccttgcttttcattccgagggaaaatcagcagaccagctggccacgccctctgagctcccaagggcctggcctactaggaatattggaacagacccacgctgcacctttctgcctacttcctcctagggatccgcccagggagtgggcttcagggaagtaaggatgcttctgaggagcctgtacgaaggaggaaggggcctgggtgtgtgagggcagagagggatgccctgtgcctgcctgcgtgtaacaggaaatctcactcctccgctgtgggtttgcagctgcacccaatttcctgttgaagggacacgctgctacgttccagggcccactctggcacctctcagacctgctgctcgggttttcaggaaggcagggcattcttgaccccgggagggcacctttcttggctgccacagttctgttcccagcctgaggcccacagccaacaagcaacgggcttcttacccggggccaccatcagcagttccgctcactagtgtctgcccacccgaggggatgtgcggagagctgtgggcaccgagtcccagactgaggcaacagccagggaccagtgggctgaaggaacctcagcgggctatcagaaggatagccctggttcccacaggcagccagcccaaggggcaatgtccaacaagctcaccttgggggtgaagggagagggaggggaaagataagaaaagtcccctccacaacacgttttctgatctcttccctccctccttaccctgcctccctctcctcctcctcctcccttccctacccggtccctacactaggacacggcagaaactagatgatcagaccannnnnnnnnnnnnnnnnnnnnnnnnnnnnnnnnnnnnnnnnnnnnnnnnnnnnnnnnnnnnnnnnnnnnnnnnnnnnnncgcagaaagcaccggggctgccaggcctttctgggtgctctaagggaactgttgaaaccccgcagcatcagctgggagcttaatgaggagaacgctgttccatctgcagagtatctctactctgagaagtgtggctgctgagcatgggagggaatcgtgactgtggaagccatatgtgtacatggctacacgcgtgtatctctcttggtacccttgcagttatcggttccaggtatcaaactccacaggagttcaatatgtcctagtacttgcctaggcctgtggacatcatcctggagactgtaatccgttctgcggctagcatctaacacgctattcatgctatgttgacaatcaccaagttatattacgtagggaatcctgacgaaaatacatttcaatatgtgtacatttaaaaagctgtattatcaacccaccttcggtttaatctttagctatagagccttcagatacaaatagcctcctgtatagaagctgacgagaggtttttgtaagacttgttttctactatgttgttttcttatctacccattagtcttgaagccacgatacacacagttgcttgcatgtatgtatgtatgtatgtatgtgttgtgtatacatgtataaacacacatacacatacaaatccagcaaggggtttttaagttcttgttgcctttagattttatgctaagttttcatttaatatctcttctttcaaaatatgaaagaggcatgcgtgtgtatgtatgtggtgtgggctgtatcaggcagaacattttcagatcagtagcgtgagttctggtcactctgtgggccagtcaccagtggcaaacacgctgtaagatgtaataactgcacataccctctgtgccaagttagataatgctcactgcatttccccagtcggacggctgacgtcggaatctgtttgttcagtgatataccattataataaccaaaaggcagttttctctgggacaggtgggacacagctattaatatggcatgcttacagcaatactcctgcagagatgcaggcctgggcaactcaaatgaagggatgagcagcccatacaaagaaaggggcagaggatgggcagcaggagtggggctctgcccttcagagaaagcaaagactagtgtcctctgagcttcacaggagaaaagggggcatctacttgataaggtttttatctgagccgattgctgtctctggggagaaacacatgcagggctcacaaataggcccacattttccagaatgtaatatagaaagcctatacccccaggcatggtattacagtcaagttatcatagtacttgcaggatggagacagcagaatcaagagttcaaggccagccatggctacgtagccagcttgaagccaaccagagatacatgagaccgtgttagcacagcacagcgcctctcttttatatgaacagacacaaaaattaggctttcttcctaggtatgtttagaaaaaggccacaccaaaatccttaggtgtttgtgtgtgtgtgtgtgtgtgtgtgtgtgtgtgtgtgtgtgtgtaatagtgacgaataatcactcaaaatacccacactaattttccaaggtcccacagtgcagctcggtggtgaattgaggcaaatgacacactttaggtgagatggatggactgtgggagaaggagatatccaaggacatttttctgccttctgtttactctcacttaagttcacacacgttttctccgggatcccatgtctaaaacccaaagaaaaggctgttctcttgccctctcctggctgccccgagcgcccgtgagctgagaaggaggctggtcttttacttacagtcaaaccaaaactggtaagcgtctttaaagccagtgccaaaccatgcaggagcaaattcagatggttgcctctgcctgcctcatgaacccggactgcttcagtttgccgtcttacatacctcgtccctagaaactgcagagggtgggtgggctcaagggagccctgggcctttggaaccacccacctgtgcacagaggcatggtcatggacaggtggctgcgcatcggtgactctccagaacactgcacttgctcttagagtgtcctaggggcttggttggtactctgagaagatgtgtggactatattgtggattttttttcctctccagtatataaatttgataagcagggatttactggcctccaggcagacacgcggtttcaaaccccattgaagatactgcatataaaaccaatttctctttcttgtgttctctctcccaccttctgggtttctctcctctcttctttcttccttctcccttctccggctcttctctggtatctcttcttataagaaagtgctattttatacaaatctagttttgagtgaactcctgattttttttcacccttgaaatgtaaacattaacagggatagtgtaacaggcaagttcttcacattgttcctggcgttgcgggcagttactgcctggtcctagccgtagagcacacgtgcctacttaaggtgggaatttaagcgatgcaccatgggactgtggctctctgaaatggcagtcacagttttaagaaaactatcccagaagtagccagggcggtgtcccctggacaccacagagacacaggaatgattgtcagctttagaggtgtcagtcactgcaggggagcgtctgtggagcagcagaagactgcaggctggagccaccccttggctctgccagcagaggatcatgggtatagaatatcacatttccttatcttaccaaatagacacctcgagtgatctgcactggggttcagatggagagggaagacagttaccatgccaccaaaccactgttttgtttgttgaggttttaactttaaaacagccgaggttaatttcgacttcctatttgagcaagtctttgagtggaatagaaagctgttttgtcatggctgcctgtttacgcaagtcaggacaccattgttaagtcctgccaaatttcagggcttttctccgttccttttacagcaggagtagagcagattacagagttctggggtagccgggcctggtccctcacacctcccttttaggaatggctccaagcaacacacatgggtcattttaggtcttgggctctgatttccctgggaaccatcatgaaggtgtcctgacttctgcctgggggagggggggagatgcagataaggtgtaaagatgctgattccgaaatccttcagaccaaataagtactctaagcctcttgctgtaaagtttaactttccttggattcgttgtgatgaagctgagcttagacttcgaggtctacactgttctttttgctcggtaatctctggtgtgacttctagacagaaacacagtctccccaacttcttccagctttgttacggggtggatatgaagtcaaatccagacctctctgaaggcacaggcaggaaggtggtgtggaaggacacacttgtgctcctggctcagggactggtgtgctactaggccgacaggcatggagaggagttgggctagccacttgtgtagaagatgtggactgaatgtgtttggttgtaattggaggttgatgctgctgtcgacgttgataataacatcagactgtgtgctggatgtcttgctaagtcatgtttcggggcattttatttttaaagatgggtagaaaagaaagccaatcagaatactgaaattctgagcatgccctaagggggatcatggggtaaggggacttccagcaactctttcttggggtaatcccacacacatttatgagtctctctcctgtggccttttataactaaagccttcttcccaagtaccatgagatcagcctagatgagagcagatgcccccatctgaagctccacgtgaccgaggaaggccacgtgctctcaggtggcccccagatttccagttttctaatggattgtcttaggctccttccaagtccctttgaaaaagttatattcgctactgtctgtgaggttcttagaggtagggttaccatgtcagggcaattccctccaccctcagaatgtacgaagggaaggaagcatttccaccttccagagtaaggagcaaactcctgcatccagagagccaggccacaagagcatgtgaaaaaggcttgtcctgcccaccaccaactcacatagcataactagcataagcagggggagagaaagggacctgcgagcccttgccgccctggggtaaagcatgggactgctcagcttcgctgcctgcttttctctgcatttctgcctccccccccatcccccaatctgtggtgtgtgtgtgtgtgtgtgtgtgtgtgtgtgtgtgtgcatgcgtgcctgcacgcacgcatgcgctaccttttgtgtttgtctctgtctttctttgtcatatgcctgtctccacccctagtcacatacatatttaaagccagcgtgggatgggcctgttgatttcctaggccatttcctttgaaatggccatttcatgcacacagcgtaaagtactaaaaattaacccttgcagcttgcttatagcactaagtaactttcccttcaaaataactcctgtctgtggcaggcactaaacccgaagagctgcaggaccggagttgtacacgcacaacacgccagaatcagatgttcacacaataaacagggcagtggggaggggaagggagaaagaagaagtggataagagaaaaccctgaaaaaaaaagagtgcagactacagagcccctgctacatggtgtgtgcttccctgcccctgtcctgtggtatgtgttgccacgcctctgtcacatggtatgtgctgccccgcccctgccacgtggtgtgtgctcccctcttctcaccccacagtgagaagacagaaggagtagtccaagtttatagaaagagaagcgcttctaggcaggaactgaggatgccctgtcatgtgcatatatattcttagctggtgcaacacaaactctatgtctaaagaaagtatgaatgtgcgggctaaagaactgtaccatagacattcaggagaagagaaagatgggtgtcagggaggaagcgccagcaggccttggtgttctccctgtttgggcccctcatctattgagcgtgaggtactaacataacctgccaccttaaggatgggcacaggtgccagcaccttgggccctaaaactgttcagtgtcacaaccctggtgtattatgtattaaccttacccccaaacacttaatcagcccttcaaagaatcacttaccacttaaactgacactacctttgtaacccaaaaccacagtttaataggacctggtttccaaagcggttcatgactgttgctcaaagaggtctgcccatgttctcaggatcctgttagtccctcgtggataccttttctgatgacaagggaaaagtcacttactatgggacttggtctctatgatcaaatcgtccttctgacgcttcgaacttctccctaaggctaatgactctaaaccttgtcctcagggcctttcagtggtcttttgtgtatttgctgaatggtgatgttaaatattcgaggcttcaaaaggaaccagtccttagctgctaaggcgggaagagtacaatcacaaactggcccaaactggctacggcatatactctaagatttttagcaagaagtttaacctcttaaagcctctgtcttcccatctacaaaatgggaatggtaattgttcttgtcggaatgtcctttgagcggtcactgttataatccttgtcgacaacaccaacttggctagttttcctgtggctgacacaacatacggaccacagatttagtgacttaaaacaatgagagtttattctctcaaaattggaggctacaagtcccaacattaaggtgacaagaggtggcactcccattgaaggcctaagagaaggactctctggcctcctctaacccttgccagctccaggcactcattggtccatggctgcatcctccccaccccctctcttctgacagctcttctctgttccatctctccttcttcttctttaaaggtctcatgttactggatctagacctaggctactcaagacagcgtcaggcccttcacttagctgtgtgtgtgagagaccagaccctttgtcagtgagatcctcgtcacaatctaatggtcagaatatggccctggcctttctggtgccaccgttcagtgccagagattaaaacctgttacattgatgtcatcggaacattagccggtggatcccggtcagtccaacgagccccttcccatctgtccctcagagtagacctagtgtccagataaatgtgatgtcatgcctgtgtgaccctgtcttgtcatctgcacttcagcatctcagcccttcatttgccagagccatgtcctgattcttccattccccaggtcagagaatagagtttcttttttttttcctgggcaagatcagctatttccgagtgtttctagagcacccatacagatgaagccaaagggtcaatggtggtgggaaaggggggcttccatccccctaccccaatacctagggtgtaatgtcagaacacaggaggcttggagcctccagaatcctgtggccacatagacagcagcgagcagagaaacaaaacttgccctgatgcccaaagccagccagttgggaggtactcaagaattcgacctccagatgaagccaggccagaggcaggcatgttgttgttttgtaggaccaagcagcaggcgttagcacagagtcttgtcaaccagattcccatgccaaaaggaccatggtttgctttgggccccggtcatgccaagccacagatcacagatcacagatagcctttcaagtctggaggagggagagaatttttaacggcagctgtgaagctttatcaaagtttaccaaaagtttggcccgagagaatagtgtcaggctgaaagggccacctaggcattctcccagtgctgggctttgtaagtgcagcccaaaggcttcatcactctgtcttgtcttgtttccccctggctccaggacaccccattctaactctaggggaccatgaactaaggcacttggtgtcccttatcttccagacaatagccacctagtaccgagtctctgccctgttaccacacttcttggccccacacagactctatattcatattaaacaattgatcgcagagccgcagagcagccaattgttgtggagattaaaggtagggatcgcggaaagcctgcagacgcactgtttactgacaagcctcccatctctccacagagtttcctcccataatccctttctggcaggacattttatgtgtcaatgccgggcgattcggttacccaggcacagtcaatatgacaaactaataaggagaaaaatagagtagaactcaccctgaaaacaaacacagatcagtcatgtgcctctctgtgcatgcctgagaacagagcaagaaagaagtgggacagggactgtgctgtttccttgttctgttgatctctgtaaccaggtgatggagggtcttcaggctgagtcctagctgagcctggctcctttgagcagtgcttaccactttaaaagtagcattttcagaacaaacagaaccatgtttcctgagctagaatgagcctctaagccactggtagtagaggctggccagaagggacccttacttctgactcaggttgaaaggtcacagaacctgggcctccctcattgctcagtgtctccctcgggctcatgcaaggcttagaaccttccagacatatttgcaagatttgaaccatcactgatggttcaaattctgatctccatggatcataaccttatcctttttagaaagctggtgtcttagttagggttttgctgctgtgaacagacaccatgaccaaggcaagtcttataaagaacagcatttaattggggctggcttacagcttcagaggttccatccattgtcatcaaggtgggaacatggcagagtgcagacaggcatggtgcaggaggagctgagagttctacatgaagagtagaactgagagtgccacctgaatgctgctagcagaatagtgacttccaggtagctagggtgagtgagggtcttaaacccatgcccacagtgacatgcctactctgacagggccacactttctaatagtgccactctctgagccaagcatatacaaactatcacaggtgggtattcattttaaacacaaaactgcagccctttcctctaagaggggattatgtgggtggaatctctgctgtatcagatgggaagacaccttccatgtcatccaacaactatgggatgccgtctgaggacaccaagtctgtccctggttccttcctgtcccatcttaattcttacacagtttcacttgttgagtcactgaatttggggttccaggatgtagcacagttaaactcatcaaggcttgggcaccgtggtgacgagtcagccctgggagtttggcaggggatgtgctagaaccatgctgctctggaatgaagagacaccactgatagattaaagtagaacttccccaggacaggaaggtctatgaactagtcttctcgtgggtgggatggttcacccattaggactgtctccagcttcatggcaggtcctctccccatgaggcgttccaggaccagatctgaggctcagagctaaatcttcactatttcctctccacacactttgaagggctgcttcgggtggctttgagagaatatcttcagacaaaaaggggcagaggactaatgagactgaggactgctcgccttagagttgctgctcacacaagggaaatgaacacgatggctttatggtgtctcctgggacgacggcgctgcctcggccactctccttccattagcacatctctctgcacatatcagatggcaaattacagaacgatagggttattaaaatatctgtaaaagtcagcccaggctcaagggcttgacttggccctcctgcccgttcggcggtttatttacatctcccaaggtcagctcgccagcatctgtattttgcggtaaaccgcccactccgcagaccaaccagaacagcccacttttgaagatgcgcttccgttggttttccagtaaggcactggcactcttaagagtgagcccagagctcttcagacctaatcctactgtcgccccccacccaattttaaaacttcagggtaggagcgtgaccgtgtctgcagccagattatcaccagagtagttgaggcaagaaaaactatcataatgatattgttgggttcacacatttaccaaaggcaattatataaagccttcgtagttcatgttgacagaacagattgcgagtggtctggtgaggtcacaggcagaggaaataccctctagaaggttcaggtgggccactccttctttttcatagtgcctgacactccccatccccccatacatctttctccagggggcggggggggggaggtgggggggatgcatatgggtgagcacacacacacatgtactcctgaaagtcggaggacagcctcaggtgtgggaggacggtctcaaatgtcagcctccaataactgccacatttgcttgagacagggcctcttattagccttttgctttgctcagtggttaggctagaaggccagccaactccagaagtctgcctgtctgtatctcccatcttgctgtaatccttgaggtaaccgccatatgctgccacaccctgtccttgggatgaaactgagggcctcatatttgtgaggagagagcttcactgactgaatctccccctgcctggcactgctctctacagtttcctaggccttgctctcaggcaagtgagtcactgcttggtcctaaacattctgtaattgtgggcacagtatcttgaagggattagagtcacccctaacaccctcagggaaaccaacctccatgccctagagcccccaccccaccctgctgcttctgattggcagacttttgtggtggtggtggtggtggtggtggggtgatactttttgctgtgtgatcaagcttagagaggctaagagccaccatatgttgccaaatgagagaagccactgcccagacatggatctgtctgatttaatatgattttccataactgacaaagcaggggtttgaaattgaatttgtgtaaaattacagatagccagctcaggtggaaggggaaggaagccttgctattcatgttcccgtggcttttcccggtttccccatttgagtccttcacgccttgggggaggggagactcggtggagggcctacggagggtagctcttgcagtcagactttctccctggccagtcatggcttcctctgaggaggactccagaacctggagatgttggggcgaaaggacaaatcctctgtccatccatccatccatccatccatccctcccatcatccagcacagaactcatcttcacacctggtcatcagaggggctccaggataaacttggggagagggggtacctagaaaagcctaattcattaggacggcctcatgccaatccagaatgctttggggctcagactccgactttgtccactttctagttgtaggtccttgaaggaaggaagcactcaggtccctgtgccacactgttgccatctgtaaaatgggcacgctcataatgcctgactcatgagatggtcttgaagacgaagtcagcatgattatagtattgggtggtcagcatgctgtgtcttggtatggttgtgtcttgttcactcctgcagaaacccctcactgaggctgagatgcgatcctgggatgtgtagagcacagcgcccagcgtgtctaaagttctcgagactgctcccgccgtctgtgtaaccataactgccattcctgctacagctcttgctgccggctctccggctgacatgaggcctgtcctgcgaggctcacagccactctgtgacaatggcctttagagttttggtgatttgagtttggggtccttgggtaaactccagcgggaccatccatagtcactatccacatctttgcctagcgcctctcccctgccccaccaccccaccccaccccagccaacaccctgaaggtccaggcgccctccataactgagctctcccaggctgtcctcttgtactgaagtcggtcatatggggaacggctcatttccccagcgctggcttagccttactcagccttttccctgtaatgggattttggctctgggagagggcaggatttagtttcttatggtcccttttcttttcttcgcttaatgttgaattttatttttaaaacgttttttttagaaggaataattaaaataatatattttaaaatggggttgtttttttgttttaaataaacaaggccatacacgctttctcatcctcttcagttcacagcaagcactcccagactgctaacagctgtagtgagctaacaggtcacttcctgaaaccagcggccctgactgggcagcgttcagggggtggtccctccccctctccgttgctttcttgaattagactcaccatatatgagtggcctgactcttctgtgtttttaatgttaccgtctactaaagggtttctttgaatgaggtctcatctccctgactgattttaagtcaatacctccctctgccaaatccaccactctaagcctgctctcagctgcagcccaggctgtcagacccagaagaggacaacaaacagtgtgggaggtgacacagccacagctgtgggaaggacagccactcagggcaggccctaggctgggacaggggggaggtgccgagtgacagtcccctcgaccagttcagaatggtcctgccagacttatgtcattactcccagaagactgcatgcatgagccgagacctgtatccagccagaggtgcccctgttacagccaagtctttgccatgaattcagagtcagggccttgaatgggtagatcagagactgttttggaatttgtaagattagccaccactttcttccccccccccccccgcccccctcccaagctaccagggaacaggatcctgcatagctggtggcttctggctcccttccttaactgagagacagaggactccagcatcctggctcttaagtgatatttacttaatagttaactgggtttcaaaagagaatggggacttgactcccttcactaattagccctgccggctggcttgtcatctccaccttcaccacccacggagtgtgctcttgacaagtcatgacccgaactcccaggggacttgcactctgggcttgcctcctccactgtctgagaaacacaagtctctaaagaagataaggctagagcaatgaagggcattctgggaaaacgtaaaggatcccgccccccctccccagatcccagaggagcaatggcagcctggaggggaaagtgacttgccacaggtggcatacactgttatccgagtgcttggctgtcttctccggttcggtcgctggacacattcctggtatttggaagtagcacagggagccttcctgaggagtcccttccaaacaccatccaggcgaacgaggggctgttgggacaagatagggcagacccaggtgtgcctgtgcacagggctccacccaatttctcatccttatattttatacgtgtgtgtgtgtgtgtgtgtgtgtgtgtgtctcagtctcaaataacccaaacaggcagggtactgatactgcagacagtctgcaggcacctgcccaagannnnnnnnnnnnnnnnnnnnnnnnnnnnnnnnnnnnnnnnnnnnnnnnnnnnnnggaagtcctaggtcagccaatgcttgaattcttttcctttcctgtcccctcctccctgcccactcccatcccccccccaatttaataaatttatatttagaaactaaatatagtttctaaccaacagcagccctgttatgaagaacatcttgcagcataaggagagagatctcttagaaaatcaatttccatctgtagagacgtgggataaggaagggaatgtaacctttagcccaccaccactcaactctggaacctgagcccatccccgtcacaactcatggttgtgtctcttctcgttctttctttcctctgctgacatgagaaagggaatcactcactggtgaggtaccagacatcacgctacagtccagcctgcttctcccacaaggagaggcagactactgagctggctatgggcagccccacctgtaaactctgcaaagccagccccttgccccaaggctctgacagcaatagatagagcccaggttggctcccctcagggttggtgtccctgaagggggattggtcagccatgaactcatcctcacagaattgtataggggaggctcaaaacaagggttctgcaaactatcccaggcattctgtgatgtaagagcccacgatatggaggccatgtaggaacccttggtgcttctcttcccctcaaccccccaccatgttgccaccatgcctcagggactcagaaaactcagcagtctcccagtgagctggcagcttaggtgcctgtggccatctttctcagagctacaaagagctcccttacacaccaagctcatctctgagcactacagggaaggcaaacactgttagctcatgggcaactgaggactgaggagacttgaagttccttgaacttcacgttcttcttgtagcataagtcattgttgctcggccatcttgcgtcagccatcttgcatcagccatcttgcgtcggccatcttgtgtgtctatgtggatatcagtggacaggaacagcttttcagacacggcagaatggccacaaagtacaggaataatgacgcctctgacctcagtgtgccttctgctgctatgactcttgagtggcaatgtaagtgaggatcctgcagcttccccttggctcctttgccttcaggtgaccattataaacccccctaggccctgtgcgtccacctggtctgatcatgtagccttcaaaggccatgcccacggccgaagaagctattaatgcctttcaagccaactgaaggccaaagacttggcgcacagagctcttttcgctgcccatcaaattcccttctcgagcaatgcctccattcctgtggtgttccaggctctccctggctccctagtccatccaagctctgaaatcactctcagccaatcacaggagcaggatggaggcagggagtctggggaaggtaccaagtggatgtgaggttagcttacctgtcttcctctctggctagtcctgttccctcctcaccctgttcccacactctcccatatttcagcaatcctcacatgtcccttcctacaaggaccaaactgagtcctctcccagttcctagacaagcctgacagtccctctcactgtaacatctccccatgtctgctctctggttatacttgagaggtggtggggccaagtgccttttccttcactgtcctgagtgaggcgtcatcctgcccagttaacaaccgcagcctgctaaccggaggactgaatctatgtgctccagcatggccttccccacacatctgggctctgagacccacagaagggtcagcagagtcccaagtacccttgaacactccttcacttctctgggtcctcaggaatacaggccacgaggtacagaaaccagtcagtccctgtagaagcattttttcttctgatcttaggaacacaggtcaaagtgggacactggtgggtgtgaaccccatttcaaagttccaggcaggaaacaatgcagtgactgggaggtccctttgcctcttgacattatggcccataatgttgtggccttggatacccgcccctccccaccatgctgtttccagacccacaccaaatactcctcccatgacaccctgccttccttcctctgcagacagctcagcctcacctgaggcagacttccacatatttgaacctgctttgcatgcttaattagagacctaggccctgaaataagctgtcttagttacccacaacttcctagggatcccagcccctaccacagcacaatactgcctccaccagccaggttcctgcttcctgcccttcaggggtgtgtgtgtgtctgctgcttccttctcagacccacatttctagattctttttcaaatccatccttcgaaactctttatttagcgctctctctctctctctctctctctctctctctctctctctctctctctccccacacacaccttttcaccttaataaagccttgccctggggccagggctggagctcagctgggagagtgctttcctagggctgtgaaccctaaattctatccccagcacttggcacccaccgacatctgtaccacctggattccagcattcaggaggtggaggcaggaggattagaagtttatggtcattctcagctctcacgtatataagttcaaggctagtctgaccacaagaaatcttttctttaaaaataattgatccactgccaagtcagggggcttcagggccccgtccccagcttctggggactttacctagtatgactcctaccacgcaggaaagtcaggcttgtcttcctctcattgtccttctctggtcacaggatggtgctcggacagccagccagacgctctctctcatccacctgtctccttacccaccatttgtgtgaaagagtgtcagattgtggccccaaacaggaagccctctggccctctggcccgctaatcccctttgggaggaaccttcactaggtactcttagagggtcttctgttcaaatcaaggggaaagtggtttgaatgagctgtgttttgttttgttttgttttgttttgtttttaaagaagacaggaagttcctgttttttagaaaggctgttcattttcaaagaaccaacttacagagccaatcgaccataggattgctgctggatttttttcccccaatgtggtacacaatacatgcgaaaaagaaagcggggagccccaccaatgagagatagtcagtaacacaaagggagatattataatcggcttttgttggtgcttgcgtcttcttgttgaaaaccagaaagcccctgaggtgctgaagtgcggacagaagctgatgttatcggcccccagaaatcctgcctggagtccagtggcaggcaggatccgaagctcccaagaccacagcaactggccctgctcagtacaaacggtgctttcagtctctggtaaacagcctgtgccccagggctcaaatccttcaaaagtttgcctaggtaattgcgtttcattgctgtctggcctgcgctcgtcagtctaatctggaggttcagacagccaggccaaagcttgcgagtctggaggggaacaagcccatgaatctaatccacttgaaagacagactaatacaagtgcagctaactcattattttaagtgatttgaacagaaggagtatggcactctctataaaagggtttcaagtcagtgcagtgcagtgtttggcagcttaaagccattagaggaactgcaaagggtgacagtgtgactccccgtcgccgtcctcattttatgaagcctggttcctccctgtgaccaccctaaaatggttttttcctgtcctgcccttggtttttgagttatttgtgaattattatagtaaaagactccaacttttgtctttgatccaggcgtgggtacgaaaggagacacaaatgtaaagacagaattctgagggacccctcggagctctgaatacccccagatctgaaaataggaagagctaccctcttcaaagccccaacaccctcagcagttagagtttttgaaggttaagccttcccattttgccggtatgatcattaggtaggaggaggggtgctttatggaagtaaaccttcatcctaccaccaacctgtgtgaggaacagagaccgtcccttcatcttgcactccagctttctctgagttggagctggcacaggtagcctctggggctgcttcctgccccatcattccatgagtctttggaacaagacctcagaactgttgacaacaatctgcaccattatctagttacatgtgactcatgcccagaaagcccaggagaagcaagtgctggcctgtcccttccaaggtagcaaagccagtggtcaactcaggggcaagcttattggccatttacacctgtggctcccccggggctggattcagccagtgccaagtctgcgtgtcagactgagactgtgagaaagcagtttctgcaaacaccgatgtggagacgaggttctccttaggcgctgcctagccatggttgcccccacctcagcccctcagttcatgtgtcttccacccaggccaccgtgctagattacatctctcgaaatcagagcagcctctagaagtcacatgctctgcttccatgttgaagttggctgaactaccctattggtgtgacgttccctgggtcagtcttcccttgtcattttagtttcccttgactgtgggagctgaaccattcttttacgggaacttcttatgcacttaacagctaccagacagcacccctggtctctacccactcaatgtctctggctctcccgactctaatcaagagtagtcctgtttcctgacattactaaaagtcctctagaagagagttccctactggtttagaccagcctgggaaaggcagaagtgtttagtccatgcgtataagatgtcaatgtgcaaaactgagttgattgggtgtctgtctgcagatcacttcggcctctgggtctctggcacctccttcctccactggccagtcccactcactgtgtgatcaaatgtgtcggtatgtcccacaatctcaacctgtacatagctttttttcttccatctgcgtccaagtcactgaaaacctatcgcttctgtatgaaaggctgccttgaccttgtaaatcaaaggcgttctctggagggagctctcccactgctgggctccgttcggtatcatctttctcagggtgacctcatctattcaagtgtgaaggttgtatttgaaatgtcatttactttccctagtcaataaatgaagccatggatctttagatcatcagaggcctgcttattaccgagagtctctacgctgtatgggtatgtgtcttttgagatctgtgttagagtttaaaagaattctgtcagacttccgtttgcctctctgaatcagagcacggggtggaattcctctgtgagtggagggtgcccccaaatgagtctgcctttattagtttgtgtcctttgttcagagcaccagggattactttatgaaagcacgcgtgactcttatcttcaaaggtctcccctgcatggcagactctacctcaccaacctgtgttactaatccattgccatcccaattagttcagatcaaggtcagttacttggggtgtgcaaaggggccgcaaatgtaagtgagtgagtccccctcctgtggttctcccacgaaaatgagagattacaggcggggaaacatagaagcgagaactgtctggtgcctcagtgtttgagagtgaagtgaagacctcagggaaccctaaacaagccaatgcttgagtagaaatacacgacccctgctgcggggaagtttcttggccccgtctccccaccctattgctgatggcaagcatctgagaaatttaggagcctcggacacagagttgggtctgagaacatttgctgggtccacgtggaggaggaaccttgtgtttatggcgcgtgataagcaccgagcctccaaaaggcacatctatggaaaagaggctggagtttggtaggtccataggatggctcatgataattcctagccacccatcccactgtcatcttgaggtcatcagcagagggatggtaaggtatgtgagggttacatctttctaggtggacaacaagacctatgagaatacacttctctgatctaccattgtttctagtactgtggggaggccatggaagatcaaatggaagtgcagtgattaatgtccattgcatggacagtcagacaggacagttcttgtgaaagatgtgttagaacaacccagataggaacagccaggaatcatgaaaggctgaccaccccccacccccaagcaggaaaaccctagacttatttattagattcttctgatgcagagagagacctgtgcatagcctggctagaggatgggagagggagttccccgcccccaccccacagctctctgaggtgcttctcttgggctttgctttggggaattgattctaagaggacaagtctggtgtgtaggaaaggaaaacacagcagtgtcccaggttcaggccagagagaacagacatttaagaccagaccagaactctgaacctacccctccacacacacacacacacacacacacacacacacacaacgcacgaggagaagaacatgggggcagacactgactggatctctcttgcaaacatttaccaaagggggctaggcatttcacctctgcggaatttttctatttcccctgtgtcagaatgttcttctgtgagttgagagtgtggaatgaaggctcttaaagaaagaacaaccctttgacatgactcacacctcagaagacaaagaacaatgaatccctggcttgcaattcagctttcagaccctgtgtcctggcaggcacagcgccaccctgccatgaacctgcgttctgcagagcgggtacggactccctctggagctgtggtgttcagggaagagacgctccctcatgctgcgtctccgcgctggcacttagccaccggaaccacacacgcatggttgtgggaaccacggtttgcaccctggaactctggctggctgggacaagtcctattcctggtagccttgcggtgtctctgctatgtggagcaccggcagtgaggataaagagtctgtgctggacaagcccaagcagtcctcactctggacatcactaccattccctgaaagggtagcaaggggagactctcttgccttttcatactacaactgaactgctaatggtcaggccaagatactatctcaccctaacagtacctcacaggctgatgcaatgacccctcctcacaggaggggagtatgcccacttgcctcaacagtaagaggcaaactggtgtctcctttgcaacctctcagactggagagtcatgcccttgctctcttgttgcctgagcactgttggtccgggaatagggaacagtggagcggtacccagatactagagatgcctggagccagtacaagccacagcacaaccggcatcatctgttctgttttggggaatattctagaggatattgcattggatcttcttttctgtccccatgaatatgaatttctcttaatactctgcggaagaatgaacgctgtgatctctgcttaataccctggtcagaggaacacaggggacagggcctgagttctgtccattaagccaccttagaaattcccaagaagttctaacatttaacaaagtgagtagtacaatgctagactacaaggttgagcacgcacaggccatggggctggggtagaggtgacctctgctctcccaccagggtcccgagtgtaggctcagtgacagcccttggcacagagatctgggagctgcacaggtagcggtgacccccaaaggaaacaaagccacctagtggcttgatagagcctggattaggtcggacttcaatctaggctgggccctgattgacattgtacaggtaataatagatccatcatcaccaccctctgcaattccaaagaagaatagccactcctttcttggtgcctaccatcaccctaaggcatgttaaggaccctcataaagtctcagctgttcacttaatgtgaccgcccaagggccagctcttactgcatccagttttcaaaagacagttggtgctcccctgaagacccagcagcagcccagagcaagctggacagaacaagccaccttctgcaggcagcccggaccaacatctccaacatcccctgacctgagccacacgaatagagcctgcagtgtgtgctactgtcagtacattccactctgtaagacacccagaggcatgaggtcctcccgctcgctcgcagcttcccacaggaggtgtcaacagcttctgtatgagtgacggtcttgtccctccatacaaagggctgagcccaagctcccaaactaaactacctggggcctcggacccctgacactgaatttctcctcaccttattcaagggaggagtaaggacgaatatgaggctggagaagaaccactgggggctggggacaggaagtcatctttaccctcagcctttcgagactctatagaggagaaagcaatggaggagaggatgattcagcaggcgctcctaggatggcacctgccacatggtggctgagcctgactacaggcctagaaaacataagtggacgtcagaggtgcaggcagctcgtgcaatgcggtgaggagtcggggtggggcttctttaacaaagttcggcgaaataagttatctgcaggaaaggacactgcagagaccagacggggcctttggtgccctcagaagcacagttctgtctggacgccaaaggccactctgtctggaggagagacggtgccaacagagaatgagaggtgttatgaaaacagcgtgttttctagaagcgggtgacttatccctgaacccttgcacagggaggactctgcctaaatacagtgccctttccagacctgtctcagactgatctggctgagaggagcggcctccctcgtggcgagggctgagctatttcccctgggaactgtctggcagctctaatgaggaatagcactttgcatttatagagagcctttcatctgtggatctcaaagctgtaccacaaacattaattaactctcacacctgggaggcaggtgagtctggttaccccccaaccccatttttaaaaaatgaggaaacagagatttgggaggaaaaggattctggggcgagccaccggggttaggagtgtccctgatgttgggaataagcgtttcagatttgtagcatcctgaccacaaagtcaggaggcctccccgggatgagtgaggaatttgggtaccggaacaggagatgaagccacacaattccttcttccctttctcaggtggcctgtcacctcctgggtctatagatgtcatttagaatgggtccctcagaccccgaaggcctttgaaacagccttaccaggcaggtctccatcctggctcactctggatgcctcccttcaaagtaaccgttggaacagtgaccgcagccgagacgcacatgactaaccaaaatgtctgcagccagtgggagacaaatgcttggcaaatcccagggctctttcacaaccctcttttcttccaggatccagaactggtgggaactgactcctgttatcactggttctcactggtgtgcttaggcgatgctaatccagtgctggctacctggggagtgggggttgggggaaggagctctggggtgactcccgtctgttctgacttctggagctgttgtgggtttactgcccaccgcagaagccaaaggaaacactgctcaaaaccaccagaggcaagcagcctttcagttgggtcacctgcccaacaccagggctgtgaaagctgacattgcagagtggggggtgggggtggggnnnnnnnnnnnnnnnnnnnncctgactcacatcctgttgtgttctctgaggcatccgagagggcattacaccagctacccatgactgagctgcactgggagggcgccctgaggatgactctgccttctgccttgcagaaagagggggagtcttctaaggaaaaacccagaacaggccccttgggtttatccattctcagagcagattttgcgcgttaagaagcaagtggccctgcattgcatggcccactgtttattttcaatggatcgagggtgaacggcttgttgttttagagatgcccgccaaatactcaaggaacagagccccgactacagcagagccccaacgtcctgacccagaaaacccaggctgtgaggtcaggtgccagggccaccaaaggctcaagtgaactaggctgatgtccccgcgtgtcctttccttggacagggagggagggcacaaggctgaatcgggatgctttgagttttcgaaacaggaacatttatttactcttctgattggagtcagcttcatcgaccactttagatacggctacttctctttgcctcgggtgtggggcattctttccccctcctcatcccatacgcagtagttactggcgttctggctttcctttcaaatatgttttccgaaccagaaatttcccttccaaagctgcctcttctccaggccctaaatgttggtgttttcattttcattaagtgactggcagtcgacatatcttttcagatctcttatttggtggctatggcatctccagataatctccaatttttgaagatttctaagtaatagttctgttaccggtttttgttgttgttgttttgttttgtttttcggggggaggggagagtgttgtttggttttagtttaagtccttgtggcctaaggaaatactttgtatgattatgccttcaaacccaagcagtcttctgtggcctcaagtgtagtctgccttagcgagtgatctgtgtgcctcagaagaaaggagcggcctaccggtgttctgtaggccaaactgatactgtccaggtcagccgagtctgaatttctgcttgcatggtctatcggtgactggaagagggtgctaaagtctcctgccgtaaggatgggtttgtctgcttttccttgtattgcagttagtgagaccctttgttcacgggacacctgtgaaggaaaatgtatatttggttttccgtactatcataacgtaacttatctcttatccctgaaaagctccatcttcaatcggctttgtagaaaacttgatacagcaactcaggctttccttggattggtgttagcacagcttctccacccttttatgcttgccctatctgaatctacatttaaatgagccatttgtatgcgtcaggtagttaagttttatttgtagcttgttctgacaacctctgtggtagatttagacaattcacctttatagatacagttggattatgatctgccatggtctaacttttatgcctgttgcacctggttcttagtcccacccccggctttcctgcctcctctgaatggaatgaaacattttatgtgacttcattttagcttgtttattgcctatcgggtaggaaaatgatttttttttttaaatagttttgtgggagctagagagctgggtcagacattaaagcactgaatgctcatccagtggacctgggtttgattcctagtaaccactagtggctaaaggcggtctgttaactccaatcccagggaaatccaacacacgattaaggtctccctaggcactacaagcatgaggtacacagatatgatgcaagtaatacaacactcatatgcattaaacaataaataaataaataaataaataaataaatattttaaaattgcttcaataattgctgtagagtttaaaaactaagcccacaatcaaataatgttattccttaattgttatatgttacttatatttaaacttttgtttacatttttaaatttagtgtctctctctgtgtatatgtgtgtgcctctccctctcctcttcctcctccctccctccctccctcccctccccttctctctgtgtgtgtgtatgtgtgtttgtgcgtgtatgtgtctgtttctctctctttgtgtgtgtgtatgtgtgcatgtgtgtatatggtgtgtatatgtgtctgtctctctgtgtgtacatgtctgtctgtctgtctctcttttatgtatgtgtctgctgtctctctttgtgtatatatgtatatgattctgtctctctctatgtatatgtctgtttgtctctatgtctgtgtatgtatgtatgtatgtatgtatgtatgtatgtatgtatgtgtatgtgcctgtctctgtgtgtgtgctgtctgtctgtctatctctctctctctgtctctgtgtgtgtacatgtgtatgtgcctgtctgtgtgtgtgtgtgtgtgtgtgtgtgtgtgtgtgtgctgtgctgtacatatggaggtcaaaggacaactcacaagaattagtggtttccttccactatgtgggtcctgaggatcaagctcgtgtattggacaagcgccactctgctgagatgtatcacttctttcttatctgtcattattgccaattattttcttgatctttatgctgtaactgtccaacaaattgtggctgttatcacttctaacagttaactttcagatccgttatgaatagaaaatgggttttattttatttgattcacttcttctgggatgacctccttttcacccaagatctaagtttctggtccatttcattttctttctgtctgaggccctttaaacatgtctgttggtgatcattgatttccatttcatcagaagatgtactgcttttccctttgcattggaagaatagttttgctgggtataaaactctgggttggtttcactttgttcccttcagacctttggtgtgagttttctgtgatcgtccagttgggttcaatgattacaaagctatagttgacaaaggcatgtagttcccccagtgtctttgttacttcctcccttgttgtctttgagtttcccatgaactctgctttagtctatgcttaaagctctttggttggcagtctaccataagatgggaaaccatgagaactcagttgagttcctgggccacaaacatgtttctcctggacagtactatagctctccagacttgtattctcattatcagtctatattcagcctccagcaacttgtgacatctccatgttgtacttccatgagcttctgtttctaatcaacagaccttgggttggttttacatgcttgcctgcctcccaggacttgggtggtgccctgctttcctgctagaattctgtgggagatacaggaaagtcacagattttctgttctacttttttccttgttcttaggacaagaatggtaactccaaaactctttacattttagtgctaaaaaaggaagaagcaggccactctggtatgaattatttggcagcgtcatggtggactctaaagatgttttgatgttggtacctttaagacattcttttcctgagtgaaatatgtcatggtgctttgtactgtctccctacctttccccttatctttgacctccatttcaaatggaagggaatggggttcagggatgtaaaaggagcccctcttatctattatttgtaatggcctggtcatgtaatctcatcaaaaccatttgtcctgaaaacaaaaacaaccagcatacagaaggctcaacttttctggtgcttttaaaaacagaagcatggattgattaaaacaccgaattcctgctttctctgtgtcacgaaattccagagtccttactcattcagcatctaatccccagagcctacctcttctcaagatactcagctccaagcactccagtagtacctgagtcccaccccagttcaagtgtgtgttgccttaccagataagtctcttggcaggactgaatttcctttagcaatgcaatcatggaaatcactcagattaattaaccatttttgatggccacatattgtgacaggtctttttcctgttgcttgcttgtttcttgatgttactcttgctagtcagaagaatgtaagtcttgcctgaagctaatttatggtggaggcaagagtcaaccccaaatctggttgacttacatcctaatgctttcctgccctgctcctcccctctgcagaacataagcatgtcacaaaagtcactgctgcccttgcctctaccttggaagcagacatttgcaagtccaaattagtcatgtgatttagcagccagcctccattcaacctttacatcatcccgtgtctgtaagtcttacaaagtaaagaccataaaaccatttgctagtgaatccctaccactagggcctgggtgaagcaaaactatttgtgggaacatgaatgagggaacaagtaaataatttccccagcctatgaatatacaagtgtttgaatgagtgaatgggtgaatgaatgcatgcatgaatgaatgcatgaatgaatgaatgaatgaatgaatgaagcaactcttagtgtgctgacatgtgcatgaggaaggaacctttccaagcatcacaaagttagaagcctttccctgatgagccaaggcaggggccatgtggctcctagtcaccactatcactggccacatttcctgtgcctggcacacggtatatgtttaaccaactcttgttcacttggatgaattggcttaccagaggcaactccttcaagactagtacacctgcactttgccgaatgcctaacggtgactctctcagcctgtggcctgttctggatagctcccagtttaatccctccttgtggcatttcccagaaggcacacagttacgattttaagtacctacacctcgcctcccatcccctacacgactcttccctgactctagcaacatatagcaaagatgagttggactaatttgaacggggagcctcccctgttgccactggatggctttagagatcatctctctgccgagagagaagtatggaggtttggtctagggcaactggccctctcagcaaaccgatgggcctagagctcctttttctgataggcaatcaacaatatggttgttatgattctaactttcctgtgttcctagccccacctcccctcccatcctaacaacgatagaacctctcccacaaacgcagaatgcactgtatttccctgcctcttgtggtttgtttttgtttttaatagagcattaaaaagctgaaaacaacccaaattacaagaagaggctcaccaccaccacctactggcccacccctggcaaaggacccaagtaggttcctggtgctggcggaaatgatggttgatgggccgtggcgtcagtgacccactcaatactgtggtgggaagtaagatgatgccaaatctataacctgtgtttaaaaaaaaaaaaaagaagaaggcgcagattctgagcctgaatcataaaggccgttccaccgaagcgaggctgtgaaatattacgcaacgttcgcacggtttaattacgagtttagaaaggcctagcctgagtttttcactacagtaaaacatgacagagcatgaaccctggcaccacactttatgcttagtgtggttttagacacagggctggggtgctaggctgtctacacaacaaggcatggattacaataccgcaattcacaccccgggggccttcatgacaattacagaacctcctttgtttgctttttaagtgattaaaatatttgaatagtatatgtccatttgctaagtgtgtatattgaaagcactggcatgtcttgtggaaaacatctgagagtgtgagctttgggctccccgcacacacacaatggagcaagatccttacagtgatgtgggatgcaggacggtgttgtttctacacacctccgggcctcaggaacagtcggctgtaaaaccgcacaaggctccacctgcatcgcagcacttgtctgatgagtttagtgtgtgccagctcccttgtctgtgccgtcccttcagacaaactctccaccattgggaggatgtcaggagatctcttcaccgggagattctaagttaaaatgttggcccaggaacaagcaggtctgtggtccttacattgtcgggtttgtggttatcgttgtgttctattttcccggacattaaaaccaaactgagtgagagaaaggaacaaggcttattgagccccgaagtcaagtgcacaagagacatttgcttcaactcccggctctgtccctgctctttcttggtgacaatctataaaatacattctcaaagttttgcccttcaaaaacaccactggccccaagagtccatgctacctggtttggtctgttgtgaagcagcctcattagtgtgcctgtgttttggtcgttcaccatgtttgcactgtctgtctgtctgtatctctctctctctctctagtctctctctctctagtctctctctctctagtctctctctctccctctctctctctctctctctctgtgtacgggggagagttatctttttactatcgctctcgctattgtttctatggcatttgaggaatggcatttgctgaagtagaaaacatacacatgcccgtggacatttcctcagggtcccccacgctccagacccccttacatcctttgtgcttcctgaacaaggtggccatctgagccgatacaatgtttctggtgatgataactgtaattgctggccaggatgaatgtgttatcctgaatgtgtcacttagagtgatccagtactaccagagtccattcccaacagtattagtgtgaaaaaaaaaatgtatatatatgctatatatattatagataggtagatagatagatagatagatagatagatagatagatagatagatggaaggaagagttagcaaataaaactccccctaaatccatgaactgtacttcagtatctttaatgggccttcatacaacagagtcatcaaatacttgggctctagtggtctcattagacacaagtgaacaagctgtgtaaacacatgtataatcatttaaataatggttaatagctatcatgatgagaacttttcgtcttaaaacccctgccccaccccatccatgaccaacatccttgtctccctgcagatgccaggcagatccagccatccccaccgtggtcctatgaccagtcctaccagtacctgggatccatcacctcttcctctgtccacccagcgacacccatttcacccggccgtgccagcggcatgaccagcctctctgcagaactttccagtcgactctcaagtaagccctgtgaaaacacacctgcagcggggctggaggggaggattcggaggaccgcgggagactcggggagacacagaaagacacaggaaaggcgggacatggctaatggaccagaaaagggttcaaagaccaaatttcctgcctctgtgcgtgtccagtgcctgagcactgatctttcttaacatgctaagagatgccagatgaggaggcagcaatgccttagtccatccctttgggatttggggtttgctcatatctggtgagaaacgttggtggccaatggttactattctgataagtggaagtggcctaaagatttttgtacctttggccaagaaattaacatcccaactgaattctagaccgaggctattctttccagaagtggccagtttttatggctcctgcatacagcacagtggggtacatactggaataggacacaaatacgccccaagataaacattcccagctaagagctgttcagactgaggctaggaaccaggtagaaagctcaggtgtcatggttagcataattgttgttaatacgagctcattacatattagtcatttaacctatgagccctttgggcttggcacactcaccttcgctcctgggcagggaaatcagaggtactgggggaaaaaaattcctttgttgaaggcaaaagaagaaacttactgtttggggctttgaaattggagccgaagcaaactgtgaaatacttcagagagcttcgtcctttagaggcccgtgaatgcactcccatgtgtgccgggggaggggcaggctttgctttcggactcttgaaggcagattagaatagatgagggggcaggcagaggagttggggctgctgctttaaatgttgtgaaagactacatttccagacagccacgattgcttaagactcctccagcgggtcagctgctccctcacaatcaccctcaattcaccccgcctttccccagcaaccatactgacatttgggctgtatcatgttttgttgtgggaacaggggactggcctatgtgccaaacaatagatagatgacccttgacctccagatgtcagtagtaaatggccctgtctgtccatcagaaatatctccaaggctggggaccagctcagtgggcaaagcccttatcttgcaaacatgaggaccaggtattaaggcaaagtgcagtggcacaggctgctagtaccatcactaggacatggagacatgtgagtatccagactagttgaattagaaagcttcaggcttgggagagaccctgcctcaaaaagccaagttagatggctgctgaggaacacacacacgcacacgcatgagtctgcactcgagggtactcatcaatgaacactcagaatgctcccactcaccccttacaaacacaaacccacagaaaatgttgctggacattgtcacttgtctcagctgggggcattgagaacttactagcttcaactaggcttggtgctggactgaaatgccaaagccagnnnnnnnnnnnnnnnnnnnnagagagagagagagagagagagagagagagagtttgccaggacccaaaagtgaccctctgctgcccagtagggaagaccagagaatgacaaacaactggcatagagtgagcctcaacttggcaaaactccctctagaaaccaagccccgagcacaggcctcaaaagcctgtaatgtgttctcataaacctgggccagagagggtaggtagggtccctgaaaggaagaggctgtcaggcccacagcttgtcagccgaacttgacccctctgtggctgatgtgccttctaatcccaccagtgacagcttcaagttctgggctttcagcctcccccagcccgacctgcctagctgctcagcacacacacatgcgttctcagcagacgggccctgtctgtctctgtcccttgcagacagacagactccacaccttgtctgaaaggagctgccacgtgaaggtttatctttcctcctcatttctcttcttcctttattttaccctcttccttttcttttggttaattaatgtctagctgccaacctgggcgacagacagcgcatactaatctgagtcacgcaggagagccttttaaggcggtcattatctgctcaggttgtttaatcctttgggggcagtgggaggggcctggggtgggacctctttcatccacatcaagctttagagccaagactctgcgctctgtcaaggtagagacttagcaccatagagggagagacactgccagtgaaagtggctgaaccttctaatcctcacacttcctacttttaaagtctccccatgaatgggagagggggcagttgtcacctgaattgagtgggtgggggcggcgtgcaccggactagccaaaagaatagaggagccgtagttgggtgatgtataaattctgtgtgactgctgatgtgtaaggaaagaggttagacaggatttaaaaatgaaaacacggggagctggtgaggtagctcagtggttaggaacctttgttgctcttcccaggccccccacattagcccgctcacagctgcccataactccaactcgagggcatctctctccttcctccagtgtctgcaagcacacacacacacacacacacacacacacacacacacacacacacacatgcgcgcgagcacctaactaaaaataaaatagctgtaaatgagaacacgtattcgaatagagcacttgaatttgaacatatctaaaaggcccatgtcttttttattacagagcgtatacaaagcgagacagggagggatggaaggagaaggggaggagggagagagaacctgacctctcgtagaaagacgccacactatctcagatcttccacatactctgcccccagcagctgagactgtaacattactcctgcgcttatgcccatgacaaatcacggactcactcgggattccggtaacgtggtaccattaccacattaccatgtaagaactgggacagactggcagagcatgttcagacacggctctgaaacgtggtgacctctccttcatttttttccagtggattcaccttttttgtctcaggacaaatgaagcaagagggataatgggcagagtcacttgtttgtgtccagtgtattgcatcagatgacaacaggccgattgtgtgtgtgcctaatgctctccctcctgcctcggcttctccctagactgtataaatctaactggaaaaaaaaaatggagtagagcttcctgttaactctcaagcatgtcatggctctctgtaagcaaaacaagtgacacagagtttgctcatagaggtccccggtgagggcgcagagatgaac

SEQ ID NO: 1116 - DNA, 4295 bp, Mus musculus
ctcattcatagagccagcgggcgcgggcaggacgggcgccccgcggccggacccagccagggcaccacgctgcccggccccgcggctggcacttccatcctgagctccccgagacgcaagaaagtcaccctttgcggctctttctagatctgcgttggaccttcttgttttcctttcctttcctttttttttttttttaatttttatttttattttccctttcttacttttgaatgaaccggcttctaggctttggatgtttcaacttctaggctgtgaacttttctccgattgtttcttttgacaactgcgggagaaagtgttccggagttccaggcgagcggtgaagttgcgtgtgcgtggcagggtgcgtgggagtgagcgtgtgtaactcgagcctactggtctacggtgcctcctcccaggcccgctccacctgctgcggttacacggtgctcgctcgtgggtatttgtgcgccccagcagaaaaccagccaccgccgggcgacgttggaggaagatcatcttgccagactctgggctgactcactcaaccaatgtagacagtggctgacttccgaagagtgcgagtctgcctgtgtgtgtgacccaactgcggctcaactcccaccaaaccacaggatcagccacaaacttaaccagcgttcccaaaccagagtcctcagctgtgggaagctctaccctgagtgtcatcgagtttgacttttttttttttaagattagctacagatctttgtaaagcactgaccatttatttggccagaatttattgagtaatgacaagtgatcctatccagccttccaactactgaagctgattttcaaggctacttaaaaaaaaaaaaactgcagcaaacattaatggatttctgttgtgtttaaattctctacagattgtattgtaaatattttatgaagtagatcatatgtatatatttatatatacgagcacatacattagtagcacaatcttttaaagttacggctcttgcttttgagaaacgaagtgagtttttcatggtaagaggggcgctctgtatggaagacactcctaagttttgtattttgttgagactctaaacaaaactgacccgcaagaaagaaaaacaaactgacaggcaactaactggtggaacttccaaatctagtttttgctggtcattttttggttgttgttgttgttctgcgcataaatattttaggacgcgtatgggaattttgctccgggaccgtttgtaatagccaaagactgaacttcaactctcaaagcgaggctctgttgggcatttgactttgaattctggttgcccactttttaacgcactaagcggccagttgctaaccctgcttgggtgtgaggccgatccgtgtaactagatctcagtccgggactgatggtaatttagtctcctacccccacaaccctccggtagtaataaaggcttctgaacttgtatgttggtctcccgggagcagcttgcagaagatccgagcccctgtcgccgtctagtaggagctgttttcagggtccttactcaatcggcttgttgtgatgcgtatccccgtagatgccagcacgagccgccgcttcacgccgccttccaccgcgctgagccccggcaagatgagcgaggcgctgccgctgggcgccccggatggcggcccggccctggccagcaagctgaggagcggcgaccgcagcatggtggaggtactagctgaccaccctggcgagctagtgcgcaccgacagccccaacttcctctgctccgtgctacccactcactggcgctgcaacaagaccctgcccatcgctttcaaggtggtggcactgggggacgtcccggatggcactctggtcaccgtcatggcaggcaacgatgaaaactactcggcagaactgagaaatgctaccgcggccatgaagaaccaggtagcgagattcaacgacctcaggtttgtcgggcggagcggtagaggcaagagcttcactctgaccatcaccgtctttacaaatccgccacaagttgccacctaccatagagccatcaaaatcacagtggacggcccccgagaaccccgaaatgccaggcagatccagccatccccaccgtggtcctatgaccagtcctaccagtacctgggatccatcacctcttcctctgtccacccagcgacacccatttcacccggccgtgccagcggcatgaccagcctctctgcagaactttccagtcgactctcaacggctccggacctgaccgccttcggcgacccacgccagttccctactctgccgtccatctccgacccgcgcatgcactacccaggcgccttcacctactcgccgcccgtcacgtcgggcatcggcatcggcatgtcagccatgagctcggcctctcgctaccacacctacctgccgccgccctaccccggctcatcacaggcgcaggccgggcccttccagaccggctcgccctcctaccatctatactacggcgcctcggccggttcctaccagttctccatggtgggcggagagagatcgcccccgcgcatcctgccgccctgcaccaacgcatccaccggcgccgcgctgctcaaccccagcctccccagccagagcgacgtggtggagaccgagggcagccatagcaactcgcccaccaacatgccccccgcgcgcctggaggaggccgtgtggcggccctactgagctgagcgccatcgccatcgagggactgggcctgccgtccatgcacagaccccgccaggagggcccttggaggccaccaggaagaatcccggagggaaactgtgaatgcttctgatttagcaatgctgtgaataaaagaaagattttatacccttgacttcactttttaaccacgttgtttattccaaagagtgtggaatgttttcggttcggggtggggaagacgcagcccatcctgtttggcatctatttcttatttcggagttttcttttccgcaccttatcgattgcaaaaatgcctgtttgcatctgggtggtcatttatttttaagtgtgtatagatttgagcttgcttttttttcttcctttgaccaactcaaagaaataaaattcccttctctgtaaggtttatttaacttttagactttcatgtagctttggggttttatttgtgtttggtttttgtttttgtttttatttttaaagagacagctacagctttgggtcattttttaactactgtatttccacaaagaaatccctagatatttatgtatcttgatgtttgaacatttacatatgtgttgatacttttttaattatttaaatgtacttatattaagaaagatatcaagtactacatttttctttataatagccaaagttaaatattattgcgttgaagatgtctggaaaaaaaagagatcgcttggttaactagaaatattgtttacattaaactccctttatgttattcaaacaagttggtaggtaacgcagcaatgtttttaattggattgtagacactgagggtcactccaaggtcagaagtacaaaattttctgctaggctcaacaaatagtctcatacctggctccttcccttcaaaaagagaggcaaactctgtcctgaaagggttcagagaggtgccaaggatttgctctgaagaggatttcattttggcctggagatatacttgccccaaggcctcctcattctggcatgctttatcacagagctcaaccaagtaagctgttggtcaggggtttacttacatagtatttacatagacccaaaccactgaatgtgatttttaaattgccttccattaatagtacccgttcattgatgaaaaccaaaacttgaggctgtaccccaaagatccaaatagaagagttaagaccaggtgtctttgaggcctaaaggctgagttttaagagagtgtaccccaaaagtctgaaggagccggtttccttctcccagtcttagtggaatcagtcatgggaggcagatgccacgcccacctgtgcaggatgctcctcagaagctgccccttcaccagcatcttctcccaccaggccgagcccctgacctttggggtgcatcagtgtgatagatcctggtctctgcagtccgccatggctacggttcagatgtgcatcgtgtcactgtaaatgtaatggtactgttgttacagtggaggacttggtcaaaatccagttgttctacaacgtatgaagcctaaccgctggttctgacatacatgtgctcaaaatga

SEQ ID NO: 1117 - DNA, 1164 bp, Mus musculus
atgcgtatccccgtagatgccagcacgagccgccgcttcacgccgccttccaccgcgctgagccccggcaagatgagcgaggcgctgccgctgggcgccccggatggcggcccggccctggccagcaagctgaggagcggcgaccgcagcatggtggaggtactagctgaccaccctggcgagctagtgcgcaccgacagccccaacttcctctgctccgtgctacccactcactggcgctgcaacaagaccctgcccatcgctttcaaggtggtggcactgggggacgtcccggatggcactctggtcaccgtcatggcaggcaacgatgaaaactactcggcagaactgagaaatgctaccgcggccatgaagaaccaggtagcgagattcaacgacctcaggtttgtcgggcggagcggtagaggcaagagcttcactctgaccatcaccgtctttacaaatccgccacaagttgccacctaccatagagccatcaaaatcacagtggacggcccccgagaaccccgaaatgccaggcagatccagccatccccaccgtggtcctatgaccagtcctaccagtacctgggatccatcacctcttcctctgtccacccagcgacacccatttcacccggccgtgccagcggcatgaccagcctctctgcagaactttccagtcgactctcaacggctccggacctgaccgccttcggcgacccacgccagttccctactctgccgtccatctccgacccgcgcatgcactacccaggcgccttcacctactcgccgcccgtcacgtcgggcatcggcatcggcatgtcagccatgagctcggcctctcgctaccacacctacctgccgccgccctaccccggctcatcacaggcgcaggccgggcccttccagaccggctcgccctcctaccatctatactacggcgcctcggccggttcctaccagttctccatggtgggcggagagagatcgcccccgcgcatcctgccgccctgcaccaacgcatccaccggcgccgcgctgctcaaccccagcctccccagccagagcgacgtggtggagaccgagggcagccatagcaactcgcccaccaacatgccccccgcgcgcctggaggaggccgtgtggcggccctactga

SEQ ID NO: 1118 - DNA, 96593 bp, Homo sapiens
aatccactggtgcgtttgtgtgggaatgagagtgaatctagagagatgaagacaattatctggtgggctgttaggaggctcaataaaaaacacccctgctctccggtgatccacaatcaacagtgagatgacaaaggagtcaagcagatggagataaaaataccagcttggtcactgatagaacttttggagagcatggcttaggtatgtggcttcctgctactgagctccagaaatagggagactcactcaccaatacccaagcagtgtctccccaaaagaataaggagagggaaagagcatgcccagggtacttgttttcttattgctgtaaaacgagcaaattgccaagcttagcaccttaaacaaatttagcccacagttctgcaggtcggaaatctggtggtgctgtactagattctctgctcacagcttcataaggccaaaaatccaggggttggataacctgagcccttacttgaaggctttagggagaaattcacctccaagctcatgcaggtagttggcagaatgcaattccatggggctgtagcatagtggccctcgtttccttgctggctgtcaatcaggggtcaccctcggcatctagagactgctctctagttcttgcaagtgcctgctctgtcttctagctacaatgctgacttcacttctgccccagcctgagaaaacactgtgtttgtaatggtctcctgtgattagattagggctaccaggaaaatctctctgttgcatgagtcaaagccaactgattagtaaccttaattacatatgcaaaaaaaaatctctttttttccatgtaacataaccagagcatgacaactcatcatattcccagccccagggattagggtggaaagtttgaggggttcattttatgcttctgccttctacaaccagtttctgcttccaacgctactaactaggtaattcaatcttttatggtggaggaggaatgagggtgtaaaaagaggtcaagagttttacactaaggaatgttgttccacatggaaacctgaagccagggaaggggtggttccaccacttcctctcacccgccccaccacccaatatatttaaatagctataacccaaaatatattataattcaagtcacataggagatgtggaaatgatgataaagcatgtgattggtctttaagaggcaatttcacctgaggcagaaggatctgcccccctccaagatgaggacaggaagggtagctcttaatcctgcagaactgtgctaaagaccttgcattgaattccagatgcccaggagaacacagcagaactatggtgcaggagactaatctggaagtactgtatacaattagcaggaaccccctttttcagagatctttgtaagaaatcttcagagaggtaatgagaacttgaaccagaatgatgtcaataggaattgaaaggtgggggccgaattgttatcaaccaaagaaatcaaaaagagatcttggcaacagactggatgagggcaaagatcaatccatggatccaagtctggaaactgggagaatgatggtgcagtggggaaaacaagaggaagacctgggttgaagtggaaactgatgaattttattttcagtaaaatacacatggcaaacactaattttctcaggttgcttccatcttacacacatgcacacatatatatacacaaacacctctcaacactggtctttctctcctcctgctacctcaccagtttccctccctcctccaacaaatttcattctctccttccctacatcccattcgctttctactctctgctccatttctgctgctgccactcaactgaagctcctttggcaaaggttacatggcactctctgtagacaaatccagtggaatattttcatattttcagtccttgttttcatggcccctttgtggcctttgggccatggttttcctccaaagctggcattttcctttattcttttcttttctttttatgagacagagtctcatcctgtctcctaggctggagtgcaatggcacaatcttggctcactgcaacctccgcctcctgggttctagtgattctcctgcctcagcctcctgaatagctgggattacaggtgcccaccaccatgtctggctaatttttgtatttttagtagagacagggttttaccatgttggtcaggctggtctcgaactcctgaccttaggtgatccacctgccttggcctcccaaagtgctgggattacaggcgttagccaccatgcccggctgcattttcctttactcttattacttattctctcctctttcttttcctagctccatctccttggttgctccctcttctgctcaccctggaatgttgataatcccagaacctgagaatggtctcttctcactggaaacagtctctgaaactagcatagagtttgattgtaccctagatacaatctgaaactacaatagatattctaaggatgttcagctcattatttctacatgaaacctctccccagaattcctgttttccccaccagcacctcctattctgttctgggcatccaaagctcagagagacatcacgatgtctctctgtaaacccgctgtttctggtcttctctactactattaaaggacagatgctggggagactcctccccctccctcacctcaatcccctcttccatctccattgcttaatccagatcctcatgaccccttgtctgacaactgctatagctccccactcctcatctctactccctccaactcaccgagctgttgttgacagacttatttttctaatatatatattaattttgttatttccctgtttggctttgacagatcaattttcccgcatgttgaagttcacatttcctcaggttgcttgtgcttccaatgacctatctacgtctatgtatttttgaactgctgcactccctcccccactccccaacctggtctcaaacctatgccccaactgtactggaactgacacactgatgtgtttcataaactcacgcccttattcatgatgcttattcagcccagagcaccatttccccaccccaccgtcacctccctaaacccctcctctagctctttgaaccacctaaaaatctacccaacctccaaaagtcaagtcaaaaatcacctctgctaggaaggaagtctttcctgagcccaccaggggctgttggcccctcttcctcttatattccctcccaccagttcctgggaccctggacatgtgtccaccaacagccatgacacttctttactctcatctgtttggtgtttgtcatcagtgagcctagcaccttgcctgggacagaggaagcattcaaggaatgctgaaggcaggtgaatcaaataccttgtatctaggaaagtcctaaagatgcccttttaaactagtggaggtgggaaaagactaaaacgccattttatattattatcaatataaaagcttctcagccaaatggaccttggctttctcctcaaactctgtggatgacagaaatgacattaaaatctgactcctaatgatatgaggtttgcatggtgaagaatttccaagatattttctgatctagaccctgagacgggggggataaaagtgaaagatgagatcagagttaattttttagaactctaccaaggatagccacaaaaataatcatgatccaaaaggaacatagcttaccatgcatgtggacctatatgtagatatgaatatgtgtgtgtgtgtgtgtgtgtgtgtgtgtgtgtgtgtgtgtgtgtgtgtttctatgtaggtcaagagtgatgtgaatttgggcaagttacctgaactctccaagggtgaggttccttatctgtaaaatgggggtagcaatgatgttcttgtgaggattaaatcaggcaaagtatataaaagcacttcacccattgcctggcatataattacattcaatgggggatgtagggaagagagagacagagagagagcatgcaagctagcacactggaggatgggctaccagattcattgttcactgtcttaaacacacgcaacctcccctctcttgcagtttgggttctggcatctttaacagtttcatgggcaaatcacttcaaacctccacaggtgctacttcacctgggcagcagttgctcaccccctaccccttccccctccccaatttaaccacacttgctgtgttctcaaggctgctgatacacaacaaactaagaaagtttttaatagttaccaatcacagttttcaaaatccactcatttttgcccttgtttttgggtttaaaaaatcctggcattttcctcagaattgctgaactattaggtgtgtagatgaacttgtgttttcttgctctcctactccaatttcttagactcagacatggaaaagcttctctgggtctcaagacataatttccagggtgcgtggttccgctgggtgtgctgtctggtcagtcttaccgttgtggattccacacccccaccccactgccccaacacctattaaagctgagctgacgtaacttcaggatacatttattatttcttaccttatcattcacaattagtgcaaatgattagttctctgccttgctctttaaaaagaaaagtcttcatggagtcattttatctacttgtgaaccacaatctcgtttttttttggatgctcctttgagactatacatatttaattcctttaatatttcatcatagagcagtccttcagaacctcttattttagttgttccttttactttggcaaaaatataagactaaagaagctgcaaatcttgttttcctgcctatttaaacagcatctagaaatctgaagtaattgtctcctcttattttaaaggtttttttttaaaaaaaaaaaaacagcatactaaatattgtggcatggagttgaaagctttaggtctgcagcatttgaaatgctcaaatcctgtctttaaagaacagtatttcctctttgtgactcagtgctgttatcaatatacaaggctgatagagtaatttcaaattcacaacattatatgtagatattcaaaggaaagaaaaagagcttcatgtgactttgcttaatgggtttacctatagttgtaaatgtatactgtaagtgatccatatttgggaattatcatgtaacaattatttctaataataattgatataatctattagaacttgtgagaggtttcgatgtaaataatttacctgcctagcagagagaagggaaggagagtaagcaggggaaaatgtttctaaaatgtcctatcattggaagtaaatgatcataaatgtttttgcgttaagttagggtttggttttaattttcccttgaattctaatgttcctacaccttccaaatatattttaaatcttcattaaataaatcacattttaatcacacacggagcttaaaagaggtgattctatgacagatattcagtattagctagtgaaggagaacattggttgaaggtacctaaaaccacgtgcataaggaacagtttatttcttatttggtgatttactatttcaagtcatttttgtgtcaaagctataaaaatctccagtgctaaaaagtgtaagaagaaatgagctagcaaaaaaaaaaaagtcgggggaaagttaatttttaaacttgcattacttttattttcctactttctgttatttcagaatgcatacttggaatgaatccttctagagacgtccacggtatgttaaattccaagttatatttttaaataaagtacacaccttcatagatgtgtatatgattttatatctatgtatctctatgtataacttgtgatataatttaaccaaataattaaggctgtttctgctgattccaatatacttaaaagcagttctccatattgtaaatgttataccatataaaatatttcaatgaaagcttaaatgataccctcagttctacagcgtttaccataggtgcattctgatgctattaaatgcctctatacaactctctaaaaacaaaacagagcttggcttccctcacagcccagcttattacctgtgttatagcagtggtaatgcaagatttttatgagagtaaaatgtttactaagcattcctaaattttaaaaagattaattttaaaatgtcctcagcttgctacttgtgaggtacacaatgggtttatgaagtgaaagtgaaatcatcacacattaaccatagcatcccacagaaacattcagatggaggaaggatgtaatggaagaactaagggctctcctcccccctctcatagtaattagatttgaaaagtgaagtaatctcaaagccacttcagaagaaaaaaatgtttaattaaattccaatgttcaaaactggatagtgtgtatggcaggtgatttgtacatacatgttactcttcatcaaaattgttttccatccctgtgacatcaatacaaactgcagctatttggttccaaaccatagcaagatacattctattttttaaaatgtaaatggtcatttaaaatagaaataattcttttagacgtactgcatttttacaaatgtgattttggaaatatattgctcgcaaagggtaattttaagagaattgttgagattctaatcccatctttatgcatattttggggaggcttttgaaagagcaaaaaggtaaaagatttagttatcttctgagaccacctatagttctttacctaaagttgtagaagaaaaacgtcaatgcactgttactgttttccaatgaaattatttttcttccaactaaccaagcagtactttttaaatccactgcagaaatgtacatttcattcctgttgtgagccgttttcaattctcctccctccctctccccgcaacaaaatttggaaaaatctgtcacgtagcatccgcccaacgtatcgcttcgttgtattttttttttttttaattttgcattatgacaaaagtaaattctagcattactccagggaaacactgggaatgaacctggtaatgtttcctttcctttctcccttaggcaaaggaaggggaattctgtattgtcgctaaaatgagcgctcttggtggaaaggaattcctcacttcgtacacgctgtggctgtccttgaaagtgcaggctccgtaaaatgcccggccgactaaggggttccctttccccggagcccctgcctctttccattcattttagatcctcagtaaggaagggcagaggttggtctgtttcttcttttcaagagggcaccgcgctgcgcagttaacagcctgcgccgctccggggaaacccaaatgtcccgcgatcccatcgagtcaaggagcaaaagctgtgattgctatcagctttttgtcgggcttcaaactcggggtttatcggttgaaactcctagctgagcagctcccacgacgctgcctctgacggctaaactcggtgcatgcaaggctgggaccaactttccttactcgataaaggaacttgactccctcctgggagaccgcagcccgagtccgactcgcagcccccgtcgcggggtttagggttttaggcaagcggcccgagacccagaggagcctccctggacctttccgaggggcaaatcacccgagtctgctatttcccctggagtcaaaagcctacttttggagccgccacaccctcgtgctccctcccgcatctcgggggttccgggggatgcacgtgggggtggccccaggagccctgggtgggatctcggggaaatgcattggagaccaggcgaaaaggtttcccttgcccagaacttgcctctagagcgggccgcgtccgaacccgcaggcaaaggcgctgcggcccctgcgggcgggcgggcgcgcgcgatgcactcttctcagggacagagttagaaagtggacgtttgggcggggggagggggggatttacaactggaattaggcttaaaaaaatcattttaaaagaaaaatgtagtaagttttctttccgagaccccaggtccattaaaacaaaactgaactcgggtgctggcagtgcccagggggagcggaggcggagagggttgaggccgcgggccgcccgccttagccccccggaagcccgggctcctgaagcacagatagccaagagcggcccgagtcaagccccaggaacaggggcttcgggaagagaccccgaccgggccgcacagcggggaggcctggtccgagagtccccacctggccggctgcgactctatattggaacctcggaaacgcgccttggccgttccagctcaagtgggctctggggcggcttcctgtcttttatcctcgaacgctagttcttcccgggcgacccgaaggccacgaggcgggccgcacagccccgcgccgtcgggggcgttccgggagctccggggactgcgcgcggcgtccagggagggcggctgctgccccctggcgtccgccagagcccgcggcgcgtcccgacagctccgcgcagtccgggcccgcccgggaaaggcctccacgccagtcaaccccggccccctcctgcgtccgggcccgcggcaacgcccggggacagtccctgcgcggcagcggccacagcaccctagccctgggggagggaggagcgggcgtcaggggccccgtgaggtcggcgagggacccccgcgccggggagcttaattgaggggctccgcggggaccacaaagcagcccgcggtggaacggggccgggatccggggactgggttgcagccccggggtggatgagaggccccgggaggtgcagggcccggcagggagggcgtggagggactcatggtgacgggagcagcctccgctgggagggagccccgccgggcggggtcggagttggcagcgcacgccggaccgggggcggggccctccgagctccgcgaaaatgcccgcagcaccgcggggaccggcgcagggggaagcggccgcccgcacgcgaagccggggtgggttccgcacctggggccgctcgagcgcacgggggcggggagaggagcgggggccgcttccggggagccggaggggagacgcggggcccgggcaggctgtccggctgctgcgggtgccggcgctacaaggcccgggagcaagccgcgtggctgctttcaactttccttccagccgcgcgttcttggggtctttcctgactaggaaactcttcgctggccgctgacgcacgcagcaagtgagacgcgcggagggatcgagccgcggcccgggcgcagcggtaaaaaacacccattacagaaaccgacccaagggaagacgctgagagcaaacggcacgcgcggacgccgtccggcctcatgcaaggaatcagcgccgcttcgccgcagctgccagccggacggtgcaggagcgcggagtggctcccccgggccccgcggccaaatcgcacccccgccctggaagcggaggcctggccctgggcggccgcgcaggatctggggccgtccgcgggctgcagcccggttcgggagcctcgtggcggccactgcgcctgcctgcagcggctcgcggggccgggcctctccgggtgcggcgcgccggccgggtcctcctcgggccggcggggcctgctttctttttccaggtctccggaccgtggccactcgcggagccgcacaagcctgcgtgtggctgcggaaaggggtccgcacgcgggcggggccccgggccagcatgcaggcttggatgcggggcgcgggggtggcctccgactccccgcccgggctgcgtacagtagcgcgcggcgcggcggcgggggcgcgcgggccaattccaggagccggcggcggcgagccgcgccctggctgataccggaaaggcctgtgattggccgccggccgcccctatgcaaacgagctgagggaatggaattcctccggccgggcttacagtaaaagcacgttcatttccaggcactctcattcatagagccagcgggcgcgggcgggacgggcgccccgcggccggacccagccagggcaccacgctgcccggccctgcgccgccaggcacttctttccggggctcctagggacgccagaaggaagtcaacctctgctgcttctccttggcctgcgttggaccttcctttttttgttgtttttttttgtttttcccctttcttccttttgaattaactggcttcttggctggatgttttcaacttctttcctggctgcgaacttttccccaattgttttccttttacaacagggggagaaagtgctctgtggtccgaggcgagccgtgaagttgcgtgtgcgtggcagtgtgcgtggcaggatgtgcgtgcgtgtgtaacccgagccgcccgatctgtttcgatctgcgccgcggagccctccctcaaggcccgctccacctgctgcggttacgcggcgctcgtgggtgttcgtgcctcggagcagctaaccggcgggtgctgggcgacggtggaggagtatcgtctcgctgctgcccgagtcagggctgagtcacccagctgatgtagacagtggctgccttccgaagagtgcgtgtttgcatgtgtgtgactctgcggctgctcaactcccaacaaaccagaggaccagccacaaacttaaccaacatccccaaacccgagttcacagatgtgggagagctgtagaaccctgagtgtcatcgactgggccttcttatgattgttgttttaagattagctgaagatctctgaaacgctgaattttctgcactgagcgttttgacagaattcattgagagaacagagaacatgacaagtacttctagctcagcactgctccaactactgaagctgattttcaaggctacttaaaaaaatctgcagcgtacattaatggatttctgttgtgtttaaattctccacagattgtattgtaaatattttatgaagtagagcatatgtatatatttatatatacgtgcacatacattagtagcactacctttggaagtctcagctcttgcttttcgggactgaagccagttttgcatgataaaagtggccttgttacgggagataattgtgttctgttgggactttagacaaaactcacctgcaaaaaactgacaggcattaactactggaacttccaaataatgtgtttgctgatcgttttactcttcgcataaatattttaggaagtgtatgagaattttgccttcaggaacttttctaacagccaaagacagaacttaacctctgcaagcaagattcgtggaagatagtctccactttttaatgcactaagcaatcggttgctaggagcccatcctgggtcagaggccgatccgcagaaccagaacgttttcccctcctggactgttagtaacttagtctccctcctcccctaaccacccccgcccccccccaccccccgcagtaataaaggcccctgaacgtgtatgttggtctcccgggagctgcttgctgaagatccgcgcccctgtcgccgtctggtaggagctgtttgcagggtcctaactcaatcggcttgttgtgatgcgtatccccgtagatgccagcacgagccgccgcttcacgccgccttccaccgcgctgagcccaggcaagatgagcgaggcgttgccgctgggcgccccggacgccggcgctgccctggccggcaagctgaggagcggcgaccgcagcatggtggaggtgctggccgaccacccgggcgagctggtgcgcaccgacagccccaacttcctctgctccgtgctgcctacgcactggcgctgcaacaagaccctgcccatcgctttcaaggtactggcccggagagggtggtgggaggacaggcggaggccggcgaggccgggggagatccgcgagggcagcggccaggcgggcggggccggattctggaaaggggcccccgcagccccgggtcggtcttcctagcttgggatgtgggggatgctgtgttgccgtggcgaccctcgggaggcactcgtctcagctttctggggcggcctcccaggagggctgaaaacatcagggtgtccccaaagatatccactgggagccggtcgggacctccctggcaggggccttagctttgatacaaagtaggaaaagttataacccagcccggcagagacagcccgtctgctaacttactgctgcccctaccgctggattaacacccaaaccattttgtcttcctcagatgaaaggatcaggaaataaaatagtaagacttttctgccttcaagtcagtgaaaagaaactaactagggaaactgtcagggattttttttccccttctctaaccgccctataggaattagcatgtccaaagtccacagcgggcgtagttaagtttgcaaaagttttctgaagagttctctgagctttttagcctgctcctgccagaagccgcaagtatcgaatcctgtttcttttcccggaaccgttctgaatgctatcatcagctcacctagattaagccaggggtagcgaaaggtgacgaggctgttttcggagagccaggggtcccagcggcccgctttcctgctagaggagggggcggcgcgtagccggagacttcagcgcggcggctccaaagatctcccttcacttttcacccctgatcatccccaaagctttgagctgcctttaaaaaccttgaccttcaacaggggtatgaaaacaaccccaggcgtttctaaacaatcaccctactacactagcagcaagcagtaggaatttaatttctgcagtggagattctgttttgtctttggtgggtttgaaaagatgcgactaagtaaaatcagtgcgggtcatttcctgttcgtttaaagggcgaatcaaggcaggtggttccaagtgtaaagataagctactaaaaaaaaagtttaaataattgtcccctttaaagggagattaatttaatataagctttttatagttccaagcctcagctgggtcttgatcttattacaacgacgaatattcactttttaaaaaagtattgttgcggttatttttaagctttatacagtttccacacttagattgtgatttctaaaacaaaacgaaatttgcagttggctgtgtctatagattggcctctttttccactcacttttctaaaagcagttttttttgtttgttttgttttttagtgggggtggaaatgaggagaaggaacgaaggaacgtggtggcttgcttgactcttttttccctccctccgtttacttagatttgggtttgggagaccattttacttttaaatcattctaaccctttgcctaaatggactcagcgatgactctttagggcacccgcattgagaggggacccaacagggttgggccatggggtcactatcagataaagagcagaggcaagacgggctgataaccaccaaaggccattaaaacctggctgccccaatgcactagggctctaagagatttgtggcttccttttgggggggaaatcagggtctcttctgaactccctcctctgccagggaacccacactcaaatatattaaaagactaaatgattaataaataatcttcaggaattggagcaattcagagtctcaagccattacatgaaagtatttattttcttctaaaaaatgaaaaattatacatattgcttttatgagctgtcagaattctttctagcagaaaccataataaccatagagtttcctttttaaaatgacttttggcaattcacttaaaaacaattaatttgttttattgagtgataatctataggctactaaaaatccaaatacagagctcttgaaaaaagttcaagcagatcccctgagaacatttaggggaaaggaaaggatagcagagaaatcagaccatttgattattgtctgtcaccaccccaatcctcataaaaagaggcttcttcctggaggagacctgctcactgcataactagaagagtagacaaaatgttcagtgagacagtaaacgtgaagggataaaatgttagggataaaagcaagcaaaacatcaaaacctgcctacatcccgggctcatttagtgtgtgtccctggcttcactctatctgcccacccaaccacctcacaagcagcttcaacagaaattattactttaaaatttggatcttaaataagccgcaggcaatctccctaggaagttaaccagtaaataattattatattccctatggtaaagagaagcaaatgtgaaacaatgataaggcctgatgatattgatgaaaagatcactgaaggccttcttaggaatctcctgaagttctgtaggtaaatcctctacgtcaatcttctgaactaaagagagatttaaaattatgaattttctttaaaatagattacaataaccctacttgcttattttgagccccaacctgttctccccctactccttccctcccatggaacacctttattttttacagtatgagagatacatgttttttactactaagaaaaccttaagtttgctgtgtgttttgctgtacttacagaattagcctaaaaagctgttttgatgacttaggatgtatttggtaataccatggtgttatagcttgttcaggccctggtacaccagagtccaaagacgtaaacgtgccttcagcagggaagttcggaggtcttggattctgatggtaatattcttttcataaaaaggaaataagtaatatttttgtcggcaagatcacagtccctagctatgccttaaatatcatctcagctgaattctgtgttccactccacagccttctttgcaacactggaaggttaacggatttgaagtaaatgaattgtaactgtaatttcaacctaattagaattggtttaaaatgccagtttggaccgtgaacaggctagccaagaacagtattgggaggtccatgtaatatagaagagagttgatatttggcccaacttcctgatactttaaaaacagagaagtaaaacaaaatatgagatatctttggccagcaagtcccttcttgcctgtttggtctgtgttaaaatgtaaatgtttgtgtttccttacctattgtttatagcttttcattccagttgtttcttttttctgtttgaagttagatatttttacattctctccatattgcccatcagtgacaaaacctgtatcaaattagcacgcatgttagttttgaattaaaaagaaactttttaaacctggcttaagtatgcttgttaacaattggacgatatacagtattaatgaattgccctggatttactagttcccctttacccacccgcctccaccaaaaaaaaaccctcagagatcaatacaaggccaagtgaatgatatgtaggtgcccaaatatggttgattctgctgcatttaaaaaaaaagaggagtgggagttaaacttctaatttttttcttcttaagttccaacatcaacagccttttcttatttagcctccatgataattttattctatgtttgtttcgacttggcgaaggtctcctgaatttgccaaattaccaatgaggatagtattggaaagatgagagaggcacaggcttggagcactgtgaggggaacagcagtaggaggcagataattcagaatacattcctgtagttataaaagaagatttatttattttcacctttttacagatccagacccaacaatgagttattcagtttgaaacccacgtagtggaggcagtctctgtatacctgctgaatgttgagttacaatagagaagcctgggttaccacagggagaggaggatgaggaagtaaaaatatgtgttcaaagagggcatttcaacactgtgagctaactttacaacgggaagtgaaaatcatgaaaaaaaggggaaaatttgttgtgagagactaaaaagagcaaaataaagcaagcccatttttcgggaatagaaaaaaaaaaaaaacagtagcaataaccaaataactgatcagggagatttatttccgtgatatctttttaaaacaaaaagggaattgtcgtatcactgctcttaattaaatggcaacaaacacacttataatgggaactaaatagctaattagagggtgcttggggaataaatagcagagttttaaaatctcctatatggaaaacatgtccaacaattggaatgaaaggattaaaaagagagaaaaggcccagaccttgtttggcagtgcaagttggataaaatagaggaaaatgcctccctgcttctatgagactagattatcctggtgtagtcttggggttggaagtatgttcatctctcatagtgagttagttcgtgttctgtgccacaaggactgaagcagttctaatgaataaaaacaatagatagtcatctggaggccacagggaaagggtgatggctaagcagatcatgaaaatgggaatcttgagaaacatgacttcgatatcatacaagtgagtctatggcagccttttttacatatagaaaaagaggcctgaaaatatatactacaaaaaattatgtagcagttattaaggtaaaaattgggaagtaggaggcagaggaaggagtgataacactagattaaggaatgctttactgttaccaattcaaaaacagcaaccaaaaatgatgatgtaattggaatgagtaatataaatgtcactactgactttaccgtaaagaatgtcagaaatgatcagaataaatacagcttggggcatttcgatttgaagttgtatgactgctttgaaaaatagaaacaaaggaaatacagccaatagtaaatgtctagaccaagaaaatagtttctagaaggcctaaatgatagccaagaaattgatgctattgtacaaagtatctttaggtcatgcttttcagagtattttactttggaattcattttcttaattacctgagtataaaaacatttatctaccagttttctccaatagccctgataagacttcatacttactcagttacattaaataaattcctggtcaagatcagctgggctagcagaaaacctcaggcatctgtgaggacatgagtttacacacgctgagactcacagatacaaaaatgcaacccaattccacccctgaattgaggggagtgcatagaagtgaatgtcccgtctttctgaggtctgttgattttgtaattagtaaacgaagggtgcatttctgatttttttttcttgtgtgctagaattcattgctagtaaaactcaagataatagcgatgagtaggaggtatcaaagatgaactgtagagggacagtttaagttacttaagaatcgtcagcaagatgaaatctacttttagcagaaattgggtttttttgtgtttttttgttttgttttattttctaaaagtaaagtctgcaccttgttcagcctgttagtggaggtctgagcaagtaaaagatgggttggattataaacttacaaacacaggatgttctgtttctcaaacgggagaaattaagaagagatgcttgtattcaggagacggcatagctactcaaaatccttgatatcttgctatggttagtcttgttccaactgtgctatgtgacctactatggctttatgaggtaaatttagtatatgtgtcactatttgaaaatttacatatagttatacataatgtattaggttggtgcaaatgtaactgcagtttttggagttaaaaattgcaaacactgcaattacttttgcaccaacctaaaatataataaaaaagtgtcttctctttataacttttctgttgttttgcttaagttatcattgctattcctctgcaacctaaaaagaaatcattgaatatacatttaattttagaataatcactacacaaatgccctaaaagtgtatgtataacatccctgatgtctgcatttgtcctttgactggtgtttaggtggtggccctaggggatgttccagatggcactctggtcactgtgatggctggcaatgatgaaaactactcggctgagctgagaaatgctaccgcagccatgaagaaccaggttgcaagatttaatgacctcaggtttgtcggtcgaagtggaagaggtacgttatctgtcaaaactatgcttgaaacacgtttcatggcaacaaacccacatttcaaaattctagtgatttctgtgatggaatccctagaaactcggtctgtcttaacattcttattgctatgtcaagctcttaaaaatatttatttgaagtttaatatttttagcagaatctctatattattgctttatgttactgagtggatttaagactgatttggaacatgcaacgtaggaattgtgaatttcaaagaaacgcctgagatttttactaaaatgcaaaaaatataaaactgactttaatgaaactaggattatacaattacaatgaggattctctcttggataacaatacaaaagctatttaatggaaactgttgacgtatgatctgtgggctatctgtgaaaagtgacagagtttcgaatgaccacttctaataattttagggatttctagtgtatgatgttgaaacatggtttcaagcaagcttacctttttagaaaaagacatgaagaaataatgttagtaccattgatggcagtatgatcttcctgttgtatttcttttcaatgccttatttaggaggaggggttgggcctggttagcattttagatactaataatattagagattggattatccaagaaattgttgcattacttcagctccatgtgtgattttatttttccttgcctttaactcattatcaaagcattagagcagaaataggaatcttggcttattgtaattttttctggtttccaattattttcaagtattatgttttctttacattgtaagaaccaaatcatattttataaatagcaacaagtagtaaaagtttagttgagggaggtaagatagttttttaaactcattttttgtaatatagtaccgattaagcttacaaataagttatttcaagtataataaaaagacttatggtaaatacctaaataacagtaatagttctcgtattgaaaaaaatggaagcaccaatcaaacaacatttaaaataagagaaattattactctttaaaaaggcatttaaaaacaagaaaatctcagttctcagagaatttgattagtcagaaaggagaaaggggtaaatgtgagttgattattttggtgattatttttgctatcctagctatctggagcattttcataatagaatcatagctggagaaaataaaaaatttatataatgtgattgaaaatatatattcatagtactatattaataatagggtaatgcaaagaaaattatatccactttttgaaagcatgagtgatgctataagatataaaagcataagtcattaaatgggttcacttgttgtattaaaagtccccacctttcagtaaatggaatttgcattatgattcagagatgtgtgtctagaaaacatcttaaaggcttcggatgagtagctggcagagtgggtgagaagccaataaaaaacaaaggccccacagcctggtccatgcccatcggcctagctaactctcttaattcagttcttgtggatttctgctgttaggaatcaatagctaagtatcattgaattgcttttctagagaaagtgttatcatcatactatgcatctgtgtgggtcttcaagttaggttttggtcataaaagttttaaaaactatttagtgatccgtgccagtgacattttcccacaagaagttcagtagtggctttccggcaatgcacagtaaaccagtgataataaaaaaatgagattttgaaagcagtgtgctttcttttctggcattgatggctgatcttgcatccctcattgaccatttctgttttgagtgggtgactaataggtgcttgtgtttacttgggtaacagtgaactgtttccccaaggtgtggagtgtttgcatttggctgcaggattcgtgccagtatgcccttgagtttgcataaaccccaaaaagtaaaatagctgcaaccaaggctgggctgtcttcccatactctggaatgagaaaattaattgaaatgccataaacagacaatattttgaacagactctccttcccaccagtgataataagcaataaaaaatacggaaaccctaatggaacatttgacccaattgtaattactgtggatatgaatattgttggtcttgagatgtatatatatatgtgtgtgtgtatatatatatatatatttttttttttttttttagtcagcgctacaaaagtaaatgagctgtctgaaggcccgatttgactctgtcataatttctttccatagtcataaaatataacttgatttttctctttcaagtgtaagtgtcaacaccaaagcctgccagatttttttctttctttttccttcttcttctttttttttttttttgcaatttgcttcccattaggaagagagcagatcattctgactaattttaacaattagtcttaatcttcctcactgaatcttacctttaacagtttcattacgttttattaagtgatcttaagacaactgtctcattttctgtttttgaaaatgtgcttgaaaatatacccttggcatgaacacaccacgccatggctcagaaggccctggctcttggctcatccaaactttcagtgccaattttgaattctgtcaaaagccaccagtctgatggattctccaaggggcctagtaagtggtgcaaaatgaaaggtagagaaagaagttctctttctgtgaccagctgccagtccatggggattgtaaacctcatagaaactgccagaggttgaacatggaagggtttttctctgttctacaaaacgaatctatctgggcgctggctgccatccaggatcacagctcctaacctcgggttcattccgtaactgggaaaacctgcctgtccggctttgatggcctcgctggctacactggccctgtagaagcctgaaccttctctcttttcttccattccctcctttttctccttggcagtttaaatcttggttcagagtgtatctcacccttggaatgtttctctctttgattcagtatctccatgtaaatcgaccgctcctttacaaaggaggaagagatagcagctcccaggagatgagggttagggagctctggggaccgggctgaactccagaggtcatgtgagcacagaggttattgttcagaataattcacattttagccaaatggactgggactccatgacacccccaaaaaattgaagttcagggtcaaaaggaattctcttatgtgaaacgaattcactgagcagcttatatcagtttacatctgcagttgaggcaagtgctacatcacctgccacctttagaatgacaagaaagtgtatcatggcttcagctgagagaaatttaagaaattttagcaattggtatccgggcacagtggctcacacctgtaatcccagcactttgggaggccgaggtgggtggatcacctgaggtcaggagttcaagaccagcctggccaacatggtgacaccgccatctctactaaaaatacaaaaaattagccaggtgtggtggcgggcgcctgtaatcccagctactcaggaggatgaggcaggagaatcgcttgaacccaggaggtagaggttgcagtgagccgaggttgcgccactgcactccagtctgggcaacaagagcaaaactccatctaaaaaaagaaaaaagaaaaagaaattttagcaatgaaatctgtgactgcttcatcccagttggagtatttaatcagtcagagaataactgatcaatcaggaaatacagctttagtaatttcatttcagaaccaaagaagaaatctctccagctgctttatcagctgcattgttgctgcaggaggaaagatggtctactgcacatttctttctagttttttcttagaatatgatttttaatctttggggaacatcatagatacttttgaaaatcctttggaaggctttttccaaggacaaaaaaaaaatgcacgtgttcacttacacacagaattacgtatatcatttcagtttctaggctaccagaactcatttatggaccttctggggatccacagaccctaggccaaaaatttgtgaatttggaactttgcattgatcatggagggccagcttagccctatgccgcatatagtagacacctgaaaatgaataaatacatgtacaaatgagctagacattttcttgaacctgtgctgttttggtaacacctgtgtttttgttatcgccggggtctggtttgtctaattaagaaagtagatctccttgaaaccactggccaggcctttggatggccatcaggtatgcccacatatcatcacgggtaaaggggagggggcctattctgtcattgaaaggacagtcgcttccctcgtactgtgtccacacccagccctgtaaggccaagtgttctgtggcctgtcaggatggcgttgagtttcttggcggaatttgtgtttacattgacctccctggcagctttaatcttgcccactttcaaaatagtatcctttcccaacacatttatacaatgaaattccttcggtatgttcttgctgtgaatatcttcccagacataatatttatcctgtcacaatctgggttattgcatatttgtgtaatgttagttgcttaaggcattttcattcttaaattattctacattatttgggctaaagtgtgggaggttgcccttcaggtgagtggaagactgtggtcaagaggaagggaaggtacatttagggaaggataaacggtactgatattctaaacaaagagacatggcttggctttatgtagcggttgttaccaagagatgatctgaatgactcgcagtattatcgtaggatcccagtccttctctattctattaacagattcatataatagaagaaggaaaaattcatctgaccaccccagagttgtttcacgggtaatgttcatggtataaactggcagtcagatctcctggagagaatataaggaaaagacatgagttatattaaaatcaactctcccattttcccactttcttctgttacatactgatctacactttaaaataatatatatactgaaatctgtattcagatctcattgcaagcaaatatagatgaataaagacccagtctctgatataccaagcctcaaccagccctaacaaatgctgcttttcgacgggcaggtcaaaagcttgcctccatgatctgatgtagaattcatctctagagaccaagtttctcatttcggtttcacatttgccaataaaaggatagcaacactttcctaaagcaagttgctccctgccctgcttaaagcctggggtggcccagtcatggcaaggaccagcaggaaaagctttcttgaaaactgcttgtgcttgcaacaggcagtttcgcagttgatcccttcatagttttcttgctgattttgtgaagtgtcaggcattgctgatggcgtcacacagcttttttaaattgaggttatttgtatgaacaatattttatagtttgatgggcagaagctgtacttctctccacccaccctcaaccccttccttgccagccggcttgtgtttggtggaggcatttctttttggtcgggacagaagactatcaatcagaaagtgcctgcaagagaaataatggttgagtgatttttagagcttcctgtttcagcaacaagcattatagacataaacagtgatccagccaacggctgcaaccctgctctggttctaataaatcagttttgtattttcttttttgtgctggttggcaaggggcaagagagggtggagaaggttggctaaagaagaacatattctgtgtttctggtttttttgttgttttttttttaaggaaaaattacttgttgacaaggagagatggtgtactgtctttttttttttttttttttttttttgagacagagtttccctcttgttgcctaggctggagtgcagtggtgtgatctcagctcactgcaacctccacctcccaggttcaagcgattctcctacctcggcctcccaagtagctggggattacaggcatccaccaccacgcctggctaattttgtatttttagtagagacgaggtttcaccatgttgactgggctggtcttgaactcctgatctcgggtggtccacctgccttggcctcccaaagtgctgggattacagtcgtgagccaccgtacctggccggtgtactgtcttaaggctgttttctttctgtagatgattatgacacaagttcagatcagtaaagagatgtttatgaataatcatatactgtcaatatggggagagtgtatgcttttgaaggcttcattgattcttagccagtggagtgtgtgtgcgtgtgtgtgtgcgtgtgtgcaagggggagagagagagagagagagagaatgagaatatccatacttccattgagagacttcttgggccaaattatctttgaggactaaattcatgctaataacatcttctcatctaaagcccaaataaagcaattaatggaaattaataagtgagcagtgtggatttaatgagctgcctatgaatactatgacatgcgctcgttttgtcggctccctggcggggcatggggacagatcgcagcacttcaacgtctgtatttataaacatgcattcctggacttcaggcagcgcgcatactccatcattggttctgctgtgagtcctacattcaacggagatgtattttgatctctgttgaagacagagcaatcgacggcattcagtttgcactgcactgatttgggattccagtacattgcccagtccctgttagtctatattgggcagcatgtcccattcaggagctccatttgacatcaccgaacgttctccaatgaaggtgtcaggcagttgaggtccatagaggaatcccagcaacttcctttgagaggctcacggccattctgctgctagactgaaaatgcgtttcctctgatttccttagtgaggaagcattcatttaggagccatttaaactgtgtttttctcaaagaagatgtaagtacatttcctgtttatttctcaacttagattaatttgggcttttaccttgagatttaagaccatcattaagaatgtatgggcagggccatctgcagaactaccccacctcccccatcacctatcccaaggacgtgcctgtccagttaataggagggctggccagcactctggggtggtgtatggccctaattgagtcaccgtatgcaaaccaaggtaaatcacaggaatatgggcagattgagcataattggtcatctgtgtgctcatcagatctctggaggtggaaacactccagtttgctcaaggcattgggttggggtctttacagatttttttccttcattctatttgaaactattgtatagaggatagtcagtattaatcatctatctttctatctatctataattagtaaggagctagtctaactcacatcataataaggctttgtctgcctctttaaatggtgtgtctctagtacctaggacaaatgtcctgccttcattattctatctgaaaccactgggcagtttattatcagtatcttgtctccctgcttatcaattttgatcataatcttgctcagtgtttcccagctggggtgatttgactcccagaagacatttggcaatatctgcagacatttttggtggtcgtgtattgggttggggagtgccggtggcatctagtaagtagaggccagggatctactaaacgtcctaccatgaacctgacagcctccccaacaaagacccaaatgtcagttgtgctgagattgagaaactcatctagctccagtcatgcgtgatctcgccctgatcatgcataggttgtaaaatgtttcccttgccccttttattctgacattctgcctccctacaaacttatcaaaatgtatgaaaaacttattttaaattttatgaaaaacttatttttaaaacattgcacagaataaaaaatagagaacatcactgaatattaaaagttttttttaaagggaaaacagcagtgttctgtatgcatagaattgcaccatccccctggcgccactgaccctgcctgctatcctgggtcagggatgtgcagtggctggaggagtggctgcaggtgggggtggtacacacagcagggcagcttctccgagaaggctccccactgtagccaccccctcatgaatgtcacacaggtgaggtccacgaggactgcagaaactaggaagccctctgccagaggctcactgcttttccctgaatacttcagcagagagtccatggagccactgatctaggaatgggaattgatgtcagtggacagtgtccactcatattaaaaaagtgataaagagccgggcatgctggctcacacctgtaatcccagcactttaggaggccaaggcaggaggatcatctgaggtcaggagtttgagaccagcttggccaacgtggtgaaaccccatctctactaaaaatacaaaaattagccaggagtggtggcacatacctgtaatcccagctgctctgaaggctgaggcaggaaaattgcttgaaccagggaggcggaggttgcagtgagccgagattatgccactgcgctccagcctgggtgacagagcaagactccgtctaaaaaaaaaaaaaaaagtgataaaagcaaggtcttggtgtgtgtcactgacagacaactcccagacaccaaaatggctcagtctgcataccctaaataaaaatgaaggcactacgtggcaggaggggagacaggaccaaggtttgtgggtttgccgcccacaggatgggcttgcagatgccacccgcagacagatggctgggttcctctggagctttatcccacctgccccagcatgtcagttttgccatcaccggtttttacactgagattcagggcacgatgatttgaaaacaaaaatccgtagggagactcccctaggtgttcccagtgcatcaaggtagagcctgctgcaggttgagtttctggaataggtcaggctgtgtctgctttgtttgtttgtccgtttccttgcttttgtgctgcatggggaccctcacgcctaattttccttctccgtgtatacatctgcttcctttaagctccctacagtagagcaacgctcctagattcgacagagatcacttgtgtgtcatgtaatctgtgactagtaagcattaactatccaaatgggagttcgtggacggtgtctgagccagggactgcacagagctcacgagttgctgtaggtgtgctctagagagaaggtcactggggaaaaagcttgaaaacagctgtggcatgcaagggtgtgtgtaggaacggagacccaagcactgtggaaaggaagatgtgctcaggagccccgaggaagtgggctcacaggaattttccaaaatcaagagatccagcctttaactagaaagctccaggtggtatcatgagtgacattagatgatgcctgatacatggtctgtgaatgaatgactgttcaggactgtttgtttttttgtttttgtttttttttgagatggagtctcgccctgtcaccaggctggaatgcagtgtcgtgatctcagctcactgcagcctccgcctcctgtgttcaagcaatcctcctgcctcagcctcccaagtagctgggattacaggcttgcaccaccacgcctggataatttttgtatttttcatagagacggggtttcatcacgctggccaggatggtctcgatctcttgacctcgtgatctgcctgcctcggcctcccaaagtgctgggattacaggcatgagccactgtgctgggcccaggactgttttgatgttaggcagtacagcctagtggtcagcacgtggactttactggcttccccactgtgtttcaacttgggtgttgctgacatttagggccagttattctttgctgtgagtggctttcctgtgcatggttgaacatttaacagcacccctggcctctactcaggggctactagcacccaccctcctggttgtgacaaccagaaatctctgaagccattgcgtcatgtcccctgggggcaaatcgcccctggttgagaaccactggcttggagctatctgtccttgaacaagctacttgacctgtctaagcctgattttgcccttgtctgtgggaagacagagggacaatgaggattgattacctgagacaagacataggttaggagttgttactttttgcagtgacaccaacaccatggggcagacaatggggactctgtgagtgcatagcaaacaacagcaaacagcaacaacaaccagaggtctgctttttttgtttgtctaaatgggtgagcttccaaggaggaaacacaatccttatccttatttcagggccccatacggttctgtggtcgtgaaagggttatatgcggcaggccctgagattcctgttagcaataggagaaacgaaattaaatatgtactgtaatttgaagcactgcttttcatgggaaaagaagttctcccaactcagcctttccaactcttttgtccaaacattaatggcatgcaaatatttatgattcatatgtgccccttttaattcccaatcgtattttaacagtaaacacttcattttaataatgaagcagaataatccctttgtcctgtcgctgggttacacaggctggcacctggcagcatcacattcttcctgagtgatcattgctgcctccacccaagttgaaggggttttgtagcagtgccacggcagctcgccttggactacttgaggacttccggatgttccgctggaagccattcttaaggttgtgtctcagcattttcataaactgcaagtgaacatccatgcatatttttctcttttggccacgtataaactcagcactggttcatctggctgtcacttggaagggttcttactacactattatcttgcattctggccaaatccctgaactctagattacaccgaacccattgtgtcctatttaatattcctttgattcgtaatgatgacatagaaaacacacacatctattagcgatgattctgtgagtcctagaaaagtagcataatgtaatatgagaagagggcacacctgtaggactcagatgtgccagcctcagtctccccatctgtgttcaataggtttaagagtgcctttcatctatgacttatatcatctatgttaggatgataaaagcgagatggtgtgtatgtaactatacttaggaagaagagctagggcccctcttgatgatgttcttccttctacagcgagaatccctgagggaggaggggagagagcaagccagaggcagcatgggtcttgctgaatttgaaaagttgggaatgatgctgtttttcagggcccactcctcgatggcaaggaatttatattccttggtcctgctaagggcctactaaaatgagagtgcatgagataacagcaggcattccataagtattcacaagtaaaagcctatgtaataataatataattacaaacttttattgggcattgaccctgtgatggaaatatagtacctattcctgttttattagaactctccctctgccccaccccccaaggtcatttactaagggcatttctttcattcattcatttatcagatatacattgtgcacctactgtgtgccaggaactgggctagcatgagaaatacgacggtcagccaaagagaacccacagccttgggggctagtaaggaacatggcaattaagtaggccatccctgttgtgagtagataacacatgatagatgggtgtggcgggagccaaggctcagaggtacagaacctggtgaaggttcagagggtctccctggaccacttgtcattcacttgagacctgcaggtgacaaggagactaacccggtggaggcatgaagaatcatgtcccagcagagaaagcagagtgaggaaggagcacctggcctgttgggagctgagagatgctccagtggcggtggttggggagtgatggcggggagccttacagagagatagggcggggattgccttaacatccacgttgggaatttggtctgatcctaatgaaatggagaaccacttataactaactccagatacaaattgtggaaagatacttggcttacagtttaaagaatggaaaggacatttggagggtgcgtggggagcttagagacccatccagagactgaaagctctcctttctcctttcaagcagcgccaggcatgtgtatatccagcttgcaaggaccccatttggtagatggcactgtacctagaagtcagctccctcctcaagcttgcctcaagcttccctctcttccctctctacctccacactcacctgcctttcttcctacctgcagtggcaagtgctgcaaggctggtgagcaggagctgacgccccccaagccttccttccctgaagaatgtccatgcctcaggcctcccagctgcagctctgtgtggccttgggctgtgtgtttgaggcacccggctaggggcactatcggaatcaggaggaggccaggcccaggaggtcactttggtcacttgccctgtgtgaccccagcccaaacacacagcctgatggatgagtgaagactggtaaatctggtggctgtccttgggggaagcacagggcagcaggtgtggccttggtctccagggggctgcgaattcagggttttggggtgttttggttaaaacttggttccccagctgagatcctagggaactgtggtatcaaaaggaaaaggaagattagaaagggaaaatgaaatctcaggaaaggaaatgcaagattgcatgagaacatcatggtgttttgtgggataggtgatattctgccaaataaagaggcccgcccctccactccttttgcaaacctgagcttttcccctgcctgcagttgagcccagcatacctgtgccttggaaaaagcaagctatgccttccaagtgaaattcgacgttgtaaaggactggctgtcaaactgaaagtttgcagagtgattcattgatttttagagacagggtcttactctgtcacccaggctggagtgcagtggcgtgatctcggctcactgcaacctccgcctcctgggttcaagtgattcttgtgcctcagcctcccaagtagctgggactgcaaatgtgtgccaccatgcccagctaatttattttattttattttttatttttattttattttattttattttttatatttttggtagcaatggggtttcaccaagctgcccagactggtcttgaactcctgagctctagtgatcctcccgtcttggcctcccaaagtgctgggattacaggcatgtgccaccatgcctggcctcatttatcaaacttttctttattgcctcagaatagaagatacaaagatgaataaaattctgtccctgtcctcaaacaactcattttcatagaacatctccagagaaaatgctttgcatgtcttcggttttctccaagtaaaacagctatttttcaaacaatccataattccaaacaaatgccatttccatggaaaactgagttctatattctaaggacctgattttcagtctgacttttgagggtagtcctggtgccagtagcttaggcctcaagtctgcattttgcatgtgtgatgtgagtgcgattggatcaagcaatctgcaaatacaggcactttgcacacaagtatatacagtacgccgacatcttaattcaattcagcatggagaatcaggaaattatgtgcaagttgaaggatttgtatcccgtccagaaatccccaaataaattaattatacaactccactgtcaaaaatagtggcaaatgtttgggtaaggaaatggaagaggagcataagcatgaattttggctgttaggttgttccagtggaaaagtgagaaatcaaaattaaaaatacttcataaaaaatactccaaatgcagactactcctggaatccgagggtacgttaatttttatacttagttatccgcaattaaaattagacccaaagccatctattgtaaaaggagaaatctccctgcaacctttcaggatcttgtgggatttcctgaatttgcaaagagcagaacctgagccttcactgactctcttggtttttaaaagctgcgatgtttttcttttatttttcctttctcactctttgggcgtttcaagactctgggcacaactggctttcctgcagacaaacacaagagtgaaaaatgttgcgattgtgtttcctaaggactctgagcccccagggcagacggctcctttgtgtctgcagccttcctttgcgtgacaaagggcaagtttcacatcccctgaaactgtccccaaaagaagaagatgactcatgcttacagacctacactaaggagagtgacaggaacagagtctgctgcagagccaactcaggtagaccggggatacctgcaaactagacctgaggaggccgagtcacaacaggagtcggggctcgcccgtcagacacggggtgttataggaggattctgctctgatgtggcctggatgcacttttaaatatgttcttcacacctaggcaagaaatgaccccgagctgcatgtctttttgctttgtaatctccttgccaccctcagctctttggggagcagtgtgcacatttgaagcaatcctgaggtttagccacttcccagatgtggtgaggaagtggagagtgcgctgggccatgcggaactgcaggttccagccgtggctttatttgaccacaattggctgtcagagttcaccagccccagggccgccaacgtcaagactaatcaagcctagacctggggcctccccgctgactggccctggggagtgtgtcatggcagcgagtgtccaggaagactcaccccttgaccttcttcccaactaaataaagcagttagtattttgccctggcatttggatggacacactggcgtcgagggagacaacacatgttgcagtgaggagcactggcctggcttgtttacatagcatatcagccactcacagttgtgccttacaaaggtcgccagctggcggggcaggagtgaacttgaacttgaagttcaagttgcgtttaggcctggtagcagccccatcacctgctgaacacacacacacacacacacacacacacacacacacacacacacacgcacaaaacccctcctcatgtcagacgtcagtgcctacttcatccccagctccttcttacgggatctgtcacagctctggtctttgtggaatcacctttatcatgtctttaatgatcattccactgacatttactgagacctttccctgtgctctgcttgtatattcagcattccatttaacctgcagaacaatgctacgagatggaatgactgttattaacccccttttacagatgacaaagctgaggccccagagaggtcaagtaacttgcctgaggtcacacagctagcaagtggcagagcgaggttttgaacctaagtaggttgccttgagagtccacactgaatgaatcaccactgtgtttccaccttcatgggattttatatggaattcttctctctcactgcttccaagcctacatcaagacaaacctcatctgccctgttgttttttgttctcaccttcttattcagtatgagtgtcgtttggtgcttctaatggtcttctaatggtcctcctggaacccaagccctggctggaactgatgctgctgtggtggtcagggttcagtgagcaggaggaaggacttggtgtttaccccttgtttacccctttccttggcttccttccatgcaggccaccctgtgaccccgtggtggccccctctggaaccaagagctgccgacttccagcagcacacacaggatcagtgctggggccatctgtgcactgaccaaagcctctgctggcctcaccagaccaaggccagtgagtgcttcagggagccttggatcctccaggctgccaacagaaacaccggccctctcggcagcagccccatccttccacccctgcactgggtcctgaaaagcccattttggggccgttgctatttagccaacctgccctcccttgctctcctgtgatttctcactattccggctgcagctcgctgggagaaacacttgagagtcttttgtgctccacacccatgtacttaaaataccaggcctataggtcatttcaatgagggaatttggctcataacacgtgtgccccgaggcacagatcctacttctgcagatgctggccaagaagggctgtgtcccagccgccatggggtggggccacagagagggcagggccacgtggagggcagagcatgtggctcctgtcaggtgcgcccgttgctgactgcagcccagtatcaaggctctgctgggtctcattggaagaatacaaaggacgtgtaaggcagttttcgtgctgtggaaaaatgtcacctacacctgtgaagaagtcatcactgtgtctgtaagataataagcaaatgtccttgtacccaaagctgtaaacaagagccctttgtgagggagaaccacatgactggccaaaacgccccacctactagtgtgtgctcggtggaaatgtcttgtgactgtgcttaaaatgaagggcatgattgggaggccaaggtgggcggatcacaatgtcaggagttcgagaccagcatggctgacatagtgaaaccccatctctactaaaaatacaaaaaattagctgggtgtggtggtatgcacatgtaatcccagctactcgggaggctgaggcaggagaatcgcttgaacccgggaggcagaggttgcagtgagccgagatcacgccattgcactccagcccaggagacagtgcaagactccatctcaaaaaaaaaaaaaaaaaaaaaagatgggcatgaaataatgagaattcagataatgaccattcatttcacaaattatcactttgattaagttttactcctgattatataggttagtctgtggtttaccagacggggtgtcatgagtgctcaactgccagaggcccaaacgcagctcagtaagaaaatgcttttgagctataacccaggttgagtaccattggtacattagaatcacagagtcagattttactttttggggcagtggtaggtgtggataaagtatctccagtccagatttcttgtactggtgctattgggtttgcgggtggagatttatgacctcagggataataaccggaagaacagtgagtagaaagctcagggatatgagttttgctgtatatcaaagctgtgtgactttgggaaaattacttaacctttctgggccttagctttgctacctattcatcaagaacaataaaatccatcttgtttatttcatgagattggtgtgaggaccaaatgaaatagtatatgggaaggtgtttaaaaagttgtaagttctacacgacttaaaaatgccagtattatgaatgcaaccattctttgttgtcatttgggtagtcgtggatagcgtggtggtaggagagccactatcggagcaagactgttccagagggtaaaacacacgcgtgcctgtagagcagttgtcactggtagagccatgatgggagctcttactacattgctatttgtactgagttaaatagtgttctccaaaaagtgtatgtccacctagaaccttaaaatatggcttaaggtctttacaggtgtaatcgagataaagtcatactggacttgggtgggccataagtccaatgactgatgtccttctaagaagagggaggggacacccagtaggaagacagtcatgtgaagatggaggcagaggctagagtgctgcagctgcaagtcaggaaacgccaagaaatgctggccaccatccgaagcgagaaagaggcaaggatcctccctagagccctcagggggagtgtggccctgctgccaccttgatttgggacttctgacttccagaattgtgaaagtcttaatttctattgttgtaagccacccagtttgtgataatttattacagcagccccaggaaacaaatacagtatttttatgaagtcactgaggtgctagagttgtaggcaacagaagaatcacacgtggacctgcccgcctgcacatggctatgggcatctcaggccagctgcattcttggaagatgaaatcagagagttgaaagggacattgcatgcatcccatgaacccccctcattttgctgatgaggaaactgagatctggagaggtaaaatcgtttgtattgcatccccaaacttgtaactctcttgctgaaagaaccacctcagtctctctctctctctctctcatacacccacatgcacccctagacctactcaggactgggacaatggcattatctattgttgtgtcctcaagggacttttttttttttaattttaaataccccctctctcctaaagccccttcccacttgcaccctttcccacctttctgtgagggctacatgggtatatagaaaagggtccccaccttctgggagactaggtctacacagccgcaaactgcattcagtatgacaccctaaataatcaaaggtgaaggatgatttatgaggcagcccaaacagccataaagcaaaatgtagtcatcaaggaaggctgcctggaaaacaagtgactgagtgactgcccgttgccagatgctgaagggcaggaagactcgggtgaagggtgcagcaaggagccttggattggcgaagtggctggaggaaggaagacctcagcatctcaatgccatggctcatgggtagaactcggagggtgcacactgggagtcaggtatgcggaggagagggggtgagtgagaaattacttggggcagggtcttattagtgagaagatcctaaaagcaggttctggagttcagtcttgatgatacaggtgataaccttcatgggttcttgacagagagggaacaggctgaccatgaggcttgtaggacaatctgttagtcagctctggaacatgtggatgtggctgctccccgtctgtggctgtcattgctcctggatctgttcttggaaagccagagactgcccagtgagatgggcagttgcccccaggacctgcctccctctgcggcagcatcttcctccacatcacatcacataccctgcttgctgggcctggccaaggcctcttctacccagtcctctccttcagctagatgccacggtaggaaagcatccagagtgtcgcctgataacatctgaacgatgtcctaaaactggcaaatccccaaaggccaacaagactcgtctctaggttctggggacaggccagttgatgggaaagatggatttggaggcagagtctcctggcatccctgatgctctgctccatggaagtcactccccagaagcatcctcacctcgtttattggacaggtcagctgagactttagttataaaggcacaatgggcagagcagccttcatcatctaattgttacttgctattgctctttttattatagactttaatacagatagaatccacatctttggggagtgttcggtggagatttctcacgattaggaatcgtggcttgctgtggccaaagattatattttcattgagcatttttctgtggccttcctttgtattaagacacgcatgacatttgtttttctgtggccttcctttgtattaagacatgtgtgacaattgaaaatattttcctttcatctgtctttgatttactttatgctacatgattaagaggagaaactatgttgattaaagaactactgtattgatgtaggaagattgaacatcagacttaatcaaatgttagggtcctattatagacccgtgagaaacagagaagagaaataaagcagacaacatacacacacacacacacacacacacgcacagacacaccctgttgaataccgtgtgccagataactgttttaacagggttactcacggtaaatcatttaatctcccctaaaactctctaaggtaggaaaatttgcatgtaaccatcttcctggtaaggatactgaggaacatagaggtgtctagtgacttgccaaaggtcagctagccagatttatcttctgaatcactttaccaacaagaaatgtttttagattagtaaatctatgcaatgaagattttctcaccttttataaatatatgtaaaatgtgtaatggaaattttgtgcattttttattactagtacttattgaatctcagtctgtcagttacatatacttaagtccatttatgagtcatcaattttattctgactgatcccatgagtacctctaataacatctggcattttcaaataatatttaaaatcagccagacttcgtcttttaaaaatatagacagaatgattctaatttagcctgttttcaaacttagaaattctatctttcctgatcttcaaaggtacaaagtaagaagagaaagatggatatggtttcttctactcttatttgccctgaattataaataattgggaaagatgggagcagggaagttgggaaccagaagtggagagctgccaatctgactctatggtttccggaaatcctgacttaacagaaaataaattctaatctttcttgatcttgtattgtttattgatgattacattaaagccatataactatgtgaagtgttacacttaggcaactatcataggtgtgtattccagaattgaagcaaagccaaaattccgggagtgttgtcaaaactggtaacttgtgctgaagggctggacagcataaattaatgattggttattcaacagatatgttcaggccaccaacctcattctgttttgttctctatcgtgtccccacagggaaaagcttcactctgaccatcactgtcttcacaaacccaccgcaagtcgccacctaccacagagccatcaaaatcacagtggatgggccccgagaacctcgaagtaagtgcatccacttggggctggtacaccctccaggctggtacaccctccaggctggtatactcagggaccatgtctcagattccttgggttcaacctttcccccagggggatgtcaggcccccgtaaagccaaaaagttgcattgtcaatactctcgctactcaaagcttgtttctgtgcactgagctctttttgaagcatccttttagagggcaaaaggaaattaggctgactgaatcatatgttagaaccattcagggcagcatgaaactaaggactgcttcctcaatatacagtaaagttcaacaggatcagaaacaaatagtaaatggaagattggccaggcacagaggcagcccaaagaggtctgagggtcagagtggaccacaagggagtaattaccgtctatgctggccttttattaattcatgagggccagagatgaaaactatgaaaatgacccttttctttctatggcacagatcaaaatcttattacaggcatttttaagatagagagtgggagggtagaagaatgtctggggaaaaccagtaaatatagaaagatagtaccaaaaaataactcctgtgagggaagcttttaaaaaaatgagtgaggttgtttagtctgcagaaaagatgtcttcacagtgacttaatgactatctttgagtaaacaccagagtaacgctcttttccagaaccacacccttccccaggatctgaggctgggttacagttccaggtctgtggaactgcccagcacccccgcccagcatccagatgtctccaaaccgtatcaggtccctggtggaaaattaatatactctcttcttggagtgagggatattgaaaaacagggcttcctactgtccccaaaagccaagatgcagggaggtcaggttgtaaaatgaagtggttaagaatttgggctttatgggcaagccagtggaattcttaagccttcagtgagctacagagccttgctgaacctcactttcctcttctgtaaaatggggataataatgagagcttctttataagatcaagccaaatgatgctgtgtgcctgatgcagagaatgaaggcaggaaatgttagtgatccccagtagggcatccctgctttcatccctggctactgctccagtcccctctagatgaccttccctgcatggtggtttctaggtggggttttaaggtagttctctgcaggctatcctgtgatcacggcagcttttatggcagccttccctgtggtcctggccacaacctcatggcatctgggtcaccttctggaaccattccccaagctgcatcaactttcccaaagtccttgagtggatggagctctgcaaataatcaccatgcccaccaggggcaggccaccaggatatggtgttcctcgtctgctttttcccttccttccatttgctgtgctcggtgactccctccagatctgactgcatttttccccagagggccctctcagctttttctgatcgagactttctggccatgcctagacttgggagactgtgggacttgataacagaccctgattcttctttatgagtgaaaagcaggccatagacacagacaggaccacacaggtctaaggaatgactgtgagctcttcttaggtttccagagtaggaatgtcaacctggacattcctacgttaatgtaaccctgcattaaacagaacataaacaccaaagcaagtttgttctccacagaggaccaaagaggaagcaggcttgaattatggcaaggggcctggctgggagggaggcagttgttaggtataagaaaatcgactttgagggtgactaaacttagagaaatgctccttcaggaggctgtagaaccactgtatttagaactagaagcaacagccgtctctgggacagttgaaatgccgaccagcctgaagaagccgaagccaggtgaccctgggtataccctctacttctcttatttcctcatgcataaagaaggctgggttttgcctcactgccagcatttcctgtaacattcaaagaaataacaaagttattgagcttcagaaaacaaatggtggcgactctgacttttaagaattggcagtcagaggggaaaaaagatgtctatgcgattgtaacggtctggctgtatatacagtttactctgcccctgctgttttacaacttaagaaaacagttgttatatggagaagcaccctctgagcagacagaagggatttgcgccaaagaagcatccatttttacacagtcttccctgccaaatggaatttggggcctggggaaaaactaaatgcgtggaataagtataagtatgatatatagaggtgcaatagccccaggtagaaagtctcacattttacaagggacttctagaaaaaagccaagtgcatgcagactcccaggttgacttgggtaatgctgacttttctatttgccctgtgaagcaagaggggccatcactgctaattttagtatgctggtttcttatggtttgaacgtcttcattcagggtgggaactttctatagtaagctttgctcacagttgctttccagtgtaacataaagagaggacactgcatgtaaatcaggatgcccagatgttgccagatctctggatgaataagacctcccgagtcccctccatgattatggtgcaatgaattctgggaaatcctggcaaaatggccctggcattgccaaggtcaaattgaatcattttggaaaattctctagtttcataaaatcaaagacaatgagagctaggaggggcctgagaagagcctttaggatcatcaccccataggtaagggaaaatagccccagaaaaatgaaacggtttgcctagctttaaaagagatagttgatgatgaagcgttaacagaatgaggagttcctgatgtctacttctgtgctgtccttcatttatctacctgtccattcatctgttcatctctctatccataccatactgtctgtacatcatctatttctttcttatagactctttgacctggcctcggtatcctcacatttaaaatgaggagttggcttatatgattggctggcatatttggctcatctcgaagactgtctattatagaagggcaaatggtagtgcctcattgcaggtgtggagcctttgacttgaggtatgcgtgcaagcttaactaaataaagcagttatctggcatttggagggacaaactgccattcaacctgccattccgctgactaagttaaggactgagaatgagaagctgtgccacagctcgtctgtttttcatgccgacgggtaaacttgatgcatccctcccctcttccagggttttcagtggtgaagctgtagccaaaagtatacgccaaagggaatttaaagtgtttttcgtttcagatggtttcttgctcttttacagtaatggacctgccccttagaaaatcaaaacttgtttttctcatattccataggattttaagaaatatcttagagtaatatagaaattattaattgttgaaaaattaactttatcatggagcaagagcaccatcaaaaggtatcctctgcctggaatgggttcttaccagcaccaaggtgggctctgttttcggttagcacgtagagcacttagtagcttgttgatatactgagagtgtctcctccttaagcacaaaagatagagcgaaaggatttttcaagaaaaggatatttgagagttttttgtttgtttgtttgtttgtttttgagacagagtctcactctgttgcccaggctggggtgcagtggcacaatctcggctcactgcaacctctgccccactcccaggttcaagcgattctcccgcctcagcctctggaggagctgggactacagatgcccacaaccactcccagctaatttttgtatttttagtagagacggggtttcaccatgttggccagcctggtctcgaactcctgacctcaagtgatctgcccaccttggcttcccaaagtgctgggattgcaggcatgagctactacgaatggctgagagttgtttttttaatgtatgttttatatttctaggatctaatgaaaaactccagctctcagctcacaaatctgtaatttaggtgtctctatgctaatattgagatcccaaagcatcttctctacagagatttcattaaataatttcaatgcaggaattggttcaatgccatggaggaagatattttgccaaggagaggttgaggagagtgagcagtggggaccctaactgacccgtcttggggggctggtcctggtggtatggattgggcagcctttacctgtctggtcaggtgtttgttacgtctggaacattgagaaactaaattaaaaatcaaaaaggttaattaacgtattggccatttctgagataacttctgtctgtccccaggttaaaggagtctttcacgtgactgtgttctgcttgagctcttgatttttttgtttgtttgtttaattaaatatagttatttctattttaaaagtgaaagagctggctgtaattttggaaaggtgtaacccagcagatgccgggaagtacaaacctggagggaaggacaggcctctgcagctgcccccctcctcacaggcaaggatgaccatgtctagagctcacgggattccttttgggtggaggcagcgttgcctctgctctctgggcagcccgtccttgaggaccaggctgttaacgtagagtcttgtgatgtggtctgtttaagggtggggcttctagcatccatacatcaggtgacatctgggatactggcttagagggcagctagggagtaaggtaaaatgtgcagctttcttttttctttttttttttcttttttttttgaggtgaaatctcactctgttgcccatgctggagtgcagtggtgcgatcttggctcactgcaacctccgccttccaggttctagcgagtctcctgcctcagcctcctgagtagttgggattataggcatccaccaccatgcccggctaattttttaatttttttcatagagatggtaaggtggagccattacttacaaactgtagagtgcttcctgaggcactagctttctttctgtctgatttttgtttttagagggagttatagttaaaataggttgatcaaagggcctaatcttcactcagctactttttaaagtacttggttgagatcatgtcatatgagtataattcttctatgactttgagtgtgtatagcaaacctattatatatgtgaacatgagaaataggatctttatatatggagaatgtgcttcaagtgaagaagagaaatgcatgaaaagtacctatgggccaggcgcagtggctcccgcctgtaatcccagcactttgggaggccaatgcgggcggctcacttgaggtcaggagttggagaccagcctggccaacacaggaaaaccccatctctaccagaaaatacaaaaatcggcctggtgtggtggtacacgcctgtagtcccagctcctcaggaggctgaggcaggagaatcggttgaacccaggaggcggaagttgcagtgagccgagatggtgccactgtactccagcctgggtgacagagtgagaccttgtctcaaaaaaaaaaaaaaatgaaggaaggaagggaaggaagggaaggaaccaacctgtaaactggtggtgataatggacctaaaaataattgctcttaggattgagtaacacctagttcacattgttattttctcttaatcataaaaatactcgataatagcaatagctaacattaaatagtgttatttgcccaacactgttcacagtgcttcacgcatattaatttatataatcttcaaaagaacaggcagggaaattgaagaaaaaataaatcgtataccttgcccaaagtcacgcaactagtaagccagcatgtaaactaaggcgtccagatgctggcacgcaccgatgccagggtctgtttttaagaactgcactggccgctttttgagcttcatggtaatgtaattcctgtattttttattgggagagtttatcagtaaagttctgggtcacatacagttttcttcaagaaagcagagccctgttgctttggcattcatcattttttttgtactgacaggagggaatcagtgttttccccggcagggctgcaggaagtaccctcccctcccacacctccccagagttcataatacacagccatggccatgctggtcacaggtgccagcagttggttctgcttctgtcaccagggtccacttggggacctggcatgaagggggacctgaccccggggtgttgtacaacatagacctcttcttccggtgttggccttcacgaaagatgggtaaagtggagtgacctgcagagtagtggtccaagtctgggtccccctttaacaaagggtttcgtggagggcccgtgtgcacagcacgtagccgccggggggatgaaaagatgtgtcactctttgctcttgaatgattatgaaaatgtcagatggttttatggatctgtgatctcaggattgtaattaccaatccacaatcgcattgctcactgggaattgcttcaagcgtattttccaggtagtgaatgatgagctacttaattcctcttcccttgaattcatcagatttggacttggactttagttctttctagatgcaatcctgatccacacaggaattagaaagtaattcttcctcccctcccacctaaagcaggagcaaggcagaggctcaaagaggaggaaaatgctgtcgtgactcacatcccctcctccccactttgaaaggcatttcaggccaagctgaaagttctgggggaacttccccctggtacttttaattccttctgtgttaagctcctcaactacctgatgacttggcaaaggcagtttttaaagcattaataataatcgtgcctaaatgtttccagcgaattttagaatgtctttctgttgaatatttttagtagtatcaaaccagtccaagaagaagaattttacatgcatacagacttccttgaccctagagtggaggttaaggtctgaaagggcccctggggtgaatgggaacctaagaggaccgtgaagggaatgggcttctgtcccagaagcggcagtaacccacctggtgcagctctgagtgagctggcgtggcctgtgtattcttggtaacttttcctgtcttatacagaaaccactgaggttttttgtgtgtggttgttgttttgttttgttttgttttgttttgttttttgagacagagtcttgctctttcgcccaggctggagtgcagtggcgccatctcagctcactgcaacctccacctcctgggttcaagcaattttcctgcctcagcctcccgagtagctgggactacaggtgtgtgccaccacgcccggctaattttttgtatttttagtagagatggggtttcactgtgttagccaggatggtctccatctcctgacctcagctgatccacccgccttggcctcccaaagtgctgggattaaaggcatgagccactgtgcttggccaccactgagattttctaagatggcatttgtattgctatagaaagaaaacaaaataagagttccttccaggtaatgtgaaaacccaaagagatgatctaggcaccttctcaatccaatgtgggagcagagaagagggaagaaacttacaccattacattgaatttctctttccgtctggaccctcgcaaaaccatatcactaatttgaatgccacaccagtgaggtcaggatctaaactaatatattgcagtccttgttagaattcattgtatgacatgccataagaaaaaaaaaaccctgtctgcatttaggcttctgtttcttaagcttcaaacatgtaaaaagttttctggatcctgaatttagggacctgggttttcacactggtgccaccaggccagtgggtgtgaacttgagcaattatcttaaatactttcgtcttcattttcctctcctgttgaaccaggcaatgggacgagataatctctaaattagttctcatgcaaaaagggtaacaaaatatggtcagcaaaataaagccgtaagttcgttcccgtaaactggccccttagaggccgaggcctccaggccttccctgggcagtgccatcctaaatcacatcaggcaaatccacatgcactcaggtggtacatgagatagacgtcgtttttttgctgtaaagtttttaaagggctttctaatttgttctgaaattctctggctgtaagtggctgccctgccttctctgccaccaacatgtaatcaagactaggggttgaggtctccattttggcacttgctaacactatgagagccgattcctgggggagcagctggtctgactgagcctctccaaaacggggacagttggtagtaccaccgtcacatcactggaaggctgaatgcagcagcctctgtggcttagaaccatgcctggcacacaatacatactcaaaagaggacaggtataattcagatttagtcttgaaatccttctggaaatgagaaaactttaaccaaaaaagatctgtggctcctaaatttaaaaattcatgaagttgccataatggtacacttttttttttacatttaattaaacatttataaattttgatttatttttctggatttcgttttgtgttgagacccagtaaaatttcttttctagtatagcatgggccctggaaacactctgggcactgttcctaagtcactaacgggtgaaatggccttgcccccaaatgttgcactttgtgaaaaagtcagaaagaaaagtcacgtgtgggtgacatcaaacatcagtgcttaagatctaacacatgggtcctgttcagtagaggcatgacacagctgcagaagtctccacactgtcctagaaacgtgacgtgtaatgtagcaggtgtcttggggtcggaattcttgtactaggcaaatgcagtgtgtctcccaagcgtgcctgggatctctccccgcagccaagctttgcaagcacataaacatggccggccacccactgagtttcctaaatcagtgaccagcactggagacccttccatgtgtgcaaggcagctccgcctgctgcctgtgtcctttgggggtctgatggggcagccccagtctgagatggtcaggccttgtcattgggtgcacgtctcccatggggatggatggacccacagctttcagatggattgcggttggcagtcacagcatcccagcacattaaaatacatcaactcctgtgctttcaggtagatttagaatttttctcataccctagccactttccatttttcattttgaaaaatttctccttgagttttctcaaaggcttcagttttttttgttgttgttgttttttcctgtaagccatgtaactaggaaaggcattagtaagaatttgatacactgggtctcatggaactccactactaccaccaaaataataatagtaataataataataataattccagtttagcttaaataagtaaaagctacccccttacaccatatctgcatttaaattcatttgagctgataggcaatttctgtgttctcctgttcatcgcatattcttttcctttaaaggcaacttttagagaaggtttgcttttttttgctatcaaagtattaattatgaaaagttggcaatacagaaagggtaaattaggtataatctattaccgtacattatggctatattatcagacatatcacaagccagtgacatttagttggatgtgaaattccttttttatagtatgattgacacatggtatattttcatcaacttctatgtgtaaattatgccgtgtcactggtaaaatttgctgtcatgaatagccaaatattctggattcacattcataggtgaaagccaagctaatatatatatatataatatatattatatatatactatatattataatatatagtatatatataatatatatactatataatatattatatatagtataatatattatatatactatgtatatagtatatataatatattatatatactatatataatatatatagtatatataatatatatataatatatattatatattttatatataatatatattatatatatattatatatatatatatgtacccaaagcaaagttcttttctgtttgccttttcaaaaagtaacacaatggaatcaatctgccaactctcaagacccctagaaagttatttaaaggcagtacattggtttggtactttcatgatatacatatacttagtttccattaaagcaattattgacaaaaacccagactgctattgaaatctttcagtgtacttccatatactgaaatgtcgaacatttgatacttgtttgattttgtatttgtttttgttcaccatggcttaaaagtcatattctgattatttaaaataaagagtaaacatttgaaataagttcctagatactacatagatttatggccctttgaatattttcctggtaccaccttattttcacttacctttgaagtggttgtatgatatttccagttcattcatttgaaagagctaggagaaatatgcggagccacgtcccacgcgcctctcggacactactcgccaggcatagcccagtgtttcaaaagtgaaccagggggctgggcgcggtagctcacgcctgtaatcccagcactttggaagcccgaggtgggccgattacctgaggtcaggagttcgagaccagcctggccaacatggtgaaaccccgtctctactaaaaatacaaaaattagccgggcatggtggcaggcgcctataatcccagctactcgggatgctgaggcaggagaatcacttgaactcgagaggcagaggttgctgtgagccgagattgctccactgcactccagcctgggtgacagagtgagactctgtctcaaaaaataaagtgaaccagggtgctcaggtagcctcggtgagcgagaaaggagtttggagcttcaagtctaaaactgcgtttcacagttttcccatctgtagaatggactgcatgatacctctcttgctaggggatgtgaggattaaaagagatagcctgaaaggcgagctggagcagtggctgatggcgaagctccagagctggcttcctgattcagcctggcctccccttcgggatcagattaacctccccaccctcagcctccttgggtataaaaccaggagtatgatatccctctgttggggattattgtgcggattgaataaaataattcatgttagggcatagcaccgtgctgggcacagaagtgttccttaaatattagctgctattattaaagcacatgctctagacgggtaggccccttgaccatgtcccaaagaccttatgagaggaaacaaatggaattctgttcaagtgggggccaaatatttaccattgccaagtacttaaaaaaaaagaagaaaaaaaaaagcttggcagatttggccctcacaatacagtacaataagggctttttctcttttccttccatactacctattattaattccaattactgcatcactgaactggcttcaacaaatgtattcctcattgaaacataaccctgtcaaccatgttgccctacttccttgagggagaggtgatctttttccaattaaaggttttatcaaaatgcagttctgcttcttaacatgaagcacctatgctgttgtgtgacctgcaaagctctgagcatctagaagcttcccctgggtcatctataagatgggaataatactatgagttctgcctactgcacagggttcttgaggacacattgagataatatatatcaatgtgctttttaagtagtctgtcaattagataatataaatataattagataattaaaaaatagaaaatctattattgttttgcatgtactatattaaaatcttagggattttaaataaaattaattgatttattgaaagtagatattatctcgtcgtgtctttcaggattggtgagaagaaattaaagagaaaaaatttaaacatttaaatcagaccccactgtgaatccatacttttagaaattttacctttttccattcacatatcttaatgttttctctacctacaactagataccctttttaaatgttggaaacaaaagaagtaaccttggcaaatagttgagaactgagttttatatgaatatacttttctcttgcaagaccaaatacagtttttcttctaaaactctgttattccattttctttcaatgaaatgctcacagaaccagaaggcttgggaagaggctcagagcacctaagagttgctgagtccgtattccttttttcccctgtggctttttatatatgctgctcgcctgagatttctggatttgatttcagggaggtgaaatgttacacccctgagtctcagtgccagtttcccaggacgagtcaaaaactgcagctgcttggaggtgagaatcttccaaggctccagaggccagctcgctgtcctgttcatttgctgacatgctgccgggagcagcttcagagaaacccgttctattcttcgggtgattcagccagtctcaaaataaataggtagctgagtgcagggagaaagaactggaaaccactgaaatttgagtcttgagggctggtctgttctcgggagctgctctgttgaactctaaaaggaatcttgagccctgggcgagggagtggcctgacctggtggaaagactgcgggcctgcccgtggagtctatgtctggccctgctagctcagtcaatctcagcagctcatgtctcctcttagaccctcagattcctcatctacagaaggagaaagaagaggagattgaatgatttttaaggtctttatcagcttctaaaagtttgatttgatggttgtaggagcaattgttctttcaaagcaccatcttctaacctcaggaaggaaagcccaggggcccctgggatgtcctgccaaactgggaagacaaagattgtgactgagaaggtgggggcagggcaggagaagggggaagaagggagaatggatcaaccccaggccggggaaagagatgaatgaaggtccacgccagagtgacatgctctaagtaggggaaatcttcctaactagagttcccatgactttggcaacatttgaaaaaaaaaaaaaaaaaaaaagacatccttaaacccacaaagtactcaattgtccaagccccattatggccaacttcccaaagctggctggtcagagaccttggtgttaattcctcagccaactaaaaaaagatggtgtaagttctgttgacttaattgttggagtgtttctgagtggggccgcctccctcctctgcctcctcacagtattatgggctattctgcattacctgccctacctatcttcataatctagccgcaaacagctttggttgaccacaccacttccctattgaaagttaatactgtttgactcattctgtgttactaacctgaagccaaagaaaacaaggcagagaataactggcttgtgtggagtttggaaagctcttggaggccctgctttcaaaatcctatacagtagctttactatatctctccgctgcagctgctgagaaaatgaaggaagcagaagtggttaaaaaaaaaagttgggggtggggaagagactgggaagggagtggggcggggtccccctccggctgggaaaagacagggtaatctgcggcagtttatgagggctgtctccctgagctgaggtcttgctttcacacaccagagtgttcacacagaagagggactgttgaaggagttaaaaggagaggaaagttcaaaacagttgttgaaaaggcagctctcctattgcctgcgtaacacagaggagctgggaggctggtctcaccaggccaggcagccataggcagagactcaaggtagacaggccagggggaagttgtgtacctttcgaatcgggaaaggattgaggagggggaatgttgccggacagaaggctgtcctgggcgtccatccttgccctccatccctgtctccatccctggcaaggatggaaccttcccttccttcatttcctaactggctcaaatgtggtcaccaaggtgaataggaggcactagtgtcttggaataaacagaactttccctcccaatgttacctggcagacagtgggaccagcatcttcatcaccatgctgtgctctgtgggagtctaggcaaacagccacttgcccattcaggtaactttagaagaggtctccctcctcacagatgcccttctcagcaggtggctgcttctggcacgtggacaacagtgcatagaagtgagcctgatgcctgaatgaggctgtcatgacacaaacaaccggaagccttatttgtgagggagggtcaacgttctgttcaaaacaacttgctgcggttggcttttgtactagtgagtactcaggagctgtgagtggccagggtaccctgtccttctgtaccagccaggacctgctcagccatctgtccaagggctttgcaaggccagcctagaacctcagttggcgtctgtgacaggagagagcgtcagagtcagatgctgttcccctgctgttgggaaagtccccgaggcccagggggcagggcttttagaaataggagggaatttccttccctctttttagaagtacagaggaggagagatcatcctccacactgctggatgagcattccagaataaatctagtccaggaaaggggctcactcattcattcattcactcactcactcattcatttatttgtccagcatttatggaggcatcacccaaccttggaagggccctgcctttacctcggtcctgtccaaacatgctcagtgtctctgcccattatgtatgagatctgctgctgcgggaggggaactgagattcctgcagggaggttaggaggccagtgtggagagcctcagtgctggtaacatgctcacgcaagcagtgtgtgtgcgcctcctggatcttcttctcctggcccccaggtcttgcctgtctaccccaggactagccctgctgatgcctgaactccaaagccatgtcagaagctccaggcagcgttctgtgagtcagtgctcatatctccatagtgcgccacccgccaccaatactttctttctcttctgcaagtcgccttctctttagagtctgtccctgggcaggagctactctgatcaacaaatccatgtcactggtggttaccactctctggttacttttcagttacgctgtaactgggggtttccttgagataagaccttaacctagggagggttgctaatatttgggattataggctggtagaagaagaaaaaccttgaatttgggagctgtctgcacccttcttaagaaactgcctccacttcccccacagagggctacctctggtcaagagcaaaagccagcaggtggcttctctgccctgagctcaagttacctccttagtcaccagacagaaatggacagtgagccctggcgaccggggatggcagatttagattttgagtgctctgcttttaggagaggcccgagtctcatgtgagtgggcgaaaaactccactgctcgtggcaatgagccctggactcagggagcagagttttgtttgggtttttgtcccgtgagtcttgggcgcatggtgcaggggggctggggaggggcaggcctgtgtgcgtctctggcttgaagttgtattggttgttgatcttgccttggcgttggccagcctttcctgtccattgactgttgcttgctacacttgtcttggcccatgtcctgagggcgatcacagaacggtgtgtgtgtgtgagtggatgtatggatgtgtgatggatgtatatgtatgtatgtgtatatgtgtgtatgtcagtatgtgtgtatgtttgtatatatgtgtccccatgtctgtatatctgcctgtgtgtatatgcatgtgtgtccctgtgtgatatatgtatatgtgtgtgtgcgtctgtatatatgtgtctgtcctggtttgtgtctgtatgtgtatgtgtgtctgtgcatgtcttaatatatgtgtctgtgtgacgtatgtacatgtgtctgtgtgtatttatatgtgtgtatccccatgtgtgttttatatctgtgtgtgtgtccaggtgtctgtgtatgtgtgtgtctgtatgtgtttacatgcatgcctgtgtttgtgtgtatatgtccatgtgtgtctgtatgtgtgtttatacatgtgtgtccatgtgtatctatattttgttttgttttgttttttgagacagagtctcgctctgtcgctcaggctggagtgcactggcatgatcttggctcattgcaacttctgcctcctgggttctagcaattcttctgcctcagccacttacttgtaactgggactacaggcacgtgccaccatgcccggctactttttgcattttttagtagagatggggtttcaccatactggctaggctgctctcgaactcctgacctcatgatctgtccgcctcagcctcccaaagtgctgggattacaggcatgagccaccgcgcccagctgcatctgtatgtttttatgtgtatggctgtgtccgtgtgtatgtttgtccatgcatgtctgtatgtgtgtatgtgtgtgcatgtgtgccatctgtgtttttgtatgtctctctgtgtgtgcgtgtgagagggtactcactacaaagaaacaggagaagctggtggactttgcttatgtcagagtgccactctcaactcagcaaaagagcctttgacctattctttttgatttttcactatgaaaataaatgagttttcctgattgatttaatttttttttttttttttttttttggagaggtctccctctgtcacccagtctggagtgcagtggagcgatcttggcttactacagcctctacctcctgggttcaagagattctcctgcctcagtctcccaagtagctgggactacaggtgcgcgccaccatgcttggctaatttttttatatttttagtggagatggggtttcacaatgttggccaggctggtcttgaactcctgacctcaagtgacccgcctgtgtcggcctcccagagtgctgggatgagccatcaggcccggactgattcaacttctaatgagacaattctcatgaaactgctcagttatgatattgtattttttctcaacaagaagtttttctgtagttacatttcagctgaaaactttaattacaacttccttcacctgaaatgatttctgctttcccacaacctagtggagggtgattggacagcaccaatcatgaaggacctgagtactcattcattcattcagccaacattagtgagcctcctaggctccagttggttttataggtgctggagacatggctgtgcagaaaaaatacaaaatccctgtctttgtagactttacagtcccatgggtgcagacagaccctggataacattaacatgtgctatggagaaaacctaagccaaagggctagggactggctggatgtgggatagtctgcaacttaaaaggggatctccaggaactcctcagggagaagatgacatttcagcaaatacttgaagggtgggagggatcaggtccacagggatctcagggaagagcttcctgagcagaggaaacagtaagtgcaaaggccccagggcagtgacacaggggcaagagcaaggtggccactgctgccggagcaaagaggggagctcaacctatctgccttctagtttcaagtaggaggcatttgccttagaaaacaggcttaagaaaatgccacctgacctcaggtgacatgacctgtacttcatgtcacctgagaggccactgtaggaccatggttcgggaaggcccagagtaggaaagccccatacacaggtggacccagtgagtgcttgctttcctgttaccacccacaagagtacaaaagctctttccgaccaaaggctctgctattcctgctggtgattctctggggctaaagcatcacccctctagaaatcgctgagtgggtaaaagggattcctaggaagtggaggtatcctaggggacttgccaggattcatccacctctaagaggcttaggggcatgagctagaggaacaggggcctgcacagggagtgtgggcggggtgggtgacaggtactcacctaagacttatgtgcctactgccactgatggaaaaggtgggcattcagggcagatgtctcattgttttccaacccagacaagaagctgggaaatgagagcctggatgagtgttccgcagagtggctttcttcccaggtgcagcctctgacaacttcctagcaaattttaaggtgtgtttaatgtcccactccctctggactcagccttgggatggtagagggggaggggtgaaagcagaatggaatgtcccagtcagtagggtagcacgaaaggctctgtgaaggcttaagggagagaggagggcacctttgaatactgaagtccaaggtcactcataactaactgtccaaagggtcactgatgaaacagctggaggcagagggagagtgaattcttaggacacctcgtgcaaagctgctgacccccagcacacagaaagatagagcaggccaggtgggatcgcaggctgggcgacctggtggggatcaagacagagctctgagaccaacctgacagctagacttggcagtggctcccgcagccaggtgtctgcctgaaaaaagacaaaagggaaaactttgaaagtcgtaacctcattagaagttgttcaagaaagaccgtgcttagaaccagttgagtagataatggcagcagatgtaattgttgtggatgcttttagagtcccttggagtaatccttcttagtctcttaattccaggcttccagatacggagcctcagtgatgaagagacttgttcttgtccacagcaaaggttggtagaaaagcagatttagaatggagaattcttaacgcctactctagcattcacgtttccctgggaccatgttgtttctctagaggggaggaggattgtggcatctgcattaacacccggtcctgtgggcactcagagaacttaactgctgcatttgtggaacggaataaaggttccatgtaacccttccctgccattccccaaagtctttctatagatggcacagcagaaattacttcctacttgagaatctggggttcaccttagcaatcagactgattatcatgacagtgactctgacagaatgtgcccagttattgtaggagacagagacggtcacacaccggcctatctgcagggcagagtttgggcattttcagctgctctgtgtgtattgaagagttaaaaaaatgaaaagacggccaaatagttatcaccaaaaggaggccgtcagtcattgctcatgaacacagtctaaacacagttcaggcatatttagttcgcgtgtttctccccagcacacagcaaatcagaagcaggcaggagaagggaagtagtaatgcacattggaagcttgagtatcaggaggagctctccctctcatgcagatattcccagcgtgctccctgtatcggcagcctcagcatcacctgggaccttattagaactccaaattctcaggcccttcaccctagaccaacctaccaaactagaatgcccaggtaattccattgcccactcaagcaggtgaaacacagcctcacagcctgcaggtcacagtgtggctggggctgtcttctgattctacacacacactgggagcagaagtgagatggttgaggcagaatgcaaaagttcaagtgctttcgtgtctctgagatctaaaactatgaagcattgtgcacttctccaccctgttcgctttgagttcacagaaatgtgtatttctaggtgcactgagtgtacatcccgagtgtgtgtgtcggtgggtgttgaatttctaggcacactgagtgtacatcccgagtgtgtgtgtcggtgagtgttgaatttctaggtgcactgagtgtacatatctgagtgtgtgtgtccgtgggtgttgaatttctaggtgcactgagtgtacattccgagtgtgtgtgtcggtgggtgttgagagtgtgtgtgttttcagacctgccctcttcctgtaactggccgtgtgagattgggcaaatgacataacctctctgaacctcacttcccacacattagttaaaaaccaaggctgatttctgtggccattctccagttctgaagtactccaaccttgtggtgttgtcttagcttaacgatatgagaagaaattggggtgggggaaagtgaggctacccatagttacgtagcactggacaatatataagcatgcatatataatatgaattagaatgtatactgacatactatataccattatatagtttatattatatagtatatataatatacatgtggtatggtaaataatattgaagaatatttcccaacattaaattagccagcatatggttaggtttgcaattagggagatttattttaccatctgcaaggggcttcaggaagagtcacattcagtactgtcactttgaaatcctaatgaccctgcaacctaaaggttagactgtgataccaggaaaagtaagctgttctctacacacattgatttcttttccattgtcataaaacagtagcaaatcaaaggaagaaaaccccatatttttatatccagattcatgtagtgagtatccaattgactggccaacatcttctgaaatacagatatccttttaaaattgactatataaaattcttatatgcttttagaagaaccacaattttatacatgtatatacagagagaaatatatctttttggtattatgcttttgcatagatttggctcaacggctcatcatgacagtcttctgagtatataccttcctcatttttctgctaagaatctatcaagaaaactagtaaacccatatcggaaacatagactaatatgttgttgactgccagaaaattctttattctatctaaccaaaattttccaagaaacggtggcaatttaaccttatctggtttctttaatggaagatcatatattacatttatgttacttacagccacagatcacaatggtgtcttgaaaaaggcagctcggttatcaacgagatatgcatacctgctcagtttattttgtatggcagaaaagtgaaagctggtctcactatccgtcacaaaatatcataacatttaaggatggcctaatgagcagccaaccccgaaaacaataggaatgcctttggaatgaagtaaaattttgcaaacggcattgacttatttttattatatacaattttttccccttttttggatttttatgactctgcatacataataaaattccaagcaagtactttcatttttttcaaaaatgagaaaatggtactagaagaatttaggacctttttcaactctgcttaagattaagatgtcccagggtgaaatcttgatgtgcccactactttaaagcaccgccctgtaaacattcacagttgattccaaacatgctgaagaagccaagctgccagcatgcaggtgttcagagctgcatcctggttctacccaagggcttgacccagggtcgaattccctgttgccctctaaagcccggtactcagtgagaaagaagaaaagtgaattggatagtagacattttccatactcctctatttaacattcggggggcaaatgagccttttaactgaacacagatacaggaaactgaagacataaagtattcattttccccagcttgaaagtttatatcggaagttcctatatttcatgcaaaatattgctatttggcacatgaggtctgatggtttcagaaagtaagaattagatgttccttcgatctagcttgtaagtgcatccaaaccacaccctgaatatgataatgcttctcatttcccctgtgccttggtgtcacagctctccagcaccattgtgagcctgagggtcaagacccctaccaaggcaataacgttcctactgactcccaggaacacacgtggggagagtggaatgggctcttccccaatcctccagcattaaactcagccctgagactcccagggcttagaaaacagcttagagtgaagaattgttttctctgagagttatgcctgaacacttctgctaaagcagacagtcatcagttaatctctataaatgactacaattttggcaggtatcagctggtatagaaattgctcacaagttaaagctctcatttctaagtatatagtaatgagggggactaattaaaataaaaaacaaagaaacaaacaaacaaaaaatacctcacgttgtgcctgaccacaggactggcttacctggaatgatgattcctgttgggtgtctccgtggcacaggtccccacgcttgctggctaagagagacacaactgccaagagctgtttttccaagctgtggctgtagactctaccacgtcaagtgctgtgtattcagaatgacctcgctcacatcactctcctgggtcacccactgtccttgacacagtgttcttcaaaaatgccactaagtgcctgaggaatgtgaagttttgaaatgagcacaaaacctgccggcagcctttgccgactggcattatttctgaggcagatagagctctccacaatcattgttcctgccttcttctttaccccaactcgtaatgccaggcattagactgtggtaggaggttaaagggctgagttattatgttttgaatggttgttccattggaattgtttgtttttctgcaagaaaactgcagatttttcagtttgatcatcaggaagccaaggatctatggcagagataagaggagggaggagctaaggaaggcttcatccagaggcactgagtcacaccatggctgaccaacacagagcgctctagaaaaaagacattttcatacttctgagggaaagggatgatgggggttgctgcaagacctggccccatggcctttcatccacaaagccggtgcttaaaatacgcagccaagaacaggcctcccacatgcatgctgagcctgcgtgactcaggctgtttgcgttcaagtctcctgttgtgggctggagcgctgaatcagagtccagatttgccttggtgacacatgacaagaggggccattgcatttgaactacataaatattatgcttaagtgtttttcctcattttggagccaaacaggtctcgttaatgataaaatcactgcaatatagtgggccctttttttctggtctggaatttgagacaatgtcaactgtgccaaggggcctggcagcaggaagaaatggccagccatggagatttgcagccatcatgcaagttataccatttaattttataattgtagccattgggagctggactacagtgcacttctcgtggtctgctcttaccccaggctgcgggagtggaatcaagggggcctctttctagtctaggattgggtcagggcatgtgaaatagcactttatgggggcagcgggcaggctgtttctcagtctggctttggggacatttggcaatagggaacagaggttgtgcaatcgatcaaggactctttattggaaccataaggctgaggaagcagcaggaggccattgtctttaaaagagaaatgaatggcccaggcctcctgtggctacctccctaccttggagcctcagctttgcacgacaggactggctctggtttaaggacattttgagaaaaccgtaggccccagtcccccatgagtggcctctgcttgctgcttcctggtgacggttgttttggtgaagagcatgatgaggacacttgctatctatatagacactgaggggcccaccatcccaccctatatagacactgaggggcccatcatcccatcccaccagtcctgagccccctggggaagctcaccagataggctgtagctacctctgggctccagtgggcctattctgctgggaatattggacaagacacaggcgaggccttcctgtcaactcctccttaggggtacatgggggagtcggcttcagggaagaaggaatgcttgtgaaaagcctgtgaggagagggagagggagaggggctgaggggctgaggatgccctgcgtgtacctggaaatgggacctccccagaggctgtgggtttgcagccacgcctcatttcctcttggaaggggccctaccactaagctgcggggcccactttgccgcctctaaaacgtgccagtggctgggtttgcagtaaggaacagccgttctgatgcccctgggaggccacctttcctggctgccacagcatagcccctggcatgtggccatgtgccaacaattaatgcgcctctttccctcccggcatcaccaccaccgccaagttctgtatctcagtgagttgtgcccattggaagtgggtgtagagggttggggagggtgccaaggcccagactgggggagcactctgtggccgaggcggtgaaagggggcccattctgctgagaggacagtggccccaaattcagctggcatatctctagcgagtctatgttggggtgaggggagagagaggggaaagacaagaaaagccccagttttaggaaatccacaatactttttctgatctcttccctccctccttccctccccccatcccctcccctccctgctccccacaataggacatcggcagaaactagatgatcagaccaagcccgggagcttgtccttttccgagcggctcagtgaactggagcagctgcggcgcacagccatgagggtcagcccacaccacccagcccccacgcccaaccctcgtgcctccctgaaccactccactgcctttaaccctcagcctcagagtcagatgcagggtaagtaccagatggagcccactgcccgcctctcctgcacctgggccaccacccacaactggcccccatgtgcacacaccttcccagaccaactggggtttccccttgatgctcagagaaaggcctcgaaccaacagcaccacctgggagctgttggaaatgcagagtcttgggccccacccaccccagacccaccgagtcagatctgcattgtaaccagatccccacaaggaaaagcactgctacagaggatacgaggagctctgggtatggatatccatattggatagatagctctcttgaattttttaagagttagctttggctatgctatttttttacctacccattaggcttgaagacacacacgcagacacacacacacacacacgtcaagcaaagtgaagatgggatgtttcaagttctcgctattgccagattatttgtgggttttgtatctagtgtttttttattattaagaaatagttgaaatgtatggatgtcatcacatcaagggtgttatttgcaaatcaatagagaatgcaggtccccccagcccatgggcctagctggcaattactaaagcgctgtaagatgcaataattgcctaaggcccactgtgccaaattagataatacaagaagttcatttacactgtagaccagtgacgtcaatgactgtttgctctgtgataccgtttcaaaaatccaaaatgcagacttttctctgtgccatgcaggatgcagctgtgtgtgatatggtttacagtaatatttctttctcaaagtagcaggcttgttaaggaaaagataagcaacacatctggggaaaagggcaggtggccagcaatcgatgtggtagctctttgcccctctcggacagcaggaattagcttccccaggcattttctgtatgtgagttgtattgtgggatgtacaaatatcatctgttcctttgggtttccaggccagtagctctctattttgggttcaaacatgggttctcaggccgggcgcggtggctcacacgtgtaatcccagcactttgggaggccaaggcgggcggatcacgaggtcaggagatggagaccatcctggctaacatggtgaaaccccaactctactaaaaatacaaaaaattaggcaggcatggtggcgggtgcctgtagtcccagctactcaggaggctgaggcaggagaatggtgtgaacccgggaggttggaggttgcagtaagccgagattgcaccactgcactccagcctgggcaacagagcgagactccatctcaaaaaacaaacaaacaaacaaacaaaaacatgggttctcaaaaggcatgcccactgtctcccatggagcttgacagcccatgccattagctctcactgttaggtttctggggaaggttcttctacttgattggaaaatttccaaataaatctttccagaagatactatgcacacagctaagtggcctgtctgtggagtaacccttttgtaaacaaacagaaacctaaagcttgatgttttggggggctgcctgtcatctataggttcatttaggtgtatttaggaagaggatccatgaaaccactggtttcctgttacataataatcattaataatgatttaaaatgtgtacattgattttttttaaattccaaaatacaagcgtatatggtaaattaagtcaaatggtatgttcagtgagcgagatgggcttggggcaaaacaatactttgcttccaaagaggatacaactctcaaggagattctttcatcttgcctttaaggtcatttaaactaattcacataatcttcagaaaactaattcacatcatctattcatgtgtaaaatcaaaaggaagactgttttcttagtctctcgttgcctaactggccatttatactactaggttgattaagggatttgcctttttctgctgatatgggaacaaaaagtcttaagcatttttaaaggcaatggaaaattcagccacatgggggaaaattgatattgtcaccattgagttgctctgtttcttggtgaagagtgaatctaatctgatttccttcttcatcagatatgcctctttaacaacaaaaacaaaaaaatggggggaagttgcacattgagttctcatcctctgaagctcctgggcaaaagcattattgtggaccgtgtgatgggcattcgtcagctctttggagacctatatgcttagtagagtatcaggtttaacactaagcatcgccccttttttgttcctcttgaaaacttttacttctgcaacatttaagaaatcataactcgcttttagagttcctacgggcttggttgctactctaaagaatgtgtgaactatattgctggtgttctttctttccaaaatatgaatttgatattcagtacttcacttgtaaaattttaggaacaacttttaaaaaataagtatccagaatattttcatgtgaaacaacttttccttttccttttgttctttctttcctataagaaaacgctgttttacgctaatcatgttttgagtagacccttgggctttttctcttgaaattggaaagttaacaggtataatatgcaagtcttgttcagccaagaccttcagtttgttcttgacagtaggaaaatgcttattttccaggctcagccctgaaatttctatgttatatttacgaagatactttaagaaatacagcatgtgtttctggctttctttgaaatggcagtggtagttttcagaaaaatatccaatttgtcagagtagttccacagtggtgctgtccagatgcatgaatgtttttcagctttacagaaatgtcagtaaccgggggtttggcgagcttgccgggatttatagaaaggctcaggaaccctaccttgctaggactttgtcagaagggttatgccagctcctctgactctgtcagcaagaaaatactgatatagaatagcaccaatacttacctagaatcacatgtgctggagggtcactcaaaatagacatctcaaattatctgaagcacggtacagattgagagggggcaagttgtcatgccactaaaccactgtttatttgttggggtcttaactattaaagggctgaggtttatttcaacttcctattttaccaggtcttaaactggtaaagccattttgtcatgaaatagaatagaaagccattttgtcatgagtagacccttgggctacacgtttctcccagtcaggacaccatcattaacttctacgatcgagtcttagaattcttttttaatttatttcaaaagatagaacagggcagattctagagctagtggtaccgatgcctgttcagtcacaactcccacctagagatgggtttgggcaacccgagtgagtgattttaaaatttcacccctgattgaccaaatatgatgtatcacatttaaggtgtcgtaatttcctcctttctgggaatatgaggatggagtaatagatgctggtacagaaaactgaaacctagataaactaggaagcccattttgttgttcttctgcatgctggttgtcataagcatgtaggaagaagatttaactctttaactggaccagttgtgagctattttgacgtgggtcagacatttgtacatattattccattccctcaacaatcctgtggtatcatttatagacagagaaatcgaaattcagaggttaaaaattgcccagtatctcaaagattgtaagtgatgaacttggacgcaaacccagaccttccttgctacaaagccagtgcaagtgggatggccgttccctgggcgtgcactcttgggtcaaggatcgatttactacagggctgaccagtgtcgagaagaatcccaatcaccaaaggagggatggaaaaagtgttgggctatccactcacttggcattcttgtattgaacatgttctattataattagatgttgataataagaagaattttggggccaggctgtgtggtgggcaccttaataaactgtctcctttggtacatgtgcatttgtttataaagtttgggagaaaagaaaactcagaataatgaatctctaaataagagtgaaagagggggtatatgagcagggagaaggcttaccagccactctgtttactttattggggccattgccttcctacttttgaagttcattgggaccaagtgcttatcatccaaacccagtcaacatctaatccacttttatgagtatgcgtgcctcactttgagtgttccatatggccaagaggggtccctgacctctcaaatcatctcttgatttttagtattccaagtaacttctgtcttgctaattattttcccccaaaattaaagttacttaggaaggactatattctggtgctgctgtctgcaaaactctgagatactgaaatgaccctgtttctcagttgtatagagttatttaagtccgtctgattctctctttatcatctggatagacaaaaggaagaaaacctttccaccttcctgtaggagaaggagataaatcctctttccagccttggaggtaaaatatccaactgcattgcattgctttcctttctctctccctctccttccctctcttccttactcttctagcaatttgaagtttgaaaacaaagggagtagggactatttgattaccttgaaagtggaggctacaatcaaacaccagaaatcctcatatgtgaatctataaatggtcatttaatggttacacaaagtaacatattcagaatgtgagaaattaatttatataataggctataaacatgacaggtgaatgatttcatttaaaaatagcttttaacaaggtgtagtagggtatgagagcctttccaggtctatagcattataatcttaccccgacaacaagcctgaatcaggtgttcacaggaataaataaaaataattaaaggaaagaagggagagagagagaagaaatgaaaaccagtgggatgactgcagagattcactgcagggcttgatcttagtgatgaaatatttcttctgtagactgcatatgttctgaactttccccttatgcttgtaaatatgtaggccagcacacccatgcactaaaaggtttcatttggaagattaatagtttcagcaaagttgtagttggagcatgtatttgatattgatggctacatatcagaaggcttgagctgggaatctaatagccaagaaagatagcagatcatagtggctaagaaagaatgagggctcaacaggcagactaccttagtttctaccacattcactataggacttttggcaagttacttaaccttttaaagccttagttttcttatctgcaaaagacgagtaataattatactagcagatcctaggaccactgtgaaacataaagcagtggacattagagccagcccatggttaacactcaaaaactgttagctgttatgatcaacatcaataatatcaagttgtcgtagtcttatatattatagactgggtaatatataaagaaaagtttattcggctcatggctatggaggctgggaagtccaagagcaaggtgccatcatctgctgagagtcatcccatggcagataggtggaagggcagagagcatctgtcagagagctcacttttatgacaaagccacctccatgataactaacttactccctcaatggtagcatgaattcatttgtgaggatggagcccttatgactcaatcacctcccaaaggccccacctctcaacattgccatgatggcaaccaggtttccaacatatgaacttttgagaagacacattcaaaccatagcattccacctctgacctccccaaattcatgtgattctcattttaaaaatacatttattccatcccagtggtccccaaagtcttaactctttccagcattaactcaaaagtcgaaagtccaaagtcttgtctaaaccagatatgggtgagatgcaaggaaacatttaaagcaaattccattagctttgtgaaatcaaaaacaagtctactataatacttccaaaatataatggtgggacagacacaaggtagaaattcctactccaaaagagaaaaacaggcaagaaaataggggtaactggtcccatataagttcaaaatccaacagggtaaacaatattaagtcttaaaactggagaataatctcctttgactccatgttctgccttctggatacaatggggctaagactaggcccccaaggccttgggcagccctgcccctacagttttgctgggctcagcccaaacttcacctctctcacgttgaagtcttgtgtctgcagcattaccaggctagagttgcacactggtggctctgcagttctgggttctcagggatagccccaattctgtgtctccattaggcacagccttagtggggactctttgtggcagcttcaacctcacatttctgttcaacattgccctgctaggtactgtctgcagtggtattcccctgtggtaggtcttggcctgagcttctaggcagtctgtggcatccttcgtaatctaggtggaggaagccatgcttccacagcatgtattctgcatgcctacggaattagcaccacatagagaccatcaaggcatactgcttgtgcccttcagaatggcagcctagctatacctaggcccactgaagccacagctggggtggccaaggtgtgctgcaccaggatgcaggaagcagagactagaggcagccctgggcagtgagcccatgaagggtgccccaggcctgtcccctaaaatcattctaccctcctagagctctgggcctatgatgggaggagcaacttgaagatctctgaaatgcttttcggggtctttctcccattgttttgatgaacagaatctggcttcctcgcattcatactaatctctttggcaaatggttgcttggccacacccttagtactctcttccaaatacactttcactctttacatggccaggctgcgaattttccaaatctttccactctgcttctcttttaattgcaaatttcatctttaagtcattcttttgctatcacatctcactatatgtagttaaaagtagccacacagcagcctcaatgctttgctgcttaagtatttcttccacaaatatcctagttcatccctcttaagttctgcattccattaagtcctaggacacagacacaatttcacccagctctttgcaaccttatattttataaatatggcctttactccagtttccaataccttgttcctcatttctatctgcagcctcatcagaatggcctttaccagcattctaccagcactctggtcacatacacttaagtaatcacttaagtaatctctacgaagatttagacttcccctagttctaaggtcttctttcagagccctcaccagaattgcccctaatggcagaaccgttcttggcaatgcaggcttttttctagcctgctcctccaaacttgttcagccttcacggttatacagttccaaagccacttacacactttcaggtatttgttgtagtaacaaccccacatcttggtaccaactttctgtcttagttcttttgttaaatgcctgagactgggtaatttataaagaaaataaatttaattcacagctgggcacagtggctcatgcctgtaatcccaccactttgggaggccaaggcaggcagatcacttgaggtcgggagttcgagagcaggctggccaacatggtgaaacccccatctctactaaaaatacaaaaaaaaaaaattagctgggcatggtggcacacacctgagtcctagttacccgggaggctgaggcaggagaatcgcttgagccggggaggtggaggttgcagtgagctgagatcatgttactgcactccagcctgggtgacagagtgagattctgtctcaaaaaaaaaaaaaaaaaaaaagaaagaaagaaaacaaaagaaatttatttcatatggttctggaggcagggaagtccaagagcatggtgctggcatctggtggggtccttgctgcattaacccaaggcagaaagcaaggggcacaagaaagcatgtgcaagagagcttgcttttataacaaaggcacttcaccaataacccactcacatgattatggcattaatccatttatgagggcagaatcctcatgacccgtttgctccctgcaaaggcctcatcaacaccaccacagtgggatctaagtttccaacatgtgaacttttgagggacataatcaaaccacagcacaagtatattagtttcctgtggctgttttaacaaataaccacaaacttggtggcttaaaacaacagaaatgtattctctcttagttctggaggccagaagtccaaaatcaaagtgttggcaagaccatacattctctgaagcctctaggggaggatacttccttatctcttccagccactggtggcattccttggcttgtgactgtatcagactgtatcattccaacttcttcttccctctttatatggcctcctttgtgtcatctcttttgtctaaggatacatgttactatatttagacccacccaggtaattcatgatgaactcaaaatccttcacttaattatagcttcaaaggcccttttccaaataaggtcacattcacagttctgggggtgaggaaatggttctggagccaccgttcaaactgctgtatctttgtacaaaagacaggggacatcagaccattgaccaggcacagcaggtgagtccagagataactctcccaagtccatcccccagaacaaacatggtagacaggtaaatgtgaactgaacatctcatgcacaaatgccccaatcgtgttactataacctcagtccatcatttgtttgaacgcaacatcatagtatttttatttcccagccagaaaaatgtatgattttttttagatgagatcagatatttccttaatattttctagagcacctataccgatggaatcagaggtcctgacagtgatagagaaagagctctcttccctgtgtcccgggagcagtgccagatggggaaacaggaggcccaggtgcctcttgtcctagcctccaaaagctcatgacagcttagatggtaggaacagaaaaatgggaacaaaagatgacatgatgaccaaagccagacagttgggatggactcaagaatttgacctcccaaagccaggcatgtcactgttgttttgaagcaagctgccttttaaaaaagtgacttgattgccaggcattgttgactacacacccatttctaaaggatggtgatttacaaatcgcctgaagatagtctttcaaatttggacatttaaaaaagaaacttttactgtagtcatgaagtagtatcaaagtttaccacaagtttgtattgagagaagaacaaacaatatatgctaatatgaaaaacagctctacttagaaagctactgcttgggttttcttattaggcatagttctccagactgagttggttttactcatctacatgatttttccttgccttatggaacagaaattcaggcccactcgaattcagttattttagggctctttaaaatccagtatttgtgatttaaatgatgcggagggactttcattacctgtgtctttgcttatttctctctggccctcagaacaccccaccctgacctttaggggaaattgacagaggcagagggtttcacctgcctcaattgtcaccagccctgttacattcttccttccaagccttagcctcacagggaccttctcattattgaacaattgccttcaaagcagtagaatagcccaattgttatggagattaaagataccgattgcaaaactcctgtaaataaaatcttcactgacaaacccagtttcttttcataggcttttcttctgtaatctctttctggcagaacatctcatgttttgatgttagagattcagttaccaaccacagtaaataaagcaaaataataatagaaaaatagtatagaactcaccctaaaaacaaacattggccaaccatgtttattttttgtctctctttgcactcctgagaattgataggggaagaatgtaccacctctaattcaggtgatttctgattagcaagctatggaaagtcttcaggttgagttttagccagttcacgctcccctaaatggcatggaatagactattttctgttttaagaaaaaatagaacaatggcactaaatgcttgactgaatgtttgactaaatgttgactgaatcatggataggaaagattgggcagaaaagacagccactgcctccagacacaggatgccacaatcctgggcaccatcattattccatacaaccttagggtcatttttagggtttagaactttctcaatagggtttcaagattttgaaaagtgtcttccaattctgatctccgtagatcctgttatgggaattaacctttttggaaggggattcttgttcttaaagatgaaattccctactttctttcctggagggaatcagtatgggcagagggaagaggagatggcgattctgacctgtgtgtctcatgtcacctaacacctatggggtggcatgaaacttgagctttaaaacacaccaggggccaggcacagtggctcatgctggtaatcccagcactttgggagaccgaggtgggtggatcacctgaggtcaggagttcgagaccagcctgccaacatggcaaaaccccgtctctactaaaaatacaaaaatcagctgggtgtggtggcgggcacctgtaatcccagctacttgggaggctgaggcaggagaatcgcttgaacctgggaggcagaggttgcagtgagccgagatcaggccattgtactctagcctgggtgacaagagtgaaactccatctgaaaaaaaaaaaaaaaaaaaaaaaaaaaaaacccaccaggaatggaaatggtgcttaattcctctaccgtcttggttcttccacacaatctgaactgggtcactgaatcttagcctccgtaagtcaacatcatcagttccgtttaataagacttgggccactataatgtccagctcaatcctcctggaagtatggaggacactgcaggatccttcagttgatgtcataaaagcaaagcatccctagggaagatctgtgagtcaagcctcaaggccctcgctgagtcagcgctaacttgagtatcaggagctcacccgtctgggacggttaagtctcccagccctgtaaattgccagttcctgctatggatgatgtcctctttaccttacggctttatgtgttcaacctgagtcattctaaagccagatccaagacccagagagcttatgctgtgccagttcctctttatatcactggaaggactacatatgtccagttgctttgggatttttttaaagaacatctcaagataaaaagggaggaagaaataatgtgactagggattgcacttcctggagttgcaggtcacatgagggacacgaacatggtggtttgattaagtctcgcgggattataacactgttgtggccactctcactccattagtgcatctctccgcacatatcagatagcaaattatataatgataaagttattaaaatatctgtaaaagtcagcacaagctcaagggctcgacttggcctttctgcccactaagtggtttatttagctctctcatctcaaggccggttaatcttcatctatactttgttgtaaatcacccgctatgtggaacagccataactgcctgagttttaagatgcgcttctgttggtcgtccaacaaggctggtatcttaaagatgaatgcagaagcttttgaagcatgagactcacccacttccccgttttaaaatgatagcctttgtttgtgattgtgtctatacctgggttatcacagagcagttatgacagcaagattatgacaaggacattgcctggttcacatgtttactgaagggagtaataaaataatgatagctcgtatttatagaacagaccaatgttgctggttcattgaatccccaccaccagtcacctgtaggtgcatgacatggttagggggaagcattgcccggaaggtcctgcctgtggtgtctggtttgttttcacgtgacccagcactgtttcctttaccaccaagtcccagtccctcatctatcatgtaagtgattaaccaggttgtcttcaacactaacattctgtcattctggatactgcagttcccgtgaattaatggtcacccctaactaacattctcaggaaaaccagtagggttgccccagagcccctcactctgctgcttatttggaaggagcctttatagttctgctgtgtgagaggctctgagccaccatatgttcctaaatgagagaagccgttgcccagacatggatctgtttaatttaatatgatttaccacaaattacgaagcatgacttcaaaattgaatttgtgcaaaattactgatggccaattcagtggaagggaagggaaatcttgttattcctattccagaatctcttcctgatttcctcatttgattctttcacgccttggggtaggggaggggaatgcattcgcggctctataaagaattgtccttattttcgaactttctccctggtcacacatggctccctcagaggaagacacagcaccctggagatgttaaggcagaagtcagttcttctgtccatccctctccccagccaggatagagctatcttttccatctcatcctcagaagagactcagaagaaagatgacagccctcagaatgcacgttatgaggaaggcagaatgtgggtctgtaattcctccgtgtcccttctccccctctgcaaaccgtcgtaacaataatagttcctaacacatgggacaattgtgaggattaaatgagttagcctgcagaaatcacttgatgcacagcacatgggaagcattgtgtgtatttattaatccttcacaaagtctttgagatatatttttatcaaatatttagcatggatcccggtacactttcaatacttaataaatggtcaatgttattctttttcactattattgctatttatgtgctcttattggcggcattgttgtatcaccagttagttgtacccatcggtcctctccaagtcacacagctactctgcgataattcccccggtgtctccttattcctcgggagccccagagtggataaaggtattggtggttttagtggtattttcatttgagttttgtttccttggataaacccaaacaggagaccttcccataaccactgttccacaagaccaaatggtaaactgttaaagttgaaaggaccttaaacttctttgctcaaagccctatattttactcatgagacactcgaggcccagggagtttcagtgattttccgaactagaggcagacctaacatccaggttttctggctcctggcccagtgctcttcccattggctggttcgggtctgcctcagaggtagcctcagaacagtctctagggttggtgtggatcattcacttgggcactgaaccatgctgtacgtcacactgcctttttctggaaatacaccatctcagggagatgctaggtcccatggttgggttcagtatcatgtgctgcttctgagtctccatttttaaaaggttgaattcgtgctaaggaggagtgatgcttttttttttttgagacggtgtttcactcttgtcacccaggctcactgcaacctctacctcccgggttcaggggattctcctgcctcagcctcccgagtagccgggattacagagtcgggattacagagtctgccaccacccccagctaatatatatatttgtatttttagtacagatggggtttcagcatgttggccaggctcgtctcgaactcctgaccacaggtgatccgcccgcctcggcctcccaaagtgctgagattacaggcatgagccaccatgcctggctggaggagggattcttaaagcatgcaaggaagggaagtcctcctcaaagccacacctaccctcctcagccccactcagcaaggaagggaaatcctcctcaaagccacgcccattctactcagccccacccagcaaggaagggatatcctcctcaaagccatgcccaccctccgcagccccagccggcaccccagccctgctccctgttggggacaaccagctacaggagaccgacaggtcacttcctgagcacaaagcccacgtgggtagcaggcaagggtgaaccctgacctgtcccattacttgcatgaattggatgcattcaacaaatgtgaatggtcagcctctttggtgtttttaatgaagcagctacaaaaggatttcttttaaccaagtttcaccgtcctgtgtgattttgagtaaataccatcctgtgccgattcctcccacaagcccggccctttaagcctgcttgggggctgtggcttgggctggcgggccagaagcaggatggcaaacaggtgtgcgagtgtgacagggcagaggctggagccacagctgtgggaatacgaggctttggcaggccgaggccaggaggggcgggaggctggtgctgactgatggtcctgtcatcccggttcaggatgccactgccaaacttcatgccaattgctcccaacagagtacacggctatgagagggagagagctgggaccagatgaaggcatccctgtgacggccacgtccttgtccatgaattcagggtcagggtgacgaatggcagggccaaaagctaccctggaatgtcacaggaatttgcagagaccaaatgcccttctttcagaggcaccagagtgggggctcccgcattgacgggtggcttctgggccccctcccttcactaagacttggtgacttggtaatcctccctcctcaatgaaacttatctaagaattgattaggaagagggactggagcatggcagtaactagcagtgcagacctgtcatctccatcttcccctcccatagcgtgtggctcttgccatgtcatgaccacactcccgggggctcgagctctgggcttgcctcagcagtctgagaaccacaagtttctaaagaacaggtatgaggaggagagacttttcttgctcaaagacatggatccactcagaaacagcattcaatggtgctgtgagtttcctcccaagtgtaatgacctcctctgacttgggcacttcttacagtgactttgaacttctgagcattagagatgagtgaatcgcagaaaactagaccccttgttagatggatgagcccagagaggttaagagacttgcccagggtcacacagataccacccatatcagagcgctcagctttcctttcccctcctccccagcttggacacattcctaggatttggatgtagcaatgtgaaccgtcctgagcagtcccttcaaaacagcacttaggcgaaagaggggctgttggaacaagacaggacaaacacccgtgtgcctctgcacgctgctccacccagtttctcatctttatattacagaaaaagagtctcaaataacccaaacaggcagggtatgatctgcagacagtctgcaggcatctgcccaagaagctgccggtcggctggtccatcctcctctgatttatgttgtgtgtgttaagccttaaattgttgagtctctggctggctgcagtggtattactggagggctggtgcatgttttcggctcacagagctggctccggtactggaggtgttggccccgaatcaagtccaatctcacacctgtctgagacaatgagggccttgttagacacatctccagtcgaggaggtgcaggctgcttatttttcacattcagaaccagaaggaggggggtctgggacaagggggatgggagaagccaaggggagacgggaaatgctggggtcagctgcctctcgggccctttccctctccttctccctcctcccttcccccgctcttatttaataaacttctccttacttttggaaattaaaaaacaaacaaacaatactaacagttgccctcttatgaaggataatttcctactgcagaacaaggagctcgtggcctgttgtaggataaattcccagtcatcatgggagtggagcagcccaggggaggagtggggtgaataggcaggggcgcagcccccaccccaccccagcactgaaacttgagctctttgcacactgagggcgcctgtcagtgagaggttttctcttctggttttccctccactgctgacatttcagtgacagccgcagaaagtagaggggactttgtccccagctccatattattcattgatgaaaccgcaaactgttctgtcctggttcagccttcctgtcccctgtgatcagagcagacagagcaggccaccaggacttacgtctgcagacactttgcaaatccagttctcaagaggccctgacatgaggcggccccgggcaggagtccttctgggtacaggctggcacccctcaagggtgatgatcgctctgaaggatcattacttagtcaaagccaccctgaaatgactttctattgcaggaccacacgacgtggaggcccatagtgtaggagtcaggaaaagagcttcccagagttatcaaaaaccactctttactgcgagagccaacagtaaggagcctgtgtagaagagctaagaaaatctcacacatgtagtggccatgtcttgggggcttgagtaactcgacaaatctcccagctctgtttgtgatcaggtaggctcttacctgagccgggaggcatttaggtgccagcagtcactcaaacaaggaatgggcagccctatccttctcatccatacacaacttatttaagcactaagccccattgctgactcctaatttggcctcagcgacacaacagggaaaatccatatgctgtttatttcatttgagactgaggacttaccagagatgaggttgcgccagtctgtttcttgtagtataaatcatttgtagctcagccacccttgtatctctgtatgtacatcagttgacaatcccagagaaacaaaaggacaacttttcagaggcagcagagtgacagacggtgaatagcaatgagcataggcaacctggacttctggctacactccagcctgagtttgaatcccctctatgtgaccttgagtgacgtgtgaagacccaatgtgctcactgttgatactttggccttcagagagtccagggactgcactgcataggttcccttagccctgcactcctggtagaacctgtctgaatatgtcacctttggaggaaagtggccgaagaagcaggtgttgctatttcaggtcagctgatgccagggaggcctgatacctatggagaccatggaaccaccagtttcctgtctccttctctagccatgcctccctgccttgttctgggccacaaggtgctccattcttccgaagctcattcttgctctgaaatgaccaaaaagtcaagccaacgaacaggagggaggctggacactgaggtgggtgaatgctgcagatcttcctgcttgatctctgaacacccatgaccagtcctgcccacaagctttggtccatgctggatgcctacccagaaagttccttcctctcctccccaccacatccccgaatcctgccattcttcagggcacctcacctgccccatctcctccagaacatctttgtcctcactgaggcccagactgactcccttcccgactcctgactgatctgttggtctctgtcactttggcatttccccacacattgccttctgctgttaccagataggctgcatgtttgagtgacgcttcaccaactgtcatggctatgattttccaccatctgtgctgtaagacagtaaaaactcaaccaccaccaccgagatgccatccaggcaggcaaccctgagcgtgcccccacccgctacacactcttctccccagagcacatcagggttctgagatcaacaagttggaaggagacttccaggtgggcaggaacgctctctccttcccaggacccccacgaacctagcccagagctgcagagaaaggggtgcatgagtcgttgaggaaggatttttccttgctcctgggacagcaagtcaaaactgtttgttttaggttttaagttaatttcagaatatcctgccctaaacaatttctttccttacatagcaccaactctctgctggggccctttggctgtttcctttctccattctttccttctcctttcccagatcccagctgggaacctggggggagagcctggctggcaccacctgccctttcttgggccatttcccttcttgtttgtgatgaggaggagcctaggaagtctccatgcttcttggctttctggccctcatcactttcacagccttctgctaactaagctagtgagcccccctgccctttcccattccctctctgaggccaaactctctcatcccagcttctttcttttcatcttccttcctctaaagactgctcagcctcatcggaggctgccttctgaatcctgaccctgctttccacattttgtaagacatctcggccccagagtaagagtgcatgatttacctaccacttccttggatcccaacccctactcactgctagctcctggcagtggcgttcttcctccttccttggtgtgcagatgtgcccctgtgtggcctccttctctaaaagcattctagattgttcttggttccagcacttctgaaacccatccttccaagtttactctttttcttgctatccctcgtattttcccactcctcatggaagcttctttcccacacccaccctgtgccctatggcgggggcttcaggacccccaaccccagccctggagcgtttcagtgctgccatcctgctggcttcacttggtgcttcctccacagcaactacaaaagccaaggaaccttccccagtccctcccctccccagcattctcctagcagaattacattttaattttcagctgaatggatgaagaaccattccaacacctctgtgtcacccacagttgtctaaaacacacaaacaaaaaaaagtctgggtcagcagaggggagaccatggtcactctccttgtcaaccttccctttgcccattctttgttttctcttccctccacctctgttcctctgaaacctcttttgttcaaatcaaggggaaggtaattcagaggtgctgttgagactggtttgctttttaattttttttttcaaagaagacgggaagttcctgttttttggaaaggttgttcatttccaaagaagttacacagccagtcagctataggatgattcctggctgcattttttcggggtagtacacaatacaaaaaaataagtcaatgagagagagagagtcagtcagtgaacacaaagggagatgttataataggcttttgttggtacttgcattttcttgttgaaaaacagagcaaagaccccgaggtgctgaggtgtggacagaagcctgatgttatcaggcccccagaaatcctgcctgcagtccagtggcaggcaggatccagaactggaaaagacggaggcaactggtcctgctcagcacaaacggtgcttttagtctttcgtaaacagcctgtgccccagggctcaaatccttcaaaagtttgcctgggtaattgcatttcattgctgtctggcatgtgctcatcagtctaatctggaggttcagacagccaggccaaagcttgcgagactggaggagagcgagcctgtgaatttaatccacttgaaagacagaataatacaagtgcatctaactcattattttaagtgatgctagtcgaaaaggggatggtgctttccataaaagcatttaaaatcagcacgctgcagttgcagccacttggcagtttaaggccattagaagaaaaggcgcacacaggtgacagtgtgatccctgtcgccgtctgcttgtccctgaaagccttcctcctccccacgaccacctcaaaacacagaaggcaaaaggaatggtaacttccatccctaattttgactttgggttatttgtacatttacagcaacagacaccaacttttatttgagatttggggtcattttggcatcgtttcagggtggagagaagacataaatgaagttaggacttcccagtccatctcaccaagctcaggatctcacagagctataagcaggcaaaggtgttccccaccagaaccatctggacaatgtgctttccagtgacttctttttttttgaggtttagctaggtctttttgttctgtcagtacatggtaactagattgatgggagggttatagtttctaactatcatgtagttaaagcagtagtctacaaagagccagaaggtctgtccctgctctgttgctatctgctgtggagaatagggggagtcccttcaccattccgcactgcagctttctctgagatggggctggcatggttgtctctgctgtctcggaggttgctttctgctctatcattccataagacattagaatgaaaccttaagtaatgttgacggtgatttgcgtcattatctagttacatgtgactcatgcccaggaagcccaggagaggcaagtgctagcctgtaccctcccagatggcaaagccgacggtcagctcaggagcagtcttgttggtagttcacacctgcagctcacccagggctcaacatgccagctctaagtctgggtgccaggccatgagactgagagagcagtcgccttaaaccttacatggggatggagtttccccctgggtgcatcatgactgcagccacccaggattctcacaagggctccagaaagtgctcaccacacacctcatctcctcatacccctcagttcatttgtactgtgcccaggggacaatgctgtgttagctttccccgatcctgaagagcacctctagaagtcacatcttccgtcttgtcatcatggtagctgaaaccattgtggcagtgtgtgctttccctgagcaaggttttctttgacactttagggcacgcttgatcttgtgggcaggatcattctctgttgtaggggccatcctgtgcattgtaggatgttgagcagcattcctggcctccacgtactagatgacagtagcactcccccttcctcagttgtggcaaccaaaaatgtctccagacattgccagaaatcccctggaggagaaatcacccgtttgatgatcgctatttaagagtaattgggaaattcacaaggatcttctagtcaatatacacaggatctcaatgcctgaaaaaaatgtgagttacttagctatctaaacttggtagtaagtcaattttgacccttcagttctgtaggtcctagcattcctgtcttccataggtcatccctcttgttgagcaagagtttcatagttgtctgctatctcaacctctacatttaatttttttaaaaaaaattactccattttagcccaagtatatggcttctatgagaaagccttccttggccttgtaaatcaaagcagttctctggagggaggtttcccactgctgggctgagtatcatctttctcagggtgacctcatctattgaagtatgaaggttgtatttgaaatgccatttactttctctaagtcaataaacgaagctgtggatctgtagatcatcagaggtctgcttattaccaagcggttttgtgtgtgtcattttttaaatcgagatctgtgttggagtttaaaagaattctggcagatttccatttgcctttctgaatcagagtttggggtgagcgagtgtagattgcccctagatgaatctgactttattagtttgtgtcctttgttcagagcaccagggatgagcttatgaaagcacaaatggctcttatcttcaagtgtttcctttatgctgcaaattccacctcaccaacctgtgttattaacccactgcaatcccaattagttcacatcaaggtcaactctttggggtgtgcaaaatggctgcaaacttaagtgaacaaattccccttgtgtagctctcacatgaaggtgggggagaagactgcagcaggggaacttagaagaaagagggagttttctgataccatagaagaaagtgatagtgattccccttggctcacaagccaaagaaatccaattattccaaataattcaaaacttgcataggaacttgtcaccaaatgagggaacattttagcctcttattcactctgttgcttggtggcaaatatttaagaaatttcaaaaaatagagaggtgcaagagagctatttctcaggggcatggaggtttcttgggggcatttctcgggggtatagagggctgtttcttggaggctatttctgtgcatggagaagccttgagtttcagaggtataataaacactactcctccagaaatatgtctgtgaaaaataagctggagcgggtgggtctgcaggacactgtgtttaggaatgaaggctgcctgtcctgccatctctcaggagctcccatcagaacagacagtaaagacaggaatggcatgtctccagttgtggggcaaggcccctcctagtgtgaagaaaatatacttcctggatctatcattatctctagcatatcagaggggggaataaaaacaactggggtggcaaggccctgctgaaagagaaactcattgttctgcacattcagagacttcctagttgtaaagccgttcagagctcttggaggtgaaggggcagccagggaatcacatagagtgaaagacctgtgtgcagcggccaggtcagagggcgtgtagaagacgacatgaagcattcccacagggcagttccctgaggttctgtcctccagctcttgctgcaaggaattctagaagccttggcctgatgtgtgggaaaggaaaacaaggtgaagaggatgcaggtaggaaaagaagagctgtgacaaggtagtcagatgggaggactgcatgagaaaaacagaggaagagagcacagaagcagccctttgatttcactcgcgtttattgaaggggacgaggcacttccacttggggaattctacttccctttgtcaggatatccttcaaattgggagcatggaatggaagctcttaaagaaagaacggttgccattcattgtgggtcacacttcacaagacaaagagcagtgaatcctcgatttgtaaaatgcagctttcagaatctgtgttgtggctggcacggtgcaacactgctgtgaggccctgacgcagctgtgttctgcagggtggctatggtgctccttgtgaaggaggaggctgctgctctgcaggaggaagggcttatgttgcatcctagcggtgcatgctaccccgctggaatagtgcaccttggaactctggctgcctaaggaaggtctcatttctggtggctttgtgagaccaagcctctccctcttctgttacctggagcaacaaccagctaagccaacagtactctccagacactgttatcctttcctggaagggcaggggagagaagactgtttcctgccttcaaggtgccagctactgcattgacaatatcgggcagaggggcacatttcaccctcccaggaatctaagggacagatgcaataacatctccttatggggggaaactgagtctccaaggcattaagttacttgcttcagcacactgtgagtgaggggccaagctagggtctctgtccttacctctcagactgcagaactatgcccttattgtatccttactgaagcccttttggcttttagagagacagctctgggatgaggttcccaaatcctgaaaatgtttggggccagaacaaacaaaagcatctttatgttaagccatatttcatgtttattgttttgaattctccttttcccccattcatatgagtttttcttctgattttattagaatgccatgcctcagagtttgctgcttaaaaccagaatccctggcataaaatccaataagcctgccttagggcccatgtcatatggaagcagaagacaacagagactgcttgctgggcttcaagccactctagaatttttcaaacagttctaacattttacaacatcaaaaaagtgccaaagtaaaaactaaggctgcagctaggagaatgcccactgagaaacccgtggttgggtttgtgtagagaggaaggcttttgagatcactgctccatgccccctcggcctctcccaccagaggtctggctcagggacagcacttgggcacagagagctggggcagtggcagagatggatggggtagtcaccagaggaagcccaggctgcaaactggcatgacacacacctgtgtggaacagatctccatctgagctgggctcaaaagcatcgtattctccaatatcgacaactcataggttagggggttcatcattttgtagcctctgcagtcccagacgtaaagtcacttctttttttttcttgcgtgctgacaccctaaggcattacatggaccctggcaaatctcagccatgttacttaacatgatctgccccagcgacagctcttaactgtatctgtttagccagagatatcacaggtgcctctctaggaaatcccaccggcccctcatcagcacagtggagattggctgtaaagcacggccttccatgcccagcctggactgcaggttggagatgacagtctcccaacccaggccttccaagcatagactatcaagcgtgcacaatcctcttgatatcaggtgccacctcaatggagtgttcttcagaaaattctgtttctttagctgtgtgcagtcctgggagatgctgtgcctcttctgcttgaagcttcccagctcccacttgaggtgtcagtgatttgttttactggagtgagtatcctcattctccaccaagggtccagtctcaggatggaggctgcttgagatatcccagccctcaacacaatatttctggctcatgtttttcaaggaactaagcggggcaaaggtgccagaggagtagaagggagcagaaagttgtctttaccctcctggagaagaaggacatggaggagtggaaggaaataaatagggtggccatagaagaatctaaacatccatgatgtgctggtgttgcaggaatgtacccaacctgtctgtagagctccttcaggcctggaaagttgtatacggggggcagaggtgcagaaagtgcacagtgcagaagatccttatggaaaagatgtctgcaacaaatgtttatttaacaaagtacagagaaagaatctgtctgcaagggaggaggcagcagaaaccagaaggtgccttctgttccctctgaactatggtccctccagctgtgtgcactgaaggccactctccctctgcctcagggacacgatgccaactgagaatgagacatgttctaaaaacacccatcttttctggaagctagtgacctatccttgaaccctccctccaaaagcactctgcctaaatacgtagccctttcccagacgtgtctcagactcatctggctgagggtagcagcctcgtggtgcagggtgaactgtttcccctgggaaccgtctgacagtgctaatgaggaattgcattttgcgtttatagagcacctttcatctgtggatctcaaagctgccccacaaacattaattaactctcacacctgtgaggcaagtgagcctggttacccccatttttagaggtgaggaaacagaggtttgaaaagaaaaggactccagggtgaaccagcagggttgggggcggcctgatgtgaggaaccagcattcttgattcacagggccctgaccacaaagccacaaagcttccccggcgaggtgatgaatacgggtcccggaagcagggagtggtggagaggcggacacagggctcccttcttccttcccgcaggcagcctgccacctcccaggctggcaggtcggcagtgaggatgggatccctcaaaacctgaggcctttaaaacagcatacccaggcagggttctgccccggcttggtctgtctgcttctcttcaaagtaattgctggaacaacgaatgcatctgagctacacatgactaaccaagatgtctgcagccggccagagacgaacggttggcaaatcctggagctgtttcacaacctcccttttttccaggatccagagctggtgctgactgactcatgttatcatgggatttcaatgatatagcaacagtgtgctgagccggtgtctgctacctgggggtacctgtagtaggaataggtgactgctcttcttacttgtgctgtgccggagctttgctccctgctgcagaggccagaggaaacactgcttctcaaagacagtggaactttcagggaaatgtccctttcagagcagagtcacccacccccagggactctgaaaggcccctgacatcacacacctctgacagatgtgatgctgggaagcatctggggtcaccccctttgtctgcaaggggagcctaggcctttcttcccaggggtcccagacagtgagatgcaaaccaccactggggctcgccctaacacatcaccctggaaactgactcacatctctgagtcctgagtcacatcctgttgtgtgttctgaggtctccaagagggcattacaccagctccccatgactgaggtgaatctggagggaaccctgggaacgtccctaccttcctccaggatgaaggagggaaaaaattcctccagggaaataaccagggctgcccctagggtttatatgttcaccaagctgatttgcctttttcaaaaatagatggtagaaccctgtggtctatgtgacttttatttttaaatagctctgagagatgactgaaagacctggcgttttaaagatgtcagccacacaatcaaggaaggggctttctaactataaccttctccaagcccaggatgaagggtgccaccgctcaaggggtgctgttggaaacccagcttctgagggtgggtgtttaaaagaccctagagtggacagtcagaggagggccgggaggggtctctatccatcttctcccagcgcctgtggggagcacgaggacaaagagggatgttttgaacttttcaaagaacaagatattttgttctattgattttgtctattattttcctgtacttaatttcactggttcctagtctaatttttattatttcttctcttctgcttgcttgaggtctgtattgctattttctccagtctcctgaggtggaagcttcagtgactgattctggatctttcttttctaatatatgtattcaatgctataaatttccctctaagtactgttctatctgcatccaaaaattgtaataagttgtattttcatttagttcaaaacattttttaatttctcttgagactttttatttgactcatgtctaatgtagaagtatgttgtttaatctccaaatatttggagattttccagttatctattattggctttttaatttaaatccatgtggtctgagaaaatactttgtatgctttctatacttttaaggatcttaaagtgtgttttgtggcccagaatatggcttatcttggtgaatcttccatgtgagctgaagaatgtgtattctgctgttgttagagtattccataaatgttaattagatcaagttgactggtagtgccgtttaggtcaactgtgtcttaattttctgcctgcttgatgtatcaattactgaaagagggttgttgaagtctccaattgtaatagcgtatttacctatttctccgtgtagttctatcagtttttgcctcatgttttttgacactcagtttttaggtggacatatattaaagatgctgtcttcttagagaattcacccacattatcatcatgtaattcccttctttatccctgaaaattgtccttcctctgaagtcagctttgtataaaattaacatcgctgctctggctttctttcaatcagtgttagcatggtgtacctttttccatccctttacttgtaatctgtataaatatttttatttaaaataggtcccttgtagacaatatgtagttgggtcttgtctttaatccacactgccaatctctgtctttaaattggtgcatttagagtattcatatttaacctaagtattaatataactgcagtagtatcaatcatatttataacttttatatttgttgcacctgattcttccccccacacctctttttctaccttttataggtttaactgaacattttatatgattccattttatctcctctgttagcatattaatcattctttttaaaaatgtttttagttactgccctaaagtttgaaaagtacatgtataactaatctacatctagcatcaaataactaccacttcttccttcctgtttatatcattactgccttttatttcatttatccacatgctataatcactcaatactttgttactattattgtaaacagttatctttcagatcagttaagaaaaataaaacttaattttaccttaatatagtacttttctaatgctcttccttttttatgcagttctttttgacatttctcatagggcaggtcagctggcaatgaattattccagttttgtttgtcagaaaatatccttatttctttgaatttgaaggataattttgctgaatgcagaataatagtttggtagcttttttgttgcaacacttcatgtattctcctttctttgtgtttgcatggtttctgaagagaaagataatgtaattcttatcctttttcctctatggataaggtgttggcttttccccctctctagcttctttcaagattttctcttctctttggttttttgcagtttaaatatgatatgcctgggtgtagatttggtatttattatgcttggtgttctctgagctttctggatctgtggtttggtatctgtcattaattttggaaaattcatagccattaatacttcaagtatttcttccactgttttctttttcttctccatctggtattccaattacacattacatcttttgaaactttctcacagttcttggatgttctttctttttcctctttatctttttgtttggtaagtttctgtatcttcaagttcattggttctttgctttgtcatgttctgtctactaagtaagccattcctcatttctgttagggtgcttttggtttttagaatttgcttttgagtgttaagagtttcaggctgggcacggtggctcatgcctgtaatcccagcactttggaaggccgaagtgggtggatcacctggggtcaggagttcgagaccaacctagccaacatggtgaaaccctgtctctaccaaaaattacaaaaaaaaagaaaaaatagctgggcgtggtggcaggtgcctgtaatcccagctactcgggaggctgaggaggagaatcacttgaacccaggaggcggaggttgcagtaagccaagattgcgccactgcactccagtgtgggcgacagagcgagacactgtctcaaaaaaaaaaaaaaaaaagtttccatctccctgcctacatcatccatctcttcttgcaccttgtcttctttttccactagagccattaacatgttaatcattgttaaattccctgtcttgtaattccaaaatctgtgtcacatctgggtctggttctgatgcttgctttatctcttcagactgtgtttttttcttgcctttcttgtaattttttattgaaagtttaacatgatttatcaggcaataggaacttagtaggcctttagcgtgagttattattctcatgtacccaagagttgggctgtatttaatgttttcagaaggtaccagagacttcaaattcctctagcgtccttgtttttgtctcccatgtcatctgtgagcttctctatgaactcctccttagtcagtatgttgaagctctttcagccataacccactgttataataatatattggatcctgtgagaatctggtggagttcctgaatgaaaaacccacaacagtgcacttcctcctgaaactgtagcccctaggagtgtcttattcgcacactagtctgtactgagcctctagcaatctgtcaaaatcaccattaagtgttctcatcagtttatgaattcagaaattctgctcccagcaagcagacctcactatgattctctatatttgcctgcttctcaaaatttggggttgcagtttgccctgcaacttcagctttccattggacttaagaaaagtcatggattttcagtttgttcagcattttttcttataaaaacaagagtgatgactctcaagctctttaaattttggaactgaaactagaagcaacaggacattctgacatgaattatttaaaagggtcattgttgactctagagacattttaatattgctgcatcaaaagataaaagcattctcctttcttcttgtgtgatatatgccgtgtacacctctgagctcaccactaacctcaactctaccttatccctaacttcccatttcaaatggaagggaatggggatcaaggagtagaaggcctgttttacccattattgatgattaaaaagctgaaaataacccatcacaaaatggcctcagtaaagtggctgcatcagacatcatttagcctggaaaaccagtatgcataaaggctcaaatttaaatttttgaatccagtgttttttatttattattatttttttttttctgagacggagtctggctctgtcacctaggctggagtgcagtggcacgatcttggctcactgcaagctccacctcctgggttcatgccattctcctgcctcagcctcccgagtagctgggactacaggcgcccgccaccatgcccggctaattttttgtatttttagtagagacagggtttcaccgtgttagcgaggatggtctcgatctcctaacctcatgatccacccgcctcggcctcccaaagtgctgggattacaggtatgagccactgcgcccggccctgaatccagtattttttaatagaaacatgagttggttgagatactgagttcctgccttctccatcctaatcccaaatttccaatctttggaaatttgcccctttaccatttaatctcctgagcccagctcctctccagcctgaagagtgtgtctgtcaagactgtagctgtgaacaaaacactattacttgagccttatcctggagcaaatgtgtgtggtctcaccaatgaacatcagataagtcccttggcatggatttcttttcctttttagtaatacaatcataaaggttattcagacttattgagcatttactatggccagaaattgtgatacttgctttccatatagtttatctcacttactcctattaccctttgaagtcagaattctaactatgaatcagagaaaataagtgacctgcctaaggtcatccagttggtttatggtgaaggcaggatgcaaactgaaatttgtctgtgatttgagttcggtgctttccctagtctcctcctctcagaggcagaacataagcatgtaatagataccactagggttcttgtttctaccttgggaacagctgtttgcaagtccaaattaggcagctaatctagcagttagcccagatacagcccttgggcaccctagtagctgtaacttccagaaggcaggaaccttccattcactagtgagtccccaaaacagtggcccaagtgaagcaaaaatgtttgttggaaatatgagtgaatgaaaaagtaatttcatgaacacatgaatgaataaatgaatgaagcaacacccagtatgatgattaatgccacaggaagatgcctttccaagcatcacaagatcctgggatcttcactgactgtaagtgcctgtggggcagggaccatgttggtcttattcatcactctcctgccaggtaaattagcacattcctggcacactgtaaatgttcaataagcttttgttcttttagatggattgacttatcagaggcaactctttcaagaacaagtagccctgtgctctggagaatgatttacagtggttctcttcctcagcctggggccttttctggataactcccatcgtactctcctctacttcctcttcctagaatacacaaatttattattacaggcaccactcttcaccccacatctgattc

SEQ ID NO: 1119 - DNA, 3225 bp, Homo sapiens
gcgggcgcgggcgggacgggcgccccgcggccggacccagccagggcaccacgctgcccggccctgcgccgccaggcacttctttccggggctcctagggacgccagaaggaagtcaacctctgctgcttctccttggcctgcgttggaccttcctttttttgttgtttttttttgtttttcccctttcttccttttgaattaactggcttcttggctggatgttttcaacttctttcctggctgcgaacttttccccaattgttttccttttacaacagggggagaaagtgctctgtggtccgaggcgagccgtgaagttgcgtgtgcgtggcagtgtgcgtggcaggatgtgcgtgcgtgtgtaacccgagccgcccgatctgtttcgatctgcgccgcggagccctccctcaaggcccgctccacctgctgcggttacgcggcgctcgtgggtgttcgtgcctcggagcagctaaccggcgggtgctgggcgacggtggaggagtatcgtctcgctgctgcccgagtcagggctgagtcacccagctgatgtagacagtggctgccttccgaagagtgcgtgtttgcatgtgtgtgactctgcggctgctcaactcccaacaaaccagaggaccagccacaaacttaaccaacatccccaaacccgagttcacagatgtgggagagctgtagaaccctgagtgtcatcgactgggccttcttatgattgttgttttaagattagctgaagatctctgaaacgctgaattttctgcactgagcgttttgacagaattcattgagagaacagagaacatgacaagtacttctagctcagcactgctccaactactgaagctgattttcaaggctacttaaaaaaatctgcagcgtacattaatggatttctgttgtgtttaaattctccacagattgtattgtaaatattttatgaagtagagcatatgtatatatttatatatacgtgcacatacattagtagcactacctttggaagtctcagctcttgcttttcgggactgaagccagttttgcatgataaaagtggccttgttacgggagataattgtgttctgttgggactttagacaaaactcacctgcaaaaaactgacaggcattaactactggaacttccaaataatgtgtttgctgatcgttttactcttcgcataaatattttaggaagtgtatgagaattttgccttcaggaacttttctaacagccaaagacagaacttaacctctgcaagcaagattcgtggaagatagtctccactttttaatgcactaagcaatcggttgctaggagcccatcctgggtcagaggccgatccgcagaaccagaacgttttcccctcctggactgttagtaacttagtctccctcctcccctaaccacccccgcccccccccaccccccgcagtaataaaggcccctgaacgtgtatgttggtctcccgggagctgcttgctgaagatccgcgcccctgtcgccgtctggtaggagctgtttgcagggtcctaactcaatcggcttgttgtgatgcgtatccccgtagatgccagcacgagccgccgcttcacgccgccttccaccgcgctgagcccaggcaagatgagcgaggcgttgccgctgggcgccccggacgccggcgctgccctggccggcaagctgaggagcggcgaccgcagcatggtggaggtgctggccgaccacccgggcgagctggtgcgcaccgacagccccaacttcctctgctccgtgctgcctacgcactggcgctgcaacaagaccctgcccatcgctttcaaggtggtggccctaggggatgttccagatggcactctggtcactgtgatggctggcaatgatgaaaactactcggctgagctgagaaatgctaccgcagccatgaagaaccaggttgcaagatttaatgacctcaggtttgtcggtcgaagtggaagagggaaaagcttcactctgaccatcactgtcttcacaaacccaccgcaagtcgccacctaccacagagccatcaaaatcacagtggatgggccccgagaacctcgaagacatcggcagaaactagatgatcagaccaagcccgggagcttgtccttttccgagcggctcagtgaactggagcagctgcggcgcacagccatgagggtcagcccacaccacccagcccccacgcccaaccctcgtgcctccctgaaccactccactgcctttaaccctcagcctcagagtcagatgcaggatacaaggcagatccaaccatccccaccgtggtcctacgatcagtcctaccaatacctgggatccattgcctctccttctgtgcacccagcaacgcccatttcacctggacgtgccagcggcatgacaaccctctctgcagaactttccagtcgactctcaacggcacccgacctgacagcgttcagcgacccgcgccagttccccgcgctgccctccatctccgacccccgcatgcactatccaggcgccttcacctactccccgacgccggtcacctcgggcatcggcatcggcatgtcggccatgggctcggccacgcgctaccacacctacctgccgccgccctaccccggttcgtcgcaagcgcagggaggcccgttccaagccagctcgccctcctaccacctgtactacggcgcctcggccggctcctaccagttctccatggtgggcggggagcgctcgccgccgcgcatcctgccgccctgcaccaacgcctccaccggctccgcgctgctcaaccccagcctcccgaaccagagcgacgtggtggaggccgagggcagacacagaaactcccccaccaacatggggggggcctcctgttcgcgacaagcccgccgggatcccgggccctgggcccggacaccgtcctggggccgagggcgcccgacggacaggatctcgctgtaggtcaggcccgcgcagcctcctgcgcccagaagcccacgccgccgccgtctgctggcgccccggccctcgcggaggtgtccgaggcgacgcacctcgagggtgtccgccggccccagcacccaggggacgcgctggaaagcaaacaggaagattcccggagggaaactgtgaatgcttctgatttagcaatgctgtgaataaaaagaaagattttatacccttgagaaaaaaaaaaaaa

SEQ ID NO: 1120 - DNA, 1419 bp, Homo sapiens
atgcgtatccccgtagatgccagcacgagccgccgcttcacgccgccttccaccgcgctgagcccaggcaagatgagcgaggcgttgccgctgggcgccccggacgccggcgctgccctggccggcaagctgaggagcggcgaccgcagcatggtggaggtgctggccgaccacccgggcgagctggtgcgcaccgacagccccaacttcctctgctccgtgctgcctacgcactggcgctgcaacaagaccctgcccatcgctttcaaggtggtggccctaggggatgttccagatggcactctggtcactgtgatggctggcaatgatgaaaactactcggctgagctgagaaatgctaccgcagccatgaagaaccaggttgcaagatttaatgacctcaggtttgtcggtcgaagtggaagagggaaaagcttcactctgaccatcactgtcttcacaaacccaccgcaagtcgccacctaccacagagccatcaaaatcacagtggatgggccccgagaacctcgaagacatcggcagaaactagatgatcagaccaagcccgggagcttgtccttttccgagcggctcagtgaactggagcagctgcggcgcacagccatgagggtcagcccacaccacccagcccccacgcccaaccctcgtgcctccctgaaccactccactgcctttaaccctcagcctcagagtcagatgcaggatacaaggcagatccaaccatccccaccgtggtcctacgatcagtcctaccaatacctgggatccattgcctctccttctgtgcacccagcaacgcccatttcacctggacgtgccagcggcatgacaaccctctctgcagaactttccagtcgactctcaacggcacccgacctgacagcgttcagcgacccgcgccagttccccgcgctgccctccatctccgacccccgcatgcactatccaggcgccttcacctactccccgacgccggtcacctcgggcatcggcatcggcatgtcggccatgggctcggccacgcgctaccacacctacctgccgccgccctaccccggttcgtcgcaagcgcagggaggcccgttccaagccagctcgccctcctaccacctgtactacggcgcctcggccggctcctaccagttctccatggtgggcggggagcgctcgccgccgcgcatcctgccgccctgcaccaacgcctccaccggctccgcgctgctcaaccccagcctcccgaaccagagcgacgtggtggaggccgagggcagacacagaaactcccccaccaacatggggggggcctcctgttcgcgacaagcccgccgggatcccgggccctgggcccggacaccgtcctggggccgagggcgcccgacggacaggatctcgctgtag

SEQ ID NO: 1121 - DNA, 65787 bp, Mus musculus
  misc_feature (1352)..(1371): "n" at positions 1352 thru 1371 can be any base
  misc_feature (5406)..(7204): "n" at positions 5406 thru 7204 can be any base
  misc_feature (19611)..(19769): "n" at positions 19611 thru 19769 can be any base
  misc_feature (34373)..(35238): "n" at positions 34373 thru 35238 can be any base
  misc_feature (44209)..(44263): "n" at positions 44209 thru 44263 can be any base
  misc_feature (52248)..(52317): "n" at positions 52248 thru 52317 can be any base
  misc_feature (63871)..(64442): "n" at positions 63871 thru 64442 can be any base
  misc_feature (65333)..(65526): "n" at positions 65333 thru 65526 can be any base
taatgattaataataataataataataataataataataagaagaagaagaagaagaagaagaatgagagaccttggaacactcagccccttgttgtgcatggaacccagtagaagaagtgggaagaatgtgagagccagaggggatggaggccatcaaaaaaacacaatcttctaaatcaacatgagcaaagcacctatgaagagtgaagcaggactggagagatggctcagtggttaaaagcactgactgttcttgcaaaggtcctgagttcaagtctcagcaaccacatggtggctcacaaccatctgtaacaagatatgatgcctttctcgtgtgtctaaagacaactacttacacataatcaatcaatcaatcaatcaatcaatctttgggctggagcaagaggggccggagtgagcagaggtcctgagttcggttcccggcaaccacatgaaggctcacaactgtctgtacagctacagtgtactcacatacacaaaataaataaataaatctttagaaaagagagtgaagcaacatgcacagggcctgcatgggtctacaccaggtcctttgcatgtatattatggcttccagtttagggtttttaaaggattccaaaatgtgtgaacaaggtggacttgattcttgtaccttctcttgggctcttttccttctgtctgttttgtctaaatccaatgtgttagttttttgtatagttaaggttatagttagagtagcataccatagcatgtccttcagaagcctatttgttttctaatgagagacagaaaaggagtagatctgggagggaagggataggaaggggactgggaggagtagagggagggaaaccataatcagggtatattatatgatggaaaaatctattttcaataaaaggaaataactttaaagaaagataattagggagtaaatatgatcaggtgaatatatgaatgtctgaaaatgtcataatgaaatacatgactgtacactaactttttaaaaaaaggagtgatcttgggactacagactcttcaaagataaccaaaaaaaaaaaaaaaaaaagagagaggaggctgttgagcggaatagtgattgaacaggaagtgtaggggaaaaagtggggaagccatgttgaagagggtagtctaaggcagatttctttgggaagatttgcctggaattaatagatgagactggaggaggtgtgagggctggctcagtagctaggcacttgcttagcatgtgccaggccctgctttaaataccagcaccggaaaaaaaaaacataaaggattgcagaatgtttgagtcaatgatgtcagtcggaaagctatagttannnnnnnnnnnnnnnnnnnnctatagttacatagacgtctagacaaaaggtgacacagacatgacttcaccttcctccccaaaccccacagactagtgcttcagaacctcacaatctttgcttccagcagtccctagaggtcaccagtgctggatcgagagattgagcgatatactattgtccacccttgagctagaaccacatcagaggaggtcagggagcctttcctgatacctacgtgccaaagacacaatagaaagtgggatcatggattggggggtgcatcagccaatgcagtacctgcagtaaaagcatgaagacctagctttggtgcccaacccaacattagtggtgccctataatcttattactaagaagacagacaggatctgatagccaagtagttgagtaaaacttggcaagtcccaggctcagtgagggaccgtgtctcaatctctgatgaagagtgattgaggaagaacctccaacaacaacttcctctggtccccagacacctgcaaacaccagcactcatgtgggtgcgcgcgtgcgcacacacacacacacatgcacaggtatgcacacacacatacactcatagccacacatacatacatatacatacaaacacacacatacacaaatgcagacacacacaaaaacagtcatgtatacatacaaacacacatacacacatacaggcatgtgtgtgcacacacatgtacattcatacacacataaacacacatgcacatgtgcacacacagccacacatgcatatacacagtcatgtgggcacacacacacacacatacacacacacacacacacacacacacacacacaaggaatctgtctacaagctagcataagctgcaaatgatagcaaagctgctgtttggttttcagtgtagggactgagtttgtgaatctgacaagctgttagtctcccagtactttattaggggagtaactcaccagtcagatgggcccctctggagctcagcatttgcacagaggacagctcctttgcgcatagtggattctggttttccacaggaccctgtctagtaaaacctagtggaaattacaagctgagaaattcagccttgtgccacaataacaggatgcacctgtagatttcacagaattagctgctgtcttctcttaacgccaatttgagagaaagaagcctgtttgtctgctgccaaacagggcagaatctcaagtattcccatatatctgcaaatgatggaagttatcaaccacagtgacactgtctttctagcggtcacttgacaaagacagggacttgcttgcctctcttttccaccatgctacccccttgttggctcctttgggacttacccatttggaatgtgatatagttaatagggacctgtctggccctgcctccccatctccatttgagagcaggaatccttttcaattcatttttgattacacagtctggcacagggcccactttctagatccttaactagtattttatggaattgaattctagaaaagtacatgaactgtgtaaaggtgacatcatgagcacttaaatagacatccaaacctatgtccacgcaataaagactccgtgccccataggctgacaaccacctctaactaacccagaaatgcagtaaatatataaatgatgagttccctgagctactagccatcctccaagaaaacaaaggcccctttcctcctcagctctctccttttcgactttcccttcctcacctccattttcttcccctctctttgcacctaccctttccagtcctctctcctacccctcctctctctattcttccttcctttcttctctcccctttctctccccttctcttctttccactcttctttcttccttctcttctctggttttcttctcctctctgcttttcctcgctctccctccacaccatgcccctctcctcctctctcttttcctcttctaattctgagaccacaaatgagcacatggctcttcagagagggaagtgaaaagacagagtgagggagcttttatgtggtgtcactcgggtaggacaggcaagtctgatagtgccaaggatccagtgagcaacagcttccctttttaagggctggtttctttttctccttgagtagattatgggcacagacaaggccttgacttctctacttcagagcccagtgtaagagcttgtgtagttgcaggtgctcagtcaacatgagctcatggcctgcttaacagaaatgaaacactttgacctgagtttcagttcttcctctctgtagacttctctgtagacttctctgtagacttctcaagacattgatagacaatgaatagacaggggtaaaggggagaagagaagagaggggcgagagagagacagagacagagagacagagacactgagagagacagagacagagagacacacacagagagagatcgtgatactctgaactgcacacctccctcttatgcctggtacacaaagaaagccgggctcagaattctaacacaccctcaaacccgattcaactccagaatgtataagaaaaagtaatttcatttaaaaagaacatctttgaggtgttgaaaaaaaagagttactgccacaaaaggaactataaacaattactgtcaaatgatttttaggattatttatttatttaattgagacaggatttcttggtgtagccttggctgccctgaaactcattctgtagaccaggctagcactgaactcagagatccacctgcctctgcccctggtattacaggcatgcgtcaccaccaacaccccccccccccatttttaaggatttctttcccttttttctttttaaagatttatttattgttatatgtaagtacactgtagctgtctccagacatgccagaagagggagtcagatctcatgacaggtggttgtgagccaccatgtggtttatgggatttgaactcaggacctttggaagagcagtcagtgctcttacctgctgagccattttgccagccccctttttaggatttcttttactctcttgattgtgcccccaaaattgccccagtctttctattccatcttgataccacatttctttttctttttctcttattaactcactttctatgagtatttatgtgtgtggagtgcacacatgtgtacatggttgcacatgtgtgtgtatctgagctccttggtgtgtgcacacatacacatgcatatttgacgtcggggtgtcttccttggtcacattctacttcatctttttgaggcaagtcttttgctgaacccagagttccactgatacagagtctagctagcctgctcattctggggatccctttcccatccgccaagtgttgccgtcaaaagcagccactgtgctgcgctttcccattggttttggaggtttgtagtccagtcttcacacctgtgtggccagtgctttatccactgagccatctcccagtccttcagcatcttttctagagcagcaattttctctctctttgcatctctagttgctgaagccttacctgccaggtcaaacatgtcagagaggcaaagagacagagaagttctgggaatcagggcttcacacttgctaacccaatacactgtctttgaactatgccccatcctgaactatgtcttaacaactgaaagtaatggtaaaataatccaactgatacctgtcttaaaagataaatatttatttttacttacttatttattattctatgatcattggtgttttgcctgtaagtatgtctgtgtgagtgtgccagaactcctggaactgaaagtatagatatttgtgagctgctatgtaggtgctggagattgaaccttggtcctttggaagagcagctagtacttttcatcactaagtcatttctccagaccaattatctttgttttttctatgtatgagtcttttgctgtgtgtatgtatacaaatgcatcgtgtgtgtgtgtgtgtgtatgtgtgtgtatgtgtgtgtgtgtatgtgtgtgtgtgtatgtgtgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttagcaccagactgcatcataacacactgctcgtatgtactgtgatactgcacttcataagtgagtacaaacattatctttcaattcttttaaacaaagaatacgccgggcggtgtggcgcatgcctttaatcccagcacttgggaggcagaagcaggtggatttctgagttcgaggccagcctggtctacaaagtaagtgccaggacagccaggactatacagagaaaccctgtcttgaaaaaccaaaaaaaaccaaaaaaacaaaaaaacaaaacaaaaaaaaaaccaaactttgattctggaggtgtatcacttagcaacggagcatgtaccccattgatgggacatgtatcagtacatgtaagaccctgggctccaaccccagccacaaactaaacaacaacaaaaagcccaacttcttgaaaatgttaaaaaaaaatccttagtctttgattttcttttttaaatgagacattgggccttccagaaccagagaaaataagaggaatagaagacaaaacctcagtaataggatttaaaaacaaacagatgactagttctacaaaatacctttgttaaaacagtttacatgactattttaaactgacctaacaaaaaagtaatggaaatctaatcttggcatggtagcctatgcctttagtcccagcacttgagaggcagagggaatagatctctgtgagttcaaggtcagcttggtttgtctacataagaagtttcagggcaaccaaggcttcatagagagactatgtataatatgctaggccctcccccatcaattactagttaagaaaatgccctacagccagatcttagggaggcattttctcagttgaggttcccctctttcagataactccagcttgtgtaagattgacataaaactagccagcacattgtttcatcctgtttgaacatgtcctgtggctcagattctatccttcaaagtcttcctcgccatcaatccaactgacatctctaccctcacattcctttggcctcccagtcaactgtacttctagttagctgttgagcacagattatacctgaaggacctacctaaaaaggctacattcacccttcaaggacagcaacttatgtctttcctgaacatagtcatccataacgttctctttgctaagcgtctcccgctcttcttcatcatgatcactgggcaactaccaccttctactgttagaaagagcaaaggctcacctctaacctaagaggaggcaatctgggtcagatagttgatgcatgatatgatgtgcagtttcttctgagaagtaccagacatttctgataagagagttgagcaacttcctgatatgtgagactcagctttatacagttgaccaaccaaccaccagtcctgaaggaacattagtgacccttagacaaatgttccttaaattaatctattggggtcatctagcctacctttttccttccttaaaagtctttgccaggaaagaagtatttgaaatagacttagtggaaactacctatttccagcaggtttgaaacaaaacttggacatgtgctcacaagcatttgtctgaaatggcttgaaatgtatccttgttgtatattcacattcacatatctcaatgcatcatggttgaacacccatatgtgttatgaaatcagtgcttatttcaaaaatatattggatgtagcctgtctccagagcccacagtgtgatacctttatcctaagatcctcagactcttatgagttcaaagtgcctgtgacactcctgtaacactcctgtctataaatatactgattatatgctggcgtgcatttttccctcaagggaggaaattaagatttcaccagatcttatttgcaaaacaaaacagtcagcaactaggctagaagtaaaaagttatgtcaatagtgggtgaaaagacagcttggtgacactatgagagaaggcaaagggttctttctgaaaggcctcctgggagaagctagacttaaaatcttccattgcagctgtaaacacatctggacaatagtctgttttctgcatttgtgaatcccacacccatggaactatgaatcgtgcatcagagttatttaaaaccaccgtgcatggagtgaaccaataccgaggtgtttgcttatcattttcctttgagcacacagcacagccttgaactcagtgacactcctaagagggctctagggtcaggccaacttagatgagatgctagtctttagctaaagatgcccttccacccccgttgcacgaccttgcttctcagtctttgttgagtcttctgggggagaatccccctagaggactcagtttacaaaaccctaagtgagaccactgccaagaagtgcttgctcacccctcctgccgcggcagggaatccccctttccttgtacaggcaaaacacaaaaaaggactcataagtgaagcctgatccttctcaccaaacactgcccacacctcctagtaattgaacttgaaaaaaaaaactggtttgaaaaattaccgcaaaccatattgtcataaaaaaaaaaaaaaacacttcctatatgagatcacagaacagagtaggcacaagttcctgctgagcagatcagcctaatgcttaaatagaacaactcctggctgtcattgacattgtctaaaagccaagatgacagactgagaggcctgagcccttgttctggcattctcccaggaagatgcagtaaaggggttgacccaatatactgcagagaatttcatccagttccctcctccatcctgatcccatgtgccaggaagatggagccacgcttgctgatgttggggtttctctcattaaccatagtacccagttgtcgggcaggtaagagaccaggaactgccctgggaaccttgggaagactaacagaatcttggtaagcctacatctgctcagctatacaaccagagggaacaatgagatggaaaactttgaagagggagttgaatcatgggttctaactcttgtccagggtccactaggacctctttttgtgcctcagtggtccctaatctatcaacctttcttaaaatagcaggaaggaatttctcattcatagtcctttttaggtttcattcccagggatggtttggctttgctgtcttggaagtttcttgtaaatatcattttatggcaatttcagaaaacataaatatattcatttttcagagcatgactttcctctgcttctctgggtgtaacgtctgtgtgttttacataaatatgaattccatcatcatagattttgtcaggtatagttttaagaaataaaaaccatcaccaactcagacatcaaacaactcttcttaattgaggatgaattccctaataccattttttcttgctaatccagaaagagaagtgaggtttgtggaaatacatatatttcaagtctattagatagattatagatagatagatagatagatagatagatagatagatagatagatatgggactgtctcactatgtagtcttggggtgcttggaatttgccatgtaaactagtttggcctcaaactcataaagatctacctgcttctgtgcataaccccacactaggctgaaaatatattttttgaaagcctacagtttcatattcttaatttctaggaatttattcttaaatgaccccagaaaaatgtattaagaagagtaaaataaataacatatacacgaagcttgattgctgactgggggcaagtgatcacattgtgttgggtcacttgggagcatcttggctttggagttaagatgtttatgattttaggaagcttttattgtgtgatttctcccctaaaagtatctatccctcaatggtgtctttgtcaggttagttcaagtcagaacaaccaagtctttacagttatgtgtattctgtctctgaggaaaggctttcaagtaaacttgtgttatgagctgtggttgatttatataaagctcatttacttggttttgcaaaacatctgtccactacttcttatgcatgtgtatatggggaaatgacagcattacaggttggaacatgcctggagctacaggggtgtggggctgtcagagaagacttcatgaagatagcgtgtccattgagccctggagactggtaaatttccataaggaaagattttagatgagaaggcacatggatcaggaaatagaagagtctgaggagtcagtatatgtattctctgaatatggggctattggataaagaacagaaagataggaatggggccaaaggcattaaagctctggacaggaagctcaatccttttcttttcctgtgttgttggggatagaaatccaaggctttgagcacactaagcaagcactctaacgctgagctgcattcctagcccacaacttaaaatactttagttgtatttggtaggcaacagaaaactacttgaaaaatgtcagggaatgccatttatagagtacacttgataaatcagatgtatacattttattacaacttctaatcactttacagtgtgggtgtcatgaatcagtagaagtaaccccaaaatcagaatatcagtgttgcaaggctcacatcacttttgtattttctattggagacaagaccagaggtgattctggctgataatagaaagagatcaggtgcaaggagttatgtcaagaggcaacttggttcccagtgggaaacagaaagaaatggccagaggtcagcaagtagctcagaaactaacccagggcaagagatgatcttatttcaactttgtttatcgtccaggaagaatttagtttaagcaattaatggggctggagagatggctcattattggtttagagcactcattactcttgtgatgcgttgagaacccaggacccaagatggtggctcagaaccatctgtaactccagttccaggtgatctgacaacttcttctggcctccataggcaccgtacacatggcaaataggcatagatgtgggtcaaatgcatatacacgtaaaaataaataaatattaaactttaagaaagggtagaaaaataaacaaatctttctattccttgggggcaagaggtctttaatgaaataagacagactgtcaacagattcaatttctagctgattcataaggcagattttcattttgaaaatttccaaagccaccatttaaaattgtgatgtggtacaagggatgtattagtcaacccgggtgtttttagtctctgtatcactgggccttgggatgtggttaaaagagaattctccctgatgttgccaacacagcagcagctaactgaagccacctttcttagaactgtggaaactctgagctgtctcttgatcatttttcattctaggaattctgtaatcaaatccttatccctctagagtcagaagacagaaggtatggaaacatgttaaggtggtacgcatgtctagttatcccttctggtaaaggctactgcccacactagaagttccggtcttcagctccgttatgcttcccagtgccccgtcagtttcttcacagtgttagagctattgtgactttgttcatcatccaaaatagaccttggagacatgtggttttgctaagcactgggaatacttaataaagcaaacattacatttgtccctaagggtctaagatagcctgatatggaacttatgcctgtgcttgatttagcttggaacattgaaaaaacagtaatttatttcatccacttacatgtcatctggccatgctctgaaagaacagcttccgaatgctcaacacctccatcactgggtccctcccaaaggcagggatttttgtgttcatgtatgcatatgtgtatttttgtggctatgtgtgtagatgaatgtgtgtggaggccaaaggtcaacttaggtattaatcctcaggtgccattcacatgagttggttttcttattatttgggttttttattattgttgtctagagatggagtttcttgctggtctgggactacatggttaggctaagctggttggtcaagaatctgcctacttctgctttcttagggctgatactaaaggtatgcactgctgtaatatatacatacatacacacacacacatatatatacattatatatacatatacaatatatatagattaaatgtatcagtgttttgcctgcatgtttatatgcacaccacatgcctgcctggtgccctcagaggtcaaaagagggcattggctcaccttggactggaactatagagagttttcaactcccatgtgggtggtgggaagcaaacctgggtcctctgccaaagcaggtgctcttaacctctgagctatctttccagctgcataatgatttatgtgagcaccagggatcagaacagaggtcctcatatttatgaggtaagcactttatctactgagccatctccccagccctgaacatctctctctctctctctctctctctctctctctctctctctctctctctctctctctcaaaaactttgagaattctagatatttttgtgtaatttcttatggaaaccattcctgtggtagcactgagtgccatgaggataggctgcaccctgacatgttcatgtcaactctgctttccttactgtccaatgatggccgggcattttacagatagaggttgaattctcttaagaaatagtgtgccaccagtggtcagtgagaaatagagctaggaggcaaatgaaattttaaagatgtatagtatagaacaaggcacctaatgatgttagaaaaaccaaaggcaagacctagcaagtcacagctttcagcaaacttctctctgcaacaggagaaggttgttgcaaagatcttgaaatccccttacaattccatcattatacatcaagaattctggggggaaaaagacctactctctcctctcctctatctctctctctctctctctctctctctctctctctctgtctcacaaacacacacacacacacacacacactcactcacaagtcttttttatcctggggtacttttggaaacaagaaaagttcccaaccaaagatatgcccactaccatgtggattgaaaggtcaccgggtatcagcagacccaagcctgagagctgggttccaggttatttccccactctccagagtgcaacgctctgcactgcagcatgactactaattctgtactgctcgagttgtgggtgtagggtaaaaacaccactgtgtttcggtgaagtcttctcccgtttgatggcttgctatggggatttcttccttcaaactgtgttcatgtctcgaaaaaggagtgggaatttatctctttcttctctttgttttgagccattccctctgggggagggagggaagggagagtctttattcaatgcattacttcaaaaagttatagatcccagacctgagatgcctctgtggttaagagtgcatactacttttgcagtttggttcctagtacccatgctgggagacttaccctgcctatttgaatccaatgacctcttctgtcctgcatgtatggatagacacatacataaataagaccttgctgtcctggaaatcaacctgtagattagaacagccaccacctcagagctccacctgtctctgtcttctgagtgctgggcatgcaccacttctgcccagtgatcccaggcctcttgatgacttgattacatcttctgtatgcctttattctgattctcagaagtgatatctctttatccatgcagccagccattcatgcattaggattatagaggtggataaaggtacagtccttgttctccaacatgaagactaaacatctgctgattgattctgattaggaagactgctaagggaaaacttgcatctgccaatgagtcaacattctgttccctttccaaccctctgccacattttcaaggacatcacccatttgcagggaaaactacaactaagtgatctctgaagatgttgggtgttttctactctaatgttgctcacatcttttttggctagttgattttatggtcattctagattttgcctttatcaacaagacaacgcaggtctcaccgggagctgtctgtggaatcatgtttcccaaccccagcttcagttacaacatgcatctggaatggctgagacttcttcagaccagtgaagtcagactctcaggggagaagaaccagacgtaccaatgacattatttttatgtccccccaaacaatgaagatgcagtgaggaatgagatccgtctaatattgtagagaagtaatataatggaataatcctacagccgggcatggtgtacatcgctgtgacccttgcttgcacttgggtgattggtgcaggaagattttgagtttgaggccagcacagagctccacagtgaaactattttaaaaagaacgaacaagaagagaaggaagaggggaagggagaaagggagggaagggaagaagagaaacgcaaatggtttttcatgctggttaatttcattgcttcatttttattctttgaaaatagaggagaacttctcaaactttacaagactcctggggattttgttataaagcattctgttcggagagggattcggtagcttgaaattctgttcaaacaggctccaacacgagatgtgtgttgtcagtgcatgggcccagttctgagcagcaggctatcatgtaacaacaacaacaacaaaaaaatgcacactatgtaaccacacagaggtttcaactaaaatgggagacaacttcagagaagattaaatattgatcaaaggttgcacagtctatataacacagcctataaatattataagtggtcagaataaagagagcagcctactgcctgggtaattaaagatgatgctttgagaagggcttttggagaacctagctctgaatgatgcttaagaataacagagcattagccgggcaatggtggtgtacacctttaatcccagtacttaggaggcagaggcaggctgatttctgagttcgaggccagcctggtttacagagtaagttccaggacagtcagggctacacagagaagccctgtctcaagacaacaaaacaacaacaacaaaacaaaacaaaacaaaacaacagaaaatgttagaagacagtattgtgtgatgattctgccaaagctgtacacatgggccattatccgtttgcagagatgtgtgtctgaacaaaatgattttcaagtgcacagtgtttctctgataaaaattaatactttccccacataaaaaaaaaagctgaacatggtggcacatgtttgtaatcgcattgctgggaaaacagagatgggtagatcgctggggcttactggtctaccagccaaatcagtgagctctaggttgttgggaaaccatatcccaaaagaaaagatagatggtatacacactacacacacacacatatagtagtagtagtagtagtagtagtagtaataataataataataataataataataataataataatgataatgataatgataataataataatgattttgctcaggcataagactttgcatgttccccatcctacttaaatcctccagtgcccataggcattagttatctctagtagatttctttgacatgatgaattactgagtagccttgccagtaccacatgacaccctggatatagtcaaagaattttttagttttcttctacctctacatctgtgtttttaactatgatgcagtcctgttaacctcataccacaaggtcagaatcccatggcttctaacacgacagcctccttttaccctgccagttcactaggcttcaaccagcaactctcaaggtagcaccagacatcctacatgcaggaggctgaggctcacatgactggactaccaacagtaaacggtttcacccaaaagaagcactgtttttaaatttttatttatttatttatttatttatttatttattggtttaaattttttcttttcttatatgtatgggtgtatggatatttgacctgcatgtatatatgtgtactctgggcatgcttggtgccaaggaggccagaataaggtattggatcccctgaaactggaattatggaaagttgtgagccactatgtgggtcctgggacttgaactcaggtcctctgcaagagcagcaagtgttcttaagttgtgaggcttctctccagttccagaagaaacatttcaaacagtgatgatgatagcgagagcttatgctcactgtctacatgccatctcttagtattgtgttaaatcagtgtctcttggttcagttttcaaaataaggtagttgtgttgggcattgtggtctatgcctttatgttcaacacttgggaaacaaaggcagcagctctctacacagtgccagtctcctctacacagagcagtgttctcaacctaacactgcagccctctaatgcagttcctcacactgtggtgactccccaaccataaaattatttttgttgctacctcatagctgtaattttgctacttttatgaattttaatttaaatatctttttttcccaattgtcttagcaacccacaggttgagaattgctgacacagagagttccaagccagttagggccacatagtgagctctggaaataaaacaacataaaaagcagttcttattatcttccctttgcagttgaccaatggagtctttggtcagttaaatcagtagctggtgtaacacaactaggaagtctctagaatctgagtttacagaatctctacccaccatcctgagccatgaccaccttacacagcagctccacagtctacctgaatggccacctgttgaatctcttgtctttacttttgtgcatgtgtgtgtgtgtgtatacatatgcatgtatatacacatgtgtgtggaggtcagagcttcattcacacgacatcttcttttatcccttgaccttatctttttgagacactctctcactgaacctggagctcaccaattcagctagaccacctgctcaaaagctgcagtggtcttgtcttccccagccctctgctggggctacaaacatacatcatggtgctgggatttctacctggagggtagggaatccaagcctgagtcctcttgctctcccagacagttacacctcagcatagcctcagcctctttttttccccctgaatgtatgtagctcagggtggcttagaaattcatgaagtgattaaggctaatctcaaactcctgatcactccaccttacttacacgtctggagttcactctggtaggacctcctcaggaccctgctagtcttagatcctgtattctctgaatccttctgttaccttcaaagagcagcctggggtgttttccttgcatctgatagcatttcaaagaagtcacagcagcagagtctgggctagcaaccggcaaaacagaggaaattctgagcacctttggccatgagtcaccacaccttctgagcacctttggccatgagtcaccacaccttgttcaggaattgccatctctgcccacagaatcgcccactgttttctgtgtgggaccaaaatagatacctccttcataaactttgtgtgtgtgtgtgtgtgtgtgtgtgttctctctctctctctctctctctctctctctctctctctctcttggtaataaaaaacaaaagacaaagatgggtatgtgcttccaagggcagactaagaagccacttacaggtgagtgtgacaggtgagaggaaccgtggcaaggaacaccctaccctggtggcagagcttctcgatatttgtatgtctgctgctttgcttctcagttcattcatgatctattgagcaacttcacgcaaggttagagaggcagagatgaataagacccaactcttggcctccaggagcttcttgcttatgcggagagaatacccaagctaagggctgagatttaagtaagagcacagagctggtggacacacactccactgcccactcctcctgcaagaccgacacaccataagctaggaactgcttcccattatatgtacatgcagaagagagaagggctcacgctgttttgtcagtgtgagtgactagaattagaatccagcactttccattttgagtttagaacaatctgcagaggttttgtgcttgtttggctcagcaatacctttcagggacatctcaggtaggacgtactgggagtccttcagtaacagactgtttccacaggctcaggagtctctgaggcaccatctataggccaactctcacatgtctgagtacatttgaagatctcccaggtcctcaacatctatgacctcttcaaggaagaaaggaaaagggggagggagggcaggagggaaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctaaggattgagcccagggttcaattcacactaaacaaaacactttacctctgagctgggtccccagttcttactatactgtataaagccgaaaagaaaagcagtgctttaaagatgtattaataaactataagaataatacataataaattgatatgtaaaaaaccacaatgtatatatgtaaatgagagcagccctaaaaccaaacaggcctgtgtccccagggaaaaggtcactttatcatgttgtggggaacggcaaaagaaatgtttctaaaagtttcttttgaagtccccgacatctatgctgacgtcagcctcttcctgcccagcgctctgaaagtttccagggagttttggggccagtgacttgacacagggttgtatgtttgacacttgctgactgtgggcaggttgtggtggctttccctgcctgccaagccccactcagctgagcatcagcatggtatgtgcttcctgtccccgtgctagtgacacctctctgttcagaccttgatttagaacaaaaaagaacctttgtgaagagaaaactccttatttaaaggaaagtaaaccgaacttttgagagtctttttagaataaaagggcgagtcctcaggagtcccgctggtacccctgaggggaggtgagccttgagggctcgctgctaggtttccctgtctggtcccagacatcactttccctttctaactgtctcctcagaggccgcttctggaggtaatttttagctgccaatgctgaggaactattggccagagcatgccaccctgcttcttagagaatacaactgccaccattgaaaacctaggctgtctaaccagtgagctcagggcgtccgcctgtctccacctcccttttcctcctgtgctgggatttgcatgtgcacagccatatagagtttatagagtgctggggatgtgaactcaggttctcatgcttctgtggcaaacccacgaaaccatctcccatccttagttttatatatttcactatacattcatattataatatacattatatattatataatatatattatataaaacatatgtaatatatattataatatataataccatggtattggcagtgcttagaataggtgccccagattttcgtaactttttctttgttttctgtttctcttctaatcttttttttttaagttggttattttatttttttacatttcaaatgttattccccttcctggtttcctctccgcagcccccacaatcccatccccctcctccctgcttctaggagggtggctaccccacccacccacccactcccacctcactgccctggtattccccttcactgggcatcaagcctttactggaccaaaggcctcccctcccattgatgccagataaggccatcctctgctacatatgcagctggagtcatgggtccctccatgtatgctctttggttgatggtttagtccctaagaactttgggaggtctggttggttgatcttgttgtttttcctatggagttgcaaaccccttcagctcctacagtccttgccctaacttttcccctggggcccctgggctcagtccaatggttggctgcaacttaaacagctgtcccacaccatggttacttctccagtctttaattgcatttgtttaacaatttattttaacaatttattttcttatgtaatatatgtgtgtgtgtgtatacatctatatatatatgagagaagagggcatcagaaaacagagggtatctgatccctttacaggttgtgagccaccatgtggtcgatgggaattgatttcaggacctctctggaagagcagccagggctcttaacagttgggccgtctctccagcttgtatttgtttgtttacttatgtattcatttacttatagacagggtccagctatgtatcctgaactgacttgcagtgtagctaggctggcctcaaactcatggtaatcacctctgtcagccttctgagttctgggactacacatgcaggggaaatcccacagatatccatttgaaacaagccctcacgattacaacttgcttctcagaaggctctgtcttttttcagaagactgtgggcgggatttaccaatttagcagtgctccgctaaaaatatggccccctcccaagaaatccgtttctaagatttgaggggaaaactgtctttagttttcagagaaagaggaggaatatttcttcccagacttttctctctctctctttcttttttaatctgataacactttaatttaaatcaagttgacattctgtggtaagtttgtggttaactctttcaagtgctgaagcttgttttctgaggtgactggagagttagaaaaagacaggcagcccaaccactgtactctgtaagcattacaggctcctggatgtgacaatctagaggccgctctgtgagacagagggcagttctcagctccttgcctgggtttctctttctaagagcaaattcctagtttctgtagacctactgtttgttgtttgtgtaactactgccaagaaggcacagggttttctccaaaatggtcttactagtgagtcacacattcctgccttatggaaacccaggctttgacgaagcctgagagaactgggcctcagaaacgtgtgtcagatgacaacaggactcacagacacaaaaggctaaccaccgttctgcaaatattgttatttcagtgtttcccctttaattttaagaaacttttctttaataatgacacacacacacacacacacacacacacacacacacatttttgacagggtctcactgtgaagccctggttgtcatggaactatcctggaactcattatagagaccaggctgggctagaactcagagatccacctgcctctgcctcccgagtgctgtgattaatggaatgtgccaccatgtctggctttcatgagtattctttcaatcatctttggattcatttcctgctattggcatggccatataattttccacctttaaacagagtcatatcaagagattttccactagtgaaccatccatcactgctgagataaattctaattgatcagaatattagtttttgtcatacctggctagaaccaagtacaaatattgtaatcgatattctgttgtctgtttttataagtgagatggtcttacggccattttctctgcagttcatcccaagtttaataggaagactaacataactctgtaaaaggaattagaatcattgaagtgtctgtgctggtctgaatgagaatagctgccataggctcatagatttgaatatttagtccccagtgagtggaatttccagtttgggaaggattaagaggggtgacctttattcagggttttgaaagactcatgtgatattccagggttgttttctctctctctctctctctctctctctctctctctctctctctctctctctctctctctctctttctctctctctctcatggctgtggacagagatctgagctgtaagctgttcctttactctaccatcatggattcaaactccctgaaaccatatgccaaattaaatgttttctttgtaagtcctggtaccctatctcagcaatggaaaagttaactaagatgccctctgaaacagtttgtattaagcatctgctacctatttcatatatttgttcacaagttgattttttcaaatgattggtttattaggtataattctcctctttcttcagcttctttctctctttctaagacaaaatgtcgccatgtacctcaggctgggcttgaactcacaatcctgctcatttttgagtttttggtggatcagtagttacacctcccttttcttcaaactgatgctctgttgttcttgctccttctagtcctgactattttcagaatctacttaaatgaatagtttttaatttggaggacattctctgctggttttttttttttcatcttggtcaatctttcatttacagttttgatctcctttctttaacattattccatggttttttaacttcctccagtaaatattaaatgggataatgcctgttctttgaacacgtattttcctttgaggttgtagacatccctggagaggctgtgctggctcagtactgcagggtttgtggttatcatttttgttgctattcggtgcagaatattttacagaatgagttctgagtttccctttgatccatggatttgtttggaagtttgaggtttcttttttaaaatgtgtgaagttttattgttgtttgtggtttcgctctctgtttttaacttttaatttcattgcgccatgattagaaaatgaatctgtgtgatgcttattctttgacacttgtggaaaccacctctggtgcctagtaggagctcagttctctttaccactgtcccatgcgtgataaagagagtgtacattgcctatgtattggtcacacaactacataaatatgcacaaatcaagcttactgacaactaacagaccttcttatagagtaaccttttcttattagtggtccttgcaacatcagtttgttttgtagtgagttctgggcttaattctagttgggttactttttgtggtttcccttggcttcctgagctgtatttggtagcatctgattggctgacctgcttttactataggattcccatgagtgtggtctctttgatagttcaggagttgtgttctagacactgcagtatgtgaaatgtattatctttggttattgccgtagagtctgtgttatgtaacttggaagagtgtagggtgatttacagcagtgcctcccttgtgtggagacagcacagtgtgttacctctttctgttgttacatccagtgttgagtcttcagccttgatcctaaccccactcactcccctgcatcttgggtcttttgtctccttcattattcatgttgagattttgtctaagtttgaggaggactaagtaatgaatggaatatggtataagttctctcatctgggatggaagtatatcttacctcctaccttgtgtgttcacagtgttgggcttgatctccagaatcaacaggaatgtcaatggttcagaagcaaatatgttctacaacatttatttgcgtttatacaataaaaccctactcaagtaacatctacaacaccaatgaccgtaagaaagtgaggagctaaaatcaaacacacagaagagatatataataatgaaagttacttatgcttataatatttctaattatacttataataattataagtatacttatacttaattatacttatgttaattctactttcattatttaattatttaattatttaattatttaactctactctctctataaaggcccgagttagattattaataaatacaactagataaaggagtgagaaaagactaatgatgggacacaaggcaaacttaacaggcaaagttaagcaagctgaagcttccctcttgcgtaggtgatgaagatgcctctttccccagcttctgttttcagagttcactgtgcttgtgtgtgtgtgtgtgtgtgtgtgtgtgtgtgtgtgtgtatgtgttatggcatgtgtttatgtttgtacatgtagtgtgtatttatgtggtgtgtgtgtgtgtgtgcgtgcatgtgtgtgtgatatatgtggtatgtgtggtgtatgtggtgtatgtgatgtgtgtggtgtgtgtgtgtgtgtctgtgtgttgggggtgggccttgtcttctagtcaaacaggtcaaaccaaacaggacagcacctgtttggtgctgtttggtgccgacagagactcggttccagatgccttgacaaagtcactgcaaggctatattcacacccctgagctaccctagcaaatcccaggactctgtgaggtaggagtcacaaggatgctattcttggtatgttttgtgatgcagcaggaggggttgctttagcaggcccatggtgaggcatcccccacctctggtatcagccgtaggacagctctagtataaaatggagtttatttgggacatgggagtagaggcagaggaaggaaggggacagagaagaacagaaagagagaagagaggaggagagagaaaaagggaagaggccttccaggaacatgctgagggagtgggagagagagagagagagggagagagagagagagagaacagggagagagaggaggagaaaggaggaagagggagggagaagggggaggaggaggaggaacaggaaggagagagaggccaaacaatcctttttatagcaagtcaggctagtacctggctgttgctaggtaactgtcgggcagagcctagaagaaaggctaacaattctcactggccattcttgtccctgtgcctgcaggagtgaaaaatgcccatgtcgttggctaatcctccaactgtctcagaacctcagagcaggagaccatgaccaagccaaagcatttagtgctgaggtgcaagtgaggggtcatcactgactgactcattgcctcctccaaatccccgacagctgcccttcccctgcttattaataagcggcatgtagctaggcataatgctggagaaggagctgagaggttgacgtcttgatctgcaggcagcagaaagagatgtgtgtcacactggtcatagtttgggcatatgtgacctcaaagccaaccttcaaaataacacacttcctccagcaaggccacacctcctaatagttccactccctatgggtctttggggggccaattacattcaaactaccatagtgccttggtcagggtttgtattcccacacaaaatatcatgaccaagaggcaaattggggaagaaagagtttattcagcttgcacttccatactgttcttcatctccaaggaaagtcaggactggaactcaagcaggtcagaaagcaggagctgatgcagaggccatggagggatgttacttactggcttgcttcccctggcttgctcagcctgctctcttatagaaccaagactaccagcccagagatggcaccacccacaatgggcccacccacccttgatcactaattgagaaaatgctttacagctggatctcatggaggcatttcctcaagggaggctcctttctctgtgataactccagtttgtgtcaagttggcacaaaaaaccagccactacacacagctacccttaatatccagatagtttctcactagtgtgactcctgtgtgcttgcctcctgtgtgacaattaaaaaggaccatcacgctaacctactatatgcaagggagtgcagtaaagaaacagctaacatgatttctcccatggtgtggttaaagtttttactgtagagatgagaaaaagcagagaggaaaagaagcagactgatcatggccaggacaagggaagcaggagagaatagtagtgctcgggagggaccaagagatagacgacagagcctagtaagagagggtaagtgaatagagagaaagagcaggaatagtggagaatagtgggttataaggaggctgcataggcagggagagggaacagcctggggactgtcacggtggctttgaaacatataacattgttgaaataattaagtaataagttaatcccagcaccggttacttcccacctcaatggtttatgttcccgaacaaaagatatacacacagtctttatattttaatatgccttaaacagcacaatagctgggtcactgccaaacctccatgaggttaatcctgaattattacttactaattctgtgttctatcttggctgctctagaccaagttgggcagccccctaggccatgctctcagtttcttcacaagatggctatgcctctctgttctccattcttcccccatctctcctctcctccacactccccctacgtggtggatcatctctttctccctcctcagggtcccaagcctggtaatctttaaatcctgcttctgtctgtcctcttcagccattggtcattggcatcttaatttaccaatcagaatcaactatatgtaactttatatatcagtaaacaacaaaacaaaacaaagcaagattgggaagtaatctaagcagccattaagacttgtggaggatttgtagataataaagcaacaagagattatttcaagggggggtgctcatcttcccgccctttccagcaagagaccctccttgtagtctactgaacacagcaatgcatttgtgatgattaatctccttgttgacttgaggagggttagagtcaccatgaaagcaaatctcaggcatatctgtgagggacttttcagattaggttagtaagtatgaagactgaccctaaagtgtgtggtgtcatttccagtagctgtagtcctagttggcattaaaaggagaaagctagcatccatgaaaggatggatctctagcatccatctctctctgattcctgattatggatgcggcatggtcagtggcttcaaactcctgctgctgggacttccccccatgatggactgcacctgagccaagataaattctttctttctttctttctttctttctttctttctttctttctttctttctttctttctttcttcttttctttctttctttctttctttctttctttctttctttctttctttctttctttctttcttccttccttccttccttccttccttccttccttcgcttttgttgggtattctgttacagcaaagaagaagttggtaggctgtgtttcacaacgcctatgctaggatggcttgttttgtttgatctgaacacccgtcaagccagggtaaacttgaacctggctatgaggcaggggccaggattctccccaatgggcaccaatgtcaaaagcccagaagcacaaatccatatggcgaaaggcaatgtcttagagagtttgggatgctgttctcatcatatcgctgattgacggttcaaggaagctgccacatgctgtttgattggcatttggatgcttaacataaagcaataacaaagtcaaccttacttgccaagaacttagcatatgttagacaaaaacttcctgggtcaaaagagagcaaagagagggttcctatccggtggttaatcacaaagcagaagggcacattgggtttcacttccggttggtttgttcagatggtattatggaggcagttgatagggtagagagaagtggtacagagagaaatggtgagatgctgttgccacagaggtggacagttgctgagttgtatgggagtcttgaacgttagtggagagggagtatgaatgccagagtattgtggctcttgggaactgagcggacatcaagaatcagaaacatgtggaattggctcagatggtgacagtcactaagagaagcaggtcagaaagggaacagggtggtttgtatgcttatttctagctttttgtttcaagagcattggagattcacactctgtcctcattctctttgttctgtattacacagtgagttttctatttaaaataatttcacgaaggtaaaagggaatttttaaaaaaaggataaacataaaggcagccattagactcctggctttcagttccccccactatgaaaatgcggtttgggtagcctgacctcttgggacctcagtctctaactgtatgaagccagttgagaatatcttccctttgtggctgcacagagcattggaggtaatatacacaaagtggagttcagaaattaggtctgttattacatatcttaaaaatccaagcagagggacctgggtgctctaacttcacagataatgatctgaactgaaccacaacatcaataaacactgcctggtacccagatggcttagacagatgagacatctccctgaaagtgacagctgtcagatggggagtgggggcaacctgtctcctggaggttacatctctctgacatggaaggaagatttctgaacttggagaactcagggttttccacaattcacagaaagggcgcagaaagatcagtttcttttttatgagtctatcactctcagagcatttgatcatgttaaacaatattcatcatgttctactgaatcgtctttcacatacccaaacacacacacacacacacacacacacacacacacacacacacactttctgtaaggcccaaccattgatttggtctggagacaaccctgaccttggctttcttatctgatctgatgaggaagaggatggctctcaggcaaaagccagactgttcatcaggtgactcacactcttttttcttttttcttttttcttttttttttcgagacagggtttctctgtgtagccctggctgtcctggaactcactttgtagaccaggctggcctcgaactcagaaatccgactgcctctgcctcccgagtgctgggattaaaggcgtgggccaccacgcccggcgactcacactcttgttacactcatgagtcccttatatagttcagtcaatacctgtcccgcagacaccatgcttggtgagtgttttctaacctcccttctcactcccagtatatggaaaagcaggaggcagcagggagaagaagcccttactcagcgttggctgagctacagacaaaacatttccttaacgactcctttctcaaactctgtccactttcttagggagccctcctttggagtcatttacctagggcacaggagtccctatcgttctcatcttaaatatcatagataaaccaacgctactgtctcccagcctacctttcctcgggctaccgactagatcccgagtaaaaatacaaagcactctgaaggcacgttccaaagcacgaagggtctgctcagtgtgcgctggaagacaagagtagctgggcagggagtacagacagaaagtagggtgcagcagccagaagttccccctcaaccttaactatctgctgtgtgacagtcgacagaaagcatcagcaccgctagagggctcacttctccagcccagtctgtctcttcaggaggtttgaatgcctgccactgggagctctctggtcgtcctccatttagggggcgctgtcttattgataaaagaaccacttgcctcccgagaacgcttcaactgtcaatattgctgtttaattcaaggggcacagaagaattcaaggcacaattaattctagtttcattttgtttctaaaaataaaactgttaaaaaaaatcaaggggaagcttttctatctgaggagtggaggcgaagccataaaaccatgtaaggaggatggcagttagggtaagaagtacggagccatgtctgtgctccttgatcttgttactacatatagaggtctcttcctgggagcagaagggtttggcgagaaaagcacaaatgacctcatcccacagcaaggctctacccctaaaggttctgcgatcatcccaaacagcgccccatgctggggaccaagtgttcaaacataggtgcctatggactgacatccacattcaaaccacaacaagcacctttccctacctgccctgtgctgcagcccacagggaggaggctttgtaattcccagagtattcgctgaaggagtcacaagttcccagaacgtcttgtattccatttttcctggagacactagatccccagataattgctgcattatggtcttatttcagggagagtgactggggagagatttggcaagcatgggactacccctcatacaagatgggcaacatactccatcctggaagagtttggcgttaactttcccagtgtaggtctctggtctgaacccttgtattgggttgattaacaactgctggccgcttctttggccctgtgcctacatgaaaggcaaaaccacatccaagtacctcggagtctgagataggagtctcccaggagccccatatcccaagaattaaggtggaaaaaggctgggaggtgaatttgggagaagtggtttgggagtattcaggaggtaaaagtagagagggaagacgccagtcacctgaagtcattttagacaataaattaggattccttttttaagttgtgtacatggaattctccttcatgacctcccagagaagcttgtaaacaaattatttttactcatttttggctgttgcgctgatgtttcttttatgacaccagagcaacaagagctaagaatatccccaatttactcttaagggattaaaaagaataaaatctctagggctgcctttcccatgggctcttctgccttggagtctttgaataagttttggaacacatttggcaaggcctttcagggagagagaatcataagcaattctgagaaaggttcttttagaaatggaaaatctgtgagagtacaaaattctacaactgtctccgtgaccccacatgacctccttggacactggactagttccggatgactgtggaaatttccatggcaaagccttgtctagaaaaacatcaccgaactctgaggaatgcttaggggtgcaatgtcatcccaaagaaaacttatctgacctttcttaaagttatgcatgtgaaaggtttcttagcttgtggtttggtaccagattccaaatatgatcaagatgaatccctgactatttgcactgacgagtagttactcaagaattgctaaattaattggttttgtttcagtgaaattagctatagaggagttattcttaaaaggttttatttattattttaatgtatttaatgtgcgtatctgtgcctgtgtgagtgcatgcacacttgtgtgcatagaagcacatgcctgagtgttattaatgtccataagatattccggtgtgccattctgcctattcctttgaggcagagtctctccctgaacctgaggctcagactctctcagctagtctggaagctagactattcgagctgtcttcctgttcctgtctgcacttcccctccgggctagtgttccaggcttttgcaggaagcccccatcttctgcaggggccctggaatccaaaatctggtccttgtgattgtggggccaagagcaacagcggatctgtctttccagaccccaaacatgcaggctttattttactaatcactattgtgggggtggtcattggggtgtgtgtgtgtgtgatgtaagaaagaccttatagggaagctatatgaataggtctgatgcaacttgatgagttttgacaactgtgcgcaagaatatgaagaacactcggttgtttttttttttttgctgtctccttcgagttgacgctgcctactacaagaaaccactggcctaatttctctctgtttaagttctctaccccctctccctctctctccctctctccctctgcccccccatttacatctaagtgaatcatgtaagtgaagtcatgtaagtaagtatgactagcttctttagtttgtttttttttggagatttctctatgttgtgtggcaggaattcgttcttttgaatgctttggtgcatttttgaatttatactctattctcacaatgataggtacatatgttactgggttggttttgttgctttagagataaggtctggagtagcccaggctggtatcaaactcataactctcctgctccagcttccggagatctgggattataagtatttcccaccatgtcccaacttgggttcgttattaattagaagtctgtgtcaaattctctcttggtgcacattatttcactactctgagacaaatacttcagggtggaattgctagacaggtgtatatttaacagtatctgaaatatattctttaaattattttagatttatgatgtgctcatgagtattttgcccacataaatatatatgcaccatactcatgccgggtatttgcagaggacagaagacagcatcaggtccccctggaaatggagttacagagagtcttgaaccacagtgtgagttctagaaaccaaatcttcatcctctacaagaatgccagctcttaattcctgagccatctctcctgttccattttaaataccttaaaccattggttcaaaaccttcctgatgctgcgaccctttaatacagtttctcatactacggtgagcccccacccataaaattagttcgttgctacttcataaccataattttgctactgttatgaatcggtatgtaactatttttggagctagaggtttgccaaatgggtcacaacccacaggttgagaactgctaccataaacagtttgcccaagtaattttatcttgtgctctcaacactatataaaataattccagcagctcagattccccttcacatttggtgcagatttctgtctattttttttttttttctatttcacccatcctaacgggcaaattcatggtggttttcaatttgtgggtttttttttcccttgaaaaagttatttattatttgtgtgaagtgcataagcacacacgtgtggaggtcagggagcaactttcaggagtgggttttctccttcatccatgggttctgttcagttaacttgggccatcgggtgtgggggtcaagcacacctagcttgcctctctctctctccccatctccctctctccctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacattttttcaggtgcttctcagcccttcggtattcctcagttgagaattctttgtttagctctgcaccccatttttaatggggttacttgaatttctggagtccagctttttgagctctttgtatatattggatattagtcccctatcagatttagggttggtaaaaatcctttcccaatctgttggtgtcctttttgtcttaatgacagtatcttttgccttactgaagctttgcaattttatgaggtcccatttgttgattcttaatctaacagtacaagccattgctgttctgtttaggaatttttcccctgtgcccatatctttgaggcttttccccactttctcctctataagtttcagtgtctctggttttatgtggagttttttgatccacttagacttgagctttgtacaaggagataagaatgaaccaatttgcatgattctacatgataactgccagttgtgaaaatgctgtctttttttccactggatggttttagctcccttgtcaaagatcaagtgaccataggtgtgtgggttcatttctgagtcttcaattctattccgttgatctacctgtctgttgctgtaccagtaccttgcagtttttatcacaattgctctgtagtacagtttgaagtcgggcatgatgattccaccagaggttcttttattgttgagaatagtttttggtatcctaggtttttgttgttgttgttgttattccagatgaatttgcaaattgccctttctaactcagtgaagaattgagttggaattttgatgtggattgcattgaatctgtagattgcttttggcaggatagccattttgactatattaatcctgccaatccatgagcatgggagatctttccatcttctgagatcttcttcaatttctttctgcagagacttgaagttcttatcatacagatctttcacttccttagttagggtcacaccaagatattttatattatttgtgaagggtgttgtctccctaatttctttctcatcctgtttatcctttgtgtagagaaaggccatttgttttagttaattttatatgcagctactgcactgaagctgtttatcaggtttaggaattctctggtggaatttttggggttcacttatatatactatcatatcatctgcaaatagtgatattttgacttcttcctttccaatttgtatccccttgatctccttttgttgtcgaattgctctggctaggacttcaagtacaatgttgaataggtagggagaaacgtgtattttcttaacagcttggtgagtgccacttcagtgagtgtgtgtcttcaataatcacaatattttctttggaaacatgactattcgagtgtttgttcatctatcgattcagttgccctttagtgttgctatgtaggtttttgtgtattctggaaacaaatattgtcatatatacattataaatggttttctcacagcctgccacatctcctccattttctcatggtctttggattagctgatacttttgtaatttttttttcttttataaaatctttaacctggagcagggcatgggagggtggactcagaccctctgatgctggggttacaggtgcttgtgagctgcttggttcaggtggctgggaagcgaacattggtcctctgcaaaggtagcaagcattctcagcaactgagccatctctccagcccccttttccttttatattcagtgcatgctctgtcctaagaaatcttcacctatccacaacttctaaagctgtctgcctttatttccttttagaagttttacagttttaattctatgattgcatgtgatacacacacacacacacacacacacacacacacacacacacacacgttcttattatggaagagaaataagttttctctgtggaaggaagctcttttcccttttcacatttatccacacgactcaagagtatttgttgagaacgttgtcctcttttcatgaattgctttggtaaatgggggggggggcagtaattaaatgttcctgagtttctagaatgtatattctgtcgctgtacttgtttttctcccagttgcttgctgtcttgatggctagctttatagtaacagatgttatgagtctcctatcatacactttatcttacagttatcttagatacttccaaggaagtttgaaaacaattttccaattttactaatatgtacatcaaaccagtgaattgaaggtaaactgacatgtcttttaaaaatcagccctccaatttataaacagtgtatgtttctctgtttatttcacttaaaaattttttctcagcagaaattcttttgcaattttcaagtctgttcttgtaggtgtgggtgaatttattcttgagtattttatgattctgatgtgtaattacaattaactttagatcttaattaattcattcagtttaaatatataacaagtgatttgagatagccacacctacctacttacatacgccattatgtagaattctcggtactttcatggaaagaggcatttttagctgtgttaagtgccctttcccacaaaactactttctgatagtaacatagcccatatcagctttcctatgcttatctctgcatatctttttctattctttcactcaattcattttggtttttatattttagcattttctttgtgagatagtatgcagttgttgtggtctgaaagtttctattttagaaaaaattgttcatttatgtttactataatcactagtagtgggttgacgttgatgtctgccttcttgctctttcttcgtgcttcttcatttcacctaaacagatctgtttaatacatattggaatgttctgtttaatttattctgttatcttttaatgtgtgctcctggtagtatttcattattgggtgccttccctggaatatttactatgcattcttaattttctatgttctatttagttagcattgtaccatttcagacatgctagaaaaatttaaaaagctaaaggcccatcaacctcagctttcttgcccaagttgtcacgttttacatttaagtaggtactaagatctgtcctgtagggaccagcacggtggctcagtggctaagaatgcatgcacactgctcttccagaagatctgagtttagttccaggcactcacactgtacagctcacaatcacctgtttctgacgccctcttctggtctctaggagaactgcactcaccccctcccctaacacacacagttaaatcaaaaataaataaaagacctaccatacagtgctattttttttttattttagacatctctttcaagaaaaaactggaattttctcatgaatatatacttactaatgcccttcattattcccagtagatttctatttttgactaatataatttccctgggtcttgacattttgtccttagctttcttttcacttttaatatgcactataagtgtgctagtggggttttgtgaactttcttttacctgaaaatgtgctaaccccatcctcatttttgaagggtgtcacgtctaatcaggattgagctgaaagcctgtctgtgtgtctgtttcgaggctggctctgtttccctgttattttctggctccctttgctctgtggtgaagtcagttgtcatccatcactgttcccactaatgtgtgtggcctttccctctggctcctttaagacattctctttagatttttggcagcttggcattagatgcataacaatttgcttttaaaagtctactctggtgtcatgaacatcttggatctgtaagttaacatctgtcttcaagagtcagaaatgagctggcaagatgggtaagtgtgtacaggtgtttcctattggtggccctcccacatttcatccttcccaaacagttccaccaagcaggaccaagcattcaaatatataagtctatgagggacattttctttcgaaccactaaacagagggatagaaaagggggcggggactggatgtgtgggttggggtgatagatagaacatacttctttgccttctacttcctgtcccagctacatctccagctgactcttgggtgcctgcccacactgagggcggggtcttttccctattattttgctgacctgtagtcagtcttctcaggcaatgtgcttacagatacacccagaagtatgtttcaaattctctaggcatccattagagccttcagtcgacacctcaaactagccgtcatgatactcaccagtctaatgtataagcaggtgcagtgttggcctcggtgttggcctcagcatgccgttccagatggagcaggtgggcaggatggcagcttgattacaaccaccttcacacactcagccatcatgccatgacagccccctgctttcctgccactcccactccttaccatcactcactcccccctccaccccccacctgctgtggtagtctcctagtcacctgatgtcttcaagcacaagagcttgttgcaatggaatggttttcacttacatcagggtccctcttcccttcaagagtcgggcatagagagctggctgtggcagtgtgcacctgtaatcgaaagacttgggactgaaagcaggatggtaggagttcatcctcagctacataacgaacttgagcccaattgggcctacaggagaacactccctctcaaaatgattacatgggaacctctatttctggtgatcatgctaggacacctgacctgtctcagaagctttggcccacccaacctctctcctgtgtatgctagacacaaagtaccttcagagtgaaattctacttatttgtacttattccttctacagtttgcattttatactgtagaggaacttgagtgaacactcctatagcatctctgacacaaatatttatctcttcagttttatacaatgggtttcattgtgacttttccatagatgcatataatgtattttgatcatattcacacacacacacacatacacacacatacacacatatcatcctctgtgctcccactgatcccgaggaggtagagtacgtaccaatcctttaaattgagagaagaagcatgtgagcaagctactgcacaatcaaactcatgtctcaccaacattctccttgcctttgcagaactgtgtctgtatgacccacccgaggtccccaatgccacattcaaagccctctcctacaagaacggcaccatcctaaactgtgaatgcaagagaggtttccgaagactaaaggaattggtctatatgcgttgcttaggaaactcctggagcagcaactgccagtgcaccagcaactgtaagtgtgacccttttgtaacctggatgggaaaggatctagagataaaaggtgacagactccagctcccattaatttgggtcaacagataaaaaatgtggataaatctatgaataacagattttaaaggcttctgtaatatccactcacctaacgttatttaatgacgtctacttggtctaagagctaggcttactaagttcttgactaagcctgagtcaatctgatagatgcacgactttgctgttggcttcccctcttcattgagttcagactgctccttcacacagcctgtatccagactcagtttcttctctattttggggtgtgcatgtattttttcattgcatatatctattatatatagcactgtgttacataagaatattatcatgcaggtataaactgtagaatgagcactttctgccctgacctgaaacagccactctcttctatattccccctcccctctgttactaacttttagattccttagacagttttctttatacttttgggttatatagacatacttatgtttagttacatagagaaagtctaggaactgcaaatgaaagaaaacatatttctctttctgaagctggcttaatttgcttaatattgttatctctaggtgcattcattttcttctttatggctgaagaaaattccatcctagctgctgagctgagggtaatggcacatgtctttaaactcagcactcagcagccagaggcaggtggatctctgtgagtttgaagccagtctggtctatatagtcagctctaggcaaatcaggaccaaataatgggatcctgactcatgtgtgtgtgtgtgtgtgtgtgtgtgtgtttatgtatacatatattaaagaaaaatccatatattccacatttgctttaatcattcctctactgttagacacctaggtgggtcccataactgatctgttgttccagtctcctttatttttgaccatgaggatggaatgggtcagtgagccaacctatgggtggagggcagagtttaaagatgactgctctattgaagggcttggcttcctcattttccaaccatgtcccttcatccaaagctggatttctattgtcctctcactgaggtgcttgcctgtaacctctctgccagtttttcacaagggccagagttttctgatcattgccttaagagcacatttctccaacttgaactgctttgaaccaggagaggggagtggaggagttaaataaacgttgtggagttagattactcctacctgtcatgtgccacactggtggcactagtgacaaggaacaaagccacttatgtttgatccacatgcacacaaggattttctaggagagaatcttgcatttttttctaggaatgtgttgtatccaatgccaatatgtatatgagtatggagaggtcagtgctagtctaggtgtgctggccctatccaagatgccctactgagccctgcctggctggggtgcctgggcacagatgacgtgctgctcaggggaggcagaaggaaaggcagaatgatggtacacagctcatcttttctctgaagggcaaacggcagagtctgggatagatgccatgtttcccagtcacctgtgtatacctgggtgccacaggtggatcactgtgagtcaggaatgtgggtcccccagtccacacttcccccttagggtgcccatatgccaggcaggaaggggaaggcagagcccaagtgaaacccggtttgattcagagtgagtgctgggacaatggagtggctggaagagagaaggccttctttagagattcaggtgtggctctttaagaccagggagatgatctttgtctcttcatactggtttatttgatggtgggtgtgactacatacactttagtcagggtgaaccagggattaaatcccttttgccggaaggaaggaatacccaggaagagcagctcattggctgatggctaagggatacctcattagcaaggagaagaattccaggtgcgtatgctatgtgactcagtggccatggttctcagtggagtgtcatggttacatattccagagcaggtagaggcaagcagggaatggcttcactcctgccattctcaattctgagattcccgggatttaagctcattcaagcttgccatttctcatgcctgtctggtaacaaggtccctcatgccctacacaggagcggtcttttgcttatctttgcacacccagcacagatatgtctctgggcaccagagaggtgtcccagggtaaatgaccgcatagacagctctttctattctgaacatttgggaacttacttgcctcatttctcccatattctccagcccatgacaaatcgagaaagcaagttacagctcaacttgaacaccagaaagagcaacaaaccacaacagacatgcagaagccaacacagtctatgcaccaagagaaccttacaggtaagacgtgcatctcagcaaccatcctctagccggctcctgggaactgagagagattagtcctgttctcaacaggcaggtgcaacccattctcctcctcctctcagatttccatgcagatgacagcattgctgattgttggcaggctcgctgcttgggagcataagaattcaactcctatagactcaattcaactcaaaaccatgtgctgggaatatctgccatctaagcaccacccacagaggaaacacatcgaatagacaagggcctctgcccttacaaattgctcctattttctcttaagcacatgccaatggacttcaagcaaaaccattgataaaaatttgccttttacagcacagagttctaaaatggtaaccccacacacttattcactacttaatgtggtgtggatgtgtgggctctgtgtctacatacagtttcccagatggaatgataatacttaaattaagccataatgtcaagaagaaagaggcttactagtgttagagccggggtttcagagatcagtgagccttaagaagaccctaatagtcttatgataaagttataaccttacaaagaacattattacatcatgtatagtccatctgaacccacagctgagtgaaccagcgaataggaagatgttccttgattaccaaagaaactaagacacagagccttgaaacggcccagctacagtcacatcacagagggaaagcaaaacctctagtccccctttcttctgagaccttatttttagctacttaagaactagtcacagcatccagtattggggtggggggataaagtccaatctagaagcattattgcaatgtgatgctttcatttccctttctttcccagctctgtcctggaatagtgtttttcaaatacatttaatgttttctctgctctcctggtatctggtgccaacctcgacagttactgaaaggtctctgttggtggggtgtcaatatttgttcttactcaaaagacaatcagatgaacttggcatggttgtacatgtctgtaatcaagcatctgggagcagaggcaggaagatgagaagttcaaagctgtcctgaattgtatgataacctcttcagccccaaataatgagggacggagagagaggggaaaaggaagggagggnnnnnnnnnnnnnnnnnnnnnnnnnnnnnnnnnnnnnnnnnnnnnnnnnnnnnnnccctttttggccctggtattcccctgtactggggcatataaagtttgcaagtccaatgggcctctctttccagtgatggccgactaggccatcttttgatatatatgcagctagagtcaagagctccggggtactggttagctcataatgttgttccacctatagggttgcagatccctttagctccttggctactttctctagctcctccattgggagccctatgatccatccattagctgactgtgagcatccacttctgtgtttgctgggccccggcatagtctcacaagagacagctacatctgcgtcctttcaataaaatcttgctagtgtatgcaatggtgtcagcgtttggatgctgattatggggtggatccctggctatggcagtctctacatggtccatcctttcatctcagctccaaactccgtctctgtaagggatgttttataatttgtaatagtttggggtttacagaaaagaaaaattaagttcaaacaggttccatcaactataatgtttcctggtcttaaaataatttgttctgagactaaaactcagtcccagtgttgttacacaaagtgcaatgtaacagaaaatggctcaggtcagggccacccagcttcctgtgggggcagagagcttgaatgtggttcttttggggattgttttgggtagtcaggtgttttgaaaatctggaaggttctaaacctacgagtaatttatgattcagagtccgacagcatatatagttctgtctgattaaatggaaggccattgatagggaattccaagattaattcagaataggccacgatctctgcggccaaagttcagccaagcctgggttccttccagtgagtgagaagttgctgggtgtcggggatctttagaagggttgacatggtcgatgtgggtcgtgcttcagctgtggtttaatcaaagatctatttctctgagattctctcagtgactcccctcctccagacattagctttgtccttggtcagctcccccaagtcctaggctgaatgctaacaatttgtttgttcctcctcacgtgttcagcagctgtactgagaggtccgtccatctgctccacccagctgctgtgtctcagcagagtctcagggtctttgcagcatgggtcaaatgaaaagcacattccacctgggctcccggcaagcatcccctccgcacctgccgctcccactgccggtccaccttcctctgtctttctcacctcatcacctatccgacccttgtgggagtgaccaccatgtgacttttcctggggagacctgaacaaacatctggtcactagatagagcaatgactgcaaactaaagaaatgattccacccaagtatcatgtaatgaaccaatgaattcactgggcttactcttgggagcaaggatagttcaaattcagctgcttcatcagaaaccccaccccagcttggataaaaaccctcgtaagctggtttgctggaggtcccagggggaccggcggacagccccaacagtttgagtctccttctctcccgtcattgtaactgcttatgtaacagtaagagaagaggggcggtgagctgcaggagcatcctgtcatctgtggggtttgtttattttatttttctgagtcttaaagagccgctctccaattcaggaaatagctgcgcatccctgggttccatgccttcctacaatgcctacatttctgacagctggaatctatcaacacttgtaggttcagtgaaagcaaaacaagtaaataagaaccgatgtccagttttagccaccagagttgttctgggtgcaagaagtaacctagaggcatttgctgtgtcttcccaaacttgccttcaaaattctcttcctcgtccaggtcactgcagggagccacctccttggaaacatgaagattccaagagaatctatcatttcgtggaaggacagagtgttcactacgagtgtattccgggatacaaggctctacagagaggtcctgctattagcatctgcaagatgaagtgtgggaaaacggggtggactcagccccagctcacatgtgtagatgaaagagaacaccaccgatttctgggtaagttgttcctttcttgtgtccttcccattctttcctcatctggaccacactgccatgggatctgggaaagccacgtggccttctgggtctcaccttttaaaacacagaaagaacactcgaaatgctgaggttcccttaactctacatagagatggttaaaggcagggaaatgaggatctctccggtgctccgaaccatacaggatgctgtctctaggacagagtgctatcctgtgtctattgaagccagagcttccacaacttctgcccatcaccaagatatcctattgttcacaagggaaagttcagaatcacacccatgactcttctttgtacttatatgtcatttgtactgtgttccatggtcattacagtccccttaaaggtccccctgattttcgataaaaagtacaagtgtgtgggaagtgacttgccttaggatgggccttcacatgcccagtcctgctcacatgcaacctgcctgtgcagaggtcttcagccatcattgtttgaaaccttactacttccatcatcaaaaggtgctcatgagtttttctggtttctttggctactgccgtctgtcacatttcatgacttcctctgtggttcccttgggatgctgtttgcttctcaaaacttccctccagagagtcacccccatggccagggcataccaatacttcctagcaagaccctgggtttctgagttagggttactattgctgtgataaaacaccatgatcaaaagcaacttggggaggaggaggcttatttgactttcatctccacatcatcatttatgatagaaggaagtcaggaaacggcaggaacctggaggcaggaattgatatcatggccatggagtcatgctgcttattggcttgctcctcatggtttgctcagccttgctttcttatagaacccaggaccaccagtccagaggtgtccccaccaacaatgggctgacccttcccacatcgatcacttattaagaaaatcccctgcaggcttgcctacagctcaatgttatggtagcattctcaattgaagttctttcttcttcaacgactgatcacaaaggaactgtcaaagctctattcgtctccatttggtagtggtggtgttctctctctctctctctctctctctctctctctctctctctgtgtgtgtgtgtgtgtgtgtgtgtgttattctgacccatttccaagtcaggggtggaatccagggctgggtacaaagtgtggagagaaagatttgtccacagttccatagatagccactgtcagggttagaattcccgtttacatacttttctatggtcccttaactgttttcagtgccctagtgtggacctgtatcccagagacatgccccagaaaagctgccaatgttttagcgggtatttctaggaacaggagccccagatggtgagtggaagaaggcattagatcccatatcaccatctttgactccagatacattgctttctttcttctgcagctagtgaggaatctcaaggaagcagaaattcttctcccgagagtgagacttcctgccccataaccaccacaggtatggagaaaacgtccacgaacagacagacatttggccatcaagcaaggctatgcaagcccctcaagcgatgaatacaaagaggaaaggaagctagccctacttgcttccttcttctccaaagcaagaatatggccatagcagcataatcaacccaaggcagtctgggaagatggctcagttggtaaagtgcttgtcatgcaaagcacgaggacctgagtttgatccccagaaatcacactctatttttaaaagcgctagtaaggcagtgattacctataatcctggctctgaggaggcagagacatggtgatctctgcagcttgctggccatcagctagtgtagcagaactaatgagctcaggttctgtaagagatctccaagaaataagatagtcaattaagaaagacatctgatgttgacctccggcctccataggcacacatgcacacgcgtgcacacacacatgaatgtgtacaccctctctccacacacacacacaatctaaggaaggagaaaccacaggacagaggttgaagtctccagacactcacctggccctcacatcgcttccctcaacctgagttgtagccggcggcggccacgaattactgggttcctgaaaggaaagctgggcatggatgggaaggacggtgagagaaataatgagccaagacaaagttctctggtcaagactcaatctttaattgtagggtcttggatttaaaggaaggagggagactcatccccaactttgccaggatctccattgctttgtcaggttctcctcaggaaagcaagctcagctgctcagcaggtagcttcatgcaggaagctgcagatgtggcacacaatagactttacctaggtaggaagactccaccctaggtgggctagccagctgtggccgaaataggtctgattcagccgctcaaggctgggggaagggcgcactgagtggctacctactgggaagcccctcctctcccagccttgtgcagtcctatgctagccataaaataagtatcccctcatctctcttctccacagacttcccacaacccacagaaacaactgcaatgacggagacatttgtgctcacaatggagtataaggtagcaggtgggccagctcatttactttacggacaatggtgaagcatgcaaagacgtgggtagtttagctggttgaaacggccactaattctttcactaatggttgtaagggtaaagaagactttaatcgctatcattgctcaaaatcccatgggtcagctgtagtacgttgggagttgtatcagctaccttttgtgttgctgtgaccagaagcctgacaaaacaaaccgaaggaaagaaaggtttgttctgactcccagttctgggatccagtccatcactatgggcaacccgtggcagcaggagactgagcagctggtcacagtgcatctgtggtcaagaaacagagaaaagctagccactgtggtgtaaacctttaatcccagcacttggaaggcagaggccagcctggtctgcatagtgaattccagtatagccagaacgacatagtgagaccttgtttcaaagaaataaaagaatttttaaaaagagaaagataaatgtttgttcccagcttactctcctttttatggaacctatggaatggggccccacatttagagcagtctccctacccatttagcctaatcttgataacctctcaaggacgtgtccagaacgttatctctaatgtgactcgaaaacctgtcaatcaacataaaccaagagcatcatcagagttaaatcacccaaaaccagtttctcccacatacattttcaagaacaatgcctcccaaactttggtgagagacaaagcaaggatccagggagagaaaatatagtgtccatacgcacctcagttattcctggtaggaggcaaaagcaggccttcctgaaccacggaatcaatggaagcttctggaagattcacatgtcagcatttgggaagtgtgagcacttccaggcgatatcggtgtgtttaggatttcttatcttgtttcaatagttcctttatgaaggatgatgctgctaatgaggactatcctctgggccttcctcaggttgagctgttctgtcaagtaccagcctctttctatggctgttccttctatgccccctctgctctttgaaggctccttgatccttctaagaaatacccagggagaagaggaaagaaagaagaaactgcaggccccagctgttcaggaggtccttgatcacctacagaattttctcacctgatctacagatccaacccccgatccatgcattcccaaagcatggtcctgacctgaactccatctccctctcttgacagtggccagctgcctcttcctgctcatcagcatcctcctcctgagcgggctcacctggcaacacagatggtaagtccaacactggaaggacccagcaccccagtgtctggtccctggcctggcatcgtgaacattgcctagagcttgacctcagctgacacgctgggaagatggctccgacgaaagcatgagatgggtgtgcaattcctaaaagctttgtttaaaaaaaaatcgaatgtgatgatggcatttgcctataattgtataattcaagagctgaggaggcaggcagaggtggatccctcatactctctggccagccagcctagagaaactggtgaactccaggttgatcaggagactctatttcaaaagtaatgtgaataatatactaaggaacaagattccaggttgacctctagactccacagtcatttactccctgacacacgtactcttactgaatgtgtatgcccggtactgagtgggttacattagcaaatgtcacccctactctcagaggtctgtgctgtttagagattaggaaaacctaggcttcccgaatgtgcagatagcaagagtttgaatcctatttagagatcttcaaccttgccatccatccaccagggctctaccaaggtcgctggaacagaccatgccaccccaccctccctccaactccgctgatcatccactagaaaccagcatgggtagcaagggatggagagaggagacggggaccatggctagaccaggcttgatggtatggatgaaggttgctagatactcacaaggctttaaaaaaaacattcttgcatttatcattaaatacagtgaaaagctcccggatagcaagagcagggggaggctctgtattctgtgtctgtgtgtctggctgtgtctgtgtgtctgcctgtctgggagttcccttgttttttaggccctaagtatcttggtcagtgatatctgccatggctcatataatgtctttttatggataaacatattttcaagccatgattaagtaaagagttttgtgtgagacagaaaccagaaatcagaaatctaggtgaacatacaaattgcacgtgcatgtgtgcacacacagacacacacacagacacacacacagacacacacacacagacatacacagacacacatagacacagacatacacagacacacaaacacacagacacacagacacacacacacacactggggggttggaggaggactgtgtatcatggtacattccattgatctcagcacacaagagttggagacaggaagatcatgagtttgagtttgaaagcagtcgggctgtatagaaattcgaatgccagcctcatagtgagagctgtctcaaagtaaatgagtaaataagatgccaagggatgtagttcatttggtagagtgagagctgagcatgcccacgaagcccggacttgatctcagcaccataagaaaccaggtatagcggcataagcctctaataccagcgctcaggaggtagaagcagggaaatccaaagttcaaggtcaccctgggctacatgagatcttatattaaaaaactaaacacattattttttaaagatttatttatttatttattttatgtgagtgcactatagctgtcttcagacacaccagaagcgggagttggatcccatttcagatggttgtgagccaccatgtggttgctgggaattgaactcaggaattctggaagagcagtcagtgctcttaaccactgagccatctctccagccccaatacattatttaaagaagaagaagaattagaagaagaaggagaaggaggaggaggaggagaagaagaagaagaagaagaagaagaagaagaagaagaagaagaagaaggaggaggaggaggaggaggaggaggaggaggaggaggaggnnnnnnnnnnnnnnnnnnnnnnnnnnnnnnnnnnnnnnnnnnnnnnnnnnnnnnnnnnnnnnnnnnnnnngaggaggagaaggagaaggagaaggagaaggaaggagaaaaggagaagaagaagaagaagaagaagaagaaggaagaagaagaagaagaagaagaagaagaagaagaagaagaagaagaagaagaagaagaaagagttaagagtataaaaccatcttgagaaaagccagatacatcctcattagagtcagctgtgtgagatgttctgtccctgtctttgtttcatttcctgtgggtgatataaaataccccaaccaaagcagcttaagagagaaggggcttctctgacttacaggtccaggatgcagtccacccttgtgtggcagctaaggtggccgaaacccgaagcctttactcatatcacaccctccatcaaaagcagggatcaatgaatttgcatgcacacttatcccagctcacttcctctttctatacagtctaggacccaaatccatttagactgggttttcccacatcgattacagtaataaaaacaatcccctgcaggcatgctcacagatgacctaatctaggtaatccaccattgagattcccttccggtaactttaggttctgttaaattggcaattaacactaaatcatcacacgcctgacgtcaagggtgtgcccctcctgcccgagcaggttctggccagccctgatactttaaatctttaataacagagtcataggtatgtgggtgagaatccagtttcttccattcttttgttgttcatctggcctccttctcattttcctcaagtggagcaagaagcagaaggcattgaggtccacatgagggtaccccgatagttgctgtgctaagagttactcatggccctgacactctacccatttccttaagatgttcttttagagttctgggagataaaacgtgatgtaatatgccttgacagtctaggcccctcagtccttgtgagaccttcttcctgctcaggacgagcatctacctggcatggcattttcgtttggtgaagacaccagactcagaaccagaggacagggctcttcatgagcaacaatagcttagagtttacaatgtgaagcaaggagctgtctaagactgtgagattcccctagacctcccagtagcggggccattagggagactgaaatagaatctcaatatgacccctttggtcaaagaatttgtccaagaaaacaaaacaaaacacttctgaaatcccagccacaaggagtccagcataacaaggtcctgttgcagacacataggtgcctgtgctcacgtttgtacatatatatatatttacatgtgtgtatatatgtgtgtatatatatgaaaaaagtttactttctagaagctaatttcatctaatgctgccctcttgtggccaattggaaatcttacctctgaattctgaaaatttcagtctttgccactttggaacacttaccaggagctaggagggcactggctggctcacattagttacgtttttaggaatttcatgggttttgttttgtttcgtttcttttctttgtttgtttgtttgtttgtttgtttgtttgtttgtttgtttgttttgagacagggtttctttgtgtagccctggctgtcctggaactcactttgtagaccaggctggcctcgaactcagaaatccacctccctctgcctcccgagtgctggaattaaaggcgtgcaccaccatgcccggcctcattttttgttttaaatgttcgccctgggaatttaatccaaggccttgagcatgctagacacatgttctattcagctatgatccagccctttgaactgttttgttaatacttttctctctttttctgtttcgtaatgttgatttttgggtgggattggagcacgagcatccggaagttagaggacaagttttgagagttggttttctccttcattcactaggattggtgccaaactcccttactccctgagacatctttctcccccagtcggattgttaggttttgtgtgtttgatttggtttagagcagtagtccttagccttcctaattctgtgaccctttaatatagttctgtatgtttaatggctaatcttactccaactcagcagttattagtccacaggactaaatgaggaaaaatccacaactgccaagtgtcagacattgcaccgcaggccacagacatgcacaacccagccctgctcgtaggaactagtagactggaagaaaaaaaaaacttgaaatatttttgtggtgctgaggatacaggtcaatagtagaatgttttctcagccctgggttcaatccttagtatagaagaaaaagaagaaagggagatatgggtggaaggaaatacggagggaggaagggaatgagggagggagggagggagggacatttgttgaaagtctaagatggagatatgtaagcagaaggacatttaatctacatgggaatcaaaagacagctgactgagctggtatactctgaagtgtcagataaaacgagccaggaaacatctcctggaagaggaagctggggcacctatggaattgtgaatctgtgtggtgatgtctgagagaaggttgagttgtaggacataaaatgaatgggcaccatggccacaatgataccacactgcccagacagtcagaaatactgtcatggaagatgaggccgcattgaggagctgggccaagatgctgatggtggtggcacctcagatcacctcacctaggagagaaaccgttatcttggccttctgggtgatctgctgcgtagaggcttaccgtgggcaatgtgttgacaatatgattgcattatggtggaataaatccacatagaagttggtgactgtgcttttgtgggtctgtggatctgagtgaatggaggaaacaaaccaaggggtatagaaaagaattgagcaaattagtatgactggtaagctggataaaaagatggagtatggaagaaggatgagtcagagaggggccgtgggtttctcagacagggagcctctgtagccactacatcctacagtgaaatgcaaattgggggtctcaagcaatgcatcccttagaggttagccacaagcatagcccagtaggacatcttgctcagacccactcagctctataaccggcctagagttagttgtgttgtgagatgaccttctgtttgtttgtttgtttgtttgtttctcaaaacactgggttgaattgccagtgcacagagcagagactgagtgcacagccagtgttgggcccctgggtggttgctggagcttgaggctgtttttcgtcaggtgggagggtaacaagattctgaagtagaactccaagttagactctcagctagggggctcaaggggactgttcagatggaatgggtttgggtggagaccatgttgttctcagtatacaatggcatgcatggctgtgacagggttattcttcttccaggaggaagagcagaagaaccatctagcaagctagaaaagtcagagcccaggcaagcggatgggaatcacaaagctcaagccaaatctgagacgccaagcattcacctaacggctgtttccttctgatccctgggtttctagaacattctgaagtcacaggacataacagcaactctatcactaaactggactttgccattgaagaataggatctaaccacttcagcacagcagttctaaagctttaatgggagagagggcccaacagtgctctgtgtgttttgtttttgtgtatatctgttgatgggagctgagatggtgtggtcacttttcatgtaacatatagtatagaaaaagtagctttaggttgacttcattgttacaacccagtttggaaagcccaagtaaaactcagcactaatgtaaataattcctcctcctcctcctctctcttttcatcctccgctccatcttcctcttcttcctcctccttttccacctcctctgtccctacccacccccacccatccactttccttcttcctttctgctctcacaagctcatcctagctacacgtgcatggctggctcctttttcaacctctgtttgcctaactggctcttctgatttcatcacttactgatcagcctttaaaactctgagctggcaaagatgactctatctatgttcttggctcagtcccagaaggaaacccccttttcatgaagcttcagttttgacatcctgaagaacagaaactgtggcagaacaatcttcagataacatcaaaacaaagtggagaagccacgggaactgtggagctctggtattcagaagcctgtgtctagggtctgcgccaggagcagaaggctgaaggaagtcccaggacgtggacttagatgctttcccagcaggccactctaagcgctggtttctttgggacagctgtcaattgtacgctcaatttagcctgcactaatctgatgcttacaggtgaacactcaaggcacaggtatggacttggtacataccgtgaaaacactggaaagaaaagaatactttcaagtttacagaaggaaggaaggaaaaaggaagcagaggtggtgattatacaaaagattagctgtagactggatatcccaggcatcctcggataatgcccccgccccagcaccctgatccaggtcaccaaagccttgtgagatcagactgcagagccagtctgtctctgagtcagtaaatgtagaatttggatttctcacaagttcctggcggtgtcttttttttttttaatattttttattaggtattttcctcatttacatttccaatgctatcccaaaagtcccccataccctcccccacactcccctacccacccactcccactttttggccctggtgttcccctgtactggggcatataaagtttgcaagtcctggtggtgtctttatgctgatctctagcccacactttgtgaggcactgggctatcccagtgtgctctcctcttccacagataccaaaagcacctgggtttgatgctcagacttctgagcacgttcttgttcaatctcttgcgtaagatttcctctcagatgagttgagtcagattctcatgtttaacagtgttttaggggattcacagaagcccaaactatcagttttcatttctgaaaaggctggaaaattttatgaaaaactttcaaaggtcagacagagccattttgagtcttttatgtgaccaagtatgaaccagatctttcctatctatggtctcccctttccaaaatatatcttttgtggggacacggcaaggaggaaagttaaatagaatctcaagctactaattttagaaaagaaaaaaatattaaactcttactaaagagctgtgggtagtggtacacacctgtaagcccagctctcaggagactgaggcaggaggattgcagtgagtcagagatcagcttcacctacaagcaaaaccctgccttacccctcaacctttccataaaaacagtcttacttgtgtaaaattaatttttaatacatatttgtgcacgatgtgtgtgcctggtgcccagggaagccaaaaaaatatgttcaatgtccctggaataggtggttatgagctgccatggaggtgatgggatttaaacccctgttctctgaaaaagcagctagttctcttaaccactgagccatctctacagccccattaaattgaattttattgtcattactcaatatgggagatggggtaatgataacaattttttttttataatactaagatgtttagctattttactctccttcacaagtgtagagtagaattttctagaagctacatgcatgatattatcgctctggtgttaacacataatggatttatcttgttaataaaagaattagtaaataatattttaaattttttctttgttttagttttaagatgattaatatctatagatactagtgtacattaagaaagcctttgggatcctcaatcattttgcatggttttagtaattttttaataacataaagaaggtctgacagattatgctaaagagctattgtggtatggattagaaatggcccccacaggctcctgtgttcaaacatcagctagcagtgctgctttgggttttggaacctttaagaggtggggccttgcttaaggagataggtcactggaggtgaaccagacttgcttccagtctccctctctgctgtcccaggaagccatcatatgaggagtttcacaacatacttctgctgccacagagtccctccagtaaggcacgtactggccactgtgtagtgtaccctctaaaactgagctagagctcccctctcctccctacactatctctgttgatgctttgtcacggtgatgaagaacataagtaaggcaaagacaagacatagtttggagactcacgtgagcatctcagccagactcaggcacagctgcgatgtgggaattatcaagcatgagatgcaaagcaatggaaaatgaatcgttatgacagaagcctacatctagtcttcccttcttcccattagtaataatagcccgtgttttagaagaacacatctttttggtgttctaggtagcttatattgcaaatgtggcacaatctaagagaaatctgggatgagggaacctcagtgaaagattctccttgatcagattgtcccactgatgattgatatgggaaggcccaacccactgtgaaaggcaccacccattggcaggatgactggggttatagaagcaaacaggctgagcatgagccagtgagcaagccagtaagcagtggcttctctttggaagaagcatggctttcttccgtggcttctgtttgatctctctcaatgatagattgtgacctagaagtataagctaaaataaaccatttcttacccatagttgcatcggttgtggtgtttatttcacagctacagaaaagtgaaacagaacatctttctcccaagctaatggtgtttgccagcctccttcagctacctgtgggcatgtggttaagctctgaacacagaggtgtgagtagaagcagtgtgtgacgtctgggctgtgccttgaagagaacataagtggcattttctctcttagctcttcaaaccagcaggcacatggccttgtcttgggagctagaaatcccaatggcaagaaccccattttaagtttgacaaggagacaaagttgaagaagtctagacatttgtctgatgccagggaggcattgcaacatggctgattgcattggactgaactttggtaaaaaaacaaaccagttgaggccatgacttttaccttgtgaggacaaaattaacgatcactaacaccggtactgttaccagctatatacaaaccctcttcccataacaaattttttcttacggtaatactggcatcaaaatattttgagagagagagagagagagagagagagagagagagaacgaacaattacttgttttgtgttgaatgactctgcctgagagttcccctccagcaggcaagttcctgagatgaaatgcatgagttcttatggagacatcaccatctctcggggcttctgggtaagtcatgaatcgaaaatagaaagcttctggggtccctaaagcccttcctcttatttccattccactcctcaagcgtgaaggataaaatacattccctgttctgctgtaatattaaggatttggattattttagtctggttccttggccatatatcaaaaccttatagtaaggggccagtgagatggccagtggacaaaggtacctgcggccaagcctgatgactgaattcaatctctagaacccagatgtttagagacctggtgccattaactccacatgtgcaccatagtacaggcttttttcccatcacacatgcacacacacacacacacacacacacacacacacacacacgaagcccttatttgtagcagcaagtttagctacacacacacacacacacacacacacacacacacacacacacacacatcagttaatttttgactagctcaaaggctgagcactcctaaacctccctctgctagcaaatgctcccttctggtattcctgagactcctgaaccttcccctgtcaccccaggcccaatgtagaagtggccagtggctactcacctgaattcttacatggctggttggctttctctcctgcagtgcttccgttctatccttctcccctgagtgttcgccattctctgtcttcatttctcccagttcctagcctgcgcaaatctaaaggtcccaccttagtctacctgtccagccattagcttttggctctttattgattgaacaaaaaccaattggggacaaggaccttcagcgttaggacatgcagattcccaatttggggggccagattaattcaaagcattggaaccaatccccaacacttatatattagaggcagaacttggggatacagtctccttgaagctaaattgttctttggataaacaacactactggtgacatagaagagataaaaaccctacaaacttggtgtttttgttattgagacagcgtctcactgtgcagcccaagctggccttgagtttacagtcctatttcagctctctggtatttcaggtatgcatcaacttaccaagctataaacttggctttcttgagccttgaacttcctatgtattgacaaatacccttgaacttctggtcctcctgtctctacctcctgagtgctgggatcacagacacataccaccatgctccatttacacaatgccggagatagatcacagggcctagtgcagattaagcaagtactctggcaaaccagaccaaaaaaaaaaaaaccaaaaaccaaaaaccaaaaaccaaaaccaaaccaaaccaaaccaaaacaaaacaaaacctgagacagacaccagtatattaggatactcttgaatcctccctttttcgtcccctccaaaattgcaactagagttgtaagttctgccccccatgcaaacaaacagtccagataaactgaactctagtggtaaatgtcaatgagggggacctctgatccacatatgtcaagatggaggtttggaaacactacatgcagaaactccatagctgaagtcacaggatggcggggtgacactctgtattccagctaacaagctagggaactcgactgtgtgcacgtcccttgtaaccacctacacatgaactgggaaacctaagatccctggatgttaatctgctgggttgaaaaacattccacctcctgtgtgaccagagaagtgggggagcaggaaacaacagaactggtttccttcctacccactcacagcctctctgtgatggcaaagggaaagatacagagtacttaaggccaaagcttgagacttcttgaagctttgtgagttgtggaggagagacagttctaatcccagagtccttgttaagctgaggtacctgagaatttagaatggtctagctgtgttttgagaccaaccactatgaatacaagcccggcagactggacttggaaaaacaagggaaaattagagacgtcctctgaattttcctttaataaatatggctcaaacaagatccaagtgttcctacctgcccaacttgtaaggcatggttagctgaggacacaaacaggcatacctctcaggggaaagagctcagggaccctgccacaggcctgcagcaaagtgagtctccagatgggcactgtcctgggaattgaatggacacccacagacatgcaggctgctacctgctacactccctctccattatacaacatctttgaccccaaggtcaaaatttaaaccaaattcgaattgagttaataattaatctaggaaattcctgcagtggataaaggaaataaacttgggatgaaaaatattcaagcgaggacactgagggcttagaatcagatattaaccactatgactataaactattgttcttaccctaggtttggaggccaatctgttcccttgtcttaggaaaaatacataatattttgctccacaaaggacacgtttgggagtcatggccatttcctttcctctccaacaatttccatccctgaagatgtcttgtgtgtatgtgtgtgaatgtgtgtgtatgtgtgtgtgtgtgtgtgtgtgtgtgtgtgtgtgcatcaaacactcaacaggaagcaacttaagggaaaaaggtttgtctggaattgctgttctagggaatgtggctcatcttggcagagaaagtatgacaagagatgtagaagaagcaggtcacatctaaaatctagaaacagagggatagtgatggtcagtttgcccatgaaacggtaccagacatttcagatggttcttccctattcgcaagcatcttaatagacccacacagaggtgcgtttccatggtgattctaaattcaatcaagttgaaaatcgtcattaacaattacaaattcaaagaaatcctaaaagacacgttatggaatacaaggcgaacccattatgctatctcaaagcaggtacgaatgtccatccgtcgttggtggtccacaaggggaaatactcttcaccacactcgtatttttaactgaaaaatacgatcgatgcatgcgtatccattcctgtgctggctggttttgtgtcaacttgacacagctggagttatcacagagaaaggagctttagttgaggaaatgcctccacgagatccaactgtaaggcattttctcaattagtgagcaagggtttggaaaggccccttgtgggtggtgccatctctgggctggcagtcttggttctacaagagagcaggctgagcaagccaggagaagcaagccagtaagtaacatccctccatggcctctgcatcagctcctgcttcctgacctgcttgagttccagtcctgacttccttggtgatgaacagcagtatggaaatgtaagctgaataaaccctttcctccctaacttgcttcttggtcatgatgttttgtccaggaatagaaaccctgactaagacaattccccaagctgaaacttaaaagagacagcacctgcttcaccaactactctttgctttccttgcctggtaagtttaaagatacgttgttttttctatcagtgtttcagggtgtaaagaccaattagaatatactcagtcaatttttcatacaatgtagctcaaatacaaaacacatttgtatggttacaaaccatgaatgagctgtcatagttactgaagctcacctggctggttgtgatggatatccagacttccggacccacatggaaattacagctgtgctagctgtcttagtgttagaagatgctactacgtaggctgagggagaattctttataacagtcttactcagttatgagtcctgtatgttatactactgacctggcaggcaagatatgctcactggttcaagagcttcatgattgatgagcaactactttctgattcaatttgaggcctgttccattcaactcatgtctggtacagtaaccttgatcaaaagtcagagtccaggcaggccataggtaccactagagaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagaaaatgagctgtctataaacgctcaggaagcccccttattctttacaatggagtgttggtagaccctatgcaggttgtgagcatgtaatcacagcttctgagtgcaatacacatacacacacacatacacacacatacacacacacacacacacacactctgtggaaatagaaagagaactatctgtaatgatagaagagatcagtggtagaggacaagcgagtaatgagcatgaatatgatgcaagtgcatcctatgtacatgtttatctgtgagaaaagagaccatcagcaggagggaggggacaagagggtaatgacccaaatgcattatatatacacgtattaaaatgtcataatgaagtctatcattatatacatcattatgtacacaatgaatatatgtatcaactttaattttttcaaaacaagaaattacagctttctcattgaatctagagtaaatctggcctcatccactagttggcaggaaagcaaaaagtcttgtctagtttaaacaattctaataggcattgctggatttctaatgaacaaaaatgcttcctccagatcagcaaaatggctcagcagggaaagcacttgccacgaaacttgacaactagaatttgatccctgggatccacgtggcagaaggagagaaacaattcccacacgttgccctttgacccgcttcttccaagcaatgtggagacagctggagagaaaactggctccatccaacttcacagttctgtaaagagtcagagtctacagaggtgaccgtccacaaaggcagtgctcccagatgcagacactgattcagcctcacagctcacagttcattgtgaagggggagtcgggggcaagaagagctcaaggcaggaagtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacactgtagctatcttcagacacaccaaaagagggcatcagatcccattatggatggttgtgagccacctcatggttgctgggaattgcactccagaactctggaagagcagtcagtgttcttaagggctgagccacctctgcagccctatagcacccggggcaacctgtgtagggatgatattgcccacagagagctcaattgtccctcatcgatcatcaatcaagaaatgctttagagacttgcacctcctcagatgag

SEQ ID NO: 1122 - DNA, 1370 bp, Mus musculus
aaaagccaagatgacagactgagagcctgagcccttgtcttgcattctcccaggaagatgcagtaaaggggttgacccaatatactgcagagaatttcatccagttccctcctccatcctgatcccatgtgccaggaagatggagccacgcttgctgacgttggggtttctctcattaaccatagtacccagttgtcgggcagaactgtgtctgtatgacccacccgaggtccccaatgccacattcaaagccctctcctacaagaacggcaccatcctaaactgtgaatgcaagagaggtttccgaagactaaaggaattggtctatatgcgttgcttaggaaactcctggagcagcaactgccagtgcaccagcaactcccatgacaaatcgagaaagcaagttacagctcaacttgaacaccagaaagagcaacaaaccacaacagacatgcagaagccaacacagtctatgcaccaagagaaccttgcaggtcactgcagggagccacctccttggaaacatgaagattccaagagaatctatcatttcgtggttggacagagtgttcactacgagtgtattccgggatacaaggctctacagagaggtcctgctattagcatctgcaagatgaagtgtgggaaaacggggtggactcagccccagctcacatgtgtagatgaaagagaacaccaccgatttctggctagtgaggaatctcaaggaagcagaaattcttctcccgagagtgagacttcctgccccataaccaccacagatctcccacaacccacagaaacaactgcaatgacggtgacatttgtgctcactatggagtataaggtagcagtggccagctgcctcttcctgctcatcagcatcctcctcctgagcgggctcacctggcaacacagatggaggaagagcagaagaaccatctagcaagctagaaaagtcagagcccaggcaagcggatgagagcccaggcaagcggatgggaatcacaaagctcaagccaaatctgagacgtccaagcattcacctaatcggctgtttccttctgatccctgggtttctagaacattctgaagtcacaggacataacagcaactctatcactaaactggactttgccattgaagaataggatctaaccacttcagcacagcagttctaaagctttaatgggagagagggcccaacagtgctctgtgtgttttgtttttgtgtatatctgttgatcgggagctgagatggtgtggtcacttttcatgtaacatatagtatagaaaaagtagctttaggttgacttcattgttacaacccagtttggaaagcccaagtaaaactcagcactaatgtaaat

SEQ ID NO: 1123 - DNA, 819 bp, Mus musculus
atgtgccaggaagatggagccacgttgctgatgttggggtttctctcattaaccatagtacccagttgtcgggcagaactgtgtctgtatgacccacccgaggtccccaatgccacattcaaagccctctcctacaagaacggcaccatcctaaactgtgaatgcaagagaggtttccgaagactaaaggaattggtctatatgcgttgcttaggaaactcctggagcagcaactgccagtgcaccagcaactcccatgacaaatcgagaaagcaagttacagctcaacttgaacaccagaaagagcaacaaaccacaacagacatgcagaagccaacacagtctatgcaccaagagaaccttacaggtcactgcagggagccacctccttggaaacatgaagattccaagagaatctatcatttcgtggaaggacagagtgttcactacgagtgtattccgggatacaaggctctacagagaggtcctgctattagcatctgcaagatgaagtgtgggaaaacggggtggactcagccccagctcacatgtgtagatgaaagagaacaccaccgatttctggctagtgaggaatctcaaggaagcagaaattcttctcccgagagtgagacttcctgccccataaccaccacagacttcccacaacccacagaaacaactgcaatgacggagacatttgtgctcacaatggagtataaggtagcagtggccagctgcctcttcctgctcatcagcatcctcctcctgagcgggctcacctggcaacacagatggaggaagagcagaagaaccatctag

SEQ ID NO: 1124 - DNA, 70251 bp, Homo sapiens
  misc_feature (40192)..(42808): "n" at positions 40192 thru 42808 can be any base
ctgtgcctaggctggagtgcagtggcacaatcggtagctcactgcagcctcaaccttccaggctcaaggatcctgccacctcagcctgctgagtagccgggactactggcacgcaccaacacacccagctaatttttaatttttttctagagaatctggtctcactatgttgcctaggctggtctcaaattcctggtcccaagcaatcctcctgccttagcttcccaaagtgctgggattacaggtgtgagcccccacacccagcccacttccgctcttagggagaggcgagtgcatttcagagagcactcgatgctcccaaaagaagaagttgacagagcccacgtcccctcagcccttcacacagcctccccttgtcttcctctcctactcagcactgtggctgcactaggacccctcatgatgaccaagatcctcataaagaggacaagaagttcatccagtaccagtcaggccaatatcccaaaattagcataactggcagaaatgcagaggcatcaacaactcctcttgacaacagggttggtagaagaatcaagggcctaattttgatgcctggcacaggttatgggagcagcagagtacatgctgcccagcggcttccagaagctcctggtccaccccgtcaagaagccggaggtcctgctgaggtgcaacacatctcagtgtgctgagactgccctcaatgttgcccccaagaactgcaaagccatcctggaaacagtggcccagctgcccattggagtcaccaatcccagtgccaagctgtgcagcaaagaaaaggattagactgctcatgtgcacgttttatttgtttttaaattaaaaaacaaaaaaaagaaagaaggaggaagtggaggaagaggaaggaggagggaggaggaggaggaatttacatcagcaggccgatcacatactagtccttgaattcatggttgaatgtactgaccattctccctacggacacttgaaggtttccatcaaacccttcataacatattgcataattgtggactctagacttgggccacaactgagtgattttttttttctcaaacccaattccacaaagtaaaagcctgatgaaatacagtgaaggctgatgccttattaactgtgtttcccaaatccagagctctaaaaaggttctgcatacagtcattcattcaatgcttaacgactgagcattaattccatgctaagtactgaactcagcactaggaataagaaggcgacctagaggcatatcctctctctaaagatgcatagagcctcattggaatgatcagccgtgtctccagagagctacaaggcagttttcaattggtaaatgccctgagagtgatgggcttgtggcatgtgtaagggttagacagacctgggacctagacatgacaccactcctgacgaattatgtgagtgtgggtgtttcacaaccacaatgagatgcaatgcctgcacttgtaacatggaaatagtgatggcatgccggccccgccagattgctgtgagaagtcagcggcagagacatgcaacattctcagcacagtgcttgccatgtagtaagggcctagtcagtgctagtgattcctttcaatattcctaagatgcagataagggaacagcccagaggagggggagcacttccagagggagggatgcggtgagacttccttcagcagggtagcactggagctgggtgttaaggagtgagtgagctttgggcttatggatttaacagaggaaaccaagaaaagaggaggcggtgttgcaggaacagtgagcagttgatgatttttattttgttctctggtctgcttgggaacatttttgtggcaaagacagcatgaaggatagcgaagaattaatactgaagagataggccagggcaggttatgaaggattttgaataccgggctaagaaatgtgggcttaatttcaaagacattatggacactcctaaaatgttacgttgtagataagggaaaagtattcttccagaagattaaattggggctgggcacggtggctcacgcctgtgatcccagcactttgggaggcgaagtgggcagatcacctgaggtcaggagtttgagatcagcctggccaacgtggtgaagccccatctctactgaaaaaaaaaattagccgggcatggtggtgggtgcctgtaatctcagctacttgggaggctgaagcaggagaatcacatgaacctgggaggcagaggttgcagtgagccaagattgcaccactgcattccagtgggcgacagagcaagactcagtcaaaaaaaaaaaaagattaaactggaagcaatgggtaagaatggtggagtggagagacacatttgagtgagggaagccagctgaaaagctgtacagacgtctagacaaaatgtgacacaagcatgccttcacctccctgcaaagaccacagaccactgagctccaaagggggtttggaatccttgtcctgggccgccattggtaactcatcagtgctggcttgagagataaactctattatccatccctgaactaaaatcatgacagaagtggccagggagctttgctgctatccccccaggaaacacgtcctccactcaaatggaaagaggaccctctgacaacatctgtgggacccaacagcactggtcaccacaagccacaaaatgttaacaaagtcagttttcaattgttagggacggaggactcagttcatgattcatacaaaccaactgttctctcccagtgttttctgggtggcacaacccacaagtcaacagtggcttgggaactagacatttgagtagagttgggttatttgattcatagtggattttggttttccacgggacccctgtgcccttgtctagtagaatctggtggaaattacaaactgcagaaattcaactcagtgccgcaataacaggatgcacctgtagatttcgtagaattagcagcagcattctttcaataccagtttgagagaaataaccctgtttgcatagtgccaactggggcagaatctgaagtgtcttgcctgcctctcggccatgggaggcaccgatctcagcaacatctatccaaccgccatccacttaacaagcaaagatggaaggccctcgtgctccaggctatcctgcaatggttcatttgcttttgatgggattatcactttgacagatgtgcttgcaattaactgggggctttctgcttccaatccaaattcccacaggtggatcactggctcttggggagcaaaaacccttctttgtttgtttttgcttctcccagagcctgggcagagctccccattcctggatcctacgttgatatgcactgaattgaattatactaaagggtgcacccaagagtgcatgagctaagtaaaatgtaatttgtgggacctcatgtggacatttcaggtccatgtgtacaagataaaggagagaaaatcctgggggacaccacaggcctgggaaaatgacctcctactaagcctaacaagaacatccagtacataaacagcaggctctctgcaaccgcttcggtccttccactgccacgctcccagaaagcaaagggttatctcctgttcggattttggctctgagaccacagctcagcacatcactcctctagagaaaagaaagtctaagatgagagagtgaggctgctttcatgtggtgccagcgtatagtgcagggcaggcctgattgctgaacggatccctgcagacgtgagcggtcacttccccttttgagggcccatttcttttcctctttgaggagactgtgagcgtcctcagtgcagggctatgttttagcttcttggctctcctcacaggttctagcataattctttgattaattgcagtcaacgtttattgatggattatgtgacagaggtgaaattctttgatctgggtttcagcttttcctttcccccactccctcctttttctttttttttttttttttttttagaggcgaggtcttgctctgtggccctggctggagtgcagtggtgcaatcatagctcattgcagccttgacctcctggggtcaagcgaacctcaacgtcttggcctcctgagtagctgggactataggcatgcgccaccacgctcagcttcaccttttcctttccttgtgctcccctggcagatatgctggtaaacaatgaaccagtcaagaggacagcaacaggaggaaaatgggagaaaccccattattcgtggactaaacaggcttcccactagtcctggctcacagaggaagtcatgctccatgtttcaaatgtcctcaaagctcgttcaactccaaaatgcatgaagacaaaatgggaattttactcaagatttttgtgggctgttggggagaagagttaacattgcaaagcatattgcaaactcttatcttcaaatgattttaaaattttcttccaagctctttattatttctccagagctgccctgctcttcccactctgggtcctttctctgccactctcctcagcatgacttctccctaatcggccagcatttcttttattctatagagcaagttttcttgccctgggcacctctcatttgcatgttataccaccacaccaagtgagcctcagagcaccagtgttttaatccctgaaaacagtccttacgggattcagcacagaggtcctcttggcagcctgtagtctccagagtgacacgtcctcaacagtcaaagtgagcaagctatggtgcccatcaccaagtggggctcaccatttccctctgcgttcacttctctcctaccttcttccttatcccatccttcctccttcctttttttttctgcattcaattattcatggttattcatttcatacgggcatctgtgccacttggttctacaggcattttttttttttgagacagacttttgcccttgtcccccaggctggcgtgcagcggtgtgatcttggctcactgcaatctccacctcctaggttcaagcaagtctcctgccttagcctcccaagtagctggaattacaggcatgtgccaccaagcccggcaaatttttgtatttttagtagagacagggtttcaccatgttggccaggctggtctcaaactcctgacctcaggtgatctgcctgcctcggcctcccaaagtgctgggataacaggcgtgagccatcgtgctcggccggttctatgggcattgtggaagtgaccgttaacaagccccaagggtaagtaaaggaaaatgaaaggtgattgattcctcaccacctctccccttttttcctctactctttgcccctgctccccaatctagactctaataaacagaaatgatttttgttgcaagctgaaaactcgttcttgtggttggggctaggggggtggcaagtcaagctttagagttgtctggataataaatgctgtcttcaaggactgtccaacattgtaggaacaagagaacaacccaagtgaacaactaactcctgttcacaaatgctactgcctctctgccatcccctaacctcagcctcacacacttgaatttcgccaatccatttgatgagctcaaatcagtgaattttctcctcgccaaagctcacaaattctgttccccgcttcttgccccacatccaggcattaccaactgcattttccctttgcctgatattctggcatcaagcctccttgccattccaatttatttcaccttcctccagtccttatgatttccttcctgaagagtatttcagcatctctatgcctcaatcttccctgcacaccacaccagctcggcctcatcatcacatcacttggctatgtcccgcctgggttagacagcttcagtggctgaagtccatagatcttattctgtttttcgaggtccacctgactctgaatccagctgatatttctgcccttagcttctacccctctctacttctggttaactatggaccacactctgcttcctcaggaaccacctaccaaggccgtatccatccttcaaggacaatacgtgggcctttcctgatcacatcagctcaacaacttttccctcctacatttcaattgctcttcttaccataatcattagtattcaccccactgtacgtctagaaagaaagtggtcttaaacctaagggaaggcagtctaggtcagaaatttgttgtccgctgttctgagcagtttcttctaggaagtaccaaacatttctgataatagaattgagcaatttcctgatgaagtgagactcagcttgcactgttgaccggctgtccctggatgaacctagttacttttaaccaaatgttcctttcttgaacttgttcctttcttgaacttaatctaccaatgttatctagataactttcctcaaaaaaaaaaaaaaaaaaaaaaaccctctactaggaaagaaatctttgaaccggacttattggaaattacctccttgcagcaggtttgaaacaaaactttgaatttgcctcacaaagaatttgtctgaaactgctttagtatatgctagttatatttgtatgcacatgtggcttcatacatagtggttggacacccatatgtgttatgcactttgttaggtgacgtaagttcacagataaactggacatagggctatcctctagaggcccacagtttgacaccttaacctgagatccttggacctttgaagttcagagtgcccacaaccgctgggtgtggtggctcacacttgtaatcccagtactctgcagggctgaggtgggaggatcgcttgagtccaggagtctgagaccagcctgggcaacatgacaaaaccccatctctacaaaaattacaaaaaaaattagccaggcctggtggtgcatgcctgtggtcccagttacttgagaggctgaagtgggaggatcacttgagtcaaggaggtagaggctgcagtgagttgagatggcaacactgcactccagaaaccccatctcaaacaaaacagagcaaaacaaaacaaactgcccataatgctcctgaaacttcctacggatttatccagagtatgtgctgatgtgcattttttccaaggagggaaaccaaaggttctatcaaattaagaaaagagtttttaccattgtggaagacagtatggcgattcctcaagcatctaaaatcagaaataccatttgacccagcaatcctattactgggtatatacccaaaggaatagaaatcattctactataaagtcacatgcacccgtatgtttattgcagcactatttacaatagcaaaatggaaccaactgaaatgcccatcaatgagactagataaagaaaatgtgatacatatacaccatggaatactatgcagccatgaaaaggaatgagatcatgtccttggcagggacatggatgaagctggaagccattatcctcagcaaactaacacaggaacagaaaaccaaatgccgcatgttctcactcataagtgggagttgaacaatgacagcacatagacatagggaggggaacatcacacgccagggcctgctgcagggtggggggtggggtgtgaggggagggaacttagaagacaggtgagtaggtgcagcagaccaccatggcgcacttatacctatgtaaccaacctgcacgttctacacatgtatcctggaacttaaattaaaaacaaaaaagagtttttaatccaaaaaagattaacagcaactagaagaaagaaagagatataaacagtgaattgcaatgcagcacggcaggtgttatgatggagtagaaaggactggaaaaggcctcctggaggaagggacactcaagtgtctttccatttcacctgtaaactcattaagggcaaaagctttgctacagcttcagtatgagatcctgggcaatccgtgacaaaatgggtctgcttttgcacccccaacttcttctcacatccctgcatcgtgccatgcagcatcaactggaaacctcagcatcagcaaacgacgacagagcgttcatccgtaaggtgaaccagaaaagccagttcaatgacttgtttaaccatggtccatctcagaaccaagagttgggcctcttatttaccagaaaaattgtgggggctttgtgatatggctttaaaaaaatcttgtaattgccaggcgtggtggctcacacctgtaatcccagcactttgggaggccgaggtgggtgaatcgcctaaggtcaggagttcgagaccagcctgaccaacatggtgaaactccgtctctactaaaaatacaaaaactagctggatgtggtgacgcgtgcctgtaatcctagctactcaggaggctgacgcaggagaatcacttgaacctgggaggcagaggttgcagtgagccaagattgtgccattgcgctccaaaaaaaaaaaaaaaatacattaacataaatttaaatattttataatgacaatccacattaactacttaaagcataagctattttccaggagaggcagcaagtgcattctactcccatgcccaagaagaaaggagcgtgactttggtgggagtactaggagtttctactggagcacttgcccgcagagtgagaaacgttcctagagaggaagttatacctgctgtggaatttaagagaatcttgtcatattttgacaagttttttgagatggaagtctcactctgtcgcccaggctggagtgcagtggcgcaatctcagctcactgcagcctgcacctcctcggttccagctattctcttgtctcagcctcctgagtaactgggattacaggcgcccgccactacgcctggctaatttttgtatttttagtagaaatggggttttaccatgttggccagactggtctcaaactcccgacctcaggtgatctgcctgcctcagcctcccaaagtgctggaattacaggcgtgtgccactgcgcctggctaatttttttttttttttttttttagtagagacggtggtttcaccatgtcatccaggctggtctcaaactcctgacctcaggtgatccacccaccttggtctaccaaagtgctcggattacaggcatgagccaccaggcccagtcaacgtgatgtgttttggaaccctgaattccttggcttgcccggagggttttctttttgttaatatctttgcttgctttctagtatttaaaaaattgtgttttgctctaactatgcaatggctttaagtcttagacaaatttccagggagcaaaacacactcaaccatttcataataatcagaagagagctctgatcaataaataagcaagactgaattttacaaaataatccaaagtttaaaaccaaagcccactttttgcatgatcctttaagagaaagaaatctggaagcaaaacaccttataaaatgacaatgcactttcaggagcccagggcactgtggtgaaatgatgatggctagtacaggttataagccttggggaattatttatgaattctcaggatccttcagttcgccgcatccttctccattatttgaatattggaggctgcctgaccagaatcttgtcaggactttgctccttcatcccaggtggtcccggctgactcctgaggacgttacagccctgaggggaggactcagcttatgaagtgctgggtgagaccactgccaagaagtgcttgctcaccctaccttcaacggcaggggaatctccctctccttttatgggcgtagctgaagaaaggattcataaatgaagttcaatccttctcatcaaccccagcccacacctccagcaattgaacttgaaaaaaaaaacctggtttgaaaaattaccgcaaactatattgtcatcaaaaaaaaaaaaaaaaaaaaacacttcctatatttgagatgagagaagagagtgctaggcagtttcctggctgaacacgccagcccaatacttaaagagagcaactcctgactccgatagagactggatggacccacaagggtgacagcccaggcggaccgatcttcccatcccacatcctccggcgcgatgccaaaaagaggctgacggcaactgggccttctgcagagaaagacctccgcttcactgccccggctggtcccaagggtcaggaagatggattcatacctgctgatgtggggactgctcacgttcatcatggtgcctggctgccaggcaggtaagggcctgtgggtgcccccggaattccgggaaggctgatgggcatccctcttcccagccacagaaccagagggagtccccaggtagatggttccaagaagggagttgaatcttgggttccacctcttgcctgtgacccacggggaccccagtttatgcctcactgttccttggtctgtcaagagagcctgaaatagcattaggttctcctgtccttctcagtccttgacaattaattctgggaagaatagtgtggcatgatatttgggatatttggatgttaacagggtcccgatgagcaggtttctcaagaaattatcttttattcttcaatgaatttccttttattctctgcactcccaccccccaactaagaagctatcaggaagctctttaagttcaggttaatttgctggagacatgagtactcatatatcaaacactgggagaatttaagatctcagaaaagtttagcttcaaggatgtatacactgcttttacgtcttaggaaataacacctaggaatttccttacaagtgcaactttacagaaatttttaaaaatatgcatactcacttttagaacattactacttctcataatcctatgtatatacatgatatgtatatgtatacgtgtttatatatgcaaattttaaatttcattccttgtttcaaatggattttctcgaagattttttttttttgacactgtctctgtcagccagactggagtgcagtggcgcgatattggcttactgcaaccttcgcctcccaggcttagcgatcctcccacctcagcctcctgagtagctgggactacaggcatacgccaccacacctggttaatttatttttttgtagagatggggtttttgccatgttgcccaagctggtcttgaactcctgggctcaagtgatccactcaccctggcctcccatactgctggtactacaggcatgaaccaccgtgcctggccaatatttttttttaaagaaataaaaaaccaccaacttctacctcaaaccactcttcctaattgagtgtgaattttctaataatgtcttccctttgcttactcaggaagacagataagaaagtttatagtgttttttgaaagtctataatggcaacaagtagaatgctaactggctgtagaaagaatttattaagaaatgaaacataatgatgcatttcaggagtctgcttgcttgtttaggggaagtgcccagtcatgctgggctgtgtactggcccagatgtaggagtgtctttaaagagggcattttatttacttattacatttttatttattttttttttactttttgagacagagtctcactctgttgcccaggctggagtgcagtggcgtgatctcagtccactgcaacctccacctcatgggctcaagtaattctcgtgcctcagactcctgagtagctaggtttacaggtgcgtgcaccaccacgaccagctaatttttgtatttttagtagagatggggtttcaccatattggtcaggctggtctcaaactcctgaccttgtggtccaccagccatggcctcccaaagtgctgggattacaggtgtgagccatcgcgcctgacctatgtgttttattttaataggttttggaggacaggtggtgtttggttacatgaataagttctttagtggtgatttgtaagattttggtgcacccatcacctgagcatgtatgctgtacccaatgcgttgtaagattttggtgcacccatcacctgagcatgtatgctgtacccagtgcgtagtctcttttccctcacccacctcgcaccctttcccctgagtcctcagagtccatcgtgccgttcttataaagagggcatacttttaggaaggtttttcaatgtgatttctacatccacagggtctttgctaactcagtctaagccaagaacaggaaaatcttgacaattaatcatgctctgcctctggaagacacatttcaagtaaactcgtgttatttctagctattggtgacttatccaagggtctgagtggtcttggagggagcaggggaactagagtcccataaggactccttcacgccattctcaacatctatccataccccatctgcccctcaacactataggaaatacaaaaatgagggagatatagtcctgacacttaagcaacttataacctggtgaggaggagaaaaacatagatataaatatagtaataccagtcagagtgtggtaagatctacggagcgttgggctatcagagaaggcttcatgaggatgacatgtaaagggagccccaagggaccagtaaatttccatcaatgagattccagggagagagaccccaatgagccaaaacacaggagtgccttagggagcagcaggtggtccaatgtgctcctgccctggacagggagggtggggatatggggaattcaaactggaaagttaggatgaggtaaaatgaatcatctaaggcattaggcatttttagtctgtatattgctgggccctgggatgtggtcagaaagagaattctcctagtgataacttcttaacttcacctagtaggcaataaagaactacaagaaaatttaaaactaccatttataaagtaacttctatgtgccagatatgtgtcctattgtaatcttcatagccactttgcagtatggatatcatgaacccctagatgaagcaagaacccaaaactcagactcgcacaggcagtgagagtgccagggtttgaacctggtctccctggattgttctgtttctgttcattgcaaacagggtcagcgctttatggagatgatactggcatagagtggagagagatcaggtgcacagagacaggtcatgaggctcttaaaatagtccaatcacaaggcaaatgaggacccagtggccaaagacaatgacaggggtcaagtttctggaatcaacaggaatttctaggcatcactccagggtaagaaaccatctcatcacagactttttctccaagaggaacctagtcttgaaacaaatcagactttttattcctcagggtaagagttctctaatgaaatcagactgtcaacagatgcaatttctagctgattcataagggcagattttcattctgaaaatttccaaagccaccatttaacatggcaagggtttatgaggacatattagtcaacttgagtgtttttagtctctatattactgggctctgggatgtggtcagaaagagaattctcctggtattaccaatatggcacgttattgaaggcacctttctcagaactgtggaaattctgagagcttgtatgtcccttgatcatctttctttcattctaggaattctgtgatcaaatctttatcctctagactcaaaaataattctttaaaaaaacagtgtggaaacccattgagataatgtgtttgtgtaattatccattcttgtaaagacaactgcccacaatggaatttcccatcttcacctttgtcagtcaaacacaaaatgtttaacccttcacatttaatctttcaacttcttgagatcccaaagtattattgctactgttacttcattcatcttcaagacatgtcttgaggctgtaagggctttcctaaacattgggagctcttcataagacagttgctactttccttaaaacagcatgccttaaataggcagtttgataaatcacctgtgcatatacttcattttagatgtgagaattgaaaaagaaaaaaattgacttcacaattctgcaccaaaagaatgagtttcacgaatgcgtcagttagaggtgctaatatagaacggttgctgagctctaaaactccactactccaccccactcccctgatagagaagtattcccagactggtttttgcctaaagccttgggtattctgaatacctctttgtgatttttttttctcttcctttttgagacagggtctcactctgtcactcaggctggagtgcagtggcgagatattggctcactgcaacctctgcctcccgggttcaagtgattctcctgcctcagcctccccaagtagctgggattacaggcacctgccaccacgcctggctaatttttgtatttttagtagagacggggtttcaccaagttggccaggctggtctcgaactcctgacctcaggtgatctgcccaccttggcctcccaaagcactgggattacaggcatgagccaccgcacccagtcctctttgtgacttttttgttggagtcattcttctgcgagctatggatatcatcaaggcaggcagtccctcaacgtggcagctgttcccacccttccctgctcctcttcttgcccaaggatgagcagaaactttacagaaaaagagagaattccctcaggaaatgaggcatgttgcttgaggtcacagggaatagaattagcaggaaaataaaccttgcaggaagcagaaagtgggccaaagcactgaggagaggacacggggagggcgtgagtttttgacagatttctctctgtaaaatgaggaggtcacccagggatcttgaaactcccttccagttccttcactctatgtcaaggattccagaaaggaaataaaataagctctgcttaaaaggcattttcaagctggggaactttgggatgaaaaagtttcccaaatgaagacatactggcacggtcagggttgagcgacttttgtgtatcaatgcacccaagcctgatgtctcattgtgggttatttccagctctgaagaagtactgcctggcagccagcatgacccactgcttctgtaattgctgcagttgcaggtgtcaacgcaaaaactccactcactcaattctcaaaatctatccaatatctctcatgccccttttcaatactataggaaatgtaaaaatgagcgacatagtcctgatccttaagagagtcataagttggtgaggaggagaaaggcatagatatagtcatggtaacacaagtcatatgtggtaagatctactgagcatggggctatcagagaaagcttcatgagggtgacatggaaagggagccctgagggactggtaaatttccatcagtgacattccagggagagaggccccaagacacaggggcagcaggtggtccactgtgctcctgccctggacagggagggcggggtcctctgctgtttgtttgcttgtgtaggaattttcccctcaaacaatgtccttgtctcccatgggagaagttttacatgagtgggaacctgtttctcttctctatcccaggccattccctgagagaagagaaaggggaatcttttttttttttggacagtttcgctctgtcgcccaggctagagcacagtggtgcaatctcaactcactgcaaccttcagctcctgggttcaagtgattctcctgcctctgtctcctgagtagctgggattacaggtgtgcaccaccatgcctggctccttttttgtaattttagtagagagggggtttttgctatgttgcgtaggctggtcttgaactccgagcctcaagccatccatctgcatgggccttccaaagtgctgggattacaggcatgagccactgtgcccagctgaaaagagaatcttaattcagttgattacttctaaaagttataagaccttcttcactgaaagagttcacatagaagctgaacttgaatccagccctcttaaatttcagttcaatattccctgcacatctgcacatctttacatgaattctcagtgatattccttcatccatccattcatgcatgaggattacagagatgaagaaagttccagctcttatcctcttgtgctcacagtttaacacgggagatgaaactgctgctgaatggctcccattctgaagtcagccaacagtgtttgccaatagcccccactgaataccccaccatattctcaagtaactcactcatttaggggaaaacaataatataattgtctctagaaattttaggtattctccactctaagattactcagtgttttgactgatctcaaggcgactccgtggtttgcttctgtcaaaaagaaaacacagttcccactgggaaatgtgtggagagtaatggttcaaaacgccagctgtacattagtgtatatccaggatgctttaaaaagtgatggccaagactcataagatgaattaagcggactctctggggaacagaaccgaacatcacaataccttcccttccagttccttgaatacttccaaatcgcacttaggattgaaactcaccaaattagagagatggaataatgatttccatggttggtctgattcactaggaacaggtatgctcaagcagtacttctcaacctttaatgcatttggaaatcatccagggatcttgtcacggagcaaattctgactcgggaggtcaggggttaccgcctaagattctggtgcaaacaggttccacaggaggcctatgttgtgggtgcatgaaccccattttgagtaacaaggctatcaagtcagagaataaatacgcattgcttttacccacacagaacttgcgactgaaatgagaaaataggctgagtgtgatagctcatgcctgtaatacctgcactttgggaggccaaggcaggaggatcccatgagcccaggagttcaaaaccagcctgggcaacatagtgagactctgcctcttaaaaaaaaattagaaaaagggaaaaccaatctgggaaagatcaaatattgatcaaacattgcaaataatgccataaatgatcagaatagggagagtaacatgctacctggagaactagaaaaaaaattctcagagaaggtggccctgggacctcctggctctgaatggtggttctgaatatcaggagaggggctggagaatggtgttttctagtgatgctgctggagtcgtgtacatggaccgtgttccatgagtagtgagctgaccaattagagagatgaggggtttgccaggacaactacataatgagccatatttcaacatacatgcagttttgtgtgtgtgtgccaagcaaatgagtctcagattctcggacaaaaacgaatacttttgctcagacagacagcatgtgagtgcttctcccccagcttcaaccctgcagtgtctacaggtgtcattggtccccggtagacgtcctcggttcaatgggtcactgatcacttatcaccagcaccacatgaccctggatggcagccaaagagttcctgggtcttgtttccctacctccacatttttttcctgacccagcccgagccacgtgcacaccacagggctggagtcccagtgcttttgtcctgacagcccattctcccactcccacacccaaccagttccccggggggtttttgaccagcagctccgcctgcagccctcgacccggatccaggcatcctgcttaaggaggggttcaggtggcaggaaactccagggcaacaaagtgtgggtggcatgggtggggttgaccggaaggtcactgtgctgggaggaagaggaacgggtggagggaaggcaagatacggatcaggagtattgacatcctgtgccagtagaggggcctgccccatggtggaaggtgtggccggatgagctcgctggcccatgtccccccgtttcccaggctttttcctcccacgctgtatgcagtgcaagaacaagctggtgcaattggactagcagcaattgagtccttttacccaaaagaagaagaaagagcaatgtttcaaaagaataaaaaggaagctgcagccaggtgcagtggctcattcctgtaatcccagcactttggggggccaagaggggaggatccctggagcccaggagtttgagaccagcctgggcaacatagtgagaccccacctctattttttaaaatgataattaattttaaataaggaagtttgtgaaagccattggtttctttattctaaagagcgtggaaaataggacagtctccaacaggccctgatttcctttggtaagaaaatgagcaaagctatagactaggaaacatgactggttaaagccggcccatgcaccaactccgatactgatagttatgtttcctttcgttcttatttgcttcaagctttgatccagaaaacatttgaacactagctagaaccaccacagtgaatatccattgcctaaatgctatctttcaggtattatgttcagacatagtattactttggttaattctcaaaataaagtaggtcatatgattatccccattttctgcctggtgaactgtggttaaatgggcttacagagattaaatgggttgcctgatgtagcccaacgaggaaggggctaggataggaagcaggcgctctcattccagaacctgccttttttcctcctgtctaaactgctgctaaaggtcaaagacaaaggtgccatgtgagcagggaagttatttttgttttttacaaaggtgaagtaataggctgtgagtaatgcccactgctccttcagccccaggtacatgcagtgaggcggtacccacagagccgcgtggcactcctcaacctgctagagcagccggcctcctgcaggatggcttaaggaccacctggtccttggggtctgggttctccgggtcctgctgttccctgcagccttccttctacccccagagcagcttgggggcatctttagagaaagcggcagtgtcgcacctgccccagcagccacaaaacagaggaaattctgagcacctccgggcgtgagtcaccataccacattcaggaattgccacctctgcccacagaatcacccactcttttctgtttgggaccaaaatagatacctccttcagaagccgctgctttctgtactctcagcaataaaaaaacaaaggctaggataggtgtgtgcctctgaggcgtgagggggggcgcgttttctcccctgggaaggttttcagagagaagttgttgctacagcagtacaggcagctgatgggttgagggtacaggaggaagagggaaagtcagggagattggagacaacctcttgtgtggtaggacttccggctattggtttgttcattcctttgttcattcattcattcagcaaatgttcattgaggaactgctatgtgtcaggcacagggtttgagacacagagatgaataagagcccatccttgacctctgcacagacaattatgacacaggctaagtgctgagatacaagtttaaagaaggagtcgatggaacacacagatcgatgttcattacccctgcaaaacccagcacatctcacatcagggactgcctcattcacatcatgttagatgtgacagagaggacagcagagagcgttgttttgtcatcaactactaaaattattaaaaccaaacaccactaattttgaacttcaggtagacagaggatgtagagttttcctttgctcaagaaattcctttacagagaaaatgggaacatttcaagtgggagtatttcaattcctttaataacaacctgttttctagctcccacattccccaagtattctagaagcacctttcataatggacagctctgaccaactgccccacacacatgcatgtgaaccgttctccaatcctaaaagtctgtgacttctccaaggaaaggaggaaggaatcgtattagtccagtttacattattatatactttgtagcaaagcagcaatgtttccttaaaaaattctatatatatatatatatatatatatatatatatatatatatatatagctgggcatgatggctcacgtctgtaatcccagcactttgggaggctgaggcgggcagatcacctgaggtcaggagttcgagaacagctgaccaacatggtgaaaccccgtctctactaaaaatacaaaagttagccaggtgtggtggcacatgcctgtaatcccagctactcagggaggctgaggcaggagaatcccctgaacctggaggctgaggttgcagtgagccgagattgagccactgcactccagcctgggtgacagagggaaactccgtctcaaaaaaaaaaagaaaaaaaaaaatatatatatatatatttgtgtgtattttctcctcatgaaatgagctccttgaagcaaatcggcccatcttttcagagaaagatcagtttattacgtcaccaagtaaagggcaaaggaatcatttctaaaagtttcgtttgaagtccccggagttaaagttgacgtcagcctcttcctgccctggtgccccgagagtttcccgggagttttggggatgacacccggctgcatgcgtgacatctcgctggctgggggcaggcctggtggcttccccgacaatgaaaccaggcagagcctgcaacccagctgagcaccagtgtggtctctgcttccggtccttgtggtagcacctctgtttacagcctgatttagaacaaaaagaacttttgtaaaggagaaaactccttatattaaatggaaagcaaaacaaacaattaccaaaaaaaaaaaaaagttggaggggtgtttcagaataaaagagccgtctctccagacatctgtctgacgcccaggtggcgctgagaccacagggtgagccttttggctggagatgttgatccctggtttactgcacttcgggctttcactacctttcacccaccggaccatcagtttcactttccctctcccagcgtctctcaagctctgcttctctggccccgttttcaatctagtgcaagaggacctgtagccagggcacccatcctcctcctcctcgtcctgcactgggatcccagctctgagcactcccgggccagggaggccttgctgcgtgctctgcttctgtgatcttacagattcctcatggccaccataggagatggggactgttagcactattcccccaccccaaccaccttttttttgagacagagtctcactctgttgcccagactggagtgcagtggtatgatctcggctcactgcaacctctgcctcccgggttcaagagattctcatgcctcagcctccccagtagctgggattacaggcatgccccatcgccatgcctgactaatttttgtatttttagtagagacaggttagtagagaccatgttggccaggctggtctcaaactcctgacctcaattgatccaccagtctcagcctcccaaagtgctgggattacaggcttgagccaccacgccctgccaccattcccattttacggatgaggaaactgagaccatgaggcagtaattcactctcccaagaaagcaaggagccagtagatctgagcagaacccatgcattcaggccgacacaggaagcaagctgtcaacaggcactgttcatctcctgggcttcctaggcaggccctgaagctctggttttcagtcaccctgttattcatccccaagttaatctcccctgaaagcacctgtcgtgatgccctttcggctgcaagagctccagtcatttccattgcctcaggggcactttgctacctcctctgcctggcacacaacatgctccccagccaagactgttccctcagcacatagcacgccttggccagcaggtctcctcctgtccttcaaagggaacctcctcatttgtgatttcaaagctggactcccaggaacaccctcctcccttactggaacaatcttccccatcttgtctgcctaccggaatttttcccaaccagaaaagcgtcttgagagaatggaaaagtcttatgaatttggaaagttgacagcttgaattcaaatcctagcttgaacttgtgaatttctactttcctttacgaaaacctttgcatgccattctgtgcaggcactagcaaggtggtgggagggagatggatacagtagggtgagtgccgtgtaaagaaaagggagcaaagtctgggactgcagagaaatgccacaaagcacagacagaagagtcccggaggcttcccagagaaagatgacagccaatgggagacctccagggaaagcaggagttaagaaggtagaaatgcattagggaagtgtggcatgagcatgatggtcaatttcaatgtgtccacttgcctgggctaagggatgcccagatagctggctaaacagtctctctgggggtgtctgtgagggtatttccaggagacactagcatttgaattgaatagactgggtaaatttcttgttggtagactgagtaaagaaaatcaccctcaccagtgtggtggggatcatccaaccttagaggaccagaatagaacaagaaggcagaggaaggttgcattctctctgttcaagctgggacatccgtcgtctgctcttggacatttgcactcctggttctccagcttttggactctgggacttacagcagggcccctctgctcctcaggccttcagtcttagactgagccacaccaccagctttcctagttatccagctccagctggcatattgtgggacttctcagcctccataattgagtgagccaactcccattataaatattctcttatttatctacatacatcctattggttttgtttctctagagaaattctgtttccctgaataatacaatgaccaaggcccaagacaaaacacatggtgagctccaagagccacgcagagtcccgcaaggcaggagagctcaggcacatagtggaagcagagattttgaagttgggcatgagctgtgtcttggagtctccccatgtcactgggcttaaactgtgtcctggaaggaacagaacatcccagaggggtctcagtcagggcatggcttgtactttggagagacagcattgggtttatgtgaagaatgaaggaagaagagaaagcactgggtttatgtgaagaatgaagggaagcagaaaggcaaacccatagggcattgagtaacctccatggaagtccatgagggtagggttttaacctcggtgggcctcagcttctgttcgtataaaatgggaataacacagaccctgctgggtgctgtaaggctacataagctagcctgcctagagtgaccagagcacacagtaggtgctcactaaatgtgacttgctgggcttctagtctgcatggccaaaggcccttccctcggacctttccgtgtggatgcctcacaggctgctcagtctacacatccagaactgtcctccctccctggaacctactctttctcctctctttgctatctcaatgaatggcaccccatcctccccatcgcccaggaaatctgggcaaaatcctcatttcttccttgctgtcctccatgcacctaataatccagcctcaatttttggcaattccaacttctaaaatctcttaacgccagcaacccctcttcttgcttacttatcaccacccacctcaggactcccatgacagccttcctgtgatgcatgacgggcacatgacaagggcagttgagggtcaggggccacgggagcaggatgcagccagcacatgagggaggataggcgggaggacaggcagacacttgtgcgtaagagcacgcacttgtcaggctgcctgggtccaagtcctagctccaccactgaggggctgtgtgtctctgggcaagtcactgggcctctctgtgccttagttcctgcctctagagaacggagatgagaagaacacatcacctcataattaattactgcataagtaataattttaattatattgactattatactctattagtgtatgatgtcttttattatatatatttatcatataatatactaattatattaatgagtatactatagtattttatataacataccctaattgcttattatatatctgtataattattttatcatataagataatttcataagctaagatggtattttatatatttcatttattatatatttatatttatatactttattgtatttgaattgtgatgtctaataaaataatagatatgttaattatccttcatattcataataagctccttcattggtgtctgggaagccgagaacatttgtgcgtgtgagctctcctgtgtgttcggcatgcagtgtgttgcgtctcagctgacgtgattgctgtttttggtggcccggaggcacagggtgcatgctacaggcaggaagagctttggagcaggctgactcctgagctctcctctggtgccgtggcttctgaggcccccaggtgacaaccagcctttgccattctagtgtttcctctatgttcatcccgcgttctgagtgtggcacaggccacactcctgaccccaccagcatcaggtgctgtgcacatggtatgaggtcgggatggagtgctgttggcatgggggttgttccttgggctacctgtgtccacatggtctgattaaccccttctgcacatcagcaagggttcagcacctcctcagggttagggcatgcgcagggcatgcagggatttgagggtccttggacaatgcatgttctccatgcaagcatgcagagacatggagagggtctttgtccctttcagtcctaacattctgtggcttcataactacttgtcccacacccgagtaaaaagcaggatcttctcagcactgtgctgaggaagtctttaaaccttccagtaggacatgggatccctgcctgcatcttaagttcccatgtccttaggaaacgtggccaccttggaattcagctctccaagaagcccagtgtgaatgcccattgcaggagcatctgagctcacccccactaaccctgaggtatctgttgaaaagaatagaacccacccactgaaactatcagagatcaaatgttgtgtgttgactaagaatttgtgttaaggcagggatagttgagcaccaatgctttcaaggaactctggagaaatgcaagcctgtatttcctctcagcatggctgcagaagagggccagggcagcagacaggcattttgacccactcacagatgaatacaaagactaaactcagcaaaagccttgaggttgcatttatgtgtctgagaacagtccctggagcacaggcatgggcttttggtaccacgtaacctacaaccgtaagctctctgctctatgctgtccactccatcaatcccacagtgcctgaaatgtcattgtcttacccgatgtctggggtagcatctgtgaacacacggatttgacacttttatgatgctgtttgtctctactgaacccttcttaagcaaaatcacagtagactagcagatcatggtagtatctgaaagcgccaggaccccagaacctcaatcagtgctccccacttcccatggttttctccctgtgtttccacatttggattgtcattgtctgtgaaaaggcatgatccctgtcaacaacacacagtgtatgcaatgtgtgtcttgtgtaaaacggagtgtgaattcttgagagcaggaaggaaaaggggtacaagaggttcccctgcgagatgggtgaggagcagggcagagtgagcctggctgctgggaacccctgaggagagctctggagagggttctggacacgtgggcttggtcagcctgacaattaggatttgtgttaacaggaccggccctcacctgacaccaactggactgaggttcccaggagaaacacttagcatcatgactttggaggttgccatcatttttgatgactttttctttttccttcttttctgtttccctcttgtcaagtttctacctgtaagttatacttacttattttgtgtttctttacagtctcaggggaaattccgttgagttgaaaatttcctcagctcctcgctccagtttctcagaagagtctctctccttgcagaaaagactgtgggtgggagtcaccaatttagcatatttctactaaaaatatgactccatcccaagaaattggttttaaagatttgaggaaaaactgcttttagatttcagagaaagaaaaagagtgtgtttctacttcccccttttaaatctgataacttttattttaatcaggttgacattctgtggtgagcttgtggttaactctttcatgcccggaagcctgttgtcgaccgagaagactcccaggattagaacataaccagcgcccaacatttcatttgcagaagcatctgaggtcccaaaatgtgatggtttagcggcagctgcttgtaggggtatttttggtttcctgcttcttttttcccttctaagtaaagacaaaataactagatccctccaccccaccaccccatcatttcgttgttgtttaacaagtgttgagtaaggcacagttgttctccaaaagggtcttaccctgtgagttactcattttagggttacggaaactctgactatttgacccagtcaaccaggcctcagaaactgtgggtcagataacaaataactcatggtgcttctgtgctaattactgcagagatgtgtccaagtgctcggagatctcctccttgaagccaaggtctcctccttgaaccacaccgccttcttctcctgtcccgagggaatcaggcaacttttctttgatgacagcaacttccttaaatcccccaagccctgagacaggcactttacttctcccacatttccttcaacatttgtgcttgctgaatgaaacaaggaaggtgaatgtttgcttgaatgaaccaatcaatgggtaacagcaccagtgctaatgctaatacactcaactactcattcagaacctaccatggcccaaggcttgtgctctgctcttgggtgctgatccagcaaagagtgggtggagggggagtgggaggtgaagtccctataccaccacttatattttgcactgtcttattttttcctctggtcacatgcatacataaattttatatctctgtaattatgccatttaaaaatcttcctactgaggtagaagttgggactcaacccccgaggcagggctcagacatcggacaaaattgaggactagcaaaaacaggattggggcagaagcagctttccataagacatgctcatgagtgtgccatgtcagtttaccattgccatggcaacacccaggcgttcctgctcctttccatagcagtgaccggatgacccaaaagttactaccccttccctagaaatttctgcaaactgccccttaaactgcatgtaattaaaagcagatataaatatgaatgcaaaactgccctgacctactactctctgcctatgtggtcgccctgctctacagaagcagtcacggagctgtagcacagccggaactataacattgccacttcaataaagctgttttcttttattctaccactggcttgcccctgaattccttcctgggcaaagccaagaacccttgcgggctaagccccacctcggggctcgcttgtcctgcatcactaccaccttctctaggaagatgctctaggcttaatcattgtgttgaattcagctgctgaggactgagaggtgatttggatgattgacttcataaataaaattgggagttagactttccccgctgtggacttgccactgagttgggggagaggggggtttctttctctgataaagttccacatccacagacagaaggaaaaggccctgaactaatcacttcctttggaagaagctttggtaaagaattaacatttgggaggttgtcaagaaaaacctatttgttctataaatatttaaaaattattaaaatttcaaccaatacagaaaaacacaaagattaatataaccaacatgtgcccatcatcaggattcagtaaatgtttacagtttaccttggttgtttcatgtcctttttgtttattttaaatacatgctcttgtcgtgcgtgatggctgatgcctgtaatcccagcaccttgggaggccgaggcaggtagatcacctgaggtcaggagttcaagactagcctggccaacatggtgaaaccccatttctactaaaaatacaaaaattagcctgatgtgatgcaggcgcttgtaatcccagcttcttggggggctgaggcaggagaatcacttaaaccttggaggcagaggttgcagtgagcccagatctcgccattgcactgcagcctgggtgacagagcaagactccatctcaaaaaaaaacaaaacaaacacaaacaaaaacaaataaatacatgctgtagatacagtggagctccctctcggtccaacccaatctcattcttcccctccagtaattgttctcttgaatctgggctgtatctcatgatgcaatatacactactggtttgttttttattttatacataaatgcataatatactgtttctatttgcaactttgcttttttcactcagcagtgtttctgagattcatttttgatgtttattctttttaacaactgtacattattacattgtataataatacagagttcttgataatgccaagtttattaatctaaccttcttttgatggacaattagattgtatctgatttttccctattacaagcaatgctctaataaacagccttgaatgtgtgcacatatgcaagaatttctctaggaatatacctagaagtgagatcactgatcctagaacatggacagcttcaattttactgctatatttaaaatgttctctttgaaatcgctatgctaatttataatcctcatcagcaatttatgaaatttcctgaattcctcacatattcctcatcatcacttaccatagggaaattttaacattttttgccaatctgataatataaaataaaatctcattactatcttaagtttcattgatacctggtgatattgagaatgcttccacatgtttttttggtcatctctgtggcctccttgttcatatcctttgtccctatttttattgggttgttggcctttaacttattgatttgtaagtcttccttatgtattacggatactgagtctttggataagtatagattcttggatcttctaagtagacgttattacttataaatgacaattttattttttgttatccacttcttattcctctaatttcttttgcttgttccattgcattagctggggtgttcaatacagtatagaataaaagcaggaattgtatatgtttccaccattaaatagaaggcttttaaggtatcacgtacatgttattttctgtaagctttcagtgtctactgtctattggttaaataagtttctttttatttctactaccttaaaagttttttttcttttaatcaataatggatattcttttcatcatcattagatgctcttcttcatctattaaaatgattgtgtaggttttcttcctttataccataaaagtatttaagtacattgagagattttctaacgttaaaccattcactattgctgggataaactctgactgatcagaatttttttttttttttttttttttttttgcttaatacattgctagcatcaggtgcaaatgtgttaacattctccagtttgactgtagaattaatttctttttgtaattcttcaccttatcaaccatatgtattgttgagtgtatacatgttcaagattatcataacttccagaataatttttatttgtgaaaatgcctttttgatctagtttctcttatgttattgtagctatggagctttcttatatctggctaccttatcaacaatatgtattgttgagtgtttacagggtcaagattattataacttccacagtgatatttatctgtgaaaatacttttttggtctagtttctcctgttactaaagctatcgagctttcttttggttgctaaatatctgcatataatgtgttttccagccctttagttcaaccttcacatgtcactgtattttaaagacgtctcttgacataacaaaaatagaccttgtgcaggactttgggggaaatttttccccctcaatcagaatacctctgtcttttacaagcaagcttaattgatttatatttattgtactacatttggacttatttatgctattttactttgaacttttattaaccattatttttcttttactgttgtatttatcttttcttgtcttctgttaaattgattgagtttcctttattttctcttttccttctactggtttgtgtattatatgttttaattctacttttagaattaagtcaccattggccgggcgcagtggctcccccctgtaatcccagcattttgggaggccgaggcgggtggatcacgaggtcaggagattgagaccatcctggctaacacagtgaaaccccgtctctactaaaaatacaaaaaaattagctgggcgtgatcgtgggcgcctgcagtcccagctactcgggagactgaggcagaatggcctgaacccgagaggcggagcttgcagtgagccaagattgcaccactgcactccagcctgggagacaaagcgagactccgtctcaaaaaaaaaaaaaaaaaaagaattaactcaccctttaagttctcaaagtactcgtgatgttaaaagtccacagttaattaacatctctcccagttccaggatcttctgttcagaacttagcacatttctggcaactaaggattgacaactgttaaaaaatatcatttcccattatatttttggattggttgttgctgatatataaaaaatgttgaattttataaatgaattttctatctggccaccttatgaaactcttaatagttctaatactttaaccgtcttgggttttctaagtacttaattaaattcctcacatagaatgattatttttatcttctctttttccaacaattgtatgccttatctatgttaccagttttatcagatcactaataacgagggttcttttaaagtcaattggagtgagaaaaacccaaagatgccattaagtccttgagtgtctttggggaagaaaaggtaggtttaggaaaagagagacaaaaggcaaagtgaacaactaagacaataccatgtatcgcaaatttaggtgtgatttaatgatggctaagaaaaaattctaaattatatataaaagtgtattcgtatataaggtagtttaaataaataacaggtaatgtgggcaggcaacaaccatcaaaaatgactggaaatattcaaattcaaccatggtgatttggttggcagcaatcagagaattgactatgcttcagtagattgaaatccgttataatctattaatgtgaatacaggtgacaggaaacaaccgaatacagcattctcataaatagttcttagaatatgaattcaaaagaaactctatttcctcgttgtgacacaatcaagctttaagcaatgaacgctttaattattgtttttcagcttagaaagtaactatatattttatcattgggttctaaaaacaacaccgctcaagaggtcattgtagcaacaatcaaaatttgtggagcattttacagatttcaatgtcacttatgttatttcaactgatcctcatatttccatccttcataccctcacgattcatgcttcagcaaaacattctacctgtagtctcttgtatcttccatatgatgatgctgttttacacttttacacattctctgccagaatggcctgacgtgcctaacctgccagttgaactcccacccacctttcaggcaccttatagttaagagcagccttcattctgttgcctggctcatgggcaggggcaggattcccagcaaggggtactatgtcaagaggcctaaaaggacatatcagcatggtaaaaggaaatggcttggggtgtatgagaagctcctatggttacatgattgggaggaattcttttcatttcgtgttacagacggagcatctgaaatgagaagggaccacagtgagccagtgagtgaaagaggaggaagattctgacacccagagctttaccttcaacatttccttctgtttattccttatctagacttccattttcctaccccatagatacccactctttgcccctaacttgccttcaactcctctactgccttgtaaatgtcccatgtgtgcttgaaaaaagagtgggctctgctattgttggaatcaaatttgttaattgtggttatcacatttgattgttcttactgattttctgtctgtcctatccatcataaaggaagacactgttaaaatttctcattatgatagtagatttctaaatttatccttgttttgtcaatatttgctttgtgtattttgaagttatgttattgggtgcatagaagtacgtaagtgttatgttttcctgattcttgatttgtatattttgaagtgatgtttttgagtgcatacacatatagcatttttatgttttcctggtgaattgaatctttagcaatacgtactgacttctgtatttctattaatgcttctgccttgaagtctgatgttaatataactccttggattcaattgtccattcttttagtttcaaacttttggagcatttatgctttaagcatgtctcttataaacatcatataactgcatatttttaaaaatatatgcagtccaacattctgtaactgcagggttaatctatccacattgataattattactgatatagtttgatgaatttccactgtcttattttgttctttattttttaccttctctttctatgcatttcccccttcttttgatttaagtaagtttttatcctattttattttcttccaatagcttgtaagttattcactttactctgtcattttagatgtaatttttaacatcttaacatgaatccagactttacaaagcctagatttaaccaatatcatagccttcctctcaaataataaataaccttagaacaaattgcctccacaaaccttttctacacagttccctcctcttcctccttgcttctttgtgcgcatttatgtttgctatttgaaagaatttcctgaaagtaaaagtgagattttttagaaggctgacatgagggcagcaatagtagactttcacgtgactcctgtcccaccaccttgagctgtgtggtttagccaacttacttaatctctctgaacctcaatctcttgctttctaaagtggggatgacagtatctaccttccagagccatggtgagcattgaaggtaatatatgcaaagaagcagcacataggcagggctcagacatcatagttattattatatagataaccccaaatggagggcctgggccctctgacttcttcaaagataataatctgaactaaaccacaacatcacacaaacacctcccagcacccagatagtttagacatagctccacctctttgtaagagataaccttcaacagataggtgaaaagcacgctccttcctgaagattatgattctgggtgttggaaaagcactgaactaggagtcagggaacctggtgatctgttgtaatccaaggcttgccacaaacttgtggaatgaccacaggcccagtgttcttatctataaaatgtagaggttggcctaaatgatctttgagctctcttctagttctcatattctatgataccattaaaagggatgttctacatcccttttgcacccaaaccacttactttctatacggcctaaacttctggtttgggtttcccaaggaagcgagagacaaccttcaatattaggcatatctttggagttcttattaaacagtaaacctcatctcactatcaaagatagcctctggctccagcgtcctctttccagtctcccacagagatttcctctgggagtcaacgagcttaaggtgaaatttggctaggggtctgggaggaattcttttcatttcatattacagacagagcatttgaaatgagaaggggccacaggggggcagtgagcggaacaagaggaagattcgggtctctgacacccagaatctatctgattctgacacagaagatgaaccgcgttagagcaagaaccagatccctctttacccagtggcccaagctcttgatgcgtacctgtgtcccttgtaaagctcagtgaaatcatcacctagacatttcctgtgctccgtgcgttattctaatcttcactgggtacaagtagagcttaaagttctgatatatggacaggaaagagaagagggatgaagcctttatccagggctggctgggctaagagtaaaacaacttcacctggattcacccaaggggcagagaatcttatctcagactcggtccacatctttatcagcccccttttccctttatctttcatgttgctcacatgggctccaggggccagatgagttttctcttactttgaacatcagagaaaaaaaataacgacaaaaagttactcaaccgacaaacgtttctcacccacacacctttcctccagtcaatgacgtttccactgcaccctgttagacgctgagtgaggaagcatctgggcacaaaccgctgtggatgcagattgagcagcactcactgtgcactggagggatgggagtcctgtcctcaccaagggggcagatggagagggggcagagagagcagccggggcttcactccctggaaactctcatactccaagtgcggcctggggctctgcagccccagcatcatgtaggagcttgttagaaatagcctcaatgtccacacctgccctgacaaatcccagtctgcaagatcccgggggctctgcacacacgctgctgcgaacaacctcagcatccgtcctgccggctctagagcagccaaccgggatatccttcttcttcagcagtggtgtccgctctctaaaatgactgtcccccacatctctttccagggttggtatttctggttaactcaagggacacaaaaatagctcagggaaaaattaattttcattctactccaattctaataatgaagtggtaaaaattaaagggacagctttcagattatgggagtgcagctgcgggtatgtggcaaaatcgaagaaagagggctcataattccacgtcagggaagagctgctggcctgcccaggctgctgtttatctttactgtgaatggggcctcttttttgtttgtttgttttgttttgttttcacttaacctcagtggcaagaaaaatggggcctcttgccaggaggagcagagagtgacgcggaaggcaaagaccacctcatttcaccaagttcctcgtcttttatttgaaatccaagacatagaagctgcacatttgtccttctgggaagagtgacgagtgactgagagtggagtcgaacactcgaaaggagagagcaggtgcctgggagtcagaaaagctggcttgaattcctaaatctgtcgccgtttgtcctgggtgaggtcattctggtcatctgtggcaggaggactacaaatgcctggcttttccctttctagcgggcacacaaagagacagagaagttgaatctttagcaatccattgaaggggaaaccccacaatgcaaagagaagcattgtcgagggcccttcacctgcaccctctgttctcccagacctgttccatgatgcattccagaggaggtggctctccgtcactgtcacttgcgattgccaaggcgtcagccagacaaggcaaaagctcccaaggggtgttacccttcagctgcatacagaactcctagaggcaacaaatccacaaggaaagatacacccatgatcgtgtatttcagccacaatgatggaggtgaggtggaaaaggacgaggaacaagtgggattctgcccatgtctgtctaatgagcatccacagcaaactccaacggaagatgtgaaacacgctcaacactagaagaactcggtttgactctgtcttggtgtgggtcccaggccaaagccctcggcattttcaggattaatgatcactgctggctgtctctttttccctctgcccacataaaaggcacaaaaactaaagaggaaggccacatcaccgcagagcccgtggttcaggattctcctcctgggagccccgatttcttttcttttctcaccttaacagtgtccagagtacttttattgccagaatagagatatagcctgctcagagcctcatgtgcggcccaccactcaggaacaaagggagagacagatactaagcatgtgtgcaacagagaaaatccagcccacgaaaccgtgtgcaagagcagctccgtcctgcctgaatgtggctttgggaagcccacctagaacttggcctggcgccagtcacccactcagagcctactgccatgaaggcaggccctcactctccatccctgcccacacagggagacccagggcaaacagaaagtcccctagcgggggcccaaggaacccctggctctctcagggtcccattcaagtttctgggctagtcttgcagactaaataccactcagttgcctggtgggagtaggtgctgggcagggtggacaggagccccactgcttctcagccctgtgccaacccctttgtgtgagaccctagtgcagggtggggagccccaatttctaagccttgagtgtttaccaccctacacccccacctccaactcccgaattgatcatctcaaattttcccacagtccataggcaccagacacttcaaataatctcagaaaagaaggtgatgtctacatccagaatcgtgccaatactttaaaattacagggagaaaaatattccccttcccctcttctaaggaaaattctgtctgcctcccaagctcccaggtcccttggtgtgagctgggggagtgcgtagagctaggaattggaaaatattccgggagagaatgatttatgttgagaagacccattgggagaagcaggaagtgggtctggaaagacaggaggaagtgtaaaggcagagaaaagcccttgttagctgaattttgagaagtaatttttggcattgttagtgagtaaaactagagaatgaggacagttgtatgctgtcttaaaaaataaaagaatgataatatagggaaagatgatttcaacattttggagtcatataagtggaatcctcctgttattactgtgcaagacttttagacaaattattttttattctttttttggatgttgttctgttgctgcttttataacactacactgagaagggctaaaaaaaaaatcccaaatttattcctattagattgaaaaagagcaaccctccagcgtacctttccacacactcttctacctcctgctgccttcaggtgatgtttggcacttcctgacaaggcctttcagggaaaaggattatagccaagctctttagtggttactgagctacagacctggaggtgtcaagatcctaaattccaggaaagattctttatgaaaggaaagtctgtgagaataagaagttctggaacttccccttgtccccgcatgacctcttcagacactcgggctaatttatgatgactctgaaaatgcccatgacctcatctagaaaaacgcactctcatggaattcaagagtttctaagggcacaaaatagcttccaagacaatttgtttccttcttttcaaattgatgtgtttagaaatgttcttggcttgtgattgacatctcagattccaaaaacatctgaggtcaatcctggttatttgtgctaatgaataattacaaaagagtagctaaatatgcttctcgctcattttgttgagctaaaattacttataaagaaatgcatagatctgcggcatacaatttgatgagttttgacaaatgtgtacagctgcaaaaacgttttcatcacttctgccttctggtcaatacccacctaccacaagaaaccactgtctgctttctatctctggatataacttttgtctttttgtgaacttcatataaatgaaagcaaagtgtatgcactatttcgtgtttagcttattttgttcaacataacatttttgagatttatcaatattgcctgtatcaatagttcattattttttatttttgaatggtttctatagtatgactatatcataagctacttgtctgttctcccaatgatggatgtttgaattattgagttggttattattaataaagctactatgtactagaatggaaggggcttaataaaagaaagaagttactataaatattttataaaagtctttctgtagacacatcccttcattcctcttagataaatacctagaagtagaattgctgaattgtagggcaggtatatatttaacgtcaataaaaatactttctttttttgttttttttttgttgttgtttgtttgtttctttgtttgtttttgagacagagtctcactctgttgcccaggctggagggcagtggcgtgatctcagctcactgcaacctctgcctccttagtagagaaagggtttcgccatgttgaccgggctggtctcaaactcctgacttaaaatgatccacctgtctcagcctcctaaagtgctgagattacaggcgtgagccaccatgcctggccaaatactttcagatagtgttccaaagtaattacattacttacactgccaccagtaacataagagagttctggtagttctacttcctccccagtatttgacgtatcagtcttttatccatttcctccatttccccaatgggctatctcatcattgttttcaacttgcattttattgatatctgatgttaaatacactttcaagtgtttattgatagtcgtgtatcttctttggggaagtgattgttcaagtctttgcccatttattgggctgtttgccttttactcttgctttgtttttctttatatattctggacacaagtatttgtgacaaatatatatattgcaaatattttctctcagtctatcatttactttttcatttttttctttttttttttttgagatggagtctcgctctgtcacccaggctggagtgcagtgacgcgatctgggctcactgcaagctccacctcccaagttcacgccattctcctgcctcagcctccccagcaggtgggactacaggcgcacaccaccacacccggctaatttttttgtatttttagtagagacagggtttcaccgtgttagccaggatggtctccatctcctgaccttgtgatctgcccgccccggcctcccaaagtgctgggattacaggcgtgagccaccacaccctgcctactttttcattttcttaatgtctctggatgagtagacattctcaatttttttcttttatagtcagtgcttttgcatcctctatgagcaatctttgcctatctccaacttgcaaagtcatttgccttaattttcttctgaaatctttttagttttgccttttatggttacatctataagatatagacctagtacatagatctttatctttatatatataataaaattaattcttgcataagatgtgagtttttttctcatacatttatccatttgctccagaagcatttgtcgaaaagatttttcctttctcattgaatttccttggcacatttatttgtttaaaaaaaaagcagttgaacaaacatgagttgagtccatttcaggactttctgctctgtttcattactgtttgtccttatgctaatactacgctgccttgatttccatagttttatagaaagcctgaatatcagatgtcatgaatcctccaaatgtatacatctttacgattgtcttagatattctaggtcttttgtgtttctaaggagcttttagaaataacttccaaatttgtactaaaaaattgtgttggatttttaaactgtagttgccttgaattaattgatcaatttaaggtgaatagattttttaaatgaatgttacaatctataaagatagtatatttttccatttgcttaattcttttaaaatatgtctcagcaatatttcagagttttcagtttagtggtattacaagtttttggtagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcactcactctgtaacccaggctggggtgctcggctgactgcaacctccacctcccaggctcaagcaattctcctgcctcagcctcccaagtacctgggactacagacatgtgctgccacactcggctgatcttttgtatttttagtatagatgggatgtcaccatgctggccaggctggtctggaactcctgacctcagatgatccgcctgccttgtcgccccaaagtgctgggattacaggcatgagccaccacacccaattttacgggtctgtttctattgagcacttttttgagtaggtcaagtatgtcacattttcctgtttcttcacatgtctagattttcttttaatttgctggatattatgagctatacattataaagggtctagattatcttatggtcctttaaaaggtaatgcattttgctctgccaggcagttaaatgactagcgcatcctcttgtctattaggcttggttttaatctttgtaagggcaggtctattttggttttgaaattcatcctagggatgcctctttctctaaagcaggattggaaaactacaacccacagctcagacacctgtttttataaataaaacttagcataactcttcttctctcagccctcacaatggacaatcagggctaagtttcactgagttctgccctgttcaggttcagaccagctcttggctaagaacctgaggtggacccctatacataattttggggcgaccttcatgcagtgtcctctccagagccccaccccacaaatcccagtcatgtcacgtcaatgaaaccactctgcttgggttccacctgggtgctgccgggaaggaaagcaccccaggaaggaagccagggcaactgtgggcgcctctcacgtgtttccctcctccaaaatcatgtagccctgagctgcctgttgttcagcacctgaaagcacttgctgtatacatttggactggttttacagctgtttcagcagaaacgtaagttttggtcccagttactctgtgatggctggaagcagaagtcttcactggtttttctgattattatccatgtcttgctttagtaacagatttatcttctgatacttaaaatattggttggtgttgatccataataagtgccaacaaatggtaccagtgatatgagaagtacagagagacaaacttttgcaggagttaaaggttaaggtaaacttcagtccagtctctatctgaattaccattctcttcttctggacagtgagaaaaaggaaaggaacagaactaccatctattccatacctgttattttccaggctttcttcaagttaccttagtatattatttgctataatcattaaatcaataaaataataattattacagcacgaagctgagccttagagaagtaaaataataaaactatgtagcttgtaagctgctggagctagaagttagaaacccatctttctccttcccaccatgctgctgctcttgccttatcatgagattaccagcatttattgagcacttatgttgcctgttccactgtaatttctggcccatggagcccatttaaattgcttttgcttagtcccttgttggttagagatgggccaagctgtctgatttctccctatcttcgtttttttttttgagacagagtcttgctgggtttcccaggctggagtgcagtggcgtgatctcggcccactgcaacctctgcctcctgggttcaagtgattctcctgcctcagcctcccaagtaactgggaccacaggcacatgccaccacgcccggctaatttttttgtatttttagtagagactgtggttttcaccatgctggccaggctggttttgaactgctgacctcatgtgatctacccgccttggcctcccaaagtgctggaattacaggcatgagccattgcacccagcctccctaccttcagttcttaggggagacaggagagtcctgagccattggatggggatggtcttccggaggacaaggtgctgggcagagtctaagggcacagagaagcttcactcaacctgaatgaccaatacacaaccggccaacccacagccataagtacagccagcagccctgatcagcctccgtgtgggcttccattgacggagaggccacagactcctgctttcctgcctcttcctgtccctgtcatctccccgtccacttcctttatccagcatgtgatatttccccccaaaatctaatctcttagagcagagaacttgttgcaaagtaggcaatggaattatttttctgattagacctgtgccacttttccttttaatagtttgatgtttgaccactgcttctggtgcctttagtgagataccagagtccatttttcaggctgagggagggtaaggtcttcataatataagaaggtatttggtgaactcagaggtgggcaggtgggtgagaaatacacatttcctatttgccagacattgagtgaagcactttctgtatatttctcaaaaaatggcgcacagtcattaattatagaaagtctaacaactcgtatatccttaaaagtatcttgcacagacatattttgcccctcaattaaatgtacgtaactttgcttcttcctttcttcacattccttgaccctcctctctccatacttgcttgacatgaggcatattcggaataaaaccttgttaatttctactcatctagtttgaaatacattgtgctttggagaggagcttggttgtagttaatttttgagccagctctgatacaaagctttctaaagaacaatggtagcagccttagttgctttctcacaaaaagtagggcataccatcttttaaataaagtgaagaaatatgtgattaagtcattataggattaaatatgtgagtacttgcctggggcctcttgagttcctaataggcttcttttgctttgcagagctctgtgacgatgacccgccagagatcccacacgccacattcaaagccatggcctacaaggaaggaaccatgttgaactgtgaatgcaagagaggtttccgcagaataaaaagcgggtcactctatatgctctgtacaggaaactctagccactcgtcctgggacaaccaatgtcaatgcacaagctctggtaagtgtcccttctgtgactaccaagaacaaaagaactgcagcaaagagtgagacagagcccagcttttgttcactcagccctatagacacaaatgggccagtccagtctacaggataactaattttagtggttcctgaaaagtcattcactaaacacaattttttttttttttggagacagactctcactctgttgcctaggctggagtgcaatggcacgcgatctcggctcactgcaacttccgcctcctggcttcaagtgattctcctgcctcagcctcctgagtagctgggattacaggcaccctccaccatgcctggctaatttttgcatttttagtagagatggggtttcaccatgttggccaggctggtctcaaactcctgaccttgagtaatctgcccatctcagccacccaaaatgctgggattacaggcatgagtcacagtgcccggccacacaattttatttttatttttgagacagtctcgctctgttgcccaggctggggtgcggtggtacaatctcagatcactgcaacctccacctcctgggttcaagtgaatcttgtgccacagctgcccaagtagctgggactacaggtgtgcaccaccatgcctggctaatttttttatttttagcaaagatggggtttcgccatgttggccaggctggtctcgaactcctggcctcaagtgattctcctgcctgggccttataggcgcacaccaccatgcctggctaatattttgtattttttgttagtgatggggtttccccatgttgtccaggctggtcttaaactcctgggctcaagcagtcctcctgcctcagcctcccaatgtgctggaattataggtgtgagccaccacacctgacctagacaccctcttttatcctgagctggaatactgatcacccccctcactggggcactcagactcaactcctttgccaaactcttcacaatagagagggctgttctagaagtttccttgtcattgtgttaagatggcgtctctaacttcaagcattctgaacagccttagggagcaaaggatcagtgtgttgtggagtgagaccactcctgctgctgtcaaacaacacagagacaattgacagcaagcaaggagtcccttttggtgagagacacacacatgcacacataacatacatgacatacacagacacgtaacatacatggcatacacagacacgtaacatacatgacatgcacagacacgtatacacacgctcaaaaacatgtcgtgggcattgccatatgcacttgaatacccagaggccggtgctgggagggcatactctggtttcgtatttgtaagctcagcagccagacaccaccagacacatcgtgggccctggacaggtgtgcttctcaagtgaatgaatacatgaacagtgttttctatgaagcatttgtgaaattatctgcatcattccatctatattttctagccactcggaacacaacgaaacaagtgacacctcaacctgaagaacagaaagaaaggaaaaccacagaaatgcaaagtccaatgcagccagtggaccaagcgagccttccaggtgagagatgattctgtcctccagctaactcctgctagcgcacccttctcctgcaggcagatgatgtgtacccaaaggaagaaggtctgccctgccttctataaacacatgcatgtggctccgtcctcccaagacatcattgcagacaagaattagtgcagagttgctcagaggctgtttgctcagcaactaaagccaatctgacggcagccaatccaggtctgggcttactccctggtttggtaactggccaaatagaattcaacccaaattcaactcaacttaaaagcgtctgttgggtctgtgtgccaggccctgctgatagaagacacaaacaagagtgtgacaacgatccctgccctcaaggaaacgctctgcgtcttccccttaagcacaagacaacgcaccgcaaaaaaattacttgcttcccagtatttcttccagggcaaggttgtaaaatgtgcatgccacacttgtgagtctcaaaagctccagatgcgtgtgtcctggccagcagtctgtgcatgagtgggcactgtggctgtcccttgtctgccctctgctttcccatgactgaattgggattcagttatggtgtcaagaaaatgggctgggcgcagtggctcacgcctgtaatcccagcactgtgggagtctgaggcaggcagatcacttgaggtcaggagttcgagaccagcctggccaacatggtgaaaccttgtctctacaatcatacaaaaattaagctgggcatggtggtggatgcctgtagtcccagctactcaggaggccaaggcatgagaattgcttgaaatcaggaggtggaggttgcagtgagcagagattgcatcactgcactccagcctgagtgacagaggaagactctgtcccccctcaaaaaaacaaaacaaaaaagaaaaaaaacccacagaacctgctaggaagaattgagctttctaaggtcaggctagccttaggagacttcagagccctttgctgattttacaaccttacaaagaactgtatcagataccatcccatttgagcctggctatacaatgagtcaggaccaggaagggttacttcaacttactgaagaaactgagatgcacaaaagataaaaagatttggttaagctcacatagtagggctggaatcagacctcaggtctcccagattagatgaggaaactttctgctgattacttattttaaaagagtttgaatttacttacagcttccattattttattttttaaaacagactaatctaggggcacagttgcaacatgatgctcttactccttccccttccgactttgtcctggaatggtgtttccaagcacatttgtttgttttgttctactggctcccccatagtcaccctgcacagattattggaaggcttcaaagaggccaatgcttgttgtcctttctcgaaggctggctctgcctgagggatgtttcaaagattgtctcagtttgggtgttttcattggaaagaagcaaacccaattcaaacatgttcagacagttacgaattgtactggctgtcaaacaaccttttatcctgagaccaaaacacaagttcagtcgtgatgttcaaggtgccacatggcaggagccagcctgggacagggccacccagcttcctgctggggaagaggctctggaggatatttacagaggctctgttgggtatgcagggttggggagagtctggaagttcagagcacgtgcgcagtttcacaggctggggttagagggcacatacaattccatatgtccaggttgggggctgtgggtggggaattcagagatttaatcagaacaagacatggtctcaggccacaggtccgtcaggcctgggatgtagttgggtgagtggaaagttctggggatgggaaattttgagacgtcttgaaagggcgcatgtgtgtcaaccttcaggtgtggcttgatcagagatggtgctccatttctctgaggttccctcagcccgtccctcctcctggctttggtgttgtccccaatccttccgacatcatcccaagatgcccagccgctgcccccaagaatgcacttcctcacttgtccagcagaaatccaaggtggtcttcatgctccattggcccaaataggcttgagcctacccttgtgtctcagctgagactgccccgcccactcctgtccactgtcaacacctgcactgtcttccaagaggcagttgtggcgttcctgtctcggggccgcaccaaccagaatgaatcgctcattcctctgtgttcccattgccaacgtctgctatccttcacatgcctttcttacccaatccactgtccaccccttgcaggagtgacagggtcttcgtgccttcctacagggcctagcaaacttccccacgctcagacgttctcaacatatattggttgaatgaaaggatgagcaagcagtcaagagagtaagaaccaaggtccagtccctagcaagaggcaacctggactcactcgcggtgctgtccccaacttgccttcagagcgttccttccatcttccaggtcactgcagggaacctccaccatgggaaaatgaagccacagagagaatttatcatttcgtggtggggcagatggtttattatcagtgcgtccagggatacagggctctacacagaggtcctgctgagagcgtctgcaaaatgacccacgggaagacaaggtggacccagccccagctcatatgcacaggtgaaatggagaccagtcagtttccaggtagggtggctcccttctggggtccacaatgttgctttgctccatcaggctgaccagggtggaatccctgaccactcctgctggacaagagtggtccttggacaagacccttgatctccctgggcttccattttttctcattctgagaaaaaaaaaaaatttaaatagaccagatcagatggactctaagggctccttcaatgaaggtccccctgtgccctgagtggggagaaaggttggagacagaagagaaggaaagccctctcctaagcaccctagatgctgcctcgtagttggtcctaagtccactacttctctaagccaccaaggcctcctctggctccaagggcaagtccagtttcccactcacacatttttcctcttactggtgatcgtgtaaatgcatgatctgaacagccctccgcggtcagcatgttccttccccttgtgccattccccagctgagcttgtaaaaataaacataaaatgtgcagagtcgggacttactcagtgcacatgcgcgcacacacacacacacacacacatactcatgcaaatgctcagcccaccgatgtcgaggtctcctgctgtcttccttctgaaatcttattagtatcacgacaatcaaaagtgacttacatgcaggctgggcacagtggctcacacctgtaatcccagcactctgggaggccaaggcgggcagatcactttaggtcaggagttcgagaccagcctggccaacatggtgaaaccccgtctctactaaaaatacaaaaattatctgggcgtggtggtgggtgcctgtaatcccagctacttgggaggctgaggcaggagaatcacttgaacccaggaggtggagttgcagtgagctgagatcacaccactgcactccagcctgggcaacagcaagactccgtctcaaaaaaaaaaagtgacttacattcaaccacaagtattcctggttttcttgctcactgcacttctcatactccatgtccttctcttgggttccctagggaggctgttttgttcccttagctgcttccctgggccaccctgacagccagggaatgcttgctgcttccttggaagagggtgagaggcagggcagagccagggttgctgacccctcaggagaagtggagagcctggcacagaagcagctgtcccttagtgcatctctgctccatccagtggttcaatggcattcgtattattatgacctgtttccaagtcacagatggaaaccaggactggggagggaggctggggagaaagcattgctcagagttttggggacagctagggtcagagttagaattcagcctcgtctgctctgctgagaccacttcaccgcttcccagtgcccctgctgtggaaccatgtggggtggcatccctggcgaagtgcccacaccaggattcctgcctcctcgggcgtgtctggggccggctgcctggggcaggcggggtgggagtgaggccctgactcctgtgtttagctccaccagcatcacttactctctcccccaggtgaagagaagcctcaggcaagccccgaaggccgtcctgagagtgagacttcctgcctcgtcacaacaacaggtgcgggagaagacaaacgctggaccacagaggcctagtccaaaagggcaggggtgaccaggagccaggctcagggagataggcggaggtgacctgtaggggagaagcccacagcagcctcctctccctctgagcagggacagggcctcagcaacctgcaggccccaaagcaagtgtcagaaagagggaacccaggaccaggaccaagcacggtccccaggcagagatggaacaccttccctcaccaccaccacgtgtctcccaccagcctctgagcttctcattcacagagacaccctgacttcctttagcctcgtgctgtcctaaagtcacggtagcaggagtgtctctctttatctctttttcacagattttcaaatacagacagaaatggctgcaaccatggagacgtccatatttacaacagagtaccaggtagcaggtgagtggggcactggctttgtggacaaaatgtacaccaggctgagatatggacaggttgactggttagtaggttggttagttggttggctggtaggttggttagttggttgattggtaggttgataggtaggttggctagttgattggtaagttggttcgtaggttgggaggttagttggttagttggttggttgcttggttggcaggttggtttgtatgttggtaggttagttgattggttggtaggttggtagattggcaggttggtgggttagttggttagttggttggtaggttggttggcaagttgataggttggttggtgggttggttgataagttgataggttggttggtaagttgataggttggttggtgggttggttgataagttgataggttggttggtaggttggttgttagggtggtagattggcaggttggttggtagttttgttggtagtttggttggttagctggttggttggttagtgagttggttggtagatagattggtagattggttggttggttagtttgttggtaggttagtaggtttgttagttggttagttgattggtaggttggttggttgactgaaaggaccccttccttacactgcagaatgtgtgagtgaaagactaatccagatactgacgtaactcagaattcgcatgaaccagttacaggatgctgtgagcaaagtctcaagtcagccctatcagctcctctcaagctgatctggaagggctgtaccccgggcctctgccaggggtcaagagtgggaggaaggagccacgtagccagtcagagaggacaggcttccagaaacactgccattgtttcctggtaggagggaaaaacagactctgagtctgcatctgcctagaaagtaaacaaatgtcagcctccaaaacctcagcagagcagcatctggaaaacccgacctctttcaggagatgttaatgtgcttctcatcatcttcatatttcaacatttcttttaccaggcgctctcggtgtccttaaacgaggcctggcctctgagcctttctgaggggcttttgtgagagaagggtgcctcctgaggggaagctccctccaccctcaccctgtcctccctgccctgttcctcaagactcctaggaaatcccatggggagggacctacttcctgagacagggaagagaggctgcagcctccgccttgctctttggggatgtcctcagcctgccctgtggccctggctcctgctgcccccatgccaagcccagggccctttgctgaactccctctctctattgacagtggccggctgtgttttcctgctgatcagcgtcctcctcctgagtgggctcacctggcagcggagacagtaagtgtggcatcaccaaggcagcccttggtcagatcaaagtcctgtacccagccccaccctgcctcccccctaccccctccatgctctctctaatcacctgcagttcagggagtggcaaagggagaggccaatccatgcctcggaaagagtcagttaaaaagaattaaagcaccgccgggtgcagtggctcacgctggtaatcacaacactttgggaggccaaggctgagtggatcacctgaggtcaggagtttgagacaagcctggccaacatggcaaaaccccatctctactaaaaatacaaaaaatcagttgggcatggtggcaggtgcctgtaatcccagctacttgggcggctgaggcaggaagattgcttgaacctgggaggcggaggttgcagtgaacagaaatctcaccactgcactccagcctgggtgacagagcaagactctgtctcaaaaaaaaaaaaaaaaaaaaattaaacgaccagggaaatgggaaggcaaaggagcctcacattcattgagcacccactatacaccaggcttgatgcttgttttataaacattattgaaatctaccttctcagaaacctttggaatagctgtggcctagagagatgcaacagcttggagaagatggcacagcagaggccagcactgcaacatgaatctagagcccatgattttcccacccagcccctacctatagaggacccagggcagcatctatgctgagctttgcctatcctgtgctccccaccctcccgtccacagaagctcacaccggcatccccttgaccaggaatgtaaaccatgtgtggtctttttgcattaactcagattttcaaccctgcatgcatcttagaacatccaggagacagtcttctaaaataccagtgagtggcaagatatgagtaaattccacaggaaaaggaaggcagtccaaagggctgtgcttctcctgtggctcagtgttattcatagctgtgacatcttttaagagaggtttacaagagggaaatcctgtcaccaaaaccattgtgacccactttgaatttggggggaatcttcatttgcaacaatagaagaacaaatttgttgcaataggaaatatttttgtagcttatgtaggttgttcagccaaaacagcataataatttaaaaagttaaaagatagcccaggagttgtggctcatgcctgtaatcccagcactttgggaggctgaggcaggtggttacctgaggtcaggagttcaggaccaggctggacaacatggtgaaaccctgtttctactaaaaaatacaaaaataagccaggcgtggtggtgggtgcctgtaatcccagctacttgcgaggctgagacaggagaatcacttgaacccaggaggcggaggttgcagtgagccaagatcgcgccactacactccagcctgggcaacaagagtgaaactctgtctcaaaaaaaaaaaagaaaaaggtaaaagatatcaatgattgggctccagtcagaatgtctgggggtgagcccaagacatcagtacgtatttttaattgagataaaattcatcatttaaccatcataaaatgtacagttcagtggtgtcttagcccattttgtgctactgtaacagaatgcctgagactgggtaacttataaagaacagagatttataaagaacagagatttataacttataaagaacagagatttcttaccattctggaggctgggaagtctgaggtcgaggggcccccatgtatcaagggcgtttgtgctacgtcatcctgtggcagaaggcagaagggcaagagagtgagagacagcaggaggggctgaactcagcttttatcacaaacccactcctgcaataacaacattaatccattcatgaggcagagccctcgcgacctgatcacctcttcaagatctcacctgtcaacattgctggattagggattaagtttccaacacctgagctctgggggatgtattcaaaccacagtaagtggtatttagtatgtttgcaatgttgtacagccatccccactgattccagaatacttccatcattcccaagagaagccccacactgccaagttccccattctccccagccccgggaaaccaccactctatgttccgtctctatggatttgcctattctggacatttcgtgtaaatggaatcacgtggccttttatgtctgggatagtcgtacgttttaaagcccctcagatgtatctaatacatatgcatccaggtttgacaaccctacacccggccattggttttcaaacttgaactagcaccagaatcatctgtaggaacataaagaaacgataaatgtttgagatgatggatatgctaaataccatgatctgatcactgtaccttgtaggtatcaaagcatccctacatacctcataaatatatataactattatgtgtcaacttaaaaacatttgttgaaagaatcatctggaggccttgttaaagcacagattgctgggtcccacctgtggagtttctgacgcagtcgtcttgcttaggtccaggaatctgtatttctatcaggttcccaggtgatactgacgctgccgttccagggagcagactctgaggatcaccgcactaggctaacagcattaagaatcagggaagctggccagactcacgcttgtaatcccagcactttgggaggccgaggcaggcggattacttgaggtcaggagtttgagaccagcctggccaacatggagaaaccctgtctcttctaaaaatacaaaaattagctggctgtcatggtgcgcacctataatcttagctactcgggaggctgatgcaggagaatcgcttgaacccaggaggcagaggctgcagtgagctgagatcgtaccactgcactccaccctgggtgacacagcaagactctgtttaaaaaaaaaaagaaagaaagaaaaaagaaaagaaagaaaaagaaaaagtaaactctagaaactccctctgtctctctcttgattatccagggcctccctgacccctgccagcatccactctggccaaccctgatacaaactccacagtaagaccctgagaaaatacagatccactcccccaaaaccaaagcccttagcccagccagagagaaaaataaaatatctcttcccttcttatatgggtcatcaggtccataacatactcctaattttcctcatgggaattaaaaagtataaattactgcagtgcaaatgataagccccctagggttattgtagcaggaatgattcatatacccggcagtctaccagtttctctaaggggttagctgactcctaaggtgtcattttaggcttccaggaggggaaggatgtgacgtggctgacatgttgtacgtgtactcagtacttgcatcctctccttcctcaggctgaacacctgacaagccttaacaccttgcaaggatttttttcatttgttagtttgaagatcaaaagccttcgggcccagaggacaaagctatttggaagtaggaatggttcagtgtttatgttgtgaaacaaataactgtgtgaacctatgtgagttcccacaaggtctcccagaactacaatctttggggagactcaaacatacatctagaaatgacccctctagtcagtttgtccaaaagccttcctagaatctgatatcaacccatggtgccctcttgtggcaacagaaatgctgcatttgaattaccgaaagatcactgtagcccagccagagagttttggttggggaaatattttttgtttgtttcgggcaatgaccaggagcccgtgatgtgctacagaaggctcacagtggcttgtgagagccagcggttaaattttcgggacttctgcaaactggtttttaagcatagccattatggaaaattaaagtatttaggctgggagcagtagctcctgcctgtaattcctgcacttcgggagactaaggtgagaggctcgcttgagaccagcctgggcaacaaagtgagaccttgtctctacaaaaacattttaaacttagctaggcgaggtggcacatacctgtagtcccagctactggtaagggcgaggtgggagaatcccttgagtccagcagttcaagattgcagtgagctgtgaccatgccactgcactgcagcctgggtgacagattgagacgctgtctcaaaaaaaaaaaaaaaaaattaaaatatttaaatttacaatttaataaattatattaaaaacaaaggcaagaattacttacaactgatcacttcctaattatttgctaccttttactgttatctttgttcgctgggtggtttacatctattgtgtccgcatggtggaaataccgtttgacggtggctaccgcgcatctcttcccaaccgcgtgatcagtgatgtcacattgccagctggaagctgtgtgtggagggaggattgacaccagggaagacaggcaaccgtcatcagagagctgcttgttaaacatcaccagcacacctctgcttggagtcttgtgctatgggaactctgtgcaaagtagggagtaattagaaattcccatgagccaaataagaactgggaaaaggctaagaccgtattgtccaatacagtagccactagccacctgtggatacttaagtgtatttaaactcaaataaattaaatacaattaaaaattcagttcctcggttgcactagccacatttcaagcgttccctagccacaggtgtctgtgttatcggacagcacaactgcaaaagatttccatcatctcagaaagttctatagcacagtgctggctagaaaccaagtgctttactgcatgcacatcatttagcacagttagttgctgtttattattcctgttccacagctattgtctgccatataaaaacttaggccaggcacagtggctcacacctgtaatcccagcactttggaaggccgaggcaggcagatcacaaggtcaggagttcgagaccagcctggccaacatagcaaaaccccatctctactaaaaatacaaaaattagccaggcatggtggcgtgtgcactggtttagagtgaggaccacatttttttggtgccgtgttacacatatgaccgtgactttgttacaccactacaggaggaagagtagaagaacaatctagaaaaccaaaagaacaagaatttcttggtaagaagccgggaacagacaacagaagtcatgaagcccaagtgaaatcaaaggtgctaaatggtcgcccaggagacatccgttgtgcttgcctgcgttttggaagctctgaagtcacatcacaggacacggggcagtggcaaccttgtctctatgccagctcagtcccatcagagagcgagcgctacccacttctaaatagcaatttcgccgttgaagaggaagggcaaaaccactagaactctccatcttattttcatgtatatgtgttcattaaagcatgaatggtatggaactctctccaccctatatgtagtataaagaaaagtaggtttacattcatctcattccaacttcccagttcaggagtcccaaggaaagccccagcactaacgtaaatacacaacacacacactctaccctatacaactggacattgtctgcgtggttcctttctcagccgcttctgactgctgattctcccgttcacgttgcctaataaacatccttcaagaactctgggctgctacccagaaatcattttacccttggctcaatcctctaagctaacccccttctactgagccttcagtcttgaatttctaaaaaacagaggccatggcagaataatctttgggtaacttcaaaacagggcagccaaacccatgaggcaatgtcaggaacagaaggatgaatgaggtcccaggcagagaatcatacttagcaaagttttacctgtgcgttactaattggcctctttaagagttagtttctttgggattgctatgaatgataccctgaatttggcctgcactaatttgatgtttacaggtggacacacaaggtgcaaatcaatgcgtacgtttcctgagaagtgtctaaaaacaccaaaaagggatccgtacattcaatgtttatgcaaggaaggaaagaaagaaggaagtgaagagggagaagggatggaggtcacactggtagaacgtaaccacggaaaagagcgcatcaggcctggcacggtggctcaggcctataaccccagctccctaggagaccaaggcgggagcatctcttgaggccaggagtttgagaccagcctgggcagcatagcaagacacatccctacaaaaaattagaaattggctggatgtggtggcatacgcctgtagtcctagccactcaggaggctgaggcaggaggattgcttgagcccaggagttcgaggctgcagtcagtcatgatggcaccactgcactccagcctgggcaacagagcaagatcctgtctttaaggaaaaaaagacaagatgagcataccagcagtccttgaacattatcaaaaagttcagcatattagaatcaccgggaggccttgttaaaagagttcgctgggcccatcttcagagtctctgagttgttggtctggaatagagccaaacgttttgtgtgtctaacaattcccaggtgctgttgctgctgctactattccaggaacacactttgagaaccattgttattgctctgcacgcccacccactctcaactcccacgaaaaaaatcaacttccagagctaagatttcggtggaagtcctggttccatatctggtgcaagatctcccctcacgaatcagttgagtcaacattctagctcaacaacatcacacgattaacattaacgaaaattattcatttgggaaactatcagccagttttcacttctgaaggggcaggagagtgttatgagaaatcacggcagttttcagcagggtccagattcagattaaataactattttctgtcatttctgtgaccaaccacatacaaacagactcatctgtgcactctccccctcccccttcaggtatatgttttctgagtaaagttgaaaagaatctcagaccagaaaatatagatatatatttaaatcttacttgagtagaactgattacgacttttgggtgttgaggggtctataagatcaaaacttttccatgataatactaagatgttatcgaccatttatctgtccttctctcaaaagtgtatggtggaattttccagaagctatgtgatacgtgatgatgtcatcactctgctgttaacatataataaatttattgctattgtttataaaagaataaatgatattttttaaaaagtcttggtttttattataaatatgataaatattgctagctataatctacataaccaaaaacctttatagttttttggtgctttttttttgtttttttgttttttttttttttgagatggagtgttgctccgttgcccaggctggagtgcagtgcacaatctcggctcactgcagcttctgcctgctgggttcaagtgattctcttgcctcagcctcccaagtagctgggactacaggcacccaccaccaagtccagctaatttttgtatttttagcagagacggggtttcaccatgttggccaggctggtctcgaactcctcacctcaagtgatccacccaactcagcctcccaaagtggtgggattacaggcgtgagccacggcacccagcctggtatcctctatagtttttaatagttttaaataacatgcaaagatcctgtgaaatggccaacaagcacatcaacatcactggtcatttcagaaatgcgaatcaaaaccacaatgagatactacttcatacccattaagatgactttaagaaaaagaataggaatgctcacagatggctggtaggaatgtcaaaatgtgcagccactgtgcaaaacagagtctgttttggcagttcctcaaaaagctaaacataaatttgtcctataacccagcaattgtattcctaggtacacacccaagaaagacaaaaacgtgtctaaatacaaacttgtacacgactctttataacagcattattcatactcaccaagaggtagaaacacccaaatacccaacaacaaagggatggataaaggccgggcatggtggctcatgcctgtaatcccagcactttgggatgccaaggtgggcagatcatttgaggccaggagttggagaccagcctggccaacatggtgaaacctcatctccactgtctctactaaaaatacaaaaaattagctggtcatagtggcgcgcatctataatcccagctgcgtgggaggctgaggcacgagaatcccttgaacctgggaggcagaggttgcagtgagccaagatggtgccactgcactccagcctgggcgacagagggactcttctctccaaaaaaaaaaaaaaaaaagaattgataagcaaatcatggcatatccctgccagtggagtattagccacaggaagggatgaagtattgatccatgctgccatttagatgaacctcaaaaacattatgctgagtgaaggaagccagacacaaaagatcactactgtatgactcatttaacatgaaatatctagaataggcaattccatggagacagaaagcagataagtgtttgccaggggatttttctggggtggtaaaaaagttttgaaactagagggaggaggtagttgcacaacatgttgaatacacgaacagccactggattgtatactttatcatggttaattgtgtgttatgtgaatttcgcctcaactttttaaaaaggagatcctgaggccaaaatatttaaatattgcttatcttattcttgatgctcaaagaagggtcatcagcccagaaggatcctcctgaagtctttatggtgactttagtattctactaagtgagttatcaggggaccctgaatttttgttttcaaaaaccaaaattagcatattactaaagtttatggaagactccactttggtattctatcgagaacgtaaaatttgcatagctcccaggaaggctgctgttcctgatgcatcaccagaactatcgtgagttggtttcagtttttactcgctggtattccttcagctaaatgatgaattcctgccagtgattttcatggaggggttgtgttggctggctcccaacgtgcataatcaattaatttgctgtgggttgaaaatctgaacaaactgaaagtcaataactcttcttaggtctgtagaagtaagtaagattacagggtagctcactgtccccaatattggagaggcagacaggctgatacagggaaatcataacctcctggaccagaaacccaggaacaaaccctgctactggaaccagcagaggggcaggaaaacctaaactggaactgacaaattgctggaggctcagtgtggacacttctgagagataaaaatttcaggggagcaacccagtcacagggggtccccactttcatgacctttccctccaggaactcaatgaggtcttcacagtgaagatgggagaaaaacttccttgtgcttttgacgggggaaagagaaaaggtactgtcacacgcatccgtgtgaagagagtccaccaacaggctttgtgtgagcaacaaggctgtttatttcacctaggtgcgggcgggctgagtccgaaaaaggattcagcaaagggtggtgggattatcattagttcttatagatttgggataggcatacaaagtacattcacaagggtggggagaatattacaaagtaccttcttaaggtcaggggagaacatatcgtatcagttagggtggggcaggaacaaatcacaatggtggaatgtcatcagttaaggctattttcacttcttttgtggatcttcagttgcttcaggccatctggatgtatacgtgcaggtcacaggggatatgatggcttaacttgggctcagaggcctgacaggtaccattctgaaatatgccagagcattcagtacttgtccaacaaggcctgccctcaagaaacagtattttcctcactatcttaaattttaccatagtctaaccaacctaaattttaccagtgtctaaccaacctgaaagaagggaaataaccagctctagcctctctgcccttcttgtctcatctaagggaggaggcgaatgaaaagcacttgtgaaggtcacagcccaggggtacaggcttgctgaaggctgaacctaatcataagactatggaatggttcccctccccctgcaccttaccaccacatcagtggggctgttgtgcgctcacaggggactacagtggaaacaactgcacatttcagtccctctttaagaagcagtctctagggaagcccaaagatgagaggggagacaaaaacaaagacactagagggaattttagcctctgacatctacagctacagcaaatagcaaacacagcctaactcctaaccagataaacataaaggctcacactaaaggcctatttaccttggttccttttatgctgtatatcaggtccagctttcaacaaaaaattacaaggcatgctaaatggcaaaaaaacacagattaaagaggcaaagcaagcattgtaaccagactcggatactaccatgttggaattatcagactgggaatttaaaacaactacacaaataagccattatgacagagatttctatggtcctgtagatccattcttcccttccaccatcagtaataaaatccccaaattttaacccaacacatttctgcccctagctaaagacaacactttctagcctcccttgcagctaagtgtggtcatgtgactaaatttggatgagatgtaaaccaaaaagtatctgagacaggtctaaatccattcagaggtttatattgccaagattaaagaccatgacctgtgatacagcatcaggagttcctgagaacatgtgaccaaggtggttgagttacagctgggtttgatattaatgcattttaaggagacagaaattataggcgaagacataaagcaatacatgtaaggtatacattggttcagcctagagaggtgggacatgtcaaagtgggaggcttccaggtcatagttgattcaaaagttttccgattggcaattggttgaaagagttaagctatgcctgaggagttgaagtcagtaaaaagaaatgcttgagttaagataaggggagtggggttgtggaagacactgtccttgtcatgtacacgaagcttccagatagcaggcttcagagagaatagagagcacatatatcttattggaacttaacagacgtcagactctctggaaaagacccattaagagaagggagattcctccagtatgaaaattaagagacagctttgcagggccacttcaaaatatgtcaaaaaatattttggggtaaaataattttatttccttcttggcctgttatatgtcatgtgatgctataccagaatcaagctgggattgggtatcttgttgctaaagcatctgtttcttaggtcttatgatctctattttaatgtaatcctggtcagttgatgcctgaattccaaaggaagggattacaatgaggcgtgtcaacccccccacttcttgtcatgacctgaactagtttttcagtttcttggggatgcccttggccaaaaaggggctcatttagtcagttgggggcttagaattttatgtttggtttacagagatatgagcagaagggacgtgtgtgacgcccagggtgtgcccttgaagagaatgtgcacaccctccttcatctcctctcactggtggctgcgtgctcttgctctcgtgagctagaaccaccgggaggatagaagccacacatgaagcctgagagggaaaaaaaaatccaaggaggctgggagtctgaccccatgaggtgccccagcagcagtgcacacactcggactgcatatgagacagaaataaccctcccatttgctgcgatttttgcccttgttagggcagcatcctaactgtatcaatcacccacactcctactaaaatgacaccctcggctatcgtttggatatggttttgttaccacaaaggggtcctgctccagaccacaagagagggttcttggatctcatgcaaaaaagaattcaggacgagtctgtaaagtaaagtgaaacaagtttattaggaaagtaaagggataaaagaatggctactccatagacagagcagttccgagggctgctggttacctatttttatggttattccttgatgatacgctaaacaaggggtggattattcatgcctccccttttgagaccatatagggtaacttcccgatgttgccatggcatttgtaaactgtcatggcagcggtgggagtgtagcagtgaggacaaccagaggtcactcttgtctctattttggttttggtgggttttagccggcttctttactgcaacctgttttatcagcaaggtctttatgacctgtatcttgtgccaaactcctgtctcatcttgtgacttagaatgccttaaccatgtgggaatgcagcccagtaggtctcagccttagtctatccagcccctattcaagatggagttgctctggttcaaacacctctaacagttgtttatcccaagcaaatctcatgttggactgtgattcccagtgttggaggtagacctaataagaggtgtttgtgtcatgagggtggatccttcatgaatagatgattgccctccctgggtgaggggggtgagtgagtgctcattctattcattcccgtgagagctggttgttaaaaagagcctggcatctccccccaccctttcttcctctctcaccatgtgacctctgcacacaacagccccccttcacctcccaccaggagcagaagcagcctaagacctttcccagtgtagatgcccaatcttgaactttccagacaccagaactgtgaggcaaataaaactttttctttataaatgattcagtctccagcggggcatggtggcgcacacctgtaatcccagctactcggaggctgaggcaggagaatcacttgaacccaggagttggaggttgcagtgagcagagatcgcgccactgcactccatcctggccacagagcgagactctgtcaaaaaaaaaaaaaaagagagagagagagggagagagagagaaaggaaggaaggaaggaaggaaggaaggaaggaaggaaggaaggaaggaaaaaagcaaagaaagaaagaaagaaaggaaagaaagaaagcaaagaaagaaacaaagaaagaaaaagaaagaaagaaagaaagaaaaggaaggaaggaagaaagaaagaaagaaagaaagaaagaaagaaagaaagaaagaaagaaagaaagaccagtctcaggtattctcaggttacagcaacacaaaacagactaagacaccctctccaccaaaattctgtttgtatagcatattagtatcaaaatcttttcaatggaaaatggactccagaatcaatattcaacatgacagcagagtttcaagtaaatacatgttttctgttccataaatattatctgaaaaagatttccctacaggagataaacaagtagataagataaaataacattggttctctttattaatttgaatactcccctacttttcttcagaaaatcactgcattcattctccaacacccctgaagcctttctgaaatgttggctcacatggagatgttccttttgcctgatgtcttctggctaagtcagaaactgcaaagggaaacctgctgaagttttaaaaacttttccctgttatttccgtttctcctcttaaagagtgcagtgcgaaacacgtgtcctcttcttctacgatgttgatgaacataccttcagagctagcctattgatatgaaggtaaggatgaaaagaaatctgttatctcagggcagtaggattatcaagcaccatatcagcaaatgcatcactcgaaactaaattgtaaatatagccatgcaccgcataacaatgttttcatcaacaacagactgcatatacacgacagtggttccataagattataataccatatttttaccataccttttccatgtttagacacacaaatacggccaggcgcagtggttcacatctgcaatcccagcactttgggaggccaaggcgggtggatcatctgcggtcagaagttccacaccagcctgaccaacatggtgaaaccccgactctactaaaaatacaaagttagccaggtgtggtggcgcatgcttgtaatcccatctacttgagaggctgaggcaggagaatcgctcgaacctgggaagcggaggttgcagtgagccaagattacaccgttgcactccagcctgggcaacagagtgagactctctctcaaacaaacaaacaaacaaacaaaaagatacacaaatatataccttagtatcacaattgcctgcagtattcagtatagtaacctgctttacaggtttgtagctagggacgacaggctatagcagccccagagtgcagtaggctctaccatctaggtttgtgtaagttcactctgcgacgtttgcacaaaaacaaaatcacctaacaatgcatttctcagaaagtatccccatcattaagtgactcgtgactgtaatagaaaatgaaaacccactgtctctcataactgtgtaccctccagtggtgcttcctgcatggctcagcaaccttatcaagaacctggttatgggtattttttcttctctcttttctgtctccaatgatgtcaaatttattcaaagaccagcttagcctcgtgatagccaacaggttgtagctattccagaattaatatcagattatcacatctagaaataagaaaagacataaggttccctcgttggagcttccagcaaatgtcttctccagtcttgttgactcaaactaggtctcatatctactcctgcactgtgaccagaagatgtgagatgattctgatttcgtaaggcccaagccacagacctcactcctagaaccagtaataaagagaagatcttaaaagcagccagagaaaaacgaacctttgcagagaaatataaataaggacgacagccagacccgatggctcatgcctataatcccagcactttgggaggtcgaggcaggtggatcactcgaggtcaggagttgagactagcctggccaacatggtgaaatcttgtctttactaaaaatacaaaaattagccaggcatggtggcacatccctgtaatcccaactactcagcagactgaggcaggagaatcacttgaacccaagaggtggaggttgcagtgagccaagatcgcaccactgcactccagcctgggtggcagagtgagattctgtctcaaaataaataaataaatgcagatttctctctggtaacagtataagtggagcaatatctttaaactactgaaagaaaaaactgtcaacctaaagttctatatgcagggaaaatagccttcaaaaatgaagatgaaataagtatttttagacatataaaagttgaaagacttcataaccagcaggcttacatgccaataaatattaaaggactcggctaaaatttcactgggttgaataatgtctccccagaattcatgcctacttggaaccgacaaatgtggccttgtttgaaaatagaatctttggaaatgtaacaagttaagatgaagtcataccagattagggtggaccttaaacccaatatgactggtgttctcataagaagagggaaatctggacgcagacccacacagagggaagacagccaggtgaagacagagtcagagattggaggattttttttttttttgagacagagtctcactctgtcacttaggctggagtacggtggcaccatctctgctcactgcagcctctgcctcccgggctgaagagattctcatgcctcagccgcccaagttgctgagattagacgtgtatgccacgacacctggctaatttttgtatttttttgagtagagaccgggttttgccatatttctcaggctggtttcagactcccggtctcaagtaatccacttgccttggcctcccaaagtgctgggttagagaagtgagccactgcgccccgctggagaggttggagcttgatgccacgagctgaggaacaccaaggattgtcagcaataatcaggttatacactgtttgactccatttatataaatttctagaaaatcccaactgccctatagtgacagaaagcagatcaaacactgtcaggggaagatgacaaaggaacattatcttgattgtggttttaggggtgtgtactcatgccaaaacttaccaaactgtgtacttcgaatatgtgcagtttttcaatgttcactaaacccccaataaaactctttctcaaaaaattacctgtttgaaattcct

SEQ ID NO: 1125 - DNA, 2308 bp, Homo sapiens
gagagactggatggacccacaagggtgacagcccaggcggaccgatcttcccatcccacatcctccggcgcgatgccaaaaagaggctgacggcaactgggccttctgcagagaaagacctccgcttcactgccccggctggtcccaagggtcaggaagatggattcatacctgctgatgtggggactgctcacgttcatcatggtgcctggctgccaggcagagctctgtgacgatgacccgccagagatcccacacgccacattcaaagccatggcctacaaggaaggaaccatgttgaactgtgaatgcaagagaggtttccgcagaataaaaagcgggtcactctatatgctctgtacaggaaactctagccactcgtcctgggacaaccaatgtcaatgcacaagctctgccactcggaacacaacgaaacaagtgacacctcaacctgaagaacagaaagaaaggaaaaccacagaaatgcaaagtccaatgcagccagtggaccaagcgagccttccaggtcactgcagggaacctccaccatgggaaaatgaagccacagagagaatttatcatttcgtggtggggcagatggtttattatcagtgcgtccagggatacagggctctacacagaggtcctgctgagagcgtctgcaaaatgacccacgggaagacaaggtggacccagccccagctcatatgcacaggtgaaatggagaccagtcagtttccaggtgaagagaagcctcaggcaagccccgaaggccgtcctgagagtgagacttcctgcctcgtcacaacaacagattttcaaatacagacagaaatggctgcaaccatggagacgtccatatttacaacagagtaccaggtagcagtggccggctgtgttttcctgctgatcagcgtcctcctcctgagtgggctcacctggcagcggagacagaggaagagtagaagaacaatctagaaaaccaaaagaacaagaatttcttggtaagaagccgggaacagacaacagaagtcatgaagcccaagtgaaatcaaaggtgctaaatggtcgcccaggagacatccgttgtgcttgcctgcgttttggaagctctgaagtcacatcacaggacacggggcagtggcaaccttgtctctatgccagctcagtcccatcagagagcgagcgctacccacttctaaatagcaatttcgccgttgaagaggaagggcaaaaccactagaactctccatcttattttcatgtatatgtgttcattaaagcatgaatggtatggaactctctccaccctatatgtagtataaagaaaagtaggtttacattcatctcattccaacttcccagttcaggagtcccaaggaaagccccagcactaacgtaaatacacaacacacacactctaccctatacaactggacattgtctgcgtggttcctttctcagccgcttctgactgctgattctcccgttcacgttgcctaataaacatccttcaagaactctgggctgctacccagaaatcattttacccttggctcaatcctctaagctaacccccttctactgagccttcagtcttgaatttctaaaaaacagaggccatggcagaataatctttgggtaacttcaaaacggggcagccaaacccatgaggcaatgtcaggaacagaaggatgaatgaggtcccaggcagagaatcatacttagcaaagttttacctgtgcgttactaattggcctctttaagagttagtttctttgggattgctatgaatgataccctgaatttggcctgcactaatttgatgtttacaggtggacacacaaggtgcaaatcaatgcgtacgtttcctgagaagtgtctaaaaacaccaaaaagggatccgtacattcaatgtttatgcaaggaaggaaagaaagaaggaagtgaagagggagaagggatggaggtcacactggtagaacgtaaccacggaaaagagcgcatcaggcctggcacggtggctcaggcctataaccccagctccctaggagaccaaggcgggagcatctcttgaggccaggagtttgagaccagcctgggcagcatagcaagacacatccctacaaaaaattagaaattggctggatgtggtggcatacgcctgtagtcctagccactcaggaggctgaggcaggaggattgcttgagcccaggagttcgaggctgcagtcagtcatgatggcaccactgcactccagcctgggcaacagagcaagatcctgtctttaaggaaaaaaagacaagg

SEQ ID NO: 1126 - DNA, 819 bp, Homo sapiens
atggattcatacctgctgatgtggggactgctcacgttcatcatggtgcctggctgccaggcagagctctgtgacgatgacccgccagagatcccacacgccacattcaaagccatggcctacaaggaaggaaccatgttgaactgtgaatgcaagagaggtttccgcagaataaaaagcgggtcactctatatgctctgtacaggaaactctagccactcgtcctgggacaaccaatgtcaatgcacaagctctgccactcggaacacaacgaaacaagtgacacctcaacctgaagaacagaaagaaaggaaaaccacagaaatgcaaagtccaatgcagccagtggaccaagcgagccttccaggtcactgcagggaacctccaccatgggaaaatgaagccacagagagaatttatcatttcgtggtggggcagatggtttattatcagtgcgtccagggatacagggctctacacagaggtcctgctgagagcgtctgcaaaatgacccacgggaagacaaggtggacccagccccagctcatatgcacaggtgaaatggagaccagtcagtttccaggtgaagagaagcctcaggcaagccccgaaggccgtcctgagagtgagacttcctgcctcgtcacaacaacagattttcaaatacagacagaaatggctgcaaccatggagacgtccatatttacaacagagtaccaggtagcagtggccggctgtgttttcctgctgatcagcgtcctcctcctgagtgggctcacctggcagcggagacagaggaagagtagaagaacaatctag

SEQ ID NO: 1127 - DNA, 96598 bp, Mus musculus
  misc_feature (19896)..(19915): "n" at positions 19896 thru 19915 can be any base
  misc_feature (40802)..(41603): "n" at positions 40802 thru 41603 can be any base
  misc_feature (46852)..(46982): "n" at positions 46852 thru 46982 can be any base
  misc_feature (89077)..(89415): "n" at positions 89077 thru 89415 can be any base
  misc_feature (90784)..(90803): "n" at positions 90784 thru 90803 can be any base
tcttctgaatatcatgtttagattatgtaagtattcaccggctttctgtcactataaaccaatacctgagttgattaatgaataaagaaaaaaaggtttagttgatgagttttgaaggttccagtctaccagtctgttactgcagacgtccaccgtgatagtatgtcatggccagagcacctggcaaagcataaactacctgctcgtcaatcaggaagcaaatagaaaagagaactggttgcggtcccacaacatccttccaggtcatgtcttagtagagcacttctcccaggagaagcaccctgttggccttgccgtcaacacatgaacagcttggggactcctactgaggtaacagtacccattctgcatacattccctgagattaactgagacttgattcatggcccgctgttttgtctgcctttgtgagtgttctgcttgcagccctactaaacacagatggccaatgtggtattcagagtagtgggcctttaagaggttatgaggtcatagcacataccctgcccctgccatgaataggattttaaagggggctgatgaaggagggttgtcccctctgactcttccacctttactgtgtgacaatagagtgattgtttcctcgtgacattcctcatttgcgtgctttgaccttgcacttcttgcctccagagtgataaaaaataaacttatgttttttataaactacccagactcaagtactgtttaacagtacagacatatgaagacagttggtcgtgtttgtagtcagcaccgaaagaggaaagttgaaaacttccactctacttgtggatttctgtctcttccacaaatgtttaggtctactactttgtacttcatgtattttggagacctattaataagtgcatgcaggtggaggtcattatttttataagggctcagtagtgcatacatataaggttccaacactcagcatctagaggcaggagggttgctgggagtttgagcccagccagagctatctatagagaccctgtcataaaacaacaaaattattactgcccattgatgacctggcccctttattcttatatatatatccttctttgcccttagtaatattccaccccctgatcttctctattggtggttatgatataaactactttgctgtgtttagtatttgtattattagcacagtatcccaggcttctgcttttaaacactttgcgtctttcatgttaaaaataattcataggaaaagcattttcttgcgtcttgctttttctgtactgtttaccatgaatgctttttatagctgagtttattttatttgcatttaatattggacctcttctttatccacattttgtctttcattgtcatcttttaaatgaaataaacgtagcacttgaagagttccattttatctcccgtctggtagttctgtaaaacggtggctttctgtagtaggactttctgcatcctgcgtctatagcgagtgaagcgctatgtacctaatgtggaagctttgatttgttctcacctctctgctagtgctggtagacttttttccctccatgggttcagaatactccataatatattgtgttgttcaatgtgtttgttgtacagtaagtttgaacatactgcaaagcgaaagccccatgtgcccacacctttatcaccagtagtgttttccttgtttcttaaaggtccaattctatctcatttcccttcaccacaaagatctgcttttaggatgtcttctgtcacttctacgcgttatgaattctctcagctctgctttattagaaagtgtcagtttacctttattgtcaaaccattctgggacaaagctacctgcttctttgtggcttcaatgtttttgttgttcattatagatatcatgatgtgaagagtttgcatgtttttcttttattcagagttgagttttgtcctagtaggccttactaagatgcatttaaagtcgcccttattttatgatgtgttcttgactcttataacacggttttcccctagactgctataagcacacatgttcagaacgtttactgatgtctcttcagcccacgtgattgcaccctcagtgtctctcagctctgtatggcgtctgtaatcttatcagagcatttatagaacaacagtggctttcactgagctttttgggatctctgttaggatttcatcagagtaaaggtgggctgattatagatttttgaggctttgcacatataccatttctctgaccaatgagatcactgctctttatttgaactctgcttcctgtggcctggattagaaagtgccctcagtcagaaggtgagcttggagttcacttaaactgtgcagcctgtatctcttgtttagtgtctcaggctattgtgtttcataattacatatgaatttggcaagatcaaatagtggttgatttataatgactgaaattagatttgtgtggatttttaaagattttttttttcaagacagggtttctctgtgtagccctggctgtcctggaacccactctgtagaccaggctgatcttgaactcagatctacctgcctctgcctctggagtgctaggattaaaggcatgctccaccactgcccagctgtagcatgctattaatgattttgaaagacattattccagggcatttatatattcaatatgttggctagctagcatttctctacagctttgttttgaaactttctcatcatcccagaagagtgccttgaatgtggtaaatgatggctcccttcccagtcttcactcactcccctggcctctggcaagcaatgatgtgttcctcttcctacgaatgtgcttgttcttggtattcaatgtgaagggaattgagtataggtgagcgaccctttctgtctggtttcagtataaatcatttagtctactggttttgaaatacaaaatcaaaactcccattgctggctgtaaggcacaccatttaaggagactgtaaatatataatgtatgattaagttgcatagaaacagtgaaccatagtgcaaaaccaccaggaaatgttatagaccttatggactgaggcgataacagtggaagagaaaatacaggttttatggaagaagttgattttgaagtaccatgttgtggaatacataatatctaaacaggatagaatctcgagtgtgaagagatgtacacactggaaagaaatgacatagagctgttacatgtgtgtgtgtacacatgcgtgtgtgcgtgtatgcagtgagcattcacatgtgtagaggtcaaaggacaattttggaagctggttctttccttcgagcatgtaagttccaagtaaggacttaggtccttgggcttagcagcaagtgtttttacctgcagagccctcttgttggccaagcaatgcatctttaaatgattgatttccctatagtaaagtgcttgtgttggatcatggtgatagttgtggtgcttatataatatataatataatataatcatatgctgagtagttgctctttggacttcactatgtaaagcacctggctgtgatctgaaagatatttaatcaggaagataccctgccatgggggtgagcggtagaaaagctgtttctgtcagagtgaggtaataaggtctgccctagggtgtggctatggacatagaaaggaagtgcacacacaagaaacagtgtgaggaaagaagtgagcgacaacaagactgttcactgcattggttggagaaggctacatttgcaagaatgagacagtcaggagtcgggcttgttgtcgagtagtaaactgtagacattagggttgatgggtttaatgtatcattaacttgttttctaatggcatcgttacctaaagctaacaggggctcattaccaaatacaccttcagagccttaacagttctaatcatgtactgatgtcacgggggttgggctcgtatcttggatagcttgggttttttgttttgttttgtttctttttgctctttcctttttttaaaaaaaattatttattttttgttcaattgagaactcagtagccgatggagaaaagccagtgcaaagtccagaccgtgactaagagtgtaattaaagctgtgatactgaattgccagggtaattaacccatgctccacacgccctctgttcccatgacactgaccaagctgtatcgtgtaggctgctgtctttccatttactaaccgttctgattggctagcctttgctgcggcgagataaatcatgaagaagcacatagaaacacagatatgcctcatttcttgcgacctgtgactgtgtgtggtgatttgtctggctgctctgtggaggtcctcagctgctctgccaccgagggctcagcctgggaagtcttggctgagctctgctgcgtttccactccacacgtgggttctcatcctccactgggctggccaggcctttcccttccaggaaagaaaatccagtcattgaacggcttcttgaaagccatgttcatgactcatgtctgcatcctcctgttggtcagggcctgccaagggcctgacaacattcaaggggcagagatgtcaattttattgtccctgtgttgtgagggatagaaaagggcagtggccattgttttgagcctactacagctataagccctgagttcagactatgccactcttgtgtagttttgtttctttggaaactgacagggtaggcaaacctctttctgatgggttgatgaagggccaaaaacatccaggtaacatttcaaacatggtttccctgtgatacagaccatggcatacacaagtatcacaaatctgttcctacagcactgtggatgacacacacacacactctctctctctttctctctctctctctctctctctctctctctcacacacacacacacacacatgttttaatttttagtttagctaactgtggcttttgtgagatattctctctctctctctctctctctctctctctctctctctctctctctctctctctctctttctctctctctctttctctctctcccttcacgtttggattgccttgtaagtagctcatctgaaattcatgcactgtaaggtcctattctgttctctgggttactctgtagaagagttctatgggctcaccaggtactagatgtaggaacagaaagcacactcgggagaaggcatgttgcagaaacgagagaaacatgctgagactcctaatgtgcatctccccagtggagacaacacaatttgactggacagtgtgtgcatgaaggctaaagagcgctcagggaatatagagggagcctcttcccgctccagtcaccgtgacagcatgctacttcgtgtgttggcatgcacaaaattggcagaacgcctcaagtgtggagaattcaccattataacaagattatagtaagcaaaaaatcactccacatcacgtagaagagggagttggcaaaggcggctggtttaaagcagctctttgcaatcttctctagagggtcttatctgaaagcaaacaaaaaacaacaggaacagcttgaatgttagcagttatcctggcaggcagcactccaacccagcccagcccacccagcccccagcacaggtgtgtaaccctttagtagcctacttaatatggctgaagagatagatggcttaactagtaagagtgcttactgctcttgcagaggactcaggctggttcctaactcccacatgatgactgacaacctcctgtcacgctggttccaggggatctggcactcccctccttgcctctgccagtacccttacatttgtggtgcacagtcatgcttgcaggcaaaacactcaagccacataaaataaaaattaataaaaccttgaaaaaaagatcctagctagcagttaatatcatgagtagactagctccagccagaacttttgagaggcttgaagcaaagatgtttttaaatgaataatacttctgtcaagaggaaaatcacatcacccattacgctagtacaagggccataagctgtgcagttagagaggccagctctagtctgtcagcctgagcaaatgactcattctctctgaagcttggctcttcaggtggactctactttctgggctcagcatagcaagagggcagcatacgtaagcattacctccggttccttagttatgtggaagcagtctgtcaagcttagctttccccatacaaaggagagcacttgtcctgaggccagagcactcactggcttctcctcctcagcgtaactggcaccagggattaggtaaattgtccctgggttaatcctgagccttccaggatctttggatcacttctagaagatggtaggaccagccatccagtcctgtgagcccagaatacttcagagaataacttctaaactccccctcagggaaaaatacaagttatagggtaatggcatgcaaccacttcagactcaaatatgttagactgtcagtagctattggcagaaaatttatctgtctttgctacagttctattgctgtgaagagacatcatgaccaaggcaactcttctaaaagaaagcctttaaatgggcctggcgtacaattgtagacgtttagtccattatcatgatggcagagagcagaggacacaggcaggcacagaatcaggagctgagagttctgcatcatggtctgtaggcagagaaagacagactctggacttgggatgggcttttgaaacctcagtgctcctcctcagtgacagacttcctctaacaaggccacacttcgtaatccttttaatcctttcaaatagtgtcactccctggtgactaagcacacaaatatatgagcctgtgtctttctcaggacaacgaaaagtttatcttgcatctttcttcctataatttatcatgagtgagctattagactgtctggtgagttaacatatgttctgtatctcccactcactaataagcttcgcatggattagctagctgagtgtttcccatgggtctgccagcccattaggctgacactccatcatgaatgggtttcttcgtcagctctcagatttgcatttgcagtgcgtgcatgtattgttctaggtcattgtcacgatgctcctggtgaaataatattgaaaataaaagaagtgggaaaccaggttctgtaaatctcagtgtggtagcatgcacagaaacattgatttatttttaaaagaaagcttttagaaatcagcattactgaaaaaaaaaaagtccattgccagcctttatcattagtgtgacatactgtcagacaggaggacacacagaaagggggacgcttctgaagagcagtcaggaataattaggagtgttgacgaattcatacttcatattttatttaacactgtcagggcattttaggttcaatgatttaaatttagattcagccccctttttattctaatacatgtctaatgtgtattagataaatttccatgtcactgtacaaatctccccattgttatagcaattccataatatttaacttacagttgtagaacaagaatgcaaacagttagatcagagcacatcacaaactcctgaaaatcgacttgcagaatttacgccctctgaatattttacatggtatacactttatgtggccatagcccttacattatgttttcttcaaaaaattctctatggaaaagaaactttaacattttataatttaatctttagcaatttattgtgcgtgcaagatacaaaacaaaaaatgttgtgaaaagtctcttttcccagtatctttgccccattgctaaacaaaacagtacattaaatgacacctaagtgacacctgttatggttactagaattttaaaccaccctgccaccccaccccctccctgatttccaagtgcaccttctagctggtgtctgaccgcctacttttcatagtgcgcattgtggttctctttggattatggtattttaatgggtttggaaatttagagagccttttcccccaaagaaatcgaacagaacagaaagagttgttggtgttggtggtgttgttgttggtggtgcttacagtgagtcaggcctcggctgcctatatctctgaacctagatgctatatagttactgacaggaattctcctgactttgtccttgatggcatacagccatgcctttagaatttctccactcagtccagctgcttcaccaagatgcccctgtgtcagattgagttactaggaagattgccacaggaatgcaggaaacagttcgttcagcattcatagaatatgtcacatactcaggacttggctggttttgttacattgtgctttgtatgaaaaccacaactccccggatatttgctgagacctagctacattttctgcgtctccttatgtggtgagaagatccctaaagattcctggttggggtagacaaatgcataaatgagacccaggcttgtgtctccctttgtgtctcaaggtccttcctcaaaagcgcaaaaggaaagtggggggaaggctgagaaagcaggggtacataagggactttcccactgctttctcatccccagctccaaagcttagtcgatatttcaacattttaggtataaacttgcttttgcaatcaatgcaaatattactcagtgattcatcctttccaagtgactctcggtttctttcttttgacatttaatttaaaattagaaattagcatttatatcatgctagagctgcacttacctttcaacgcctcagtaatggccaaggctttatgcgtcaagattctaaggcacccgagtgttccttgagcttctgtagtacctgacggagttaagtttttagccacatataatctagaaaccgtaggagagggtgccatgatgacaaggtgcccagtatggtcgtttgtcagacatttaaagtggagccgtcttcattagggcctcatgtagggaatggaccaggaggatacccttacgtctgtgaagtgcggttggagttgaatcttccaagttggagtgagacttctttatgttaaattcccccactcaaacttctacaaatcatccaattttaaagaatgatttttaagatgataatatattatatcatttccccttcccctgcctccaagttctttcatgtacctctctctcaaaacttcatgacctctttttctttaattgatgtatctttttctaagtacaaaaaaaaaaaaatcaatctgctccatccatctaatgttacttgtatgaatgtttccattggcattgagtaaccaatcagtgtacatttttgggaaacacaatttctcatgctctcagctttccctatgtgcctgtagttcttagtctagggttgagacctcctgagcaatctccctttcacattgcctgtctgttggtgccatccttgttcaggtacacacagaatcaatgacataaaggtactaagtgggtttggacagtttaataaggcaataatgtcacctccaccttagaagattgtctttggattgttaggaaagaatatcatcacccaggttaatggaaaacctagagtcataaggatagtgtaaaacattgtttgtggaaattaattagtatccaaagtcacataccagacagtggcagaaccctggtattttcaatgatgtcatacccctttactgcatcaagtcaaaattcccctgttttaacttttttgtctgaataaatatgtttagttgcagctgcttagagagttttgttttgtttgtttcattttgttttaagacaagaatcttactgtgtagccctggaactcaccatgtagaccaggctaacctctaccacaaagacatctacttgcctctgcctcccaaatgctgagattaaaggcgtgtgccactacacccagctcgtgttttctttttaagtatgtatgtaaattgtgtgtttgtgtgtgcctgcataagtttatgtatactttatgtgtgcaggtaccctcagaggccagaagagggtgtcagagcccttgtaactggagtttgacggtcgtgagctgcgcatgtaagtactgggaactgaatcagggccttctgcacgcttaactgttgagccagctctccagcttgtgtttaaacattttcaagtgtttcttgttttaaacaaccccacttccttgcacacacctttgtgaagttgtgccaaaggacttagagctcctacttttcctttagttggtgctggccctgctccatgtggccctgggagttctccagagcctcccgtgcatcccattagtcacgtggtgttatagcacagagcctttcactggaaatgaagcctcaagttatgggaatgtcccgagatgtttttattagtgtaagataggcttttgatggaggctagacagtacattggattgaaaactaactagcctccattcttccatcagcctatgttcaagctccaaggtgggcacaacagccccatcctttgatacagagtctgttccctcatgtgctagaagccagggcttttctacatttgggttttattcagcatggaacgcagttttttaaaaaaagatttatttatttatttaatgtatgtgagtacactgtagctgtacagatggttgtgagccttcatgtagttgttgggaattgaatttttaggacctctgctcactctggtcggccctgctcactccagcccaaagatttactattatacataagtacactgtagctgacttcagacgcatcagaagagggcatcagatctcattacaggtgggtgtgagccaccatgtggttgctgggatttgaactcagggccttcagaagagcagtcagtgctcttacgcgatgagccatctcaccagcccagaatgtgattttgaggtgcagatagatggttctatgtgtttatcagggtctctgggtgcctgaaggccgctgaggctgcttatattaatagcttgctaagttcagtaagtttgagactttcaggtttgatgttttcactggttatttttttagtgcactctttagagttacagaattttcattgcactttgacaaaggcagaatgactctcaccagtcctcacaagagggcagggggtgtcgttctatgcccactcaagtgttatgtaaaatggtatcaggacttcctcagcctctcaaccgagtctagacagtcctaggaccatctcagagttcatgagaaaaaaaatgcacaaagtagaagtggccacagggttccatctggacctgatttttacccagaggtaggaccagctgtatcaaaccgaggaccctgagcttagccaaagggtttagatcccgtggtctccctacaatgagaggtagatgccaaggaggtacagcacgcatgatgccctcctacagaggtcttttttgcagacatttgtggtccctgtagaaatacagcctagccctgcatatgtgccagagttgtaggatctttaagattcactccagtgctacagctttcatttcttgttctgttttgtacagcttcaccatggcagacgatgatccctacggaactgggcaagtaagtcctcagctcactagcaactttgtttcaacgcgttcttatcccaaacacacagaggcaacgctagtaactcagtatcaagcaaaccctaaattagtaaacactactcttaatttattttcagtttttctgttcttccagagttggagagggccctttcttatgtatttttgcataaaaccgtatatactacatgccagaaagtagccactgagtcagttgtggtgttgaaggtctgaccccagtatttcatatggtgactggtatattaaaaaaattgctattcagtgagatttctagggctgctattaacatcgctacaaacctggtgacttgacacaatagaagtgtatcctttcataggtctggaggcaagaactctgaatttggggctggcagaatagttcccacctcctaccactgctgggtgtgtttagagatccttggcatcacaccagccacagtctgttgttgtgtggctttcctccacgtcttcacacataccatctcctctgtcttaaaaacacatcactttttggatgtaggatccatctctgtctagtgtgaattcatcttaacatatataaaggcaaaggctgccgtgtccaaataagtcacatgaaggaggagcacttatgaattctgaatatattttttttcaaaggtactgtagttaagcccactgcagtctgtgggagtgagtgtgctttgagagcggagcagtgtttatcatcacgtcattgtcgctgtcatcataggtgtgacagcagccatgacacagactgacacgaggatatctgtatcttcactttccttctagttttttctcttaaaaaatctaaacccatagaagtgttagacagtctgatgatacttccatttctttctcttctccccatagagaatatagggagcatagaactgattcttgaaagcagtttctagctgctagcatgattacagtggcaatattaaaagtggactctaatggtctattaaattatttaaaatactggtatctctttgctcctcagctatctactgagactttatagaagactttatgcccagaacattagcatcctagagacgaagggacaggtgatatgctcactgggctcaggactgcatcccggctggagtaacggaaccacactttacacagtctgtggatgttgccatggttcactgagagacagaagcagttggagggattgctgtgtgttcctttagggaaagagcaggttaaggatgactttgcaaaggaggactaagctgagctttgaaagctacaaccagtgcaggggcactatttaccaaggtagccctgccacaacattcattactacttcacatttaaattttggtggtaaacacccgagactaccatttcccaaatttatgctcgcaaagagtcagccaaaaataaaactgaaaatgaaatatttgggggagacctggtgtttctatagtcacacagccccagagccgcagtcagagctgccatggcctgcaccgtagtgacagctgcagtggcctcagagctgcagtcagagccgcagtggccctcttcttctcacccagcgggcggagtgagcatgcaccatccgctcctgaccatgttataaagatggtggtactgggtaaacctaaggatgttttcttttatggcagcataaaagacacctggcaaccatacgctcaaaccccttgtttaacctttcacttttaatgggcctcctctaacacaggccagccctcaccaccatgagagctgtctgcttggtttcaaaccatgcttttctgtctgtacacaggaaatcttagcaaccagagatggtcttttatgccacaaaagagtaagacctgccaaggacagtcattttgaaagtgtctcatgtgggcagcagttctgagctcattagcagggtgggcatgttctgatagttcagttgtgggggaaggggaggcccttggaggcttttaagtttttgtctttgggttggttttttcttcctgtcttaagctttaagtctatctcttctaaagtttgcgatttttgagggaggtgtcctccgtgttttagccacactggagtttgttctccacctgtcaccaagcaaacaccacatgccgccttcaacaggacgtctgtcttagtgggcttctcccccagccagatcactgcagacagaggcggaaccacagcaaaggacttctttgtgaggtcgttctctttgctcagagatggaggcctggagcttattataaaacctagtttcccattcagtgtgtctttcatggttaatagcgaatggcacagatgcgctttgcttttaaggattgaaatataacacactctttgctcctcagttgaaaatttgcatccctcaaaagtggatttgaagtgactcgcatttaaacatcacattttaggggccagtaagatttttcagagagcaaagtgcttactaagttagcttgactttgacttcctccactacccacacataagcacactcatgttacacacacacacatatccatctcatgttaaacacacatactacacatacatatgcactcttacactatgcacacatacacaccttacacaaacatatatgtgcatacactcaaacacacacactcacatactcccactacacatacatacactttcacactatacacacatacatgcacacacactcacactacatatacatacatactttcatactacacatgcatacacacatactacgcatacatatacactctcataccacacacacatacactcacactacacacacacatacacattctcacactacacacacaaatgtaataaacatgcaagcattactcttcttattcttgatttaactagacatagtaggatttgaggtacccaagaatatctagtgatttactaataaggacaaaaaatcccaaaaaccaaaaaccaaaaaaaaaaagaaagaaagaaaaaaaccgtctagcttgcaagctgaccagagaaagtaaaagaaataatttggtttctatgttgtccataaacatttcaacaagtcacttctggtgagtgagacagatagtaagctcacacatacaaatgtgattttctaaatgagctaactgggaaaattccttttggagtaattattagtcataacttaccaaggtagagcttaattctatcaaaacgttatatgttcactttttcagttttcttagttgtgtgttgtttctgtaacaagttaccatagtatttgaaacaacacaaatatcttctaaagattagaataaaaatgtcagagtcgaggcatcaacagggctacactcctagcagcgtttatttcttgtcttccaagctctaggggctgcctgtaagtcctgctatcatcccccagtcctgcctctgtaggcctgggtgagtcctgctagcatccctgactcctgcttctgtaggcacactgcactttgatttctcactctcctaagtagctcacttggatattccaggataatcctgtcatttaattgtcctacattgatggcacatgcaatatatcttttgccacagaaagcataggttctggggaataggaaggttctgtggagtagcatgtagacatctttagagccattgttcagtgtgccttcatctactagattcaggtatttatattgtaatagaaaatagagctgggcagtggtggcacatgcctttaatctcagcacttgggaggtagaggcaggtggatttctgagttcgaggccagcctggtctacaaagtgagttccaggacagccagggctacacagagagaccctgtctcgataaaaaaaaaagaaagaaagaaagaaagaaagaaagaaagaaagaaagaaagaaagaaagaaagaagacgacgacgacgacgacgacgacgacgaaaagaaaaagaaaatagaggcgggagaaagtgagccctctgctccatcatgttctcagttgtattgccagtcattttgtaagttgtgtaactcctgcctgtaattctttcaaggccttgaagttctgtagctcagtaagtaatctatttatcatcagaacagaagcatacatatctaagatcatgtgcacgtatgtgctgtctgtctgtacgtgtacattcacaagtgtgtggaggctgaaggtggctccccatctttgattttgagaaacggtgtctaacctaacctacagctcctggattcagctaagacctccagccagcaaatcttcatgtctccaccttcctgtagctgggactgcagacaactgccgccagcccagcttttcactggggtactggggctctggactcaggttcttgtgctctacagcaagcaccttatcaactgggccatctccccaccctctgggatgtaatgaactcaagttcctaagagggtgcgagattcagatcacttactctacacatttttctgaagggtccagcatgcctgaagctctcttggctccgaagatgcacagcttgcgggatccaccaggcccttgtctttagggaccccatagccattattctcctcaaatttctttgttacataagttacacacacaggggcctaagaaggtcccagaaaggcacgttaaaattttgatttcaggaatcctatttttgcgtttttatttctagttttcaatcatgtaattagttttctggctttgtgtattagtgcaagaagagaaattaaaatatttgtattttcttctttacagatgtttcatttgaacactgctttgactcactcaatatttaatgcagaattatattcaccagaaataccactgtcaacaggtaagaaaaacacccccttttcctgttgttttgctttcccttaaaaatatttggggtcaggagtcagggagatgtggatcaaccaaactaagtatatatgaaattactataaggaaatctgttgctttgtgggtgcttgggacctagcccaggccctctggaagagccacaagcacttttaaccacagaaccatctctttagccacaacagtctcttttaaaattcaacaatattcataggaaggaagtggtgatccgtgttttaaaaccaccctttcagtatgctttctggaaatgtgtctcacaaaaatgctccggcgtgcgcgcacacacatcgttttagcaagtgtggtttctggtctctgttagaataccctgaagccctgtcttcaccccgtgtaaggactttcctcttctccgtatctcattacccattagtgctcctttttgctttaccgcagctcacagagagccagtcttagcccctcagttctgtatctgagggccagtcttgtcagccaggacacgaggctctggggaaacagtaggaaagtaacctttatattctgaccagaccaagcgtacagaactaatgctcctgacatgactgctaattaacgaacccacaaactgtttaaggtccctttatgctatagcgcacgggcttcctttagactcattattgactggcatgtgtgtagccttggcctgatggctcttttgctgctttgatcacctgttggagctaagccgtcttcagcagccacttgttagttggtggagatgcgtatggaagtgattgtccattactgaggtggacagcaggtgctttgtgtgctccggatttctgtgtctcgtgatgtagtttttatcattctcatttaaaatgactatggttttgccagcgcctgccttacggaaagttttctacagacgtgggaggaaggagagttagtatgtcaccctcctcactggtgcccagaagttacatcacggaggcctgtctgtccttaccccaaataaccaccacagtttatctgtaatcttaagctgtccaacacgctctaggtccccttcttgtgaccaagtaaatgcaggggaggcaaccgtgtttcctgtgaacttctaaactctgagaccccaagagcttcctttagcatttctgctttattgaaaatgttgcagactcggttctgccctcagggaaagcacaggtttctagaaaatgcctctaattagttagaatactaaacagcatcctgcaggcagatgatattctaatgtgttctccttttcctttggtttatggacttagaaataaagttatccaaagaatcatctcagaaagtcgttggtgttcatatcattgcgcttcgggaatcttcttttccatagtgttagagaatccttcagaattgcatggaagatgcattcttttcctgttgtaatggctccttgcttgcactagctctccggctctgtttcagtgcgttgtcctgtttttatagtccaagatggatgggacattttgttcagattttaaaggactagaaaggctatctgtgacagtgtttgcttgtaattttcatgtggattttttttcaatcttctcaacttcttaaaatctcaacgtattagtatttctaaccctgtgttgggaactctctaacaagggacagctgataggtctgtgtcattttgctgtgatttaattttctttttacaatggaagatcattttttttctggcacagaaatgtagccaacagaatattagccttaaaacaagtatctgtgtatcagctccagtgttctacttctcttacccttgggtgtgctcttctaagggtaatgattgccccctctccgcatggaacttcacatatgtaaggaaaacctaaaaccaatcctgtgagtgtttcagacgggctgttaagaaggaagagacttggagcctaacacgaggatgtctcctctgcctccatatttcagcagcatcttatccaaatgctaccaccttcctggcctggcttctcagtaggctcttttggatgcctagaggaaatgtatatttttaatattgttatacaagctgtctgatatgcctagcatgaaatctttttctaatcagttttatttcctcataaaagttaaattcgagcaattttctttttgaaatttaaagttaacagttacctttctaaaagtttaaagtgtcaagagatgaatcccatgagacagaagaaggtaatttgctacattactgaccccagtaaccacccatctgtctttcttatttggcttcaaattaggtttccaattgctttcctggtacagtgtttaggcttccgtgttatctgatcagtcataatattgagaaggtaaaatgtattctctttgaagttacagtttattaaaaattacaacctgaacttttatctcacctcaaatttacatatgcaaaataaggcttaagcttcagccgagaaagtgaattttcaaatgagcacagaagtgttcttctagactgtcttcagcttcaagtcttaattttcactcaaacaactataaaatgtcgaatatgtttgtgtattacacagctattggttatcatactgggacatagaagccatctgacgcccttatggaattttttatcataacatttatatttatttattttgaaatttcaagtcagatatcattggtatataaattgagcctttaggtccttttcatagtaattaattggcatgcatttatcttcaattacattatttttggtattttatcataactctgggctgttttagaacagagttcttatgagcacacactgttagatactttattatatctgcatcaaaagctgtgagtaagatgccagggtagtggtccatgcttttaatcccagcacttggcaagaaaatctctgtgagtttgaggccaactttgtctacatagtgagctccaggcgagccaaggatacatggtgagtctctgtctaacaaaacaaaacaagccatggagaagcaagaaaagttcttcaggtctcacagagggcaaggaagaagccagttaggcaacagtggctgtcccttggcttgaagtaagggaaagactacatttcaggagcagtgttaggagaggcaggtggcccaggatctcccttctgtgggtttctagcttcagttcttcatttactcctgggcagttctctttgagggaggaaagtagtctgcaggtgaaggccacctgacaccacagcactcagaggtgctccctgcactcagctgtattgtgccctaaatgtttgttgacacatgagtctgaggacggctcggatcagaatctctgtcagcattcagaccttttgttcagtgccagtggtgtaccattaccattcagaaaaagccacttatttaccgttagtcacttaaactataaaactannnnnnnnnnnnnnnnnnnnatcagacactctcatctggcttccttgggcactaagcaaagcacttatgagcaaaaaataaatattttttaaaacatttatttaatatttcaaatgataacacagatcagtagaacacacttcacctataaaaattgatttgaaatctctgtttaaagcataacttcagcatttgtcttgctttgtatttcatacaagattccagaagtctcacagttttcttttggttttcttgtgttttccttgtttttaacagatggcccataccttcaaatattagagcaaccaaaacaggtaagcgtaaaggggtcgggtgtttggtaatattacatctcatggtaaggctcggtctctgagtaatagttaaatctgatgacagaggtaagggttttatctgaataatcggcagcctgccgtgttatgcaataacttcctgtgtctacatttttcttacaaatggctttgaaacatcagttaattataaatccttggtagtctgtcctttttccagcttagctcatcagctgcttccagggaaagcactaaagagtctcattcatgaagaaatactcacacacacacaggttcacagccactctgacgctctattgctcatggccatgcccacagggtacccctcctgccttcataagctctggccttttctgtgcatagaatgtgtagcttaaggcagtaaacgcactgggagacattagagtggactgggagatctcccctccacccctctggctttaatcccagcctttttgaagcaaggagaggatttttttgtttggttgttgttgttgtttttgtttgtgtttttgtctggctctttcgctttctactaaatattgtgttcaccagctgaagattaaaatagcctcaaaactgcaaatatgctcattagaagttgcatggctctagtactgtaagagagaagagaatcttcaatatctgccgacagaacatttcagtcattatgggatggaagttatggtatagcctcccacagagtgagaaccaagtcactagatctctgggtggatatgctcatcacagccgtggcgctgaaggactgtatacctggcctaccgagttgtgtcacccaatgtcttttctaggctgttccttcttgtaactcaggagagtgggttaacacattgtgttgtatgacactcaatgctaagaagtgaatgctgacagcattcggtgctgtgctgtagaattctgatgtggtcagctgttaaataggagaaacatcttagggatgtccatgctactttgtaaagctgaaatcagatggaaatgttaattataaagacaggaatgtcacatggaactttggggcattgtttggttgcttataggcggcctcttaacacacacacacacacacacacacacacacacacacacacacacgcacacacacatacttatacacatgtacaccctccctgggctgcagataacacctgcccttgctttatctccacgtccatctttgtaaagatgatttctcacataaagtcgctgttctcggagctcttcagtagagttgtgttctgtgaaattctgcccagtaatctggaatcctggaaaatgtcctagcctggaagatttggtgaattcataaaactgatgagtccaaaatgtacctacacatcaaatagatttttcagatcctttagaaaattttaaataatttatttaattttattttgtgcgcattggtgtgatggcgtcagagcccttgcaactggaattacagacagttgtgagctatgacgtgggtgctgggaattgagcgcaggttccttgggagagcggacagtgctctgctgaaacatttctctagctcccctttttaacaatattaaaattgcattgatttattttttaatgtgttgctctctttgcccccaccccgtgtgtgtgtgtgtgtgtgtgtgtgtgttattatgaaccccaaagtcataggtatttatgatgtgtttgaacagctagtatagttccagaatttaaaatttaattcattttgtgtgaatatataaaatcatatatgtataaaacatcatgtttgattgccagtccgattttattttggtatctggctttagtgaaagtaagaaggttgtatgtaagccaggctttttgactggatgtatggagtctctctgaggttaatgactcatttgaagtaaatggcgttcctgagatgaacagcgatagatggtgaacgtttaatttcagaatactagaattagaaatgtgtccagagcgtgcattttaagacttcctaattttaggttgttatttaatttaaaacattagtttatttctgagtcaaaaaatgtctgtagtcattgctggcttcaaactggtgccagttttcctacctcccctctccaagtgataagatgacaggtgtgagccaccatgcccagctcaaaggcatcgatgctccagccgaacagcgcaatacacattacaaccttcagaataaatgctgccttggataggacgttcaatattcttattcgaccgagaataatacacagtgtcacacgctgtgcaataaatcatgctggctacagggttaaacgtcactccccataaggtatgagaggtacaggtacagatttttccaatgccacaaagaaattttgtaattaaagataaggaaccactatgttaagtttttgagttagaaatgttctttttcttggaggccttttgggcacagatgatgaaaatgaaccaaaccacagactacatgtctttagactgtccagttccgtggcatgtttctcactgttaactgtttattcatgttgtgttgtgttgtgttgtgctgtgtgagttttgtactgctttgtttggaggcagggtctcagcagtgtagccttggctggccccaaactcacagagctccatttacgtgcctctgcctcacaagcactggggtaagatgtgtggcagttataatctgaaggtgtgtttgaattttctcagttaagtggatccccatcctaacggcagcccatttggggctcttggtgttatacatgctattattgtatagtttgggggtgattgagttcaagcgttatccagactggatcccagtaatattaatttttacaaactttatgatcttattccttgaagtgctcagaagactgctagagtcacagtgtcgtagcatacagcatgtctgtaacacagatgcacttaatcctccagagacttgagaaggggcaccaggagaagggggatgtggggggggagcaccctctcagagtcgaggaggaggaggaatggggtgaggaacttgggggggtgatgtaaataaataaaataattcttaaaaagacacctttatggtctgtgatcagagcagataaaggaactcctttaagtaattagcataacttttactgatggcagagcggagagcttggcagcagccattggtaacgagaggctccagttgaataaagtgctaacgtatatccaaaggcttaaactcttcatcactcctgtgttgaaggtgggtgcctggcttctccgccactgctcagtgcatcattttcatagtggctgttagaaagcatttctccgtctgcagagttgtcttccacagttttgcatgtttagagacgtgtgtgtacatctgtcattgttgcgttcagtaaataccgctgtgttcacctctgcagaggggatttcgattccgctatgtgtgtgaaggcccatcacacggagggcttccgggagcctctagtgagaagaacaagaaatcctacccacaggtcaaagtaagtttgaaacctctgctctcactgcccaggagcaaagccaaaacgttcaagtgaatgtgactgggatgttcctttgcccctcagcgggagtgtttacatggttcttagaatttttaaatagaaattcacctcatgaaaatgacgaatcgtcaaaacaccattaacatctccatttaagtgagatggttccaacatcaactaagaaaaacttaactacctctccagtgatcttaaagctgtcttttcatcttaaagtatttttaaatattctctgatgttttagtaaaacttggagccaggtgtcatagtccatacctgtagtcactggacttaagaggctagcaacaggactgttagatatcccaagctagcctgagctacatagcatgcttgagctcagcctgggctaggtgagacccttatctcgtaagaaaacgaagaaaataaaaaatgtctttgaggcaaatttcaaatactgggtttatagagatttcatgacaagacccttgacagaatatatcggctatggagtatattaattatttaagatcataagttcagacccaagtgatggaataaacaggttgtaagcaggcttatctcactgaccaaacatataaatacacaaataccactagcatgtacttcacaaggtgttttagagtttcaatgaggaaatatgcttaagttctctgtagagagcctgagagaaaccgtgtgcagctaccatgaatgagttctgtagcatggggggcagaggggtgggggaagcttcactgtctttaccttggggtgtcgggtgtagcttcgctgctcttcgctttttacgttgttgatctagttgagactaccttcctctagttcagagtttctactttcctaatccagtgttgtgtttcagagactgacagtgattttccaaggaaacagttaaaaactttcgagtggtttaaaaggttttatttatttggtaatctgggcttagactaaatgttaccagcagtaaacgttatggcactccagcctctgtctttctgctggcttgagatctcagacgctcttgccctcagctgagctgacactggggaagttatcttcagttttgcctcctaggttgcttgtcccccttttaatgttgtacttccaggctcaggccttccaggttcttgccctctgtctaagacaaaagagccataccatcctttatctttccagtgaaaaaaatgtgaaaaagccataccatcctttatctttccagtgaaactcagctcctggcttgggtcctgagagtcacattttcattttaaggctcccagctctagttgtggaatgagccgttttttttttctcagtaaaggtaactgaacgtggaagtgcagtggctttagtgcacagaaggccacagttatattagacagtgtttttcagagaagtcgaaccaggtcggtgaagacagggagatagttagatggttgactgagcgatagcggaggagatgagagtaatcggcctcagctgtgacgattatgaacgacaccaagacccactctgcagcgtctgtaaaatgtgcgcagggacactgctaggattccagcacagaagcctgggcgccctgtaaccaaggggactcttcactaaatctgggcgtggctatgcttttcctctaaaggcaggagaggttggactgctgatgccctggaggggcaagaaatgaagagtgtcctccctcccattcaggtggggcagtagccggagggagggaaggagaggattctctggtgttttggtccagcaggtcttctagctgaagggaaggtcttccatcagtccagcaaactttccagtgtcctctggaaacgtgcacacagctaggaagcaaatgctttatcagctttcagcatctgcccagtgtagtcgactgcacaccggaaacttccctcaggacagtctgtggcttccagtcctgcagaggccaggcaaggaatgcagagcagagcaccggcgaagaaaacggttattccacacccctggtggtcctcgtgtctcccatctgttccctcctgtagccttattaacactgaggagctcaggctgaggttaactggccctcttcaaaggtgctgggcttctttctcctgcagctcactggccctcccatgtgagcgtgtgcagctgaggggccaggggccaggggctgaagaacaagtcaagaaggactgataaatcaagtcagggaggatgagcattctgaacagcaaagaagaaatgggggcagaagtcatcaggggtcagatctagaatttcctacctgtgtgtgtcctgtacaaatattgtgtgcaattatgtgtccttatctgcaccagggtcactgaacatcccttgtcagcactgatactgatcataactacttaagaaccgatgttaggagaaaaaagtagggtttttttctctattggccttctaccaaaaaaaaaagaaagaaaatgtacattgtgttctatttatgaactctttccttctgaggcactagaattctgtggtctgccatgcatgaaagatgggagtgtctgtagaaagaggcttccaggggtatcatggcttactgcatacccacccataattcatcgtagaggtgggtccatgtacttcctgagggagcgactcttccgtagccttgcacatgcaaggctgtgacttgcatgaagtatatgtcttcagactcaccttttcttcacccccactgacaatctctgtctccctggactcaggccctctttcctgccctgcctcttcaagcacccctccctgctgtccttagggagcgcccctgcaaggttagtggttgatgtgatgtgaagattgcagtgaagatctgaaggctcttgaaagctttgggaactggtcatgacttaaggctgcagaaaccaagctttgctttatggagcttgtaaacttacatcttgtttggtcgtctacttgttgactgtttgaagcatcaggttgacttgcaagctaactctaggaatctcccaaaaccagcacttcctattagaagtatttccacgctgtggtagatgctgggatgcaagctcagtcgtcaccccctccccccactgaggtaccaccttttctagaactcaggcggctgtaccatgtgtatgttcctctcgtgtagttgagaagaaagaacctctttggctctctaggatcttgttgtacaagtcttcacgttcttatttcctctctctcttttgattaatttctctgggattactggttcctatgtcctcacaggtatcatgaatggtttcttcagattgaagcattccttccactgccttcaggagctcggggtgggtgaatagtctcttttaaaccagctacttcatatttcaaaatattttaagcatacaagttgtaaagttctatataacaaataccatgtaccaaaattaataaatttaatagatggtaatattttgcctatttgctatctgtctatctgttctctctctctctctctctctctctctgattctctctgaagtacaacatagttacagtgggagcccctactcagccactgctctgtcctcttatcctctttctttgcccaaaggaaaaccactgttctgaacattctttatctgagatgcattcatatcatatactaaaatcactttcaagaaagttactttttactatctttaatccaaagttttttattatatatggtggctctttttcaaactatatccaggttaaaactgggcccctgaaggcttaaacattgattgctttaatccagtctcttcctctttattgtttgactaaaaatgtcttcagtcacagtgtggaatttatgctgacccttaaagcaaaaaatcatattcatgaggaagctagggaaaataaatatccagaatttaagaaagttttccacttttaaaaaatggagtaatccactgtctagcctgtaagctctccctccagtgtttgcttggttctgactttatctgcggctcctgggagaacaggagagacagcagagctcctctgggccaagcctgtcgctacctgttcttgactcagcaaggagtgccagggaaggctcactgccctccttttcccgaaagtggtgcagaaaaattttaaatcaaagtgtcttccttgagcaaatggaacagggccaagaggagaagccacacgtggctttaggaatgcgcctgcagcccgtcctcacttgcttgagtccttctgtgctgggcaccttgtgaacattgcacttggacatcagtgactttcatttctaaaagacagtttgtttgtaatcatccaatgccaggaggttggaacacagtgatgctaatatgacgattctgatcagctttgctggcagctgccctgcctgccactctcctggggtttgatggttaaagaacgggtttattggaatgtttctgtgaacaacagctttggctccgttctcccacctcctgtagtgtgcactcttacgtgcctctcactgaacagtccttaatgttacgtttccgtcaaggttaataaagcccggctgatctgctgtaggcttgaggatatcacatatctttgcaaaagcgccctttcccttgcacaggcttgtctgcatccggagacttgccatcctaaagatctagttggaatactaattttgaataatttagcctgatccagttacctaacatgccaggggggaaagatcaccacaacagattgggcattcagaacctacctagttcatagcatttattagaatgtcctttgacacttccaagtgtttactgtgctcaaataaaagaaaagagctatgttccctaccaatactatagtctgtgctttgtaacacacacacacacacacacacacacaaacacagagtttattaaaacaagggctttgtaacccaaggttcatggatccttttgtggtttcagaaaggtttgcaacctctgactctacacatagagttttatgcatatttgtatgcatttttaaagactcgaacatgtgtaaaagtaatgctgaagggcattggcttttttaccacagctgattaaatcgatctctacaattttggagggatgggggcgggggcggggggagggcgactggctctcactgtgtagcttaggctggccttgaactcatcttcctacctctgcctccagagtattgagaaattccagggatgcaactgtcttgaatgtttttcttctttcttttttcatttcaaaaatttacatttacactttttagttttacccattttaggcaagttgaagcgctttgtgtttctcagcatgtaattcaagctagttgctctttagtattccattgactggaaaagatgtgagatttagcgcctcctcacacacacacacacaccacaccccacccccgcctttctgttctctccttcctcccctctcctccctctctcccactcccaccgagtctcttggcactgactaaatacgatggttcaaaaccaaaaagaaaagagaatcatttccctgatattcactcagcacggtggcaagtcctgcactacaaggaggtaacatcctctgcgtggccataataatctagacttctgcataacttttcttctacgtatcccaggcgttttgcgattgcctccatgagtaaaatactgacttgttaaaaaacaaacaaacaaacaaaaaaaccagccctttatttcactgttagcattagaagttagagaaagctgcttactgaaggaaactgttgagcagtgagaattgatcctgagagttaggagagccaagctcctgagggttgcaggttgtctgactttccaggcttggtatggtggcctgcctcgcctggcatttcctcttcccctctcctgtttctctgcatactcattgctcttgggatgcttgttcctagtggcagtgttcagtctgaaatcatctctgatcaaagtggtctctgtttgaagaggatcattacattcaggccgggaatcccggtttcgtaaagccacatgtgaagattggttttgatgaggcagagtgagtaaccagagcctatgatcctcatgtccccagccaccttctccatagtcagggtctagggtctttggtgggtctagggatgttctgctggctctcctggagtccccatcttccccctcccactctaagtggattttaggtcagtcttccaaacaactttcactttcttgaggtctaatggaggtgagtgggaggatatctgggcagacatgtgaaacaatccagtctgaagaccaggggaatgcagagtaagtccccagcatcttcagataaccgagttatctatccattgcttgatagataagtacaaaacaggtttgcttgtattagagaagacttggaattgaaaacaagccagaagaaggtaaggccaaacacacatttttcaaatcacatatcattgaaatggtctagacattggaaaaacaatgatcaggtgggagagtggataatgaggtttctcggggtggaacagagaaccgtggaggctgggagaaagggagagctgaaagcagagcagagggtgtctagctgaagtcctgggagaaactaacatggctgcatgtgtgtgtgtgtccttctctacgcacagctctcagattggcatgcagtactcagcttgtgggcaacatattcacggtgttaagcaccagctgtgaactgatggccagcgtggggtgtgacattacttcctagattctcattggctaagctttgtgaactgatggccagcgtggggtgtgacgtcacttcctagattctcattggctaagctttgtgaactgatggccagtgtggagagtctcactggctaagctgcagcttcttcatctgtaaagctgacgtagagaaccaactcaatggaacatgtgcgtacattcagttgctcaatgccggcacacagtcagcctggaaacacaattacacccgttttcatataaaatttcaggaaattgggtactactccaaaagcttgtgtttagaggtaacacatgatgtcataggaaactcacagaaaacaagaggatagaaacaagtgttaggttttgttaggtcccttcactgtgtcctggtaggccctatgtgtctaatttgcacaacgctgtattcattcctaggttgccataacaaataactgcaacctgggtcatattaaacaacagagtttattgttccaaagttctggaggcccagagtccacagtgaagttgccagtgtggtcttgcttcccacagaggcttcaggaaagagtcaatcctggcctcttccagtttcgggtacttgttggcagtcctcagcaagctctagctgcagccacttctctgatctctgcttctgtcttcacagggctcttctccctgactttgtatctgaatctctccctcctttccctcgtaaagacaccagtcagcgtggttagggaccaccacgctgtgtagcaggacctcttcttgaccaatcgcatgtgtaggaagcctgtgtgtagatgaaatcatgttcttagctcctgcataggcccgagtcctgggagatgctcttctcacttactacaggcacgatgtgcagtggttacagagtgttcccgagtgtgtgcatttaaggccatgtcgttccgtgctgtgctcagaaagaagcctgtgtgcaccacgtgctcccctgtgtacctttgttagattcaggtagtggaagaaaatctctcaggtctgaggaaattgctgtactagggttttgaacatttattctagtagatggaaggtgtgctagaaagtgtctggcatcagactcttggatggcactctgaattgtagcatctgccagtttccttcccatagtaaatttcaggctgctaacatgaagtcaactggcttgcaataaataaataaatagataaataaataaatattttaaaaaacagtgaaaatttaactattctgaaattaactccatgaactagtcaaccggtttctaacctactaggtgttaagccagcaaagttagagcgagagaaggtgatacattgtttcctgtaggagctactttctatgcacatgttacataatataaagatgtgcaggctatgagggaacccgataggtgttacagctgggacttcattgtgtgatagttaaagagagctgcggttgagtgggattactgctgtttagaagcaaggctagacctcggtcccattctgccactcgctcgcaggtggggtgttcttcagaaagttgctaaagatcttcaaacttggttttgtttatgagatgaaagtagaaacaactccttcacaggaaccatgcgtgcttacgtaaaaaactgacctcttagaaaggcagctgccatagtcctggcacatctgcgtcattaagtgctcattcggacacgtgtgtagaaagagccatggagatgactgtttttttcctgagagcagaagcttgcaggtactttgtcaacagcacctagaaggatgcccatgtatagcagacaggcagcagttacttgtacagtgagcaggtggtcagtgctcagaagctggaaggatcatctaaggaggcacttgtcctcccatggtggcgctaagcaagtcactggagtggccaccaggtctccacctgtcactgctgctcactccccaccagcctgctcctctttgcttctccagcctggcatgactgccagccaggacagccacatcccagacctggctgtacactgtagtgtagctcttagacatagcaccaatctattctgggttgaaactggcttttctgccttagtttctaaacctattttaactgtccaattgcaaaataacacttaaagaaactaaaaaggtttaagcaaaatagacatttatttattttaaaaactgaaaattctaagggaagaagtagaaaaaagaaacccaaacaaacaaacaaatttgccaaatccgtagaaaaactcccattgggctttttagcatctcgacttctaccttagaggccactcagcagcagcaggctcactgtgagaagacctgcattcccaaagctgacatcaaagcttatgagacacccaactggcagttcctaggcctttggtactctgagttgttccactgcctgcccctgcagcagtgagacaggggatagggttgagccctgtgtccgtcagtcgcatactctgccgctggttctacaagtgggattagtcactgactaggaacatggggaatgaactgaggttaggattcactgagcaaagagctatgcgctagtgacacgcggatgctccaagatcacaaggattagctcattcgtccatcccgtgaccagcctacagtttctgaactctcattcctaacagttggtaaacccgggttcctctcttgagaatgactgttccatgctactcctaatatatgaaacttttgtttttaaaataaaccaaaaagttttttgtttatttacagatatcacttgcatttaataaaatttcaagaaacacaaagttataggtagtaagtccccttctgtccaagattcctttgttccctggagaggagagctgttaggggcttctcaagtgcactcccaaccgtgcctgccgtgtgtttaccatgtgtgtttatacctgctggcacacttccactcacgcttcctcgtgtaagtaagcattagtgtagcgcttgtgagcacggatgtagtctactaatctatgaaccatctgctgcttacttttttcacttactgagtctgaaatttgctcagattaacagcaaactccagagctggcaaatccagattcaagtccagctctgtcccctgagtaactgtgtaaccttgagctaactgaccaccttctctgtgcccctatccaactagcataagaacaactccatgtctcatagtgttgttgggagtactaattgaattagtgttgaaagagcaatgtctgctccagggaagagttctgatgttgaatttcctacccatctactctgtaaaggctgtgtgctttccatggctgcttggggcatgctgtcttctctaagctccatctgtcttctatcacaggccaaccttagtaaccctgcatgatagtaacttctcccttatcctggggtctttgtcactttgggatgttttgttattgagatagctttttaaaaatacttattcatttttattttatgtgtctgagtgtttttgcatacatgtatgtatgtgcaccatatgtatgcagtgcccacgggggccagaagagggcgttggaatccctgaaactggcgttgcagttggttttgagcagccatggggatttgctagaagagcagaaagtgtttttaaccacagagccatttctccagcccagagataccattttaaaattataatctgtgactgttttgttttgttttgttttgttgaaactaggttttaccatgaagccccctagctggccaggaacccactgtatagacaagtctggaatgggactcacagaggttggcctgcctctgcctcccaagtgctgagattaaatgcatgtgccactgtgtctaaccctttcttaatgtagtgtgtttattctttgaagagtcataaactagattttcaccatattcacttcccactgttctttttagctcttctgaggtctacctcctacctcctctcagtttcttccttccttcctccctcccttccttccttcctcccttccttccttccttccttaattcattcattcctttctttctgcctatgtactaatggatatgagactatccactgaccatggtcattcctataaacattttcctttcataaatgttactctatgcatgtggaggtcagacgcagctttctaaggtcagttctcactttctgcctgtctctcttgttccccactgtgatgcatcctccagacttgatggccctggagctcccagctggttctcctgtctctgcctcccatctctctatggggtgttgggattatagatgtgcatcacctaatagggctttttacctgggtcccagggtctcaaactcaagttgctgtgataggcatatataacaatgcttttactcatgagcctccctggatgctgaatttttttttatcatagctttattttgactctttattgtgccatttgcttcttatatgtttaatgatgtgtttttcaatgtgatgaccctttcagagagtctgccctgagttgttcccaggcctcgcccacttgagtgtgttctggggatgccttcctaatgagccccatgcggactctgatggctgccgtactatgtcttactcagatgtgcccctcctcatttctagaccttatttcatgtgcataagaactgtgtctttttagattccctaacactgtgctcagttaaattccttttcattcttgggtactaggtgattaccccagttagcaatagaaatatgcaattagtattagacataagaggaaacatgtctctcccgttcatctcttactgagctcttgctgtgtctcacagccaatcatattcagctccaccagggaggcgttggtatcctagttttcaattgggtttgatgaacacttggccaaaaacagcttgtctgtctacctttcttatgtacatgcacacacacatatctcctaattactttccccagcctagacttctccagaaaaccaggcttcagatctggctacttggtcgactttaccatttggatacctggtaggcttgctgagctcaaagttgaatgcttgattccctacttgaagttgtccactcttagaaaatggtaacccatcccccagtttctcagaccaagcggtcttgaagttattcttgacgctcctcttcttgatcaccacttataatctaccctactggctatttcttcaaactaattagaatctacttgcttgttgccagctccaccccatgagccctggtataaaccatccgcctcctaatggctgccatttgcatgggtgatgcctgtctcaagcaggtattgctaactgattacaaatttagggtttgctctatcattttttttgttagatagcatttatctttttgtacttttcaaagtagttttctcttcttcacactcactaaaaaatatttcagactagtttaaatgtttctaatctaaaaacacaaagtcaaaaaatgctctgaaagaaccaggggaaaatgaatgggggtgggtgggggggtaaagtacttgtcatacaagcatgaagagcttgagtccccagaacccacacgacagctcaatgcagtatagtagtgcaaggctctataatctcattgctcctgtacagaaatgggaggtaggcactggagactccctggaaatttacctgtggtcctgagcgtgtcagctgagtgcagttctggatcctcttctcatccgggagccacgcatcactcctgccatgatttactgtgatatttgaacggtgcttgtcaccaaccagcagaagtgttgcatgccagctctcgtgtccgctagacctcgctcccccactgctaactgactgggctcatcctccatctcctgctctgtcctgaaatggctcatctgtccaagggacctgattccttagcagagtcgcttttcctaggttttcctgaggctccatcattgatcttttttgttgttgttgtttttaagtcttgagttcagagcctatttcacacatctcattgttgccatcatcacagactctccttccctccccatcctaggtttgtatctccttttcccaataaaatgcaaaccctcattgccaataacactagaagtgcctactcagttgattggtcctacaatacttccaaacacatggggagatagtatggtttcaggatgacgacgccagtatcagccctagcaacttaacaaagagttgcgttttctttttatttctttaaccaaaattcagcagggaataatcaaccagaatagcgttttcatgggttacattcttttccttctaggaaactgcgttaccattgaactatagggttagaatactttgtttatgatgaatcttaagagttttcctattcctgctgattttgttttatttttgaatggtggcatgtatcggcctcaattaccttccatttgtgtgagataaactggacgatttgggaactatcataaagtcggtttgctttattaccttttaatcagagagaggaacaaagagttctgggatggttattctggaatgtgaacccagtaagctcacgttgtcacatggggtgttccatttctatatttggagccctcttagtcttcctcacagtcacagagtacacacatatatggttctcgcacataggcttggtgctggctctgcggtcacagacacgaatgagtttattcctctgccccgaggttacagagagtagccaagcagcagacacgtatgagatgatactggggtgtttccttggaatttggggaggatgctctgcagtggggtgcatatgtgtatgtgtgtgtatgttcctgaagtgggtggccttccctgaatgcattcctactgtgtagtcattccaaacttctgatggtggaatgccaggatcacagagcacttttcatactggatgtcagaggcatggccccttcacaacacacgtgcttcactgtcagagcggtgggcctgtcacactgcgtgtgcctcagagataacataatcttccaagctggtgatgtcatcctggagagacagagccaacgatgagccccaggggattgttcctaaccattttaacaagtctcagccctaaagtctttatggttcttatcaagttttttgacaagaagtggtagataacaaatactttaaattcaaattaatcttgaaaactggagcgaagtgccaaactcttcagccttgatgttgaacagagacacacacatccagaaaaaaaacaatgaatccacaaaagtacagagcagaggggtgagtcagcagcagtacatgcggagagagtagagttgacgtgcctagcaagagctagcaaggcctgcagctgccaaagaagtcgctcctcactaggcaacagtaatggaaatatgatgtataagagccaagaggtgatagtctcatggccaccctgcaggaagatcacactagatgcgtgcagcctgctgggcagagcacagtagtcggctgtgggcggggcggggccagatcaggatggttgtgtgaccacactggaatggcttacaggatggtcctggctgtcctcggtgtttgaatagctattataagaaaatggaaatggaccccaccatcacaagacaggggaaagagggagcggtgagctgaagtcccagaagacaccagcttcgtgggaatcacagccaccacaggacggggtgactttgtcgtcactgctctgaactaacctgaaagacggtagaggaagaaagggaggctgcgtgggcttcagcttcacagcctcggagtctctggctctccatccctgttttatatggcattagacagagttttgcttagtaaatcatacctttgtaacaagggctgatcaagatttgggtacaaggaagttataatttcataatttcatgatagataagaaaatataacaatagatgctagtgacttgctggccattttctccatgggtcaaagtgcatgacttatttttttacactagtatgtcagtttattaacacaggccgaacagtttagtcacagcttgaaagggtttggtttggtttggtcctgaaagaccaggtacagagtgataccagatttttccaacaacttgctggcattatcctagaaatcagtagaagttttggtgtttacccctccatgccttggtctacatcatgctatgcagatggcacactgctttggttaacctcagtctgacacgcagatcgtgagttctcttctgccatgctcctgtctgggggcgtgatgtgaccgatgaagtgtcaccaagaaataagacaaaatttcccaggtctactcactggcaattctctttatttagtaggggttttccacaggaaattgcaggagaagagttgaagtgctctttgtcttgtgtactttcctctgacttttctccttcccagagtggcccacattgccttgtaaaggagctgtgttgaccatgatactgatcaaagtcagagtgcgttctgccagtcagctaaagcctgattgctcctctgcagtggacttctgtagttaaactctgttttccaaacatgaaaacacataaacaaggactggagatatggctcagcagctaagatcacatacttcttctgcagaagacccaggttccgttctaagcacccacatcgggcaactcacaactgcctataactccagctccaggggacccaacacactcctctggcctctatgtgcacctgcactcatgggcacatattcacacatatatacataatttaaaataaaaatcttttaaaaattaaggaacatatacccagagagtaagtatttgtctctaagaagaaataaatcggtgatattaatctgaaacaaatttggacatcacagaatcaaaaatatttctgattatcctaaattaagatcaaaatcattttaagggaattctggagaggtggctcattggctaagctcttctctgctcttgcaaaagacccaggtttagcacccaggacccacatggcagcttggcaactcacagccatctgttgtcccagtgccaggagacctgacaccctcttctggcctctgcaagcacctgcacacacatggtgcacgtatttcagggaaaacaattatagacataaaattcaaattaattttaaaatgtcattgtaagatcatgctagataaattttgtataaatcatgtctgttttcagacagggattctgtacaaatctaacatgcattttagacgacttagttttgaagtttacacaaactttttttaaaactttgcttaaaatagctaattatgacttcatttgcctgttttggccctgccccccatggccaaagcctgctgacatccccaggaccaatagtcccttattctcagtactataataagtactgagctcccagggcagagcctgcactgcagtcactgaaaagcactgtgttgagtacccagacccagcctggatgggaaaagttaatatcattgcctaacatgaaggttttctttgtctctaaattttgatttttccatgctatcagaggcccccttgcaacaggtaatctgagtgttgtctgttttctccgtccgtcatcgtggttaagtgtattttagatgctcacaattgtaaagctaaattgacttgacaaggttctttccgacccaaattctgtgatgtccgactctttttttcttcttttattttggatttgtgattgttgaccattgtcctgtatgtcttacatatatactttagggaaccataagcattttagagctggaagccatgctagctgtgggctaggactagacattttgcaaagaaagcattaggagaccaaagtggttagtgattcaaacaaattcatagcagtagctaaagactaaaattctgaccatcttcagaggactaaaaataatcaaagtgttatctgaaaatttgtaactccaagccaggtatatatatatatatatatatatatatatatatatatatatgtatgtatatatatttaccccaaacaaattaaagcttcctataattctgtactcatatatgtatatggggtgtgtgtgtggagagagagagagacagggaaagagaaggggaattaaatatttttgataaacgtaagctttgataagatctgcctgacacaaaatacaaaatgcatttggtataaacagcatcattctccctttataccaaaaacggaaatttcttcgcattctatacatttgagaatgacacgtcgggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccgtgtttgctgctctgtactggctataacctgcacaagtaatggcctcaatacaactgttttctaataaaagcatgcgtgatgttatacctctaaagtaagattggtttatgtaggtctgccattgagagtggttatgggaggattcctgtccagcattgggactgtatctaaaaacagcagtctagctagaaaaaaacagcacctgtacaaaaaaacaaaaacaaaaacaaaaaaagcagcagactcaaaataggaatctcacaggtctaatgggaatcctgagtacttctgctgcagaaaagtatccttaagagagcccaggtgaaatagtgttcgaaagaaaaacagggacatgttgtgcaaaaaagatagactattgctttgtttgtaaggagatgggtcagccgtacgcgttttaatagagtggtaatgagcatcactaatccctgagcttcagagcacagactcggcgtctgtctgcaaagggggctgagttggagcactgttgtgattgattcctcttcagttagacttagagttcaagctaagatggataggcaaggcagtgagatcagaggaaagggctgagcacggggggaggggcaggggacgaggagggaagtgccctggctctgaaatttggcagttaagtggagataagaggcagcgcactcccacacactaggacggttttggtacagtggctctgttcaacaggaggcaacgttaggtttaagaaaaaaggtaagctgggcgtggtggtgcacgcctttaatcctagcactcgggaagcagaggcaggcggatttctgagttcaagaccagcctggtcttcagagtgagttccaggacagccagggctacacagagaaaccctgtctcgaaaaaccaaaaaaaaacaaaacaaaaaaaaagaaggaaggtaattagttaggcttgggcacatggagtgataaactgctgtgaacagaagggcttcctgctaagggctagaaatgtcacacatgcttatctgagagatgaaaacactgggttattggagggggctgtgagagcgagcgagcacagcccgggcatgtgtttgaggacaggagcctaaggagagccagaggtatcaggtcacagtggtgctggggctgcaggcggttgtgagcctctccaaacaacgcggccatgaacaaccaaattcagatccactgcaagagcagcaggctcttaaccaacaagcatctgtccagcctgtagactctaagttagtatcatatggagtagatgacacaactccatcttgtggatggatatcagataatgtgatgacttccagaaagagactaagagtcgtggaccggcgcttgtgagctctttgagaaggggaatgtagccaagcagctggtgatgggggagaagggaggtcagagggaccacgtttcagggattgtcataggtcaaaccataagtgactcatgggtttggaaacttaaggcagtcagaaccgttaagcaacctttatttgaagactagtagaagtacttaactttcagaagacttcgatgtgagaagctgtttctccctggtgactagagttgttcttgaacgcttgggtgtagagaaaggaattcaagcaagagtgggtagactcttttaagaacctttctcacagacttagaagaagaaaaaaaaaaaaaaaacgtcaaatgaaacaaacaaccccccaccccaagccagccctgttttcttggagtggcacctgccgccatgtgtttgaataaatgatagcctttaccatcatcaagaaagggctgctatttttagaataagaaagcaaaggaactatgtggatagctaaggggaagggtcatttagatgctttgtaggggtggagagtaattaggggatctagaataaatattgtgggtaaaacaagatggcttttcctggaaaagggaagagacacagttctctgaattagtgacaagaacaggtcctgagcttcagtaacagaaaggagagacatttgtggaggaccattgtggaggcttctcgttagatctcaggaaatcccagcagcagatgtctgtgagggcaagaagagataaaggagaattattttgcatcaagaactgttctaagcaatttaaattatctcttcttaatccttgtgaaaactcagagactatgacattgaaagttaaacaactttcccagagcctgatatcagcttgttatggagggtctaggattcagagctattctgtctgactccaacgcctgtgttcttatggtgagaggactcactagtttcaggtcttggaagttcagccctatatcatagcaggatgagaactttgagggaggtccatctgtccatcagagaaggatgctctaatatattggttctcaacctacctaatgctgtgactctttaatacagttcctcatgttgtggtgacccccaactataaacttatctttgttgctacttcattgctgtaattctgctactgttatgaatcataatgtaaatatctgatagcaggatgatcttgggtaacccctgtaaaagggtggttcagccccccaaagagtctctaccacgggttgaaaactgctgctctcgtgagaaattgtgaggctgagaaattggggtggaacaaaactgtagaccctgtaagtctgacagaagttaagataaatggacagaagacaatgtgaggcagatgcaggagacaagaggcctcaggtcagcagccaactggaaacaggagggaaggcaaaggagggttctgacttcatggggacagctgttggcttgacttgactttctggtggtgatgactgaagagtctatttccacagctgctgtgatttctttggaggtttcggtaccaattctggtctagagacaagaccagggtcctagacacacagttaagcttaggttgttctctggtatttaataaacaagctgtaactcaaatagcttgttgagaggctgtgttgggatccaggtatctttaaaggcaaaagaaaaagcatatatcactttaatttcttcctacctaatataactgtttacactttagtagtttgccttcgataaagaacatttagtgctatctcaattgttagtcacgcccacgttaacaaggtaaagttacaggaagtactgtgagcacaaggaataggaaggacgggtgaaaggaacgcttctgttcttatagtccttccattctcacatagaagataggacattattgatacaggggacatgttacatacttaacagttattaacatacagagaaaagatgaagcagggcagagagcagaagatggggtggtcggagcttaggtggaggaagattcgaaaaacacttgtctgagaagagagctgtgcacagactggagctggacagaagacagcagacatcctggaacaatgtcccagctaagcacgcaagtccaaaagctctctggtgggagccctcttggcaagttctggaacagcagggtctactatagatgcattggaaatacaagaatcaaggttgaatcaggaccccactcccccaaaacccccgaggctccctcagccgctgtcgaggctttttaagaatagagacattaaaatgttttatttacttctgttctttaacatgggaaattgtaaccatgtattcccagatctgtgtgttgaggcccttgtgctaatcactcaattaacatgggaaattgtcatgtattcacacaactgtgtgttgagcccctgtgctaatcacccagttccaagtgttttcatttttggaattttgaactgaggaatgatgacttagcatgtcctgacttgaacaaaactcactcagaacaggttctgaggaggcaggcagggagccagggagtagcctgagaagtggttatttggggcttcgtttgaagatctggcttgattttatttattttctaatttttttcaaaagaagaactgaaaaggcaaatagaacagtgaaaagagaaaggtaataaagaggacccagcccagggagcaccccttcacacttcaccttctacctagacgtgtacctgcctggcaaagggctggcagagggaatatttctaacaccatcctataaatgacaagccacattcctatgctcttatggaatcatggagtattaagcccccacacaaaggtgaggatttgtcacatgtcaccaaagcattgagacccaattgtacctgaggtacctaggggcgcttgacctctagatatttatgatgcatgtgataagtttgaaaattaaaaggaaaccaaaaagaaaacaaggaagccctgcatcaaggctgatgaggtgaaactttcagaacaggggtacatgcaggtagaggtgtttctctcttctcttctcttctcttctcttctcttctcttctcttctcttctcttcttttttctcttctctcttctcttctcttctcttctcttctcttcgtgtgtgtgtgtgtgtgtgtgtgtgtgtgtgtgtgtgtgtgtgtgtgtatagactagagtttattcagggcctggggaggggagttaagagggtagtggagtcagagaaaggcagagagagggagagagtagagaagtagttgctggccatgaccatgtggagagagaggagaagggaatggggagagaaggggagcaagagggagaggcaagagagcaaggcaagagtgaggtgttaccctctttcagagcaggatgtctgcaggtagaggtattaccttctttcagagcagaggtgtgggcagttagaggtgttaccctctttcagggcaggggtgtaggcagatagaggttttacttgcctgctctatatgaaaccctcctatctgagtggtggtttgccattgtagttgcagcctgactcttgagatgttgatcacactagtagggagtgtcaggaacagtgcaaatccatgaaccctggtgaaggtccaagtgtgccagcaatagtggtgaatcaaagaggttttcatgtatcctgtccctgctttgcattcccacaccaatattcagagggctaagagtgaactccacagtgttctgcatcttggctgtctctccaaagcttacatcacttgctcaggctgtctaaacttgccttcttatctgcaagttagggtactactagtgccaaccctgcctatctcagggtcatcagaaagcccagatgttctccatagataagagggaaggacaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaagacgagaccagtgtcatgagtccttcctatgccattagctataatcccgtttagcaggcttgatctgtgcttcctggttgcacaaataaataataaagaacagtaaactgactccctgtcatccttgagaggacatacattattaaaccaatatactatttcgtctctctccctccctccctcctttccttctttataatttgacttgactcaagaagagtaagcaagtagcctttttttttttttttctttaaatggaaaagactttcaggatgacaaggggactcttgctcctccttttcacacctagcatgaggcctttctcacaatatgcctcaccagtgccaacaaacaagcaggagtctctgtagctgtacctgtgctcagatcggtgattacagccatggcgcattaaagccagttagagagagaaaaataaccgagccgagtgttgacatggtgccgtggaaatgtgaatagactttggggaggcaatggcagaccccgagttcagggcaccaccaccttaccccaaaccattggaaccaggtggtgcatgttacttgagcttgcaaagggctggttctttccccggtgatatggggtgccactactgaccccacatggctattgtggggatttctccctcctcggctgtagagacagaatatgcacatagacttagatgagcacgtgctctgggaaatgaacaagcatgcgaagtaaggcgttatttaactcttactagccagtcacatatcactttcctaccctatgtcctccagtcattctcgaaaagggcacagtcgtggagccatgatgggctgacattgtgaggaaggtgggaaacacaagagacacgggctattggtgcagctgcttgaaggaactcctcctgtgcgctgttaatgagcaggatgagggctcgagagcactgagcaccctgcgagcatgactgcgctcgacctgctgagaatgcctttcgagcatgcgctctacccgcccgcagagaacgcctgccaagctgcctcatcctccacttgctccttgcttactcagctcaactctgccttcaaatctcagtccgcatgagttaaacacacggaagctttctctcacttcccaaccgtgccagacactgttattagacattctgtttgatgagttctccagttaggttttacctgtattgttgaagttatccagttagcgtcagtcccactgtttaattccgtgagagaaagaaattgggcttgttctgaacgaggtgtagcccccactctctgaccttctacagtgtggggctcttagaaaggggcgtaacaaactaaactggtaaactttagtactcagtgaaataatgggctagataagaaacaattttctgagattgttgatatcatcaggaaccaagtgttgtcttaactcctttaatcttaaaacagtccggtgatacttcgtcattaatttgatttttgaaggtggagaagctgacacacgtcactccacgacagctgggggatttgagcctggctttgagagatcttaacctaaccatgacctgctgtggtaaagagcaaggttgggttcacaagcagagccaggccctgttagaaccctgaggatgttcgaaagaaaaaatcagcagaaaagaatgattttaggtatgatgtcttacatttatgctgcttctgctttctgtcagagtacgttagccgaattcacccagagagcagcctggcttttgaaactgtgattctgaggaagttctaggccactcatctcttgttacccctttgaagaaacagcaaatgcttttccacagtaggtcagggctatctgaggttaaaaaaaaaaaaaagtacgtggctgactaagagggctatacctgagcccatgacttgtagtttttattctaaaaggagctctgacccatggacccagaattctagaagagttttccttcatcagggaaggccaaggaagtctgattgtccccaagaagggcagctgacactagaataacatagtattttgtagaaaaataaaacatagcaaaagaaagaaaataaatgtatttgtagaaaactaacaaaacactgcaatgtaggaaaaaagaaaaaccttccccttggaattgatgtgggccaagtatcttccagccacttgcttcaaatggacctattagacatcctctaagtgagggagcatctgacagtctgagatagcccctgagggttgtcctctcctctgctgagtactgttgtgaagtgtttgtgtacttgaatgtatatattcctcattaacagccccttgaacattactgaacaggtgaagagaccaagcaaggtcacacagactggaactgcctctcgcccccagccagcctagcctgtctctgaagtccacactcttcccattccgagcagctgactatgcaggatggctcctttggcttcttacctgtgcttgagtgcttacaattaagagtctctgttcagattctactctcagaaagaccttcctagtagacagttgccctctataaactttatcttcaagagacgtaatacttccattcccttcccagaataagtttctacattggtgttgaatacctcttggccactatggcatgataaatgatggttccaagaaatcgttgtcaaggtttgcctgtgccgcacagctgtccccacaagtaaggctttctttctctcagatggcatcttggaaagtacagaaagcccagggccctccctgttttcattctgtggtctgtgtaaaaaccaaatgctaccatcccgactacactctttcagatggatcaaacagcacattggtcactggcagatctttcaggtccctcacctcagagtcctcccagttcctcattcttgccgcccttcaaccatgaagttagtcgtaagaaaaacagtaagtgcttcttgaatgcacctcccacctctttccatcagcgccagtgactaactagcctgtcagcgcagcttcagaaggctcggattccaaactctcaggccttctcccatgaggcctttctgcttaagtggaaagcctgcctgatttcacccaagtgaagcgcttccttgagccttcctgtgctgtgttcctgtgcacactgtcagttaaaagtgggatcacgtgactcgctgcctctgccgatcattagcagaccgatgtgatcagccatccagagctggaatcagccatccagggactttgtaggaagagcatcatcagccttggagcaaaaccagaacttggtattcattgtcctacacttaaatggggaagtatttggcctgtgaagaaagacgacttgctaaattcacttcattttaatatcagagagagttttaagttctgtgcctaagaaagcaactcatgctttgggacagtcaaggttaaagttagtacaaaacctttctctgaattaggtcactctgtaactatgggaaggcagtcctgctgatggcctcgccgctctggaagaagtatgccctggtctgttttatgttgtgttggttgacaagcaaattacacaggattaaagtttgcttgggctggggtttgaagcctgggagggttcaggttgttggtcagccatatctgacaggaactttgcagcccaggacaagacaggaaattacataacaagagaggccatcttggctgaagtatctcttcctctttgtatagctcacagctccgtagatgagggctggctcttatggtgtattcgattttacctcctaaagatcaacttccagacaccatcactggattacatttctaggctcaaaacgtctcatgagtttcggggtgggttcagaagcaactcattataatgttgtatcagggctcaggcaggcaggcctccttggggagtctagagagctggctcgctggccagaagggagaccgttcgttgttcagggcaatggtatcttttctccatactctctggggagttacgcgagcagtgatcagcttcccggctctgaccatcaaaggttacactggagaaaatccatattgagagcaaactctgtagagccctgcctccgtggagtctggaccccgctgatagtagtgatattataagtgagcaggctgaggaaggctgtgtgtctttacaggaagctcctttagcagatgcaggctcttcacgttcacgttgacatttatccagagaggcgacgtacctcatgcatttctaacaataggtgggatttatggcaggttctgacttaatcgaattcagaggggagtaatgcctccgagctactcatggtgtgagtctcatggtgtgatttccacggtgtgattctcatggtgtggttctcatgttgggccatcttgacgaaaagttctacactgtagaggtcgggatggtcaactagacaagaaagacttggtcatctcctctctcctgtcctgtccattgctgttcttaccacgttacaaatacacaagtgaaatgatcgcctcacatggaaaacttaactttgtaaaacaagagctaaacaaccaaatgtgaaacctacaaatttttagtcagaaagtttgctttttttatttaagaaactcacagactcctgaacatatacagtataatgtcagaacccatgcctggggaaactactgaagagtagtgggtgtcctgttaggtgatgtggaccaagccatgggcttatgtcattaaaaacagcctccagagccaagcccctgaacaagactacctttctggtaatcacatgacaaggagttaggactcagtctttgtttgtctctcttacttcatcagtcacccattcccttctcgtgcatggtttgcccagttttcatcactgaaaatcgtgacaaggtttcagagaagaaacagtgttggttagtaaggacccttgtgacagtcctacctaatgaggcatactctgttttcagtgacttgtttcctggacatataaacaacccccactaccattttgatttatttccatcctgtcatgtgttcattgtatattttttaagttgagctatagtcaaatatgtatatatctgcaaaatgttgtatttatgctgattggttccatgttacagtcaggtcagatgtactaactgttgaaaatgtgcttctcatatagatttgcaactatgtggggcctgcaaaggttatcgttcagttggtcacaaatggaaaaaacatccacctgcacgcccacagcctggtgggcaagcactgtgaggacggggtatgcaccgtaacagcaggacccaaggacatggtggttgggtaagtgggctgtgtggtatggagggagcgggaacacgcgggtgtgaaatccataggcccctttccttgtggacctgtgcaaagcctgagagggtctcacacacgcgcaagcagataaagccaggggaatgtgtgtcctctcctttgaactgctaaggaaatagaggtgaccagatatctgtcctgcctgagacaatccttgcatctgtagtcttggcctctcaaggatgggtttggacaatgttataattataagcccttgacctaagaggcatttgtgccactttcaattatatttttcttctcctggaattaaagatgaagaaaagaatgaaacaactaccttaactatatagaaatgattaccatggagatgctttttgcttccttgaaacagcatctccactatagtttaagcttaccttgaactcacatagatcctgttgtctctacctcccaagtgtttgggtgctgggattagagatgtgtacccccccacacacacacagagctctgatttttgcctatttgggattttcttaatagagttctagtgggaacatttgagacatgaagcagataagtaaatattgtttcaactctgcgctacttataaaatgtgtgctttttaagtcaacaagacatgcaaattggtttgggcactcatttgatctggaacataagtagaaattagtgtattctttcaaagtcagtcaaatacaacaatttttagtgaatgaaattttatagaagtaatcttacttcaaaagaatcacaaaatatttaataagacataattatgggctgagagaggatgagtttagtttgcaagtatgatggcccaagttcaaacccctggcctctcatagcagcgcttttcagagcacaggcatttatcctcccagctcctgcaggggagcaagaggcaaagacaggagaatctggaatctcatgcagtagctggcctggtgtggtggacagacaccaaacagatcccatgtcaaacctgaagttctcctcagacctccatatgcacagcacatcacatagtcagctgcgttcgcacacataaaataagggcactcactatgctaaggttttatatttcattatcctgaaacactaaaatagcagacaatgtagtaacttaaacagcaaaaaatgatgtaagcattcagtcatctcaaatacagataactcctattttccagactcttaaaaagcaaaggggatgattcagtgggtaagtgcactttccaccaaatctgagagcctgagtccaactcctgtaagccacatggcaggagagaaccaacttccacaaattattctccaacctccacatgcaacaaaggtataagtgcacacacacaccatgtaatataatttttaaataaaaaaaagttaactaaaatatttttaaagccagaaggtaagaactggggagacaggtcagtgggtaaagtatttgcaatgcaaacttcagggcctgagttctgagctccagcgcccacatgaaaatccaggtgttaaaaaaaccaaactgataaataaaataaaaccgggaaagggcagagcacagcggtgcatgcctttaatcctagcactcaggaggcagagtctaaggccagcctggtctacagagtgagttccaggaccgccagggctacacagagagagtctgtctcactgccccccaaagccaggtgtagtgatgcacctggaaccccaatgtctggccacagggatggagcagatccgcggggctcacaagccagtcagaaagcacggcccagtccatgaccctgtctcaaaaacccgagaagtgactgaggaaaattccctgcctgtgttctctgtggtgcatgcagatacattgttgttaattttatttaattgtgtacatcatcattcagagttctccagtcttagatcaagtagtgtctgggaagaccccagtgaatgtgtgctttttttaggagattgcttagccagccttgatgaagtctgactctgttgccctgcaatcttgggaggttcagctttcaaagtcccaggcatcatttcttcatttgacgacgaagatgctcaagtgtgagaagctcccagagagagggcccttccctttaagtcattcatctctggtgctttttgacgttagggagaaaagtatccgaattggaggaagctgaagttagttctcgtggacttcagcttgtctcggcatctcctggctgccctgcttctcaatctgccgaaactgacatgcagggtgactgtcagttttagacaactgatcggttagtgtattccctgattgattggccacatcatagccaatcgttttgaagcatttccgttcttttcgtcttgcttaatctgtcttacaatcatatgttcttaaggaaatcacaggtgaacttttctatcagtatttctgtcagtaatatttattattataaaacttgcagagtgttgcttctctgttgggtttaataatctttcatgatttagaagaaactaatggtggctgtgtctgctgctctgaggtagacacaaggccttgggttgctctcccctgcagcactaccgccactaaaaacactaatggctgtttatgctggagcctaggttgcagcgatggaggtaaattcagtacctgtaagcagagcggagaggtccgtcggtgtcttttagtgtagtggggcacgcggctctagagttgggagtgtgcattactcatgatttagcaaacattttcgacatccgattcctgactaggctccctgtggtttgatctagtcatagctgggtgggattttctaaggtgaggaaactttctcggagagatgcagtcgaggagatgccgcctgagtgatagggggtaaccacagtagcttttcccacccaagaatctctcactgtagaatgtctgcagtcgctttcccggttggcatttagctgagagaattctgctcatggtattttccccagacaccattttcttcgtgattcccttgtctctgtgtctctgagtttctaacacggtcctacaccttttgccttttcttctgtttctcttggatggaaaagcagcgtgctagcagccgggaagtcagagctcctgtatgcttctgtcactctgcacggcagaagggatggaggccaagttgcatgactttctaaagacttgaattcctttccttacaaaatcagaaagacacaggctctgtctatctccaggcactcagtgtttaaccctctagaccaagcccacattagctaatgttataaaacagcaggaggaaacttgccactatctcctcatggtatgacatcggttattttatttagttctgacttgtaggccagaagtttaggaaggcagccaaaggtgtttcttagacttgtcaatactagaaatagaaccaagataacattttccaatactacagattagactgaatatagattcacaaacaaggcaccagtccaaactatcaacatatgtaaaaatgaccccaagaagaccaagctttgaacacatcaaaaccaaacggaccccctttgtttacagtgtctttcacactttcttctctgtttgaattcttaataagtttagtttctatttttccaaattattttatcagtattagaactatcatctcttggggtttgattatggatttgattgttttaatatagggtcattaacttcagttagctttcattagacctcttgtctcttatgcacttagttagacttcactgcctttcttaataaaaaaaagaagaagaatcctgtttagtattctattttgaccagaatgttaatatttttagcaacactctagttctctgaaattttttgttcagtggaaaatgtctgtgcatttctactttgctgtcggccacgtccaccaaaagtcaccacaccctgtttgcttactggcaacctgggttgaaagagatgtacagttctttttatttccccctcccaactaatttatgtagcttattgcagttggtaagcaggagagcagagattctcaacctgtcggttgcaacccctttgggcgtcaaatggtcttttcacagagcatgcctatggagatttatattaagctttataacagtggcaaaattacagttatgaagcagcaatggaataattttatggttggaggtcaccacagcatgaggaactgttaaagtgttgaagcatgaggaaggctgagagccactgccctggatgatagtagatatgagaacacacaggagagcctttgggctccctcaggagaactgctaccttaaattactgctggacagatccagtgtaattgtgtagctaaacactagcccacaggagaggcactgcctagagaaggttggacaaatatggacttaggttcaaggtgtgccgtaccaagttggtgtatgcactgtgagacgagagctgcttttgaacactgaaatcaaggtctgaaacaacaaaggccaaagaggggccactgtgagccccaacccagtgttagacacatcaaaatttgagcaacagcttccaaatgatgatgaagatgaaacatctgacctacttcagcatgtttattgatggctacaggtttgagtcagcctgggtcacttcatagaaaactgatgccagcctccatcccatagagtgggatttcacagagcagtgaaaagccaggccctccagcctcagcattcctcttgagttaatggaaaggtttgtttgaaaagtcctgattccgtagggttggatggagccccagatttttagtaaattctaaaacaacactgatgttgctagttaaagactcccatgttgtgaatatgagaggaagaagcaaggttgtggtttcagcccttttattagtggttgtagcctttctgtttttaaaatgtcattgctgcaacactcctcctctccagtgttcatttctgtgaattttgataatcatgtggctactcctgatctgaggctgatgagttctctttggttttatgtctgaaagtcgtcccttcatcttctctgttcaaaggtgttttttgaagagcagaggattctaagttgacaatatgtactttcatgtgctggttttatgttgattcaccgtctcaggtcttgacctgtttccagcaagagctctctgtaggtctgcctcggctctactgttcccagagtgtgattgtttctctagcagcgtcttgacttctctttagcactcgtaagcagtgtgagttttgatgggtttgagggtagctttctttttaagcttgagcttcttagtcgtcatagatccttggatttacatttcttattaaatcttaaagcttttcaactgttaagttttctgtcactgtcactgcccctgctccccattcctgttctctgtcactttctctcttccagactagggttgagttggcacagtgactaagagaataccttctgaatagtcaatctgatgcctcatgtattccgaggcttcctgtttatgagaatagtagctctttcccttagcctaacagggctttctcacaaatgtttcctttggatttttgaaaatctgtgatgctctggatataaatcctaatcttcttaacctcaagtctttgcaactgcagagccctagctggctgcctgggttctccttcccatcctgcaacctaagcattaagccaggtaattgtaagagtacctttctatttttttttctcggatgactgttgtgtgtcacctatctccagagcatgacaatcgttttctcgtgtgttttggctatttaattctagaggaaccgtctaggtctatattactccaccatggcctgtggtggaacactggtgtgttgtttactagggtaaacccttccttcatgattcatataataaataagcatgatgcctttctccagatgtgaagctgggttacgtgtaagaagtgcagccgaggtgatggtcactgatgttcccaggagatgagcctgggctcctagcgggggagcagtctgcacaagagtgagacccaaaagggcagacacaagatctgttagacacaaggacctccaagcacattagcaggttgggtgcataatgtttgtgatgctccctccgttcaagctttcctgtggtcagcaggcacctgctgaggacccacatgtcagcctgcattctaagacctggggatctctgtcctgaaggagctgtggaaacacagcatgttgacttctctgtgtccctgtaactcactccacatctggccttctgtgtgtgtctgtttccttctgccttcacctcttctcctccctttctccagtttatatgacctttgcacagtagcttgttctcatgtgtgcaggcaagttgtcagatctcttttattgtcattttatattacatttaccgtgtgtgtgtgtgtgtgtgtgtgtgtgtgtgtgtgtatgtgtatttctgcttgtcgggggaggctatctgttctctctctctctctctctctctctctctctctctctctctctctgtgtgtgtgtgtgtgtgtgtgtgtgtgtgtgtgtgtgtgtgtgtgtcagtgtcaaagcccagaacaacttgtggaagccgcttctcttcccctcctatgtgggttctagggattgaactcatgtcaccaagcttggcagctagtgttcttactgacttagccatctcactgacctgtatcattttcttccttctactaatatttattttacttttagagtaaaagtccttacaaacatctatatggctctgagagacccaggccctgcacttttctctttgagttcatctgtcccctctgactctgctccttaccctcagcccatgtgccacctttctgccactgtcaaaaacagcagagtggccctgccatgcggtcttcacattcaccagagtggtcctgccatgaggtcctcacactcacctgtctgcagctctgatacttagaatccacttcttctgacctccctcaggactggctcagctgtgatctcagggtcctgtctgggttctccctgtctggctctcctaccctctcacccctcccaggcctgtcttctttttcttgtttacatgtatttctcttttaagttacactgtgaaatctatcatcgtgtacgctagcatgtgcattgtgtgagagcacagtgaagccacacaagccttccctagtaaagcatacgtacaagggcacccgtactctgtgactcctgagttgacatctaatatgttctgagacgtaaggtgattcaagttttcctccaactcttttagtaacccagtttaacctggtctgacaaatccacttctgtgatgagtctggttagaggcctctctgcagaaatgtcaatgagctgagtccatggtgcaccccagccctgccaacagtgtctagtgacgtacagcatatgccatatatcaccctcataaagtcccaaattctgatgttcatctgactttggtctgtgtaagatgctgagtgcttgtgtacttttttcggtgtgctgtctgctgacctgaagcccgccccccggccatgacctgcctgacttctgctctcactgtttttctccagctttgcaaacctgggaatacttcatgtgactaagaaaaaggtatttgaaacactggaagcacggatgacagaggcgtgtattaggggctataatcctggacttctggtgcattctgaccttgcctatctacaagcagaaggcggaggagaccggcaactcacaggtgagccagctgacccagccttaattaaggcttctatgttccaggatgactgcagccatcagcgtgccaggctatcagagggaaggggatcagtgcagcccggtctttcctttctgtgctgggcaccgtggagaagcggagcccacacacaaagactctgcatgcttgttctcacctatgtctgcgcagccggcggtgcagagacgtgcatttccctgtactcctcgcattctatgtgtgccttaactcttagcaagcgtaggagagtagatgggtgagcatgggagaagacaatatttacaatactccagagaaaacgcagcttacctttgatgggtttttaggcaatttaataagaccattgtgtaaaattttactaacagtttaaagaatttcaggccaaagtaaccaaaagaaaaaagaagactcagttattaaaattaaaggtgaaaatcagggaaacattaccagaggtaatggtcaaatccaaagaatcattagggctttgaaaatatgtattacagcaaattagaatatctcacagaaatgggtaagttcacaggtacatctgacctgccagtgttaaactaagaagatagaaacaacttacacagacctaagacaagcaataaaatatctcccaactgaaaaatacccggtcctaaatggaatcatggctgaattctgtcagatatttgaagagataacgtaaatcctccttaaactgttccataaagtagaaaggggaagaatatcaacaaacttattttccaaagccagcattacttttatacccaaaccaggtaaaagaagaaaagaaaagaaaagaaaagaaaagaaaagaaaagaaaagaaaagaaaagagaaaaggaaggaaaggataagccgattcatacattcccaataaaataatagaatgaaatgaaaaatatacaaacgggaaaggaagagatgaaagagccctatccacagacaatattgtcccacacacaagagcccagggctgcactggagaggcttagctctgattgaggatcagccctgcgtcatcaccacacagaccccgtggttttcctatatcgatagtgagtgtgtcgagaaagaagtcagcaaacgcgacggccgagcacagtcacaggcatccccgatagcttcaacatgagcaaataaaactcctggcaataaactaaccatgtgaaaagtcctttacagtgaacatgttaagacacggaagaagaaagagatgtcaatcaatgatggaaaggcctcccatgttcctgggagttaacagagttactaccacaaaaatatggccaagtgtggtctgtagattgaatgcaatccacaatgccaataccgttcctcctagaaaataaagttcacttgggacgacaaaaggtctcaggtagccaaagctataggatagtaagaatatttcagaggtatcacagctgctgatatcagaggtatcatagctgctgattccaggtcacactacagagccatggtaacaaaaaaagcatggaagtggggtcaaaacagacgtgtaaatcagcagaagaggagagtcagaaaggaacacaatgtagccacctgatacccgagaaagatgccaaaatgtgcattagagaaaagacgggctggagaagaagtgatgccggtggggaaccggctagcacatataaggaagggaaccagatcccaggctcctaccctaccaaccaattcaacacggagcagagatcttaatggaaaaggtaatggtctgaaacagctaaaggaaaacatgcagaaaacgcttcgtgatgtaggcaagccctttccgaaaagggctccagcaactcaggaaataaaatggagaactagcaactgagattcaaaggcgtcacagcagaggaaacagtttcctgagttgcagagacgacagccttcagtgggggaaagaattgttgctagctatgtagctgacagattagtatctaggttctataaaaactcaaaaaaaattaaattctggaaacaaacaacccagtaaataaatgcgctcagaagaaagagagggttctccaacaatgagtgcaaacagccaacaaatgtgaaagcatgcttcacacccttagtctttaaagttcctctgaggtcccacctcaccctggtcagaagtcattaagaaaacaagtccaggagcctgccaagtagctcaggtggtacagtacttacctcttgtgtaagaagtcctgggtttgattcccagcactccctacaaacggctgcactcccagatgagttcaaggtcgtccccagatgtgtgtagcagatgtcttagcaggtaacccatacaaagcctgctgccctgaattcagtctccaggacccacatggtagaaggagagaacccctcccctcaggtggtcctctaccctaaacacacgtgtgttatgaccaacaaatgcaagaatgtaaataagaaaatcaaaatggagatttagaataacatgaagtaaaactgcatagacacagctatccactcctgcggatatttacaaaactctaactccacgtactataacatacatatttccctgcacatatgtgtttatttcagccatattcaagagctacatcaaacaaccaccgtagctctccattagcagatgatggattaagaaagcatgatatacatgagtaatggagtttttttttcagccattaaaaaaaaaaaaagaaaaaagaaagaagggctggagagatggctcagcagttaagagcactgactgctcttccagaggtcctgagttcaaatcccagcaaccacatggtggctcacaaccatctgtcatggaactcgataccctcttctcttgtgtctgaagacagctatagtctactcacatacataaaataaaaataaatctttatttttaaaaaagaagggaagaaaaagaaaagaaacatttgcagggcagtgtatgcaactggagatctctgtatcaagagaaataagccagaacaaagaagatgaacatcacctaccgtctctctcggttctagatcctaggttttatatagatgtacataagatattttgcatatgcgtgcataggatatgaaagtaagaggaaggtactccgttggtagggaggggacgagtggatatgaggaggggagaaggggccttaggtacggtcacagtgcttgttctaggatgaaaatgttttcagggagttatcccgatgagcactgagtatatgccaagaaagactttaaggaagtgtttctagaggaaaagaattggtctttgaggccatttgctgtcaaatgttcacactctgacctgcctgggcatgagcagactgttctctgtgaccctagacagagagaaggagatcatccgccaggcagccgtgcagcagaccaaggagatggacctgagcgtggtgcgcctcatgttcacagccttcctccctgacagcactggcagcttcactcggagactggagcctgtggtgtcagacgccatctatgatagcagtgagtactcgttcccaagatgggacagtttcatctagctgcatggagggcagggccaccatgtcacttactccccagagctgaggcctgcagactgggacctagtcacatagagcctctagtttattgtctacaaagttaatactgcagtctagggtaaagggtcaatatccagttaagcgtcttaagaacatgtctgccaaggtaacacgtcttcctcagagagtgcattatattccttacatgtaacaccagtttcttactatgaacacatgactgtaaggatagattgctggtgctctaaaaaaaattaccttaatttttgcacctggcagcacggaagaaaaattgatagaagacaagtatccctcttgtctctctttatccccagtttgaaatacatttattaagacaggaacgtcaaggtaactaaataaatgaatagtatgtcaaaatcatctttcaggctgcagataatagaatgtgcagggtttccagtagcttgtagaatttactgtgtggctctattgttcgatatgcattgggcttaacaaacagttgtttcaggaaccctgcaagcctcactgaatggtcatagaatacgatgcacaaggaaatcccatgttctgcatccagccacgcatgggtctgtctgatttaaacaagtgtgaagggaagtgaaaagtttattgaatggaaaagagtcttactgaacagagatgagctacagctgttggagtttttaaagggggaagctttgccccactcaccactatgggcagctttgccccaaaccacacagaatgctaatttaggttgggggaaaaaaaaccagaacatcttcacttttctttgaagaatatgtgtgtgtgtgtgtgtgtgtgtaaatgtgtgtgtatatatatatatatatatatatatatatatatatatattagcttaaaatgtcattttcttaaaatttttaagaattttacaaatgacataaagttagcatgaaacaagccattggtccagaaacatcagacagctctctccttcctcatcagcctgtgtgttagagaagccatatgccaccatccctccctgacctgctcctttctggggaaccatgagtgccccagacccaagaactgctcctagtaccttggaagtctttcttgctctatttgtgtcttgttaaaggcagtaagagtgagcaccatcatggaatctttgtgaggctaatgctaagccagggtatgcattctcttctccctttgaacagaagccccgaatgcatccaacctgaaaatcgtgagaatggacagaacagcaggatgtgtgacgggaggggaggagatttaccttctctgtgacaaggttcagaaaggtacgtacacacctggtctctagatgtagggtgtggctgtcagagttctctggaaacagcggaccaggggtgttctccttttgctgtgggagtctcaaaaagacagcgttcttcaacaccattacacgcattgcaatcacatgcttgaatacgcccgtttgcagatgacatccagattcggttttatgaagaggaagaaaatggcggagtttgggaaggatttggggacttttcccccacggatgttcatagacaggtaggtgggttattattgcgggttttattttaatgcacttctgccttggtgaaattcagtgctcagtttccacatattaacaaagaaaccgtcataagtctctttgacatccatacagcaatgctatgtttatggctcttccagtactctgacatagaggctgagaagtctaaagggctgaagctgatgctgtcctgatgagctggtgtctctggctgattggttacatgaccagggtctcccagctgatgacatgagccaccacagtaatagtcactctttgacagtgactgagaaatggtgtttcaaataattggcaacaacccaaatgttagccagtaaatgactaattagatagtggtgtatctatgtaatggaacatcatacagttactagaaaagaaggctctgtgaatgaacaaagacctcaaaatagaatgcaaagatttgtaacaatcgatatggaacacactgtatgtagaaacaattctatgtagaaacaattctgtgttcacgtgcacaggaagcctgagacaataacaacatcagctccctctaggatctcaagttagtgcatgagtgggaagcggggaggcagggagaactgtcagcatatgctacctattgctcatcctatatttgatgacatcttgatccttataaacatagaaagaccgaaactaagtctgtccagttccttattatcccagcactgcccaggactagcatgtgacacctcctgcgcagcctcacttagcatgactgtctgcgggctgtcaggggcagccctggttctgtctgcttccacatccactccttctcttgctgctggcagtgatcctggatgttttcaaggctaatctgaaagagaaatggctgagtcgcgtgatccgccatcatgctgttgtgttttactttcacgggggcagtataagtgtgggtataaggtactaactgggaactttctccaggtgctgggtttgcacacactttatttaagttcagagtatacatagacgtgtatagaatgtgcctgatgctcaccgacactagaaaacaaatgtcctacactaatgtttgggtcttttgcaccctgcagtttgccattgtcttcaaaacgccaaagtataaggatgtcaacattacaaagccagcttccgtgtttgttcagcttcggaggaaatcagacctggaaactagtgaaccgaaaccctttctctactaccctgaaatcaaaggtacctgggtggtttagactcttgtgcttgctctgaaagaccagtgggcccctcctctactcagcctcccagaagctgctgcctggatgcctggatgcacgctgcatagtgttaggggcaaggaaggtcatatgccaaggtcatggaattagccccaggaatttatgttactatattgctgccaaacttatatgagacttagacatttggctattgttgggtattagaatctagtatggagccagcaagatgggtaaaagcacttgctgtcagggctgacctgagcctgagtcccaaagctgtgtgctgaaaggagagacgtacctgccagaagatgtgggtggtcctccaccaggagggggctgggcggggaagaaagggaaagtaaaaaaaaaaaaaaaaaaagtaaggattttttcagctactcagaagcccttaagaattaaccagaaggcttagccactgtccagcccagaactataaaatgagatggtcactatactttcctcacaaaagacacctcaggaaaggtgcactatagttaaaatgcagattacgattctttttgacgtgctagacatcatattctctgggccttgtagacactaggcagctgctctaccattgagctgtaaccctggttctcaaatgataagtacccaaagggaagcatccacaaactgtatgaaatagttgaggagacagtcctggattccttggtctaaagaatcagccaaagaatttctcttcagtgggaagccacttaccacattatgaaggtgaatggaagtcaaggctctgtttatgaaagagagatgttcagaggcagaggtgtggcagctggtgtttgtcctgggagaaatgattactgtgaatctgtgtggactgaggaaggttgatttaggcgagggaggccaggtccacgcagtgaagcgtttctgtggtagctggaggtttttgctttgactctgatggctaggcctgcctgctcactgtctggaatgatgtggtcagaatgttgctagaattcagtggtgcctcagcagagttagaaagggttctagcagccagaagttagcatccagcagatacttctatgttggtgctgtggagacctggaccttgggtgaagagaaaggaagagagactcgagagtctcagattgttctagggtttccagactagaagtgtatgtatggagtggttaagtggataagaggaacaagagagaagagtctgagaatgaaagagaagcttagtgtaaacatatttcagttggggtcaagtgcaggaagggggccagtcaaaggcatgactcaagtgggtgggggctcagcactgaagagaatcccggccccacagagtttaagtgtagggacgcacagtgctgccgtcaacctctctgtacctctgtttcgtaagttttgtcttgacggccatggttctgagaagagatccatgaacttggaggctacacaaggcctgggatctgataaaatcagaaatgtctggctcagagagaatggggctggagaggatgtcaccaggtacagggtcctaggtccagggccaccaaggcccccaggtatcggtcccttgaaggcaaagcgtgatggtggccaggagtttctgggaggccatgtctctttttgaggtatggcctccccattcctgggtcaggcttatggtgagctctgtggctggcctacttccttcctcaccagcttgaggtcttctagatccttctgtccagacaaggcaacatgaaattactgctttacctgaagcctctgccctctgaaaacaggaaaaaaagattatttttctaagaaaaaaaaaaaaaaaaaaacagtgtatctcctgaaatgtgcctttaaaagagcgttgtcattgctgatgcagaatcatgagaaaaagaaaagaactgcaggttccctgtgcaggatgtgagccttgaaacgctgagagtttggttgccaggcaacctctcctgctagtgtctgcatctgaagagtacagtagacaaggcccagcttcctgggcactccacgccagcagagtgggagttttctaatgcctggattagaggattggggttccctgaagtcctggttacctcacatcttctaggtcatcatgaatacaaatggtatacttgaaatacaaatgaggctccacctacacacaggatggctgaggtacctgttgtgttccgtgtttctacactggaaacattttctctgtgagatccacagttcatccactgactaaatgaatatagctattggttttggtataactggtgggaaaactttataaatatttctccgagccatcagttagaaagtagacagtctcttcacctcagcctcactcctttctggccgaaagccgttttcttcctaatcatcctggtgtgcccagggttggtttcccagggactggcaaagtccaccatgctctcctgctttccccatcagctgcagtagacagtccaacatagtccaaaagtccttgtgccacaccgtggggtgatggaaacacccacagaactagagaagtagggatctttctgaacatagaccatgatgaaagccagcattaatcagtcagacacaggacgattgttcagtattggcctatttcctggatagaaagcaccatgttgactatttaatgtaaacacaaaaccaccttcacttctcagccccaaagacaaagaaaacaaacaaacaaatatctgctaggatactcccagaccacaaaggaacaggagcaccatgtcagatctcccacacagtaacaggactgagaacatggtggctgaagatcacacgggccatgacagaactgagggcacatggctgtcgatcacattgcagtaacagaattaggggggctgtctgggttagtaaggaacacagacagtgaaagacaagaggaacacagaactctgtgaagagcaccaagataagtctcggagcacctggacctgggcaggccactgtcccagaggtcactcactgtcccagaggccatctttattttggagtccgagatctcaggagccaaaacatctctgtacaccctctctgtgtttctaggatcgacattatatctcttaccacaataaccagtaaggactcggtctccattgcctcatgcctgcactgtcttccttagagtttgactctagatgtcctgtatacagtgatagatgtagctcctaaaatgctgtcctctatgtcattctctgagacattcagcaagtccctcacattcctatccctgaggctcctcagcatgggtgaccccagtcctcctttaacctttattatcaaaagcacccacccatgttatccctctgagaagccctgtgtcttcccagaatatcatgttcttcggccatagttgttagcctttatagaggcttgtcatgctgtaaatctgttttcacgtgatttcacatgatggtatgatgcataccaccataatccatcccactaaatccctctttgccttgaaattgacggtccttgacagcagagatgtgtgttatgtttctgtccatcccagcaccttgctcagtgtatgtacggaataaatgtaagctggttattatagttgtcttaggtgaacaaggacaactgttctgaacgttagctgggtgtggtggtgcacacctctaatcctagtgttcacgaggcaaaggcagttttgagtcttgttcaaaaccaagctagtctacatagtgagttccaggcagctagagttacatggtgagaccctatctcaaaataaagaagtaaaagtgctttaaaaagaaaaaaatatgtgtatctttgggttatctgaatcttgagaagcaatgagatctctcaccatcttgttagcactgggaacttaggagggggcgctcaggagagttgggtgtgtgccgcactgtggtctctgaggcgtgctcttggtcttctcgtccattggaataaaaaccatgcttcctcctcgggtgcctgttatttccctttaatgcatttaaaaatatcatgagaatcaatcgtctctctgcggctgctggtggaacccgatcagtctttcccccctggtttcccttcctgtaaatacagacaaagaggaagtgcaaaggaaacgccagaagcttatgccgaacttctcggacagcttcggcggcggcagtggagcgggagccggtggtggaggcatgttcggtagtggcggtggcggagggagtaccggaagccctggcccaggtacgagaaacatctcttctatctaaagcctttcatgaagaggagggggtagttttctttcccaggttgccaaacatgtctgcccatggagtgatggtgtcattactaattattagatttcaattaatggaaaatttcctacagatgtaaaagaatttttgttctcaaagaaatgtatgtccaactcaaggcacagccactccccacccacccacccatcaagtttcactttctgtggtttcagttacacgcggtcagcttgagtctaaaaatattaccattgtgttgacagagagagaccacacacacaaaactgtcttcacagtctgctgttgtgactgccctattactctgtgttcttggtctccttctgtctttttacgttgtgaactttacccaggtctgtatgcatctgcagttttagggatacactgggggtctcggacgttctctttcaggataatatgtgtctagtcccgaaaagtgtaagaaaaaagtcaactgaagggtttctggaagaaaacctttctcaaatcatttttgagtgtttccctcctccccctcccctttgcttttggagaagcagttagtctattattctgagaaaatattaaaacaactatcatacccaccgcatggtagatgggtataatatgcctacacagcatactgtgggctggagacactgtactgtaaacaaactgagtcacagaaaatcatgccagggaagcacttcaatggtgtgtaaactactgctcctaactgccacgcatacggcacagtcagtatttatgtgttcctctcgggtccggctatgatccccgtgcgtggatttccagccatctagttacactcagtttttaagcatcgttgcatcatgcttgtggatgctgagtaacgctgcttttgcctcagatctagctagcttaagcatttcaatggaaatacagttcttatagcagcataagtgtgctgtttaatgactcacacctgtagcgtaagtgacttgaatgctgtttcctgtctcctgtgtaaaataactgtgctgagcatggcctttctttattccagataacatgtaaatgctttaaatgtcagagagtgtagtgctaagtgctggctgcccctctaaatttatcattcatttctccactaaagtatcattatattacgtattgggttcttctcaccaggggtcttcatatttaactatttttttctgtaggtctaagtcttggtgtgagtacttaccgttagcttttcccttcacctggaagaaagggacctgctcagccttaagtcctccaagctgctagtctgggcactgcctgtttgttcagctgtctgtttcccacagtgattctgctaactctcgggcagagccagcctgtgtaggcttgtgcctccccatgccacagcctgcctccctgagtgggtccccatactgttaacaatctccctgatgttccctttgtctcattgctggttcagggtatggctactcgaactacggatttcctccctacggtgggattacattccatcccggagtcacgaaatccaacgcaggggtcacccatggtaagtcggatcggaatacccagagcactgctcgggcaacaggatcatctctaaaagctttggaaaattactttccaataaattaatattctcaggttattctaggacagcataagggacacccctgacacgtatttgctcatcacattgtgtggaagcaggacagaggctctagacaaaagatgagacttgactacgcaaacacacaaataccaccttcacatctgtccctttaccccaagtcctatccttctgaaatcagttttcattttgtagggttggccttttcccactcttgggcatcctctgagtagctgtggctacaggctgctcgtggtttatataaagctgcattcttctgtaccatggaaattattctataaagtctttccatatataatgccaattcatgccagatgcgtacatcactgtaatcttttttaaagatttttaactggcattgtcgtttatcctataatcgggtaaccattcatcccataaaatagaactattctttccattacctataacctcatgacccctgtgcaaggccagtgctaggcttggcaccttctggacagaggtgaggttcagaaacttgactttcagaagacactgtagcaggattgggttttgctccaggtttgcccaggagtcttactgtcactctgtcacataacgaggttcctacagcaaccacagtcagtctagtgatggtgccctagagccctcctggccacacagaatggaaatgagctctgctcggctccctttcccttgccactcaggattaggaaagaaaataactgctttcgagaactttccaactggctatcagcgcacagaactttatctcatttttcttcttcacagataaacaaaatgagatccatgccttgtttctgtttggttttgtttgagagagagagagagagagagaatatcactgtgtaaccttgaccttctgggacattgtgggtggagctcactacagctggctacagaatgagttttgggaaggcaggcttttaaattgtttctgaatatttaaagtatttccgaaacatcccaggtttttttggtacacacctttaatcccagcactttttgtgagtttaaggccaaccaaagctacacagcaagaccctgtctcaaaaagtaaatagagaaggaaatataaactatgtccagaacatattatttgtgttataaacatttatagttttccatttcctgcagataagccttcttcctattttccttttttctgccctatgttgagacagtgagctatagcttaatagattttctacgtttttttccctaggcaccataaacaccaaatttaaaaatggccctaaagattgtgccaagagtgatgacgaggagagtctgactctccctgagaaggaaactgaaggtgaagggcccagcctgcccatggcctgcaccaagacggaacccatcgccttggcatccaccatggaagacaaggagcaggacatgggatttcagggtaggtgagcttgcccacgagggcttccagggacagctggggtggggtttcagggtaggtgagcaagcccacaagggcttccagggacagctgggtaggggcaattctaggtacaggaagctgtctccagaagacaggtttccttcctgttaatctaaagctgatgagtcagcatctcctctgagtgctctgcaccgtgccctgtgccctgcaagagaggcgtcctgtggatccagtcatctttgcagcctcagctctgattataaagtgcagaaacttgcatgtacattgcctagtctgtgcagttctgggtatgagaagaggcaactcactttgtccctggcccaggtaacaagtctccatgtccttcgcgcacctccctcccagcagccggctcagctgccacactgaagacgtttgcctgaaaatgggagttttcctttattctcttgtcctccttgaagaagtagaattgaaagggaacgttccatctgagcaggcctcattggcatatgagtcatgattctcgatcagacgccatctgtaaagagatagtaactatttacacatagtggccgtacacatggttactatcacatatttttttcccttttttctgtttttaaaatacttcttctgagatgcacagtatatgtgtacagagccatatggaaacagggtagatttgcccatttgggttgaggttagtctgctgtcccttgaccttaagataataaaatttccaaaacccctggggtttctgagactgcctggcacccaagggtgtgtttcctcactttgactcagacaggattccagaagagactttgtttgtaaagtgattggctatttaaaattatggcaaaagccaagtaccctgagattggttgctccccttcaatcatagacactgattgttcttctcaaaatagcagatgtttctagattgttcctcacagacactttaaaatcaacctcttaactgtattatctgtcagtgagacaatgcccgaaatgcccgattgtgcttgttctagtcaacacaatccagaggcagcaaaaggagcattttcagctaaaatggtgtgccatgccgcacacgcggggcgagcaaatgacactcagctgtgcttgtgggcattaccttgcagataacctctttctcgagaaggctctgcagctcgccaggcgacacgccaacgcccttttcgactacgcagtgacgggggatgtgaagatgttgctggccgtgcaacgccatctcaccgccgtgcaggatgagaatggggacaggtgagttgagtggggactgttgcacagcaagctctgtttcaggacggggaaaggcaaggatactgcccccacaaactgcctttgaaagggagctgccctcatctgacaagacctcgagtatgctgtctccctaggcaagaaggctcagatgtgtgtaatcatgctaattttacacccctgctttgtgtactaaaatagtaattgagaaaattattgacagccctgcaaagtccctgaagtgttattgtcatagtgtacccaagaaagccaggtaagaacaacattagtagagtaactaagaggaaatgccattctctcctagctactagctgcttctctgtggcctctgttaagggtcacgaggatgtgagtgggtcaggctctgcctcagctccaggccaggctgtgtgggagtctgacattccagatgccatgcctgctgtctcttcctgaggttctgtgcacatagctacctggctccttcctaaatggttctcttagtccttccattgagacttctgaaatgatctaaaagcctataaatatagccagagacagcagtcttgagattcaagtgctttatctaagtgatcctaaaatagcgttaacactgaaaagaagccctttgctgtggaagcattctggagtgctgtgtgctgagtctcagtttaaaaacaaagcgctttaggagaatgccaacctcaggggtttcgtacaaggacctttgtcctcgtcacttgcagtgtaactaaggatgtggtataaccgctggtcttatcctacacagtacaagaggaacccagacgaccttctgtgaaaaaagctctgaataacagaaggcgcctttagaaggaaatcatccagttagcattcaatagcaaataaccacaaaacagagcagataaccagagcaggacaccggtgctccaagggtcatctttaaggactggcgaaattcatgagtagtgagggcgagtggattaagcaattaggaagtgagatgctgctgtctgaaggagaggctgtggaaagggatgccaggcacatgcagtccagcaagtgtgtgcagaggaatgcaggaacatgtgtgtaaggacctgggtgttcatggggcagctgagacactggccttcattcccaagtgggtacaatacccagagcctcgtcaagccaagacttaaacaagcaggctccgtgtaaggttaggggtatgagacctgggagacacagaggacccactcaggagtatacataagggactattctggtttctcttctttattcatcttgtcatatttggcttataatctggaccctgtcaccattagtcatcatagaaatacaataaagagaaactatagaaccctctggtatcggggaacttcccccaggggtatgaagatctgaaggggaggggacgtgcttctgtgaagtgctgagctgcacatggaaatgttgaagtagcttttgaagcccttttactcgacgtgtgtctgtccgcatcacctctcacaagcctcctgtcagggtcccatcaggagcaccacaggagcctgaggtgtggctgcggtgcttctcgtcaaagcgtgcgtgcttcacttgcagttaacacaggcctggggtcatctaaagaggccaccatgatcttccctgagaagtattgctaagtgaaatatctcagggataaataacaagaccttgtttagaaatagaagtcacttctcattgttacggaggaagagagctcggcagctgagttttcccaagctgctcctaagcctaggcattacctttcttcatggtcttgtatgtcagggagagaccagggagagctgccagggacagaggcatggagacagagctggcttggagcttaatgccatttggtttccgacccggcaggtgcctttgcacttcatgtgtctggtcagatgttaacactccgggggcaggtgggcacgatcagtgtgtagtagcctgcgataggcagtggagaggaagttctccagagaaataatgtcacctctgatcagtacattcagtacatggtagggccaaggaaagctacacatagtagctagtcttcagctccagtcatttcttgacatgtttttgtttctgtcgcttgctacatccccagttaattattgccactgtgtgtcattccagtgtcttacacttagccatcatccacctccacgctcagcttgtgagggatctgctggaagtcacatctggtttgatctctgatgacatcatcaacatgagaaatgacctgtatcaggtaagcagccaccacaaggccgtcgagaagagaaaaggttgccttagtaacacgtgcgtgagctgttctcagtgatgggaaacaggaaaacagcatcttctcagaagtggcatcttaaaagcatccttagttgggaatgtcattttacagagagatgggttgggatcatgggtttgatggcaatcacactccatggaaattcaccatcttctagaaaaggcagactttaagacctagaagtcagagttgataaagttttgagggcaaacctcagaggggaaaaagtcacagctgtcaggagagacatgttaaaaagaaatccaagtttcaaaagccagagttacagagacaaagtttggagctgagatgaaaggatggaccatccagagactgtcccagccggggatccatcccataatcagccacaaaacgcagacactattgcatatgcctgcaagattttgcggaaaggaccctgatatagctgtttcttgtgaggctatgctggggcctagcaaacacacaagtggatgctcacattcagctattggatggatcacagggctccaaatggaggagctagagaaaacacccaaggagctgaaggggtctgcaaccctataggtggaacaacaatatgaactaaccaatacccccagagctcatgtctctagctgcatatgtagcagaaaatggcatagtcgaccatcactggaaagagaggccccttggtcttacaaactttatatgccccagtacaggggaacgccagggccaagaagcaggagtgggtaggtaggggaacagggcgggaggagggtataggggactttcgggatagcatttgaaatgcaaatgaagaaaatacctaataaaaaattggaaaaaaagaatattttcaaattaaaaaaaaaaaaagaattttgaggtctgcggaaggaagggtattcgcacagcaactggatcaagtgtatgtcaaagaaaggctctgaggtcagctcctggagaggtgaaaggctgtaagaacaggaagaggcacctcagagtcccatccagctcaggtgtgagaaggtaagggagccccgaaaactccagaggaaaccacctggagatggcacagtgagctgaggacagaggcagatggtaggggaaagcaaaccagaaactccactggcagacacagtctgggagctgtggcctggcccaggatggtggcctgctctacggctccttcctctctcacctctatttctctccaacccttttgtgcccctacccctctctctgggcctgttggtcttatcctcttgttggcttctaagttcctctgcactctcttgcccagagtgtcattctgatccccacagccaggcccatgctgagacctctgcttccaggtcatattgctttcattgaaaaactgtggccagcaaccgtgaataatttgttatttagaagagatgagatgagaactagtggaattcttacttgtttgtttgtttgtttgtgatgttttttgttgttgttgttggtttttttggtttggtttggtgcttgggactgtacccaaagctgagcacaaacccttccagcaatctacaaccatgttactccatttttaaaacaagttattcaagttgttatctcttcttatccatgcttctctctgtctccctctgtgtctctctctgtctctctcttgtctgtctgtctgtctctgtgtgtgtgtgtatccctctctatcaatctctctctgtctctctgtctctctctttctctccctgtgtctgtgtatctctctctatcaatctctctctgtctctctgtctctctctttctctccctgtgtctgtgtatctctctctatcaatctctctctgtcattctgtctccgtctctcccccccccccaatgtgtgtgtatctctctctgttgatctctctctagcgtacccaggctggcactgagccatcagtgtcctacctcagcctcccaaatcataggcttgacaagcatgtgcctggcatgttatctcatttttaatttaaaaaaaaatcattattttagaagaaattaaaaagaaacaaagagatgactcagtggacgaagtatctgctgtacaagtgtgaagaccatgttcagatccccagaccatcgccagccagatttagtaccacacccccccacaccccgcccccgcccccccctccccagtcagggcaggagacaagcatcttgcatatgcgggggggggggggggacaaaagaccctgccttataaccttgcacaaggcagggggcagtacacacgttgccctctgacctcatgcacgtccctgcacccacacgctcagagaaggaaagaagggaaggaagaaaggagggagggagggagggagggagggaggaaaggaaggaaactaactgcacatacacactaaaacaaaagagctaaaaaatttttattttaaaggaaatcattaaattcttattttttaatacaatattttaaagttactttgaaaatatgaattggaggctggaagtggctcacatgcttaaagccttgagttcgttcgctccccacaccaaagaaaaggctgaagctgttagttcgttggcctgtagctctcagacttttccgttttcagaggagcacagctgctttctgcacagcactctgcacttctctgtctgcagtgattcctatccaggggagatgactaggctaaggtgttattttagatgtgttcttcaagatctgtcttcctcgggcttccatgccatcttgggatactattggtatttggaaagtcattgggccccgaaagttgaattctccaaacttttaggcagatggcactttttaaaaactttgtattgattctctgtgagttttgcatcctttttttttttttttttttttttttttttggtttttcgagacagggtttctctgtgtagccctggctgtcctggcactcactttgtagactaggcatcatgcaccccagtcccactcatctccctgtcccctcatatctgccctctgcccttgcagcctccctcccacaaaataaacactcaagtaacaggaaagacaaaaacaaaaaaagcatagagaacatctcgatgtgggagcgatagtgtgtcaccgggcatcccacagtgtatccctctgtccacacatcttcacttgcaatgagtgtttggttctctgtgacacggtaattctgagttccccaaagtataagcttttatgttatttcaagattatgcttatactgaatttacaataataacaaacatgtggcaaaagtgagagcctgagaactaacgacataaaaggccgtgtcacatgccggagaatgcaagaagagaacgcagtttaaagactcacacttgggctagtctagagagtgggtgggttccaacagggatctgatagtgacagatggtcacagaaatgtactatggttagtggaagatgtttggggagaatgtttgagataatttacaaataatccaaattacttagagaactgtatacttttctgccaagaatagttattatgtcatgcatgatggtgcatatctataattccagcccagaggagtctgaggcaggaggattgttgtgagttttgggccattctggcctatacagtgggttccaattttgtctgtattatattatagggtcttgtttaaacaacaagaacaacaacaacacaaaaccaaacaagcaaagaaaaaaaaccctccaaattaaaaagaaactagttcccaagctgggtgtggggcacacatttgtagttctaacacccaagaagacacaggaggactgacagcttcatgtcaatctgggctacacagcaagttctgggccagcctcaaacacaggaagaccctctctcaaacaaaacaaagcaaaacaactccacaaagccaaacaaagaaacccaaaagttatgagaatcacaaacgctgcctgtctatgtccttgaggctaagaagctggtatggcagggaatgtttgtgcccattaactgagtgaagccaaggtgggaaaaactggggagaaaggtctgagggctccaaatcagagcagctttgccttgagctcaggggagaggttccatccacaaagagctgggtcgcacacaatagagcctgcttccgcagatcctatcaccaacagccagcagggcttcctgaatccaacctccagcagccgagggaagcaggttttgcaaagaggattgggaagtagcaacttcctcttcttcagtttattcttatacttgtgatggttaaaaatgcaatctgccacttgtctgctatgaggtagcctgggtgcaggggtgatgccttcctccacctcgcctctcactacctgtacaggcagtcaggagagctggcctggggtcatgcaagggggtgagctagccctgtccttcacaggctttcgagagcaggccttgcatctagcctgtgctgcagagtagagaggaccctcgtggagggagcacagtgagcagccctgagggtgtgagagcaggagaactggccctgcccctcactcacaggctgtagtgtatgggagagtgggtcctgccctttgggcagcacagtggagccagctctggaggcatagggagatccgacagctccctatttccagatgtgactgttgcatgtatacaggaagagtgctcttccagtgttggctacagacagctgctctgggaagacatgtattctttagtgtgctcacatgcactccacacggttttatacatacatttcctatcccacatcagcctttccctttaagtttcaatttaaaatactttctcaattcataatttttgcaaaattcaactgagaggacctgtatatttcctgagattgaaccagacgcttacctcctaagttcccccagcagttacatcctacttaacacaataatacaattaggaattgcaacagattctagtcagatctcaatatttgtatgtactcatatgcatggatagctctgtaagatttttttttcctaagctgaacatggtggtattgtgttttagttcctgttattcaggtagctaaggcaggaagagtccttgaatatagatgttccgatgtagcctgggcagaaagcaagactgtttctaagcagagtgaatgaatgaatgaatgaatggtcaatccatgtgcttgtggatgtgtatgtagcattgtactgtgtccctgtcttgggtcttcacgctgtttatcctttagtttcatagacagctggtttgttctcattgctcctgaagagaatgctgtcatgtcccctaactagctgctcactgtccacaggctgtgcactgcagtgagcacctgcactgtacccatgggtgccacaagtgggtttcaagggcagtgtgagccctgagctccacagatggattctagggattccttgaggcacgcattttatgcgtgtgtaaaatgtaacccttgggtgttggtggcccaccagccactgcttcccagcaggaagaactccctgaatgggaggtcgggcaagtcctcactacacagcctgggcttcagtgtaaagcgcctacaacacagactggctggcattgagagttggtgctactctctaccagtgatctcagctttttgacagacacttttgtgattgggttagccccacttgtttctgaaaacagttttccatgcgtcctacttacaaccatggaagcacagctttgaggtcagggtagtcagaaagacctcccagagcctattatgcacagtgcctgggattgttttctgcctgaactttcttagggagagtgctgtattggctaactatgccctgaggatctggtagcacctgtgatagtattacagtggagcttgtatctgtgcgtctcttgaagccagcctgcagcagtgtgttctggtttagcctatgtacttccagaccattgtggaaggatgacatctttcttgattgctttcttttaatagtctatttatgttttgttgttaaaaacacagcattggttcgatttgcaaatgtatagaattaccagctatagatagatacctatcagaaattcagagaaattaaattttcttctacaagagttaaaaaaaatcatgtagcaaacgtatcccataaccccgactgttgaatgctggttccctccgtgggcctttgagcctggcatgcagaacaggaagctccttgagtgacaaatgtccctacagtatgactccataacgtagcctgaagccaggggctacagacatccctaagcaatggctctccctctccttctctgtgtagacacctctgcacttggccgtgatcaccaagcaggaagatgtagtagaggatttgctgagggttggggctgacctgagccttctggaccgctggggcaactctgtcctgcacctagctgccaaagaaggacacgacagaatcctcagcatcctgctcaagagcagaaaagcagcgccccttatcgaccaccccaatggggaaggtaagagcagtcgccttgctggctaaccgtcccctctcggctgcagcataagggcttggcatttgacaaatgcgtctgacatgactttcaccatgaatactctcctcggccagctggagtttgtcatatcttgtggttatttctgctgtttattacagcaaacgcccttaaagagtatttgtgagtattgcttagtaagtggaaaagcaagcccgagcaaacattagtctttataaagcatcgtgtgtgtgtgtgtgtgtgtgtgtgtgtgtgtgtgtgtgtgtggagaacgtttacatagtagctcagtgtctcccgagaacacagtgggagcttgtggcttctgaaagtagaacagtggaccgtctgaggctttgaagcacgccctgaacagaaaccggaagtgctgcgacctggtggtgtccctcctccccgcagcccagctctgtcagtctcacccacatctctgcctttgttcggccttaggtctaaatgccatccacatagctgtgatgagcaatagcctgccatgtctgctgctgctggtggctgccggggcagaagtcaatgctcaggagcagaagtctgggcgcacagcgctgcacctggccgtggagtacgacaacatctccttggctggctgcctgcttctggaggtaaaggcgtacttgtgatcttgacctaaatccccctggaagttttagggaagtcttttcaaagaatgactctagggccagctcgctgtcagtattccactgtctgctttctgcatccccagctccagcccagctctcaacctggggatgccagtgacagagccagcccagtatagcagttgggtgaatgatgtaacctgaggtgcaacggagatgtggaggtagacagtggaggagagagcccctgctaactctttctttgtgggcggatttagggtgatgcccacgtggacagtaccacctatgatgggactacacctctgcatatagcggccggaagagggtccaccagactggcagctcttctcaaagcagcaggtaagacgctgtggtcactgataccagcaaagcaaactgcctgcaagttcaaagctgcctgcggaagctgcggttctgccctgggaaagtgccggtaaaggagacctgcacccgggccactctgcagcggctgcactggaggctctgcttggcctcgggtttaccttgatgctcacgctagttcccactctctggttatctacgttgcctttgggttgttgaggtttactcggtacctataaaatcttgagctgtgtcagcttctggtcatattacaagtctcccagaaggaaaatatctaaagacttccttttgcaaaaaaaaaaaaaaaaaaagtctcttagaagctgaaagcatgggaaaagcaaatgagccctgtatttgtgttactgtgcacgaggcactaagacttgctggcctccactgcctttcctcggctccaggcaccatgctggcatcccatattcacagtctcctttaccacatctactcctcagtaactctctgagataagaactgttgctattaatcccatctgagcaccaagaaggcagactacaaagatgatcaagccccactcccagtgtcccggaaagctgagtcacagcaccgcagcctgactgcagactcttattcttcacgctgtctttctttctgctctgcctggggttctagtccttcctgtaaagcactcagaaacattccagctcatctcctgtctccggcgctttgtgtgttcagtgttaacacatgcttgatgaggttggctggccttccgggcctgcccagacacacctgatttacttcagaggttgataagggaggatttgtgaacgacacattccttatagattcaggcaaagaggccttggttgtaatgtgttgagtcattttggaagtcactgattatactgggggaaaaaaaaaaggttgtctcttagtcagacacctgaaatctcaacattcagaaggctgaggcaggagaatggccacaagcttaggctaccttggtccacatagttctaggcagaacaaagatacatagtgagatactgtctcgacagtaaatatataaatgtaaacacttttacttgaattcaccatgaaaaggtagcaaataatatcttgtgtgacataaagaaaaccagacaaaaagcctagccctgacctcctcggagtcacaaaggtcacttcagggacatgtgtagccctcgggtcttcaaactcatttcccagtcatgttcctggccatgttttgctcacgttataaaagagcaagtgaggcagcagagagtggcaaggcagcagtgttggcccaagtcagaggttctgtcggcagaactgaagcaaacacttcattccaaaaggctgtgctgagcctgcctgcctgcctgccactgttggccaacccggagccggacacccataggtagaatagccaggaaggcatgacaggtaactccactaacattagggttacgttttatgttgtcttgctgggagctgaagaacaggcaatatccccaagatttgttagcacattttttccccataacaacacatcctgcctagcatagcggccttgtggtgtccatttctctgttgcttaggaactagaactagggccccaacagtacagcactcaaggacagagctgaccaagcaaatctgctccacacaagtaagcgagagtgtgagaagtgtgtattggtagatgtaaatgtgaaggttcaggactttacccctgtgggtgcataaattgccacctactagtccttaggttaaaatgtatcctttgtagtataataataataagaataataatcctgcagagttacaaatcccaggagtacttgaagtctttcatgtatttactttacatcctgatcacgtcctcccctcctcccagtgccctccacatggctcctcctccccaccccctccctctctcttcacagggtccttggctacctacttccatagaagtgaattaaaattttttaaaaagttgttttaaatttcactagaaatgaaaagttatcctgtaattgccttaatgagctagaggtaacctgtccctcgacatgggaatcctgtgtgtgattggaggcggacaagctttttcttttacacaacactgtatttccctgactccataggagcagaccccctggtggagaactttgagcctctctatgacctggacgactcttgggagaaggctggagaagatgagggagtggtgccaggtaccacacccctggacatggctgccaactggcaggtgagctctggccagcccatctcatgggtatttacgggggagccagtggctcaggaatataaaacagatggtcttcttggcatgctcctccctaaagaacatgcctttgtttttatgaggtcttgttaccgagagggtcttaatcttgaaagatggtcttcatccatgaaagatgaaggtccggtgagccagagtgtaaagctgtttgcgtaactggattagagttcagatatgagaggttagaaaagcacaaaatgcacagaagagttaccctgtcagcacacgaccagagttcttgccatttctgtcagaagctagcttgctcagagcttaagtaagaggtttctgaacataaaaataaactagaaattctcttgtggatttccataaacatattaaaaaccttccttaaaacacaatagggcttacacttaaaggagaaaacgctaggtgtttggaccaagagaaaagagccagaaggcaaagtaggcagtgtacgggtccaacacagtcgggtttgtaggaatctagactctctgtgcacgtctaggaggctgtttgctggctgggttcctacagggaacacagaagactgacccctgacctgattcctaccctgtgtaccatcagcaaattcacctcagagaacaccaggacttttaaaaatcatttctgtgaatattttctcatgtttttctatccgacaggtatttgacatactaaatgggaaaccgtatgagcctgtgttcacatctgatgatatactaccacaaggtgaggtgtggcaggacagattctctcagccagtgttgccccatgctgtggtttacaggaggagaggagaggccagcctgggcgagggtgtactgcaaaccgtctagatcttatctcagaatctgagatccctggaggtgtggccctgagctgctagaagcacctactgctgctgctgagcagggcctctggacttggcagaagcttggtggcctccatcagaagttggacaatgacctgtcctctcagattgattgtccctggaaggttaaagcagtcatgtttcttccttaggggacatgaagcagctgacagaagacacgaggctacaactctgcaaactgctggaaattcctgatccagacaaaaactgggccactctggcacagaagttgggtctggggatattgaacaatgccttccggctgagtcctgctccttctaaaactctcatggacaactatgaggtaacgcgccgccgtaccatttagagttgtctgtgtaactattggtagttgaccgtgtcagctccactgagcagcacagcctacccccttacatagtaactttatggaaggaaaccagtcattgcctggaaggcaaagggagccaggccaggatggtgcctttttcttgagaagactggttacccgtctctcggcattccctgttttcaaattctcagagccttcctgtgaaaatactactgcccacaggatggggacccctccaagctgtgatcggtgtgtgcatccctgtttgcaagagggagccccccagggccatggcttcattgttctgtcgggtgactcctattagagcaattccaaactaaaaaatagacaaacatgggcgagctactccgaatgaggctgtcattgctagctgctgtcttccctggatttctgtgcgtagacatcaccgtaggcagtctcctgtctcctgtctccatgaactcacaggcttctttcccttccttcccctcttttttcttatctctctccccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctacacagaggccattgaagtgatccaggcagccttccgcaccccggcaaccacagcctccagccccgtgaccactgctcaggtccactgtctgcctctctcgtcttcctccacgaggcagcacataggtaaagaggctgagagagttcctttcctcgctggcaaggtctttgtgctctgggacgtggcactacactccctttccctagtctttttcctgacatgtgttcctctgtggcatgccacccgctccctccccacagtgctcctctgcgcacacaggaacaggcagttcccacagacactcacattggcatataggtcacttagaatcccagtagacactggacatggcggggagggttaaagaaacactacttctcatatttgttaaatttggagaaagattctaagaaaggtgcacagccctgggccacaggacaagaagtaggacccaggaaatatgcatactgtatgacccttcctttcatgccaccacccttcaggtcccccacctcctccctccctcggcactccccgtccttcagctcccaccctgctcatggtcctgcctttgtcttcccacactaacatccacctgtcacccccaacacatgcatttgtacgaatggatctcggtacaggcttgaattatgtcattgttcccggcccgtgctttctctaacctctgcaccctttcttcttgttcattttctaccctagccacaaactccactgagaccaggaacaactagcattctcccatctttgtattatgccagcaccccggtggcaggccttccatctgggctcagtaggttatgtctgccttccacctggggcagtcctcccctgggagcctgcctgtcaccttcagcaggtcctggacacctgattcttgcctctttgtcctgtactgtccttccttccccacctgctgtggagaacctcttgctaggatgtaacttctcatctttaaacactggcccgcctggccacaggctgcttagccccgctttgattaatgttacatctcaatgaatggctttgtccattgatagcgctttggttagctcatgttttcacgtttgtatgatacatgctgttatttttgttcgcatttctcatatgggggaatctacaggtaaacacagcctccaagttcagtagaaaaatgtcatcattaagagtattatatccaataaacagtaaacagattttttaaaagagaaagaaatttagagaaaaacgagacatcacttccttgttacaccctttagttgagttcaaacttctcagaagaatatgataactgctggtcagctcaccacctctgtctgccatctgcttctgtcccctcctctcctannnnnnnnnnnnnnnnnnnntcccattttcacatgtgttccctaccctttccatccctttaaagcctgttttccgccccctggaggcctttgctagttttctggcctctgctcacgctcacttccacatgaatatacatacgtgactgttggaagctaggatccacacgtgagagagaacgaatggtatttatgtctctgggctgccttgattagtattctccattaacctgcaagtttcatctctctttacggccgaataaacttttatcatcttcacacaactcttggctcttgcacaaactcatactggccatgactgtcaaaagtatagccaggctgtaacaaaatctaagagtggcaatgaatactttctggcattcaggtcctcatgcttaaccctgaaagggcatctcttcttggcagatgccaagttccgcccatcctcactgcttgcctgaactccaacagtggctcctagtcagcctctttgactctttgcttgcccctccatcagttctctgcaccacagtgatgtgacatgatagggctccagtcacaattaaaaactaaatacttagcagctaggaacacggcaagtgtcccctcctctacctttgggaaagccaggtagggtgacaaatatgtacaacccgatagcccactcatagaggaaaggacaccgagagaggtggatccacgggactcactggccagtctctaaaaacaagatggagaaggaacaaggaagtcacacaatgttgacctccccacaccccacacctgcacatgagcacacatcccacaaacacaaagcaaatacttaaatactgtattaaatttccatcattgtgaccaacttaggagagatttggttgggcacacagtttttataggtcccatggtccactgccttcggggtatagcaaaacccttcatcacggaggaagcacatggtagaggaatcctactcacttcaaggtgtttggaagtacacagagatggggaggagccccagtacagatctctttcaaagccacgccctccatgacctaacttccttctgtgaggccccatagtcaaagagttgtatcacctccagataatgtcacaggctagaaaccaagcctttacttagcacacagcctttgtgggacattttaagatccgaaccataatacacagtaagcctttcaaatgctgcccagtccctgttacacaacagacagttgactggatgaggtaacaccaggacaccgctctggcatggtcattgagtctcagtgttctgacgttaagattcaatgatgagagtcaaacatttgcttagtaagtgttatgcttctgtttctttagtcactctgtacagaaataatctgctctggttcccaggaatgcttttcaggtgatagaatttaacttaagcttttggtatagacacatttaaaaaaaaaaaaaaaaagcctcattttcttgcaccaaaagaaaattttctaggcaatgtgtattctttaaaagctcatacagctcagagaaaggtgccatttttagttcctgcttctgttatgagtttattttgccttgtattcagcagtttgcccagccgttaaaaaaaaaaaaaaaaaaaaaaaagacaaaaggtaaaatgatagagcagttagaaaaatatgcctcactttacaaaggaaaacatgtttatcctgaaccaagagaattcagaacagattctgttcaacagaaagactgatgtaccctgtagcactctctaatgtcatttgataaccctgccattcacacagccaagcagcaccggtggcatgatggggaggtgggatgccgtgctgcgcaggagctagcaagcacaaccctccataccatagtccacacggagcctgggagggagcccactgctgtggatggtgctctagggcactgtgacaaagctctctgggtttatgtcagaagggattcagggcaggaacccaaagactttgaatctgaaactgctgagcaccccggcttgctgcctcatgggctcatgctccgctagctttcttttcctttttttgttttgtttttttttttttttttttcgagacagggtttctctacatagccctggctgtcctggagctcactttgtagaccaggctggcctcgaactcagaaatccgcctgcctctgcctcccgagtgctgggattaaaggcgtgcgccaccatgcccgtcttccgctagctttcttacacagccctggactgcctctcagggagtggtgctgtctacagaggataggccctcctcccgatcagttaactgtcaggacacgcccacagaccagtctcatctggctgggccctccctcatctgcacctccctcctcaagtgattctagacgtgtgaagttgacagttgaaggtgacagggacagcaggcagaacaaagcccttgccatggcctaactcagcccctcatgagtctgtgctttctccgcagatgaactccgggatagtgacagcgtctgtgacagtggtgtggagacatccttccgcaaactcagctttacagagtctcttactggagacagcccactgctatctctgaacaaaatgccccacggttatgggcaggaaggacctattgaaggcaaaatttagcctgctggccgttcccccacactgtgtaaaccaaagccctgacagtccattgcatcgtcccaaaggaggaaggcaaagcgaatccaaaggtgctggagaatcgccggcctgcagggtcactcgatttcattcaaggccttccgaatttggcgtcctttcttggttctgaaatgaaatgtagttgccacgcacagacggtgtctagcaatcatggcgctcgctcgctcagctgcactctatggctcaggtgcagtgtcttgagctttctctgctgctactggatcacatttgctttgtgttgttactgctgtccctccgctgggttcctgctgtcattaaaaggtgtcgctgtccccacccggtgtcctttctagccatctactgtaagttgtgcattcaaattaagattaaggaaaaacatatttttaaatgagtaccttgatgcgcaataaaaaaaagacatttctttttttaatgtggtttatctgtgatttaaaaataaaaaacacatgaacttacaatatttaaaacatgctacaatcagtgctgaaaatagtattttccccgttttatgcattttactattgtaaatatgttttctaaatcaaatactttaaaagaagaaatgttgaatttataaatgctatttacttttttattttacttttataataaaagtacaagcacattgttgacctaatcttgtctgatctctgcaaatgctttctcagaggagtccctgtgactgtgggaacagccccacagcccgtttgtcacatccacattctcctttagacacatttctttgaagctagaaatgttcaaactgtggaaataaaagtgttctaacccaagactgaggttctgacccaggcaacatcatctggacgcctagcatcaacattccaatctctacaccgttcctctccagcgcatgctgtctgtgtctatgaaggataacagaccccagcttcagcacttcatcttctggatacgatgtggccgttgcgttcatagctaactacacaaaacctgtacaagatgtggtccttcatcatgtatagagagggactgatgaaatacacacacacacacacacacacacacagacaccacagcaactggctgttaatagttgctaggggaatgggagtcctttcttcaaatggtatagcacatactccagtaactattccctccccatgttcatgcaggcagccctaattaaactcactcatacacacaagcacagaagcaggaaagtaggaggcggaaacgagaaggcagcggggtttgtggatatgatctcagtacatcctatacatgtttaagatcatgagaaaatatacattttaattaaaaactaaattccaacatatgtaaaagattttccagtatggagtttagtaagtctgcatggctgaaagtagaaagagggaagattaatggcttgaaagaggtcttagtttggactctggtgtgtgaccaaggtcatttagtgtgtagtgtaaagatcaaatccaaaaccttctggtgaagtggcttggcagttaagagcactgatcttccagaggaccagtcagtaggtttaattcctagaacccctcacagctcacaaccacctgtaacttcggtcccagggaatatgatgccctcttcaggcttctgtgggcaccaggcatataaatggtgcacagatatacatgcaggcaaaacatccatacacacagaaagaaaaaaccaaaaacctaaggccttgtcatgccacacaagtgatctactactgatcccacggaagggcctggaaacccaccagctattacctttgggaactgccttcactacaaagagctctcacccccatttccatggtagtcatatgaatgcctttcccattgctgggaccttcagatcctgggagacaggctaaagtgatctgggctatctccctcacacagctcaaggtaccccaaatagacatcttgtatgtcagtgtccatatgacaaaatattccaaacttacaatgaagaaaatggaggtccagagagcgcaactcagttgtggctaaggtgcatctgtgtttatatccagatacttagcgcctaggcttgtgagttagagaatgattttattgggacaaaaaagatgataatgactgaatctattagtagggatttggtataagattaagtaaaatatcattaatgaagaaatgattaattatttaaatatataatacaagctacttaataatacttaaattatttaataaatattctaagtgcctaatcatcaattaatcggaatccctttctaccaaaaattccatatgtatgaaaatttaaaccatacgaattttagacataccaccaatcttagacaaacacccttgacatcgagaaggccctaatcgagacttcattctgtgatgtaaaagcagagcagattctacctcttagaatgcatcacaaatgaacagaaactggttaaacagcaaattctgttttccattacagtaccctctctccaccctaacacacccttattctgcgttggaaactttaagacaaaactgtcttgctttggtgtttcgtaatacttcctgggacagccatgccaccatgccccagccaggactttctatggctgttagctgtgcgtcttaaaacatggtgctgaagcccttcccacagagagacaccattgtttcctgggtttaggctcctgagtccaggccacctgtggcaaggcaggaacgatgctgagtgacttccgaaactaggtccgaatttctgccaaccttcccggaactaccttctcctggaactcagtcaccctgttcagagggtgccaagcagccatgaagagaaggccagtacaggtgttcagccaacagccttaaccgaggtcctagccaaagcttgccaagccgacggctgccaggtgaccctgcctagcctttaggctgtctcagcagatgctgaccacaataaacatgggctgttttgctgttctcaaaggacagatttgaaagcaaattaaatactagtgggggttttaagccctgggtgtagagtggacaccaccattctccaggcatttgaaaagacagcttgcctaccataagttcagcagaaaagatactgactggagagacgc

SEQ ID NO: 1128 - DNA, 3892 bp, Mus musculus
  misc_feature (3755)..(3755): "n" at positions 3755 can be any base
agcggccgccgcgggcgcgctctagcagcgcaggccggagctcagggccccgcgcgcccggcccgccccgcgcttctccgcccgcgccgcagccatggcgcgccgctgagccgcccgcccgcccgcccgcgccccgacccggctcggctcccgccggtccgcgccgctccgcagcggagcccgcaggcgaggagaggccgcgcgcatctccagggtaccctcagaggccagaagagggtgtcagagcccttgtaactggagtttgacggtcgtgagctgcgcatcttcaccatggcagacgatgatccctacggaactgggcaaatgtttcatttgaacactgctttgactcactcaatatttaatgcagaattatattcaccagaaataccactgtcaacagatggcccataccttcaaatattagagcaaccaaaacagaggggatttcgattccgctatgtgtgtgaaggcccatcacacggagggcttccgggagcctctagtgagaagaacaagaaatcctacccacaggtcaaaatttgcaactatgtggggcctgcaaaggttatcgttcagttggtcacaaatggaaaaaacatccacctgcacgcccacagcctggtgggcaagcactgtgaggacggggtatgcaccgtaacagcaggacccaaggacatggtggttggctttgcaaacctgggaatacttcatgtgactaagaaaaaggtatttgaaacactggaagcacggatgacagaggcgtgtattaggggctataatcctggacttctggtgcattctgaccttgcctatctacaagcagaaggcggaggagaccggcaactcacagacagagagaaggagatcatccgccaggcagccgtgcagcagaccaaggagatggacctgagcgtggtgcgcctcatgttcacagccttcctccctgacagcactggcagcttcactcggagactggagcctgtggtgtcagacgccatctatgatagcaaagccccgaatgcatccaacctgaaaatcgtgagaatggacagaacagcaggatgtgtgacgggaggggaggagatttaccttctctgtgacaaggttcagaaagatgacatccagattcggttttatgaagaggaagaaaatggcggagtttgggaaggatttggggacttttcccccacggatgttcatagacagtttgccattgtcttcaaaacgccaaagtataaggatgtcaacattacaaagccagcttccgtgtttgttcagcttcggaggaaatcagacctggaaactagtgaaccgaaaccctttctctactaccctgaaatcaaagacaaagaggaagtgcaaaggaaacgccagaagcttatgccgaacttctcggacagcttcggcggcggcagtggagcgggagccggtggtggaggcatgttcggtagtggcggtggcggagggagtaccggaagccctggcccagggtatggctactcgaactacggatttcctccctacggtgggattacattccatcccggagtcacgaaatccaacgcaggggtcacccatggcaccataaacaccaaatttaaaaatggccctaaagattgtgccaagagtgatgacgaggagagtctgactctccctgagaaggaaactgaaggtgaagggcccagcctgcccatggcctgcaccaagacggaacccatcgccttggcatccaccatggaagacaaggagcaggacatgggatttcaggataacctctttctcgagaaggctctgcagctcgccaggcgacacgccaacgcccttttcgactacgcagtgacgggggatgtgaagatgttgctggccgtgcaacgccatctcaccgccgtgcaggatgagaatggggacagtgtcttacacttagccatcatccacctccacgctcagctcgtgagggatctgctggaagtcacatctggtttgatctctgatgacatcatcaacatgagaaatgacctgtatcagacacctctgcacttggccgtgatcaccaagcaggaagatgtagtagaggatttgctgagggttggggctgacctgagccttctggaccgctggggcaactctgtcctgcacctagctgccaaagaaggacacgacagaatcctcagcatcctgctcaagagcagaaaagcagcgccccttatcgaccaccccaatggggaaggtctaaatgccatccacatagctgtgatgagcaatagcctgccatgtctgctgctgctggtggctgccggggcagaagtcaatgctcaggagcagaagtctgggcgcacgccgctgcacctggccgtggagtacgacaacatctccttggctggctgcctgcttctggagggtgatgcccacgtggacagtaccacctatgatgggactacacctctgcatatagcggccggaagagggtccaccagactggcagctcttctcaaagcagcaggagcagaccccctggtggagaactttgagcctctctatgacctggacgactcttgggagaaggctggagaagatgagggagtggtgccaggtaccacacccctggacatggctgccaactggcaggtatttgacatactaaatgggaaaccgtatgagcctgtgttcacatctgatgatatactaccacaaggggacatgaagcagctgacagaagacacgaggctacaactctgcaaactgctggaaattcctgatccagacaaaaactgggccactctggcacagaagttgggtctggggatattgaacaatgccttccggctgagtcctgctccttctaaaactctcatggacaactatgaggtctctgggggtaccatcaaagagctgatggaggccctgcaacagatgggctacacagaggccattgaagtgatccaggcagccttccgcaccccggcaaccacagcctccagccccgtgaccactgctcaggtccactgtctgcctctctcgtcttcctccacgaggcagcacatagatgaactccgggatagtgacagcgtctgtgacagtggtgtggagacatccttccgcaaactcagctttacagagtctcttactggagacagcccactgctatctctgaacaaaatgccccacggttatgggcaggaaggacctattgaaggcaaaatttagcctgctggccgttcccccacactgtgtaaaccaaagccctgacagtccattgcatcgtcccaaaggaggaaggcaaagcgaatccaaaggtgctggagaatcgccggcctgcagggtcactcgatttcattcaaggccttccgaatttggcgtccttcttggttctgaaatgaaatgtagttgccacgcacagacggtgtctagcaatcatggcgctcgctcgctcagctgcactctatggctcaggtgcagtgtcttgagctttctctgctgctactggatcacatttgctttgtgttgttactgctgtccctccgctgggttcctgctgtcattaaaaggtgtcgctgtccccacccggtgtcctttctagccatctactgtaagttgtgcattcaaattaagattaaggaaaaacatatttttaaatgagtaccttgatgcgcaataaaaaaaaagacatttctttttttaatgtggtttatctgtgatttaaaaataaaaaacacatgaacttatcaatatttaaaacatgctacaatcagtgntgaaaatagtattttccccgttttatgcattttacatttgtaaatatgttttctaatcaatactttaaaagaagaatgttgaatttataaaatgctatttacttttttatttataataaagtacagcacatgtgact

SEQ ID NO: 1129 - DNA, 2916 bp, Mus musculus
atggcagacgatgatccctacggaactgggcaaatgtttcatttgaacactgctttgactcactcaatatttaatgcagaattatattcaccagaaataccactgtcaacagatggcccataccttcaaatattagagcaaccaaaacagaggggatttcgattccgctatgtgtgtgaaggcccatcacacggagggcttccgggagcctctagtgagaagaacaagaaatcctacccacaggtcaaaatttgcaactatgtggggcctgcaaaggttatcgttcagttggtcacaaatggaaaaaacatccacctgcacgcccacagcctggtgggcaagcactgtgaggacggggtatgcaccgtaacagcaggacccaaggacatggtggttggctttgcaaacctgggaatacttcatgtgactaagaaaaaggtatttgaaacactggaagcacggatgacagaggcgtgtattaggggctataatcctggacttctggtgcattctgaccttgcctatctacaagcagaaggcggaggagaccggcaactcacagacagagagaaggagatcatccgccaggcagccgtgcagcagaccaaggagatggacctgagcgtggtgcgcctcatgttcacagccttcctccctgacagcactggcagcttcactcggagactggagcctgtggtgtcagacgccatctatgatagcaaagccccgaatgcatccaacctgaaaatcgtgagaatggacagaacagcaggatgtgtgacgggaggggaggagatttaccttctctgtgacaaggttcagaaagatgacatccagattcggttttatgaagaggaagaaaatggcggagtttgggaaggatttggggacttttcccccacggatgttcatagacagtttgccattgtcttcaaaacgccaaagtataaggatgtcaacattacaaagccagcttccgtgtttgttcagcttcggaggaaatcagacctggaaactagtgaaccgaaaccctttctctactaccctgaaatcaaagacaaagaggaagtgcaaaggaaacgccagaagcttatgccgaacttctcggacagcttcggcggcggcagtggagcgggagccggtggtggaggcatgttcggtagtggcggtggcggagggagtaccggaagccctggcccagggtatggctactcgaactacggatttcctccctacggtgggattacattccatcccggagtcacgaaatccaacgcaggggtcacccatggcaccataaacaccaaatttaaaaatggccctaaagattgtgccaagagtgatgacgaggagagtctgactctccctgagaaggaaactgaaggtgaagggcccagcctgcccatggcctgcaccaagacggaacccatcgccttggcatccaccatggaagacaaggagcaggacatgggatttcaggataacctctttctcgagaaggctctgcagctcgccaggcgacacgccaacgcccttttcgactacgcagtgacgggggatgtgaagatgttgctggccgtgcaacgccatctcaccgccgtgcaggatgagaatggggacagtgtcttacacttagccatcatccacctccacgctcagctcgtgagggatctgctggaagtcacatctggtttgatctctgatgacatcatcaacatgagaaatgacctgtatcagacacctctgcacttggccgtgatcaccaagcaggaagatgtagtagaggatttgctgagggttggggctgacctgagccttctggaccgctggggcaactctgtcctgcacctagctgccaaagaaggacacgacagaatcctcagcatcctgctcaagagcagaaaagcagcgccccttatcgaccaccccaatggggaaggtctaaatgccatccacatagctgtgatgagcaatagcctgccatgtctgctgctgctggtggctgccggggcagaagtcaatgctcaggagcagaagtctgggcgcacgccgctgcacctggccgtggagtacgacaacatctccttggctggctgcctgcttctggagggtgatgcccacgtggacagtaccacctatgatgggactacacctctgcatatagcggccggaagagggtccaccagactggcagctcttctcaaagcagcaggagcagaccccctggtggagaactttgagcctctctatgacctggacgactcttgggagaaggctggagaagatgagggagtggtgccaggtaccacacccctggacatggctgccaactggcaggtatttgacatactaaatgggaaaccgtatgagcctgtgttcacatctgatgatatactaccacaaggggacatgaagcagctgacagaagacacgaggctacaactctgcaaactgctggaaattcctgatccagacaaaaactgggccactctggcacagaagttgggtctggggatattgaacaatgccttccggctgagtcctgctccttctaaaactctcatggacaactatgaggtctctgggggtaccatcaaagagctgatggaggccctgcaacagatgggctacacagaggccattgaagtgatccaggcagccttccgcaccccggcaaccacagcctccagccccgtgaccactgctcaggtccactgtctgcctctctcgtcttcctccacgaggcagcacatagatgaactccgggatagtgacagcgtctgtgacagtggtgtggagacatccttccgcaaactcagctttacagagtctcttactggagacagcccactgctatctctgaacaaaatgccccacggttatgggcaggaaggacctattgaaggcaaaatttag

SEQ ID NO: 1130 - DNA, 96592 bp, Homo sapiens
ttgacaagctggttctaaaatgaattcagaaatgcaaaggacctagaatagccaaaacaaccttgaaaaagtgaacaaagttggaggactaacacttcctgatttcaagacttattgtaaagctataaagtaatcaaaaaggtgtggtattatcatatagatagagaaaagatcaatggaacaaaatagagtccagacatacagatacaactgatttttaacaatttgcaaaggcaatttagtgaagaaaggatagttttttttttcaacaaatgctgcagaatcagttggaaatcaataatctaaaaagaaaaaacttcaatccatatcttgtaccactatatgcaaaacttaactcaaaatgtatcatagacctgaatttaagtcctcaaactacaaaagttctagaagaaaatagaggagaaaatcttagtgagtttgagtcaggcaaagagtatgtggatacaacactgaaaccacaatgcagtaaaaaactgacaaattatacttcatcaaatttaaaatcttctctgcaaaagaggatgaaaagacaagtcacaggctaaaaaatatgtatttgcaaatcatatatctggtaaaatacttttatccagaatataaaatgaactctcaaaattcaataataagaaaaaaaatacaccaaaagtaaacaaaacatttgaacatgcatttcaccaaatggcaaataagcacataaacagatgcccatcatcattagtcattagggtaaagcaaagtaaagcacaatgagataccactaaacatatcaattgagacgattaaaataaaaaagactgaccataccaaggattgcaaatatatgaaggagctagaactctcatttcctgtagtgggaatataaaataatatactctttgggagaacagtctgcagtttcttaaaaagttacatgtatgctaactatacgctctagccatttcacttgtaggtatttcccatgacaaaagaaagtatatgtctatataaacagttaaatagttacacacaaatgttttagtggttttattaatatatcccaaaactggaaacaacctaaatgtctatgaacaggaaaatggataaataaattgtgactatctatacaatggaatgctactcaacaataaaaaggaattaactactgatacaacaaggtggatgaattttaagataatcatgctcaatgaaagaagtcagataaaaaatagtacctactgtatgattccatttatatgaaactctagaaaatgcaaactaatctatgacagaaagcaaatcagtggttgcttaggaatgtggaggagtgaggaatggaaatgaggaactgcagagggccatgagaaaacttttcagctgatgcacatggtcactgtctttattatggtgatggtctcatgggtatatatatatatcaaaaacaactctctctctctctctctctccaatcccccaaccccatctcttacaacaagaaagtatgtccctagtatatctggaagccatcttttgaccaagagaaaagccagcatgaggaaactgttaacacagggacagaagaaaagaaaatgtctctgaagggaagagagccagaattgtgattacattaaacctaaagattttcaacgatgtgacctgatgaaattccataatggttaagtcattttgagtcataattttacatcttttcaccttaggtgaaaagcatcctaaccaagataagtatatgctcagcattatattgataatttataatacgccattggaaaaaaactctcttcctggcatttaattatattacttatttcaaagaaaatgcagtaaaaaactgatctgtatatctactgatatgtctatcagtaaaacagataagtatatctatgtatacctactatgcataagccttacaggtgctacatagaggtgatatctgttgtttatactctttgtcttcccttcttcctttttttgataacagtgccccaatttacgcttagctaaccataatctagcattactaattcatgtcttccagatgagatagaccctccttgtcactaaaagtagacatgtgactcacagcattgtaagaagatagtaatggaacacaggtccccaaatttaccctcccaatctcttctcaattactttccccaacaagaaaaaatgctactgcaggtaagcaggggcatctaaagcagggtcacttgaggtcacaggctccagggtctctaaaaggaaagagatactctcactcttctctgttttaggtagtctggagggccttgttatagaaagacttaaaacaaaggtctcaattttatggcttccagtgaaagttagcctgaggaaacctatgaatgccttcaggaaagcattacatgggcttatttgtgtgtgttcttgggaaggtcagactaatctgggtagtgacaggtcatatggaggaacgctgcactcatggaagagttgcttgtagcccctgaggttaggcaagcattctcccttgcacccagggagctctgggagaagaaagactttttttaaagcttcagctgggtgtggacagattgccagttggtttactgccagcccacaaaagcagaaacctttcccctggcaggtttgccactgcataaaagaccctaactacttgtcctgtaattataggtcagtgtatacagagcctgaggtctgaacaggaaatggaaaataataacttgccctagtagtactagcaagccagagaggaaaactaagataaacacttcaaacaggtgttttgttgaaatagaactgttagaagagccaggtgaaaacttttctaaaaagtaataaattcactcaagaagatataattaaagattaggagttaaatatatgatagatgctagaatgataaaatatacatattttaaaaataggtaatgactccatgtgtttctgacagtatacccttcctggttgaaataactaaaatgaaataactaatggaaataactgaaatgctacataacatatttttaaaaattaatactgcttagccagcatgaaattcaggaatctaaatatttccaaaactgaaaaactggagggaatagctgagaaattgacttagtctgttttgtgttgctatcacagaaaaccacagactgggtaatttataatgaaaagaaatttgtatctcacagttctggaggctgggaagtccaatatcaaggtgccagcatcttgtgaaagctttcttgctacatcatcccatagtgaaaggcagaagagcaaaagagcagacactcaagagagaaagtaacctactcctacaataatggcattcatccatttatgggggtagagacctcatgacccaatcagctctcaaaggtctcacctctcaacactgttgaatggggagttaagtcccaacacaggaactttgggggacatgttcaaacgataacactgcctatctagtccttgtcactggacagaaaaagaagaaattctcacctgtgaattcataaccacttacactatatgtgatgatcaaaagcacacaagtaaaaaattttatttaaggtttttccaagttaatagtataccagataacaggcaaaaagaagcacaaatattccttactcaattttaacctaagcttcaaataatttccagagattgtttcaagaaacgtaagcaatttattatttataattcagttgacatattaaacagcatatgaaatatagctgaaaagagaattgataaactagaaggcaaatataaagaaattatccagaatgaaatccaaagagataagagatattaaaagacacagagattagattgagaagatctaacatatacctaatttaaattccagaaaacaagtctagggaaaatgaaagagaggaaatgttacaaaagataatggactaggaatgtaactgttgaaacatcaaatcttgagacccagggagccatataacatgcttccaaaatccaagcttattatattaatatacaaaaacattaatattaatattatatattaatgttattgttaatataatcattatattattaaacatataatttatacataaacaatatattatatataaatgtatatgatatataatatacaatagttataatatataataaattatatattgacttctatataatatagaattatataacttataaattatatatagctttatatataaatcaataattatatattgatgtgtacaattattattttatattattattaataattatataattggtattatataaatattaattttatattgcaatagttataaagtaaatatcatataacattattaatataataaatatagtatattaatattaataacttgtatttattaacaatatattaataaatgacataatttcacatttctttcagatttctgtaaaagcttatcaggagttatatatatgcaaaaccatatttatcttattaaagaggcatgtataagtgtcagaccatcacttatgaatagatttgacagccagatatacaacctttcagaaaacagaagcaaacctcctccataaaaacaagtaattggcagctgtctcaatgatgtccagtaactagccttatttcactcagaacagttttgtcggcttcatatagcatgaccaatcaccctggtttactagagcctgagggtttcctgcgcaagggactctctgtgctaaaagcaagatagtcctggatcaaccgggatgagttaagtctctatttccatgccttcatagaaatcattaaaagatatctctctgttatgggctgaataatgtcacccaccctgaaattcctatgttgaagtcctaacccccagtacctcagaatgtaactggattttgagatagggtttttaaagaggtatataagttaaaatgaggacagtgggatgggccctaatctaatatgactgatgtccttataagacgaaatgatttggacgtggacacagagggacaaccacatgaggacagggagaagatggccatctgcaagccaaggagagaagccctcaagtaaaccaatgctgccaacacattgctgttgaacttccagtctctagaacgataaaaaatatttctgttgtttaagccacccagtctgagatattttgttttggcagccctaacaaacacattctctaagggtttattctcatttttggtttagtgtatttcagctgatgattatagcctaatcctccccctcttcttggggcctctcttctctgtactcttcctcctcatatctcacacaggcagatttgttcctgcctcctcacctacattacgagctccgcacagtctcctttcttctggctccggctccctcattaatctttctgttattaacgctattaactcgttaaactatctctccacctttccaaacttccattaactctggcactccataagtgttagtcaaataaatgaagaatcacactaactcctctttccttccctctcactccaaactcttggtgagattcttttgcacttatgccctcgtttccccatttcccactcacttgtcagtctcctcattcttggttttcctcattatattgaaacacatctgaaaaagtcatgtaagaccacagccactgcgtatcagtgctatttgagagttaataaagttcccttttcctccaagacagcgagcagagtgaacagaagaaagactggtttctgcccttggctgcacagccatgccccgaggccgggcttaggattttataattcacaaagtcaactgtctcttcccctctccatcctttaggaactgtctgcagtatctgacactgttgagagctctcataccctttaaactctctcttctctggctttctgagctttcctcccacttttgatggcactgcaggagtttttaagcatctctctctcataccaaccccagaaataaagtcattcctcgaattcctgtacttagccccttgtctcctaactctttgaccactaatgttttagaaacactctcctgacaactatcgcatctttgcagttgtttccatttccaacgccatgtctctctgagcagcagccttgagttttcaattgcatatttattagtcatttccatatggacatctcactaaatctgtcatactaaacatgtctaaaatatgtatgtttacatgttacatgtatgtttggtatgtgggaatgcattacattcccacagattttttcccagttacagtgttactattctaatcactcagactagaacactcagagctatctatgagtcttcctctcactcaaactgcatatataatctataaacaggtcctgttgacctcatcttctaaaaatctcttacatgctcctttttatatcattggataatagtttagtgtggtggttaatatcatgcacactggagccaaatctgttaggttcaaatcctgactctccttctatttactaattatgaaaccttaggaaaattattcaacttttcatctgtaaatatggggattataatggtgatccactttatatgactgacaaccaaataagtgaatacgtgtatagcaggtattaaccatatgcttagccgacctatttcaacctcctaaccaaccagaagaactgtagttccctgctctcttgcatctaagtggggccatggaatgtgggcagaagtgttgtgtcacctttactcagaggcaattaaaaagaagacatacttttcctatgttctcattgccaatgaacacactacacagatctcaacctcagaattctctccacactggtatttccaaaatagcttcatgagaagggaaatttgtgtagtttcaatgatttagtgatgctatggtttgggtatttgtctcctctaaacctcatgttgaaatgtgaccccaattttggaggtggggcctaatgggagatgtttcggtcatggaggtggatccctcacaaatagattgatgctattccctgcaaggaggagaggatgagtgagttctcactgcattagttcctatgagagctggttgctaaaaagtttggcatctctcccctctctctcgccatacgatctctctgcacacaccacccgcctttgccttccattgagtggaagcagcctgaggccctcaccagacgcatatgctggtgccatgcttcttgtacagtctgaagactgtgagcctaataaacctcttttcattataagctacctagtcttgtgtattctgccatagcaacacaaatgaactaagacaagtgacaaacacaaaataacttgtcttttagacaatattgatgtctgaaattccacattgaggcatttttttcctcttcgtagcctgataatggcaaataccttctgacaccttaggatggatgaatttgtaagagatattcctggaagcaggtttgtacagtgtagagaaaatgttgggtaacaaagcaggaatggaggagggttaatcagcaagccaaaaagcttttatagttttgcctgctgtgctgcatggaattacatccccccaaaacatatgttcaagtcctaaccacaggtacctgtgaacatgagtttatttggaactaggatctttgcaaatgttatcaagttaagatgaggtaatactggattggggtgggctctaaatccaatgactggtgtcttcataaaagaaaggtgagggagagttgaatatagcgacacaaaggaaacacggggaaggagaccatgtgacaatgtaggcacagaatggagtgttgcagccaagccaagaatggcaaggattgctggagctaccagaagctaggaggaggcaaaggattcttccctagagccttcagagggatcatggccttaatggcaccttgagttcagaattttaggctccaggactgtgacagaataaattcccgttgtaagctgttcagtcggtggtaaatttttacagcagccccaggaaaatatgcctgctcaacaccctaccctgaattttaagttcattttatggaatcattttgagtttggagtttgatttaatccttttcagtaattaacgctcttcattttttactcccaaatatgtcacactggctctactcttataacaattgtatttatctatcttttggtaatggggctgccaccccttgcagaatgaaaagtagagtgtgtatgctcacacctccctccctccctccctctctccctccctctctctttctttctttctcagagtatcgctctgtctcgcccaggctggagtgcagtggcgcaatcttggctcactgcaacctctgcctccagggttcaagcgattctcctgcctcagcctctggagtagctgggattacaggcgcccgccaccacgcccggctaatttttttgtattgttagtagagatggggtttcaccatattggtcaggctggtctcaaactcctgacctcaggggatccacccgccttggcctcccaaagtgctgggattacaggtgtgagccaccgcacccggctcacagaatttcttaaaaagtcattgtgttcagtctttatggatcctctaaattccagctgctcagcctcccggagctaaatgagatcacttaaaggtcgactgttggggcctccaaggtcgcctcggagactcacctcataggcaatcaaatggatcgctgggtttttgtgtgtgtgggttttttttgtttattttttttttccagaaaaacactccaccaagaaggtttttataacctactggaggaggaggatggagagtgggcacgaaaggactaggatgaacatgccataagcaatctaaatgccactgcaatattgcctggtgaggacctgattactgatgttttaaagctaagctttcagttgtcactccacccagtagtgaaacaatgagctctaaaatatatatttcggctcaagctttcttatgtggggaggtaatccacccgaaggtatccccagcctgtacctaatacagtgcccagcactaaagcagctcagatgccagtgaatggtggccactgggaggcctgtcagtgggtgccagtagcggtctcttcagagaaaaagaaaactcccctctgccagatcagtattttatgagctgtgaaccaaaaccattgctaccaccatcactataattctatccacagtaattatcataaaggcctaacaatgccttgtagatgaacattctgagtaactgctctataaccaggagatttaagaccgcaccaaaaaccagtagagggttatactttactgggcacaagtcgtttatgataacgaaattgtagtttaatctgtgaagagatgtgaatgtaactgagacacgcttaaatggaatatacagatgagctttatttttatatctggcatgcttggatccatgccgaccctccagctgctcgggcctgcccttaggggctatggaccgcatgactctatcagcggcactgccaccgccgccgcctccgtgctgcctgcgttccccgaccattgattgggcccggcaggcgcttcctgggggcttccctaccggctccagcccttgggattcgggagcgccctgctaggaagccagagccccgcaggggccgcggcgtccaggccgcctaacgcgcgcccctcgcccggcgccccgaagcggccccgaggggcgggagccgaggcgagcggcaaggccgggccgggggcgcacagcgcccctagaagtgcgggcttcccccacccccggcagcgaccctacctcccgcccccgctgcgtgcgcgcgtgtgtccgtctgtctgtatgctctctcgacgtcagtgggaatttccagccaggaagtgagagagtgagcgagacagaaagagagagaagtgcaccagcgagccggggcaggaagaggaggtttcgccaccggagcggcccggcgacgcgctgacagcttcccctgcccttcccgtcggtcgggccgccagccgccgcagccctcggcctgcacgcagccaccggccccgctcccggagcccagcgccgccgaggccgcagccgcccggccagtaaggcggcgccgccgcccggccaccgcgcgccctgcgcttccctccgcccgcgctgcggccatggcgcggcgctgactggcctggcccggccccgccgcgctcccgctcgccccgacccgcactcgggcccgcccgggctccggcctgccgccgcctcttccttctccagccggcaggcccgcgccgcttaggagggagagcccacccgcgccaggaggccgaacgcggactcgccacccgggtaagccaaactcgggcgagtgggggcccggcaggggacgcgtggcccaagtcctgccgcccagccctccgcaccccctccagccccactcggacttcctcattcctgcgctaaccgctgggctagaccgtgggaggaggttgacagtagctgagaggcacatgggattagcgacagcggggaaagacacatccggacctcgcaggggctagtcggccgaagggccgcggccgcccggcggtcatttctcttcacgtccctccgcggggcgggaacgcgaaccggaggggaactcttacaaacttttaaaatccccaaccccagccccacctgggggatggtgagaaggttggagtgcgctgcggcgcggaggagagagggaaggtggttggtgcagtgcagaaccagatttcacctaagggcgttccatgaaatgaaagcagaagtgcttgtcagtcctcttggctgggaaagccctccccagctccccagaattgaataggagagtctattcatccctctcctacttctaaaagaaacctggctcgctctctgtctctctctctctcccccctccccccctccgtgcgcgcgcgcgcgcgcacacacacacacacacacacacacacacacacgatatagtcacctgctataggacttgattctgatcctccggggcctggcatttgagagagaaaataaattacctacctggatacttagagcactttttagacttgattatgtaaaactcttggacagtgccaccatgcattatgcatgaccgctgaaacaaaaataatgtaaaaacaaggcctatcctaaatgcaagtttttctatggtccttaaaaacagacaccagggaatgtttgccctgacttgctggtttatcctgaaactcaaatgggacttaatgatacaggatttaattatcaagattgacatgttcatggactttgttaagtagaggttttcagcattacagtttatgaaataaccatatttaactcaaagatttttttataaagctcataatctgaaaaaatgcttatggtattactaaaacatttaatagctctggcatcaaaatattctacatactggtgatcttttagtaaatagtaaaggttagggtcaagatattcaataatttttttctagcagaatcccacaactgaatattgtcaagcagtttaaactgcattcgtgtttgttaaaactttaaaagggaaacttaaaactaaagtatgttgtttttctgattttaatattgtgctttctagagatgaatccttttactgtttgaggcactataggaattatgtatttaaatgtatgtatttaaatttgaagcaatgtacttttttgagtttataaacttgggaagacaggaaataaaaagatttgtttcctgtagaattttacattcatgatttaattgaattgctaaaatggaaagaacatgtacgattaatggagacttggaatctgagattattcatccatattgatacacctgcaattcctaaatgccctcccctgcttgtttagataaaatgtcttcctgggctgcagcctactggacaaacttgaacacaaaggaacacacgttatatgtacatttaatactggaaccgaaaagctgcttgcagtgaaaagcaaaccacttctaaactctttgagactttttaaagaaggtagtataatccttttaggggttggtggtgatgtgaaaatctattatctttttgctgaaatttcattcttatgttaggcattggcactcacttgtgctgagtaaatgcccgtgtttttcaaacccagatagtaaatactgggggtatacatacaaaaatagtccttcccctttgtaagcattgctttgatctttgcacttcctttttactctacctcttaaacaagatctgtgttgattgagttgattaaagcacaattaatctgaaataggcagaattttagatttagtgattatattccttacatttctgttgttactgttcctggaaacaaattgaagtagtttgagaaactaatatttatgcaggttgttttaactacacttttagacttgcagataattgattaagtaagttactaccttgactttcagggattgctcattgtggtagatacgaggtctagatagggaattggcagctacatgaatgttggactatcattccatcagcaagaccttatttttacctaatttatgagaggtatttctctgttcagaagaggtgaaagttctggcttctggggggaagtggttacttcataaccttcaattggtttgaacttgggagaagtaagaaaagtagtcgatattttcaaacagtaaaataattgtatctgagttgctgtatggatttttgatgaagtactcaaaatgtcatcttttgcatcttcgggtcttagtagatgtgctattctgagtatagaattgactgcagtaggaagtgtatctggaaatgcacagtactgttgtataaccaatagagtaaattctcagattatgctcttctggtccacagattgatcagaaatcacattaacaggaatggatgtctatgcaaaatttctcattaattttcttacttttagtaggaagtttgttttattcggttggtctgttggttttctgtttacaaggtgaattgtctacagtagtgggattgttatattagaagagaaggagaaggaaaaatagaagttagtgctagaggatatgttaagatgttctgctcctacatctacatttgtgtctaatcagcattaattgatgactacgtcttggtaaacagtagaccatactggagcaatttactctgctttttgggaattagttctcatttgcactcttgcacctcccataaatactgaactcacttgtagtgttcttagaggtcagcaataaaccatcaagagcatatgatctctctttgaattttgtcactactttggagacagacagtttggaagaactgaaggtactcagcctcagggagaaaggtttgaacgttttggcatagtcctgcaagtcagtttggctccttgactgtgaatttttttaatcaaaaaagattaatatttgaaaccacataatttggacagttaatagttctggtaacataaccaagccttttatctttgtagtatttcattaattagtatccagtgcctcacttttagaagaaaaaaagagaaaaaagtagtaacattcttttaatgatgatgaaattgcttcatacctttggtctctgctgtattaggggttgttcctgggtgcaaattaatatactgtcttttacatttccggaggttgttgacctggccttgaagatcagccaacagtttagaaaataagttgtgcaaattgcattgctacacctcaaataatttaaagcctgacagttctgtacagaataagagtcacataagatgtgatttgttaaagattatagaaatctcagaagatagattatggatgaaaatatttgtttaatttagagtactaataataaaaatagtgcattttacattttaaaaagaaaacaatttttattgtgtcatattttctgtagtaacaaacagaattaattatcagtaatacaaatttcatctgctttaatttattgcctgtttttgaaattagaataatgatatatttggtttaattatccattacaaattgccttattatttttcattcatctttcaccattaatccagaaaccttaaaatagcttttattttgacccatgccttcagtagatatcaacagacttgagttcatctatggatcctattagtttaaactgtgacaaattttgactgcttaagctttagaaaagaatttattctttaaaatagccaaaattataaaaaatgaaataaagaaaaagctgtttgagagaatcaaatactctagtttaactaaaaataaataatatctaatcaatactgacgaaagaaatatctgatgcttagcattgtacttgttggtacatagtaagcaatcattaactgttaaatgaatgaatgatatgaagttgttgcaaaatttttttttaaatggacagccatcttctataaggaacaaaaattacattattttgctttgccttctggaaagaaaggagcacaaaatagtccttgtgtcttagatattatggaaatcttatctaaagaccacttgaagtttactagaacaaataatttattaaaaagtatctggcgccttccaaaaggggaacatttcattctgaaagaggcatttatgaactagaaaaaaaatgccttttagtttcaaagttttagaggcaccagagcaagattataaagtaattggaatgataaaaggtgcttgtaaaattgaaaaatgtaattttttggtgaagttagaatttctgtacactccattgaaactgtaatatcaaatactaatacctccaaaaaagaaacaatgctacaagcactgcttggtaatctaagaattgttaacacttatctaaattaatcaaccaaaaagttaaaacaaaatatgttattttgttatgttacctctagaattaaacacctatcacccataaatctgtgactgttaaaagttactagatggcaaacctcaggaacaagcaggcagttagcagggtttactgtactttccactttcatactttaatgatttttccaacactatagaagctggggcctcatcctagcacagtttgttcattatttttcagttgtagcattttttaaaagttggccttgaatttctgaattgaaccatttatttttttgtggacacagttttttaaatgaaatataccatttagactagaaaagagcaaaatgccaatactccctgtcctagtgtcattgtgccccctgggaaccctaatgcagtcctgtgggaaaacaaccattttattgagcgctgctcacttcagttcattctgctttgctgccacttagttctggttctgaccctgatctcccctcacatcactcacaacaaacattcaagtttaaaaattaagttaaaagttagttacatatatatgtaactaatgtgtatattaaatatactgatatatattagttacatatacagatatggcaacaacaaaaaaggttatatatatacatatttgtaactaatatgtatattaaatataatgatatatgtataaatacatatttgtaactaatataattatatttaatatatattagttacaaatatgtatatataatattttttgttgttgccagcaaaatgagaaagaaattaaatgttaacatctataacaattgcactgtaaagccgtcattgttgaaaagtactccgaagattaatagcggcagtgtttgttaaaataataaaataatccaggcactctgcctgtgacttccccatgagatggcttccagaaaaagataaatttttgtgtgttcccttacgagttcagtctgcagcttctgggcatgaagagaagcataaacaaaacaaacaaggctctaactttgttataatccttacgctactagtagaaatgtatggacaattcatgcatttcatattggaaaataaagctattagatttttctttgagatgaaccttttttttgtaatttattttttattttttattttttttcagtagagatgggattttgctctgttggccaggctggtctcaaactcctgacctcaagtgatccacccgcctcagcctcccaaagtgccgggattacaggcgtgagccacctagcttggccaaggtgaacctttttgataaatgaggctcactaatatttctaggatttacttttcactaacttgaactaaagaaagtataagacctgcataaagttgagcatacctctataatgtcccattttaaaaagcaatttgtttttaatgacttttatttgttaaaagcagttatttcaaaaaattatttttattatttatcatgtcatttggactgaaaatactataccatatttcagtgttagggcacacctatccctctttatcccagacgtcaattctaccatataacaagtatgtaaaaaagaaaacataaaagtgatgacagactccctaatcaacctatttattggttctaagcccaagcctgcagttcatttaaatagtgaaaatagattacttaattgtcttagaaaatatgtcttccatgacaagaattttaggaatgagaaaataactatttttggatgttttaacacaaattcccaaatcatgttttattgatatttgaagaacctctttgtctaccagttcttaagtataggcttattttgtaaggcttaaacatgtattggtgtttgactgttaagacttgatctataaccttcagtgtctttttcttttaaatggggtatggacttggtaatgaggccagaggagaataccttacaatttatagcatctgcatataatacaagaaccttcatgatttataaaattaaaatgatgatgatgtggaatgatggaagaagcatgtgtgggtggctatttatgtagaggaaattagaagttgaaagcaatgttaagaattaaaattaaattacacttaattttttgctcagttggatagtcaggaaagtacttaaatcagcaattgatttacgtaaaatcaaaactgaaaactgaatatacaatctaggaaataggaaaaaaatttttagtgtgttcatactgctaatttcaaaccaagcaaaaaacctggggaactacttttcagaggagatggcttaaaatgaaccaaaaatatagccatttctctaccctattcatttaatgcattcatttattatactgctaatacatgataaggtgaataggttaagcatcgtttgtatatgtgtatgtgattttaaacctgagtcttttgaaagattggtcaaagcaaaggataatgaaagcataaagatttagggggaagagtcctctataaaactaagacttaaactttgttatcaacttgaatgtgaagatagaataatctagaaagtgaatgagaattataaataaaaggacaaatcatatatctcatggttgagaaatacaatgagataaattgtatatctcatctcatggagggtcataatgaaagaagtaagagagattgcccttggatagaacctttcggcagacatttcataatggattatcatatttttgctaaactggtaagaatggacttttcaccacattatgaaaaaacactttagaagtcagttgcgatcaagcaaatataagtacctgggaaattaaaatcaaaagcacagcagtccaacaatagtcaaatgcatttactcactctcataccatatcatagcgttaatttgagataatgtctttatggtgtctctttatatatttactcgatttcccatttaagacatttaaccaaatttaaaaagcaatccttagaaactttaaaaatatttcctattttaaaccattacataatcatttaccctgcagttacaattctttttttgtgatgggtggggaagtatcccatttctcttagaaagtcttctgtaatagccaaataggagtcaatccaagttgcttagagaggtagttcaatcctgtgttgaaatagatgacttttggagtaattgtgctatatttactgagtatctgttgaactgtaggagtccagtcattcaaggcaagctacagaaatgattttattgctgaggcacttaagtatcttcacatctatatgccaatattaaatttctcatcatccttgatccccacccctttgcacagattggtatccccagcacattagggaatgcggttgttagcctgttagggtccattcagtagatttctcatgccagaaatctagaagcccttcttatacattcagctttcttcttcagtcagtcaccaagttctatcaaggcagcctcctcatctccagaatccatcccttcctcgttgaatttctagattttatttttgcattgtctcctgcttctaacccatcgttcatttcgcataatggtcagctttctaaagtgtaaatcggatcatgtctctgcagtgaatcccagttgtcttcacaagctgattctcgcacacctcacccccttactccctccggtgttccccaaccatcccctaatctcaaatcctccacaccgactttcagtttcctatccacagtttctgactttgaatgcctttgcttatgccctccctgtatgagaagtgccttttctttcctagccatcctgctaacttctaaacccttaggcctggtttgagcatcaccatttctctcacttgcctttctgttttctccctcccctttccataaagagttatgtgcccccattctgtgttctcctgaattcctgtgggtcctagaaaagaaacatcttgagggcaaggagttcatcttatttactttttatttgcacagcacctggtgtgtttgctgaataagtaaataccgaacaagatatcaagagacagtgctgccaattaactgtgtggctctgagcaagttaattaacttctctgagtcttatttttgttctgtaaaaaaaatgaggtttgacaaaatgagcatctctctctaaaattatgtgtttctttgatgtaattgtattaattggaagacttcagattttcttgccatatcaagataggtcaacttaagaaaaatgcatgtgagtaagtaccaagccaattcttgattatcagtatgataatatgaggaactgcccattttgtcgataataagttataatttttggtctcagtgtaggttctttctcaaatccagatgtttctggtgttgcattttttcattattattcagtctctcgcattcatatttctccaaagaaatttatggaaaacttgagacaaaaattgaatgtaaagtttaatatttaaatgctagattgattcaaggtctcactaattataactatatttggagggagaagaaggggaggtggtggtagtatgagctgaatcctcctctgttccttcctagaaggaacacaacgtcctacatcaagaaaaaagacagaagcatatcttggagatatgaaaagaaccaccaggtaaactaaaaagaaaaagagtgttaaaaagtcagcctttaaaaagcaggattggagatgaggaggggtggagtaggggaagcattgcttgtttatagaagctcttccatcttcgtatagtgtgatttttatttttttattattttttccttccttttttttgacctccagctttagtatagtacagttgacagaaattatatatgtttatggtacacaagatgatgttttgatatacatatgcattgtgaaatgattaaatcaagctgattaacataagtagggttttatttctttaacagtgatttatttgaatatatgttgagtcctttctatgtgccagacacagttctaaggacaaggcacacagtgccaaacaagacagaaatccagaaattcatggagcttaaatcatgtagtcttttcagtttttaaaattttcttgctgggcgtagtggctcatatctgtaatcccagtacttcaggaggccgagaagggaggattgcttaaacccaggaatttgagaccagcatggacaaaatagcgagaccccagtctctacaaaaaatttaaaaattagctgggcatggtggcacatgcctgtggtcccagctcttcaggaggccgaggtaggaggttcacttgagcctgggaggttgaggcttcagtgagcagcgattgtgccactgcagtccagtctaggcaacaaagcaagactgtctcaaaaaaggaaaaaaaaaatagaaagagaaactttatttttacattagccttttttaagttgaagaatcccatagctaaaaaagtacacaaatattaatgctgcaactttagtgatttatctcaaggtgaacacgtttaacctagtgggtggtcaagaaatagaacactggcagcactgcaaaagcatcctatctgccctttcttagttaggaccccttccctccactgtcatttaaaagatttcacaaacaacttttggattatatgtatgtcaattctgtgactcatatatatccacatagacaatggagcgttgactgaatgaattcattattccaaggtgctaataatgagcttcacaccagcgggaactctgctgtgtcagttgggctctaagctcagttcatttcagatattcctcactaaacaaaatactgtttttcctcagttgttagtaaaaaatagaaaacagattacattctcatttacttattacttatgaatgtaaaagtaaatattttgcttaataccaagtagccagggtcactgacagagacatgggagaaagaagtattcacatctgatgttatcagacatagaagagagaggtatagttcacctatttctccccactcagtttatacattgacatctgtatgtgtgttgttttgttttgttttgtttgtttgttttgagatgtggtgtcgctctgtcacacaggctggaatgcagtggcgcaatcatggctcactgcagcctcgacttcctggtcccaagctatcctcccacctcagccacccaagtaggtgggactacaggcatgcaccaccacacctggcaaaattttaattttattttactttttaaaatttttgtagagatggggtctccctatgttgccaaggcttgtccccaaatacctggacctcccaaagtgctgggattataggtgtgagccaccacacccagccatgtatatgttaaagcgtttatctgtatgagtggtcagtgtagaaagggcttcatggagcctgattttgatggcttgcaaattattatatttgtgtatgtgtaatcggaaggccttcgccgtgattatttcttcaaaggaaccctttgtccctccagggtgattgtacccatgttcataggaccaaacattgctggttcacataatgactctttttcttttaaaacataaaggacatatttttatggatttttgaggattaatagaataaaaatctaaagtcatattcagattcaagagaactggatcagtttctctgtatttgaacaaaagaatactaatctctaattcataatgcatgaggtctacttcttcctcagtctgaaaatatgaatattccaaaatggtactcaaggcagaggctatatatcaaaattaaaattctgtgatactatgtttttagggaagaagaaaactgtagcattagaaatgtagacgcaaaaggtcagaacaaagtccagtatgtcaagtccctttataatgccatctgaatgaaagacctcacaccatgaacagaggtattgaagcagtttttatgtggaaatggtaggcagcaatatctcaggagtgactttaattataacatttaaggttttatctaacttattataatccttagagaacttctctagctctacaagttattcttggcagaatttgtcctaacatagtattaataaaaataaattttacttgagtatgatataaattactcttaattacaatataattttaaaatgcccaaaacatcttttgatcttatgaatttcagtcagctatgattaagaagacaaccataggcaaaaatttctttcttatggaacacgttggaatgcattctaatcacttctctaagaaaatccctgtcccccatgattatagtgaatatgatacagcaataatttagatgcttctttcaggggggtgaggttatgtattctacagtctattgattctaagaggcacttttttctcccccaatttaacagttttgtttaattatatacatttcaggattttttggggatatttttctatcactggtttctgatttaattccactgtatttagataacatattccgcatgctttcaattctttgaaatttattgagacttactttatggctcgggacgtggtctatcttcgtgaatattccgtgtgtatttaaaaataatgtggactctgggccgggcgcggtggctcacggctgtaatcctagcactttgggagtccgaggcaggcaaatcatgaggtcaggagatcgagaccatcctggctcacacggtgaaaccccatctctactaaaaaaatacaaaaacttagccaggcgttgtggtgggcgcctgtagtcccagctactcaggaggctgaggcaggagaacagcgtgaacccaggaggcagagcttgcagtgagccgagatggcgccactgcactccagcctgggtgacagagcgagactccatctcaaaaaaaaaaagaaaataataataataataatgtggactctaaaatcattcagtggggtgttgtagacacactaggttcttttgattgacagttttgttcctaagccttctatatctttcctaccatggtttgaatgtgtccccaccaaattcaggtgttgaaacaggatgaccaatgtgatggtaggaaaaggtagagcctgtaagaagtgatgggattaggtgcccttttaaaagggcttgctggaggaaatttgtctcctcttgcctttccgccctctgccagttgcggacacagcattcctcccctctagaggatgcatccctcaccagataccaaatgctggtgccttgatcttgggcttcccgttgccagaactgtgagaaataaacctgggctctttataaattacccagtctcagctattctgttatagcagcattgacagactaagacatttcctgacactctgttgatttgctttgatcaattaccgagagaggaatgttaaaaatcttaactgtaattgtggatttgtcattttttccattagttctgccacgtttttgcttcatgtattttgaagctttgttaataggtgcgtacacaataagatcattgtttttctttgatgagttggccctttgattcttatatgcaatgttcctctttgtccctggtaatgtttattctcttgaagtctactttatctgatattttagaatgtagcctgcttttcttatatttagcatttgcatgatataactagcccagtgtaccatcttcatacatttaaactgtgtctttaatattaaagtacaattcttatgaaaagcgtatactttaatcttgttttttaaaaatccagtctgatcatctctgtcttctagatgagttcagtccagttccatgtaatattattattattattatttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccccatgtaatattattactggtatgttgggtttaagtctctcatcttggtaattaattatctatttgtgctatctcttctttattcttttttttctcctttcctgccatcctttgaataaatcaagtttagtgttttaaattccattttatctccttcattggttactttctaaagtggttactttaccactttagaaaagtatttgtttattacaatatgcatctttgagtctctaattaatgtgagaacttgacaatgttatacttctgtttgtccttctgtgctgttattgttatacattttacttctttatatgttataaactccaaaatatattgtcttgttttgctgtgaacagtcaatcgtctgtttaggaaattaagaaagaagaaataaaagtcttctgcttactcacatatttatcattattgatgctttttattctttcatacaggtccaagtgtctatcatttcccttcagcatgaagaacttctttttagcatgtcttttagcaggtctgctggtgatgaatactcttagctcttgtttacttgaaaatgtcaatttcacctttatttttaaaagatttatttgctgaatattctggaccaatctttttttttcttttatcactgtaaaggtgcctttacattgccttctagcttgtactgtatctaatgatcatcagaaacatcatgcttatcatgcttatcaattgttcccccatatataatatgtcctttcttgtcctttgctattttgggattttttttttctctagcattagtttttaacagtttggctgtaatatgcctaaccatggttttatttgtctttatccagcagagagatctttgagattcttggatctgtgggttgattttttaaaaatcaaatttataaaaattctcaactgttatttttttgaatattttttctgtcttttttctgtttctgggattctatgttacaaatacgtaagactgcttaatattgtcctgtaggtcactgaagctgtgttcacttctttctgcctttttttctctgtaattcagtttgggtagtttttattgacctttcttctagtttattggtactttcttctataatgttaaatatgctaagtccatctagtgaaatttcatttcagttctaaaatttccattcttttttttaaaagaaaggtatgcatttctttgctgatattgcctatctgttctctcattatgttcatcttttcctttacattattgaccatatgctattagctatttttgtcatttgtgtcattttttttctcagtcttattttcctatttctttgcaggcttcattatgttttattgtacattgtggagagtttgggttttttgtcttcctttaaaacgtgttgagctttgttgtaacaggcagtgaatttactggtggatcacctagttttattaagataggtttagagtagcccttattttaggatgtttctaactcccatcgtgtggtctttctgaaatcacaactgaatgctcacaatgttcagtgatgtctttccaccctggattattacaaattcagtgtctctcagcactatatgatgtctggaatttccatttagctcttagatgcccagaaactgttttctattaggttttgcagggtcttgtcctacactatcacagcttggtatttggccagtgaccagagatgacccctatgtagatttctgaggctcttgctttttgtgtaaagcctttctttgtgatattctgcccattggtgttctctctttgggctctccctgtgtcatgatttggaaagtgtcctcagtcaaaaagtgagggcgaatttagaatttacctaaatcaccttataatatatagccctatgaagtccaatgtcttaaattacatctttaggtattttgtatggtttcacagttgagtatagcaaggagggaggttcagataactgttaatctgtgataactaaaaccagaatttgacattctgacaaacttgaaattgcagtgcttcttaaaattaatacagtattacttaaaaaacaaaaacaaaaaaaccagtgttttccaatttgccaatacaaaaaagcaaaactcccatctctactttttaggaacttctatccatttgagaagatgataaatatataggtaaagttagattgcagtaaaactatgctgtctagtgttaaatcaccagtatatataagttttatagatattatgtgactacagagctataggttataggaaaaatataggatttcttggcagaaattggatttaactagagccttgaagagtggatgctattgaggtagaaaagatggcatttcaggatgcagggcatattgtgaacaaatgtacaagatggaaatgagcaagtcattctgaatgattaatctgtctatcatagagggttttgattaggacatagtagtagttgatgcttataatatgatttaatataataatgtaatgtgctgagtggttgaagtctttggactttatcttataagtaatatggcaataatgtgaaagattcttgaagaggaagaaaccctgcagtgagggagaacagtacagagcctattactgtcattcagaggtgaagcaataaaggtctctcctaggatgttggaaagaaggggcagatccaagaaacaacatgaagaaaataatcagcagaaattggttattgactagatatgtgtgaaaatgatatattggcagaaattgcaaagtcaaaaatggggctcattgcagcaggaatgatgaaattgcttttagatagagaggtgaagggatttaaaacattaacttgttttaaaggtatcactgcttaaagctaacagtgatttattaatatttgcactctgaaagttttaacagttttaattttatgtatacaccacagtgttttggctactatacttgcctcttttgttcagttgggaattgagtaaactaatagagtaaaaaaatgagtacaaagtgggctttgactagaactctaacaaagtgtgatcactgaattaccaagataattaacccataccccacatatactccatttcccatgacacatattatattgcattgtttttgcctatttgccttcctacttcctaaactgttgaattagtttgcttttgttgcattaaaaaaaaggagaatcaccacaaagcaaattaaaagatactgattacttcttccaattctgtgggctgcctagttcatctggcctggcctgctttggctaatctctgaggtcttttggctacttgactggtactgtttgtagctactcagctggtgccctactgctgtttgtctgaagttgttttggctactcagctggtgctagggagcctcagctaggactgcctgtctgtgctccacatggtctttgattttccagtggctggtgcaggcttgtttgcatggtaacaatgttccaagaaagcaagaatgatcattgcaaggcctcttataagctgggtttagaacttgtacttctacctcttcctattggtcagagtatgtccgtaggtctgccaagactcaaagcacagagaaatagatgtttcctcttgttgagtggcatataaaaaaaagtgtggccattgatttcaatctgccacaaccgtaagctctgtgagtacaggaactgcatcactcttttgcactttggtgttgttggcatagtaggcataaatatttttaggtgaatgactaaattaatgaaggaaggaaaacattcaggtagtatttcaatatactgtagttttaaattatatatattatatacatttgacatagtttaatatataagtatatacacatatagttttcatatataagtatattatatattatataaaatatttatatgttatatataaagtatatatataaaatatatagttttaatatgtaagtatatgtatataattatatataatattataagtatatatacttttatcataccatcagtgagtatagacatggttcagggagaatctctttattctccttctatcttttgagatagaccaaagaaaatttttttttaaaaaaagaactatcacttgagttaacattgtttggtatttttatcttcataggtgattgccttgtgaataactcattttgtgtattgtcagaatcctattctgcttttcaggctgtgctatgggtagactagctctaaccagaacacttgggagacctgaagcaaagatactatattaaaataagtaatgttatatgccaaagaggaaaaccacttctgcctcctaaacaactgaaagaaccagagactgtggggtcagattagctagcattactatatgaacctgagcaaatgacttactctctttcagcttcagtgtcttatctaggacattggttctcaggattggtgtgagaattaagagaaatatgtgaagttctagctacagttctttacccatgaggtagtcagtaaagtttacttctttctccatgtgaaccaaagcactgtcatgatgtgatgatgttcattagggtttctcatgctcagcgttattgatatttagggttgcataatgctttattgtgaggggccattctgtgcagtataggatgtgtagcagcatctgtagcctctatacactagatgccagtaggaccacctatccagctgtgacaggcaaaaatgtcttcaaacgttgccaaatgacccctgggggcaaaatgcaaacagtttatctagcagtgacacatagccagccaccttagaaagggaattgtcagcgtacccataagtgtagaatgggaaacaaaatacttgagtcttctcagaatgtctaaaccttttgctgtctatattcctctttttataatttaccacaaacatatattgcttattatgccatctaataaaatggctaacatttgctgtgtattatactcggtgttaataagctttgtatgaactcactagctgaatgttgtatatgtatctgccatacctgttggattgacattccactgtaaacaggtaccttatctttaccagctccaagcacaatgtatttggtatatcaggtagctattctacatgttaattgatcacattgcacccaaatgaaacatggatgtggaagtggaaggaggagctttaaaacatggaaaattagtttatacaaatctaaatgttgtagtgcaccaaattgattcctttttaaaaactttcagaaatcagcttttaaaaaaaaaaagtaactaagccatgatcaacttttctttcatcaccactaagccaatatcagaaagttgtcaatcaacagctcttttaaagttgaaatttttctattgtatttcttatgaagatttcagtagtgcttagaagtttttggctcatttatcatgttttattcactgtatgtcattaattgttaaagatgtcagagtcaaaccttaaattcaggagagatttaaatttttcctttttcctatttaaatatatgtttctaattacataattcagttagaaaattacaatatagaaacatataacttagtaaaagtttccagttactgtatacagattatattgtatactgtattatttttaacagttgcatatttaacttataaatgtggataattataattaaacaatctgttatcaaaggacatacagattatttccagttccttgctgcagtgaatatccttgtacttatttttttacacacttgctcagataatttttaagtacaaattcctgaggtagaattgcagaatcaaaagatactctcatttgagtgtttcacattttatgcaaagtattttgtttcctccagaaaattcctctgtggaagaggcttcctcacattctttatcagtttattagccagcagagaaatgatgaaaagccaccccttttcttgtagtttcatcctcattgctatccaagatgaggtattaaaatcacacctaagtggtgtctgttgtggctgaatataatcttgaaagtagagacacttctctctgattcccaactgtactctctggatggcacctaaaattttattttttcaaactgaaaatcattttaatgagttcgaaaaggttttattttttaaaatgaaatcctatagaaagaatacattttcttacagtgggtcatggtcaaaagtgtgaatatctctgatcctagaaagtttccccagttacaaggacaggcgtgcccccaactccatccttaatggctcaattctgtggctttcaagttaatccactcagtcctacagccttcaccaagaagctcatgtgctacactttggtgttagtgggggcattgtcacacaggttcagaaaataacccattaggcattttatagaactcatcacatgttcagaactaagctagttgtaacattatgtttttcatgtgaaaaaacacaagcaattcactggctattttatttgttgctagctagctatactttctatttctttttccatggtgtgaaaatcttcctagaaacctcactactgggaaaagagatgcagagattagtcccatcttctcccctggaaatttactatcgcccttttggcttcaaggtccttcctcaaaagcaaagaattgaacaagggaaagtgaggggaagggctgggggaacagggaggtagaaggggttttccctggtcttttctaatcctttagttccagacgcttagttggtatttcaacattttagaaataaaacctgcttttataattaatgcaaatattacttagtgattcatcctttccaaatgattcttggtttcttttgacatttcatttttaaattgtgaattaacattgacatcaccatagcgttactgttacctcagctctttacagtgaactgtattgcaaaggctataaaagttcaaattttaactatcacccacgtgagccttggactgctgttaggcttttgaaactgtgatcctttggcaagaattggtgtataaatcatggggaggatattgaaggggaagatcatgtttaatttggcagttgggtgcctgcaattgacagattttcattaaggttttagctatagtagtgatcatgcatcagttctaataaagtaggtttcgtttgaattttaaaaattagagtgaggactgctttatgttaactgtttacattcagaagtctggaaaaccatccacaggtttaaatgtatataatcagtataattaacacgtcaacagcctcacctctgtttttgaggaccataggctaatattatttatgaaggttcaggagatcagtctagatcgacagaaagcttaagggcaaagatggttttaatatttttcttggaagtttgagcttctgtggtattctaaggatagggattttgacattgattgttctagctggtattcagtactgtatttaagtgtaatgtttttactagtattcttcttataactgaaaactatgctaatgattctttactatagatatatactcataaatacgtgtaaaaatccaagtttaccaaaaaatattaagacttaggggatatgttctttgaataggcatttatttgctaattaacatattctaatctcaacaaggttatattcttttcaaaaatccattccatcaaaatctgtcatttttacagatgaagaaacaaaggccacagtgagtttagttaatatccaagatcacacagccagcatgatagaactcttaaatttcaagcgacttaccctctttactctatcaggtcaaatttcccttttttaactgcttgtcttaattgagatttgtttaattgtggctgtctgtatatcttcaatcaatactttcttgttttagacaaatgtttccctgcaaatctgcatgaacttcatgttctgaaggactcagagctgccctttcctttttgttaaagttgtacactgctctgcatccccctagaatgctcatcagctttctcactcttcctcactcacacagtgctccagcaggagaggatttctttgaaaatcagattcttttttggagggctttgtgcttattggagtgttatgtgatatattcattacggtgagggctaaactctttgaacaaagagacctgacagtgcatttgggttaaagaacaaagtttatttctttctctcatcaccaccagcatgagcagcctggatggtcagagcagatctgtctcatggcattgttcagggatcctcattccttccctctcatttatctgccatcccctaggctattaatcatcatgtttttggtagaagccaggtcttctccatgtctgagtttttatggaggaagcatgtcaagggccttaagcccagacctggaagtggtatgcaagagttctgacattgcactggtgagcatttggtcagatggccatctctaactccaacgaagtgtagggtatacactaggtaagcagtcacatttccagctacaatactaattctatggaaaaggagacaacatattttgatgggtagctgacattctcatctgcagtcctaagtactcatgactgctagatagactttatgaaaaaaaaaaagaaaaataaccccaggaattaatatttaccctcagccttgtgtttctttaattttctcatttttcatgtcacatatctaaaatttgatctaaataaatttaaataaaattaacctttatttgaataataataaggacatttctcaaggaagtaaatctcaaatgatatgtgattttagatactatctttatctgaccatgtggttccttgcttctatcagggagggcctctgggtaatagaagattgctagggcctgcagtatattaatgtttagctggagttgattaaatctgagacctatagccttgataataaggacttttatttttgtatttttattgcacttttaatattacagagtttctgtaccagcttgacaacagcagaaacatggcttgcttctgtggaacacgctagagcagcagtccccaacctttttggcatcagggaccagtttcgtggaagacagcgtttccacagactgggggctgggggtgattttgtgatgattcaagcacattacatatattgtgcactttatttctattattattaacattgtaatatgtaattaaataattatacaactcaccataatgtagaatcagtaggagacctgagctgcttttcccacaactagacagtcccatctgggagtgacgggagacagtgacccatctggagacagtgacagtgatcatcaggcgttagattctcataaggagcgggcaatctagatcccttgcatgcacagttcacaatagggtttatgctcctatgagaatctaatgccactgctgatctgacaggacacggagctcaggcagtaatgcaagcgatggggagcagctgtatatacagatgaagcttggctggcttgcctactgctcacctctttttgtgctgcgttatccatagcccagggtttggggacgcctgcactagaggacagagcctggtacactatagcagtcctccccttgtgttatgcagagtactgatcagtcccttttgagcttctcaaccttgtataaaactttgagacagttctgggaccatcacaaggtttatgaagggttagaaaacaatacacttaaggaactaagactgtaaatcgttgaagttcagagggcgataaaaagaaatggcttctaagaatcccagtatgtatgattttttatacaaagcataaagatgatttgtaccaaactcaggacactgtggcgagcttaacacgagggtattgaatcatacgtaagtggtaattcctagattatgcaatctccttgctgttagatttagataccaaagaggaactacatcatgtcctcctcctatggtcttcaaaaaaggattatatttggtcttactggtataatacagtttattcctgcatgaattccatggtgatagaatttttaaagttcattctagtgttacagttttgttttgttttgttttaatacacagcttcagaatggcagaagatgatccatatttgggaaggcctgaacaagtaagtgtcataatctcactgataactttatttaaatatattcatatttcaaaaatatgcaaaggcaacattagtaagttagcattaggaaaattctaaaattagtaaatttttttttaatttcagtttctctgtcctttcatgtgaagttggagaggatatgtcatgtgaaatgagtaacttacacccgctttcacacatattgttgcacaaaaattgtatatgctacaggatagctattgtattagctttctagagctaccataacagatcaccacaaacctgatggcttaaaacaacaaaatacattatttcacagttctgggggctagaagtatgaaatcaaggtgttggcagggttggttccttctggaggctctcaggaagaatctgttccatgcctctcccctagcttctggttggttgctgggaatccttggcttgtagctttatcgctccaatctcttcctccattgtcacgtgcgcttcttcccggcgtgtctctactgtgtctctaaacctaaatctcctctttttttcttccaaaggcatcattggatttagggtacacccttatccaatatgacttcatcttaatttgtttatatctgcgaagaccctatttccaaataaagtcacattcacaggtaccggggattaggagttaaaggtgtctttttgggagggaacacagtttaacccactacagccccttgacatatttatttaatgtgtacacatggatgtagagagtggaatgacagaccatggagattcagaaaggtgagggatgggagggcagtgggatgggggtggatgataagaagttacttaatgggtacaatgtatgttatttgagtgttggataccctaaaaaccctgttttgactactatacaatctatgcatgtaacaaaattgcacttgtaccccatcaatttataccaaaaaaaaattttatttaaaactcatctagtaaggagacagattgttgtagtgaaaagatctttgaactcagaatttgaagatctttatataagtactgactactacagatcagctcctcagacttgaagaatcacttagtccccgtaatcctcacttttctcatttgtaaaatagaaatgctagcaccacactaacagggatgagtcaaaaatattcaatgaatgtgctttgtaagcataaaactgttcctatcattatattagtagttatgaaaggatagcagtgtccttttttctttttctcctatattttattttgaaaaatgttggaaaaaataaatagaaatgttggaataatctaacaaatctacattggttcttaaaaccgacattttcgcttttctctttgctctctttttcgtgtgtgtgtgtgtgtgtatatatgtatatatgtatatgtatatacataatcatttggaagcaattttcagactctggagcaattataatggcaatattaaattatttatgtaatgattccaagaagtatttaaaacatggagatttgttcattcatcagctatttattgaggtattactacgtgccagaacattggcttagtggggaaaaaataagtgatatatacactctaatttcaggaacctactattttaataggaagaacagagacattgttttcatatggtgatatatgctgtagtagtagtctgcgcagagcgggatagaaatgttaataagcagcatcactaggtgctaccttggaggaagagcagagttacggaggactttccgaaggaagtcttcgtaagctgtgttttgaaagatgtagtttgctagactagaaaaggtgaaggaacactaggtgccaggatagcctggtcacatttaaattttagtggcaatcatttaaaatagtggatttctgaaattacacgtgcaaagaatcagccagaaaaataaaaacagaagtggaatatgttttaaaggctctggtatcatttctataaataaaatggacatatatagcatttatcacttcgggtgatattctgattgatttagaaagaatgactgcattgcttttcacattaagatgctcctttctaattttatttttaaaatggtgatttaggataaatctaggaacattttcttttattgcagcaaagacatttggctaattgtattatcaaaaccgtttgttttacctttcgcttttaatgtgctttctctaacaattaagggcgaactaaccagcatgaggattgtgtctgcttgattttaaaccatcctttcctgtctgtacacaggaaatcttatcaacaagagatgattctttatgccacagaagagtaaaacctgctgaaaacattcattttgaaagtttttcttatgtgggcatctttgcgatcatcagtaacaggggtggggcatattctgacatttccatttttgaggcaagcggtcttgaagtttttttctttcttggcttgagcttggtggtttatatttcctaaagtttgcatgtcctcagtgttttagtggagtctggaatttgctctccaccctgacctaataaacaatgcaagctgcagcacaacacaacttctctcttagtctgaagtgaagagtatatctctctcctaaggtgagcccttttgcccactcgccagtcatttagccaccacaggaaagagttttcctgctaggttatcacgtttgctctgagactgttaaaatcctgtatgaaatgaggcccatttttgcagaacatggtttttcattcctgtatttccttttcagcaaacaatgaatagcatcagtgagcttttaatcttataagcattgaagtgaagcgcattctttgttcctcagttgaaaatttgcatccctcaaatggatctgaagtactgtttatttaaacgagatttttcttactcttaatttaactaggcatacgaagatcttcagtaccccagaactttcaataatttactactaagggcaggagacaaactgtaatactggctactaaaagaaacgaaaagctagttcagcacacttactagtctctcataaaaagtaaaatatggctggtttccatgctgtccacagacatttcaaacatataacttctttaggctaaaataaatagcaagctcagaaatacagttttaaagtcctaaatgagccagcggttacaatgttttttgataagtaatgaatagtaatttattaagataaaatgtactttcttcaaaatattctgcatgcccactctgttgctgccctaacacattaccacatacttggggcttaaaacaacacaaatttatacttctgagtcaggagctcagaaatctagaatcaaggtgttggcagggctgctttccttcttgcggctctcatctctttgccttttgagcttctagtggctgcctgctttccctgtgcaccctctcatcactccagcctcttgcttccattgtcatacttcctactattcagtgtgatttcctgaacccctctcatcaggcccacctggacaattcaagacactctcttcatcttattatcattaccttaatgacatacgtaaatttccttttgtcatataaggtagcactcacagtttctgaggattaggatgcagacatgtttagggggtcgttattcagcttaacacacccactaaattccaggtattttgtgttatgctaggaaactgaaggtaaaagaaatgagtgagctcagtgcttagttgtctactccttgtactgtcagttatattttcagttattctgtaaatagtcccagaggtgctctctagcattctttcaggccttgacattggatagctagatgaggggtatatttaccaccatagaggaaatactgatttctaggattatattattttgtttatacttctaagagagtacaagcttcaaatcattcattcaacaactatttaagtatctgttctgtgataagcatgtacttggccctgaagatataccagtaagcaagctagaccaggtccctgcctctggggactttatagccaagttatgcttctcaaatccctttgttacgtaaacgttgtccaaccctatgtaaagttttgtacacatgagaactacctaggtctcatgaagatcttttaaaaccctgatttaaaatattttcagatttttgtttttggctttagtttcattcctattattacattttaggtgtcccaacttcaaatttttcatataatataggaaaaataatgattgaaacatttaaatgttcttctttacagatgtttcatttggatccttctttgactcatacaatatttaatccagaagtatttcaaccacagatggcactgccaacaggtaagaaaactcatccctgttaccctgttgttctgctttcagtcttagtaaaatgcaggatttgttaatagtctgtcctagaaactcagttgtgtacctagaaaggaaatggtgatttgttttaaaaaccaatcttttaacatactttcttgaaatatatttgcacaaaaatatttcatctcaattaccccttgtatggtttactgcatttcatatctgctaggactactcagaaggaatttctttagtcaacataaggattttctttattatctctgtattccttttaagtcctttctcccagattcacacgaggcagtctccactcttcatttctgtttcaaacatttaagagggcctgttgtgtactaccagtgtgccagtcactggggaatcaaagtgtacagaaatcataaaaatcatctcattagaaaaatcatctttataaaagcttataactttgcactctgacaagttggataaaactcataatccttccttctaccatgactgtattaattgtgccgattggcaactgtttaatttcgtaagagtaataaaaaaaaaactctctttcttaaaaaaagtgatttatttgtatgtaagcttggtgtgatggctctttttatgttctgtttctctcctcacttcacccgtcaccagtgggacttaacagatgttcaaaagcagtgtgagtgaattatggaagttatgtgtaaaacagagtttggtaatcgctgaaggaggcatcagctcttttatttaccagggacttgcttgtcttcattgggggactttatcccatttgtattattctcatttaaaattatcatggttactacagtacttacttttcttttgttttagatcagaaaactttttctgcatttatatctttagtatttctaggagttcatgggagggaaaaaagtagatctactatactttcaccttcactagtaaaggtgtatttcagaggtttttctgtctttacccctacaaaacattatttttaggctgccatgtctgagatcttgtgaagtgctgtccaatttgagctctaggtcagcttcctgtgaacaagtaaatgtgttggtagtgtgtgtgtttcttgggaactttttaattctggagttcaaagtatttttcttagtattaatgtattactgaaaatataagaacttggttctgtccacaggaaatacacacattttcacttaatgtcttgtgaatacaaaacagtatcctgaggcagacgttttcttaattttattccttcggatttatgggcatgaaaataagattatcaagataaccatctcagtaaatattctgtggtcacagctttatgttgtagaaattattttgccataatattagaaaaactattcaaattacacctaaaaatctaatttgttagttgttgttacaccatcatttttacctgtatgtttttccctcttcattgcagtgtcatagtacaatttttatagtccaagatatataggatgttgtattcaaatttttaaagaggtagagaggttgattatctaaaccaatattaacttgtaactctaaaatggattattttagtcttctagattttttgaaatctaaaacctttagtagatctagtacttgttgaagactatgggatgcgacataactcttaggtctaaagttaaatttctctgcacagtggaatgtccttttcatggcacagaaatgtggccaaaagaatgttggccttaaaacaacaaatacatgcatatcaaatctaattttctagttgatttaactttaatgtgttgcctgaaagaggaaaaatggctctattttacatgaattttcacatatttaaaggaaattaaatcctacaggaaaaataatagcaaatttgcagttgtttttagcagagttaataaaaagtgagagacttgaagtttaatgtaaacatgcttccaactcctctgtatttttcatgacatccaaatattgctctgttagaggactgtcttgatatgttctttcaccattttaacagggaatgtttttataagtgttacattgtcatacaggctgtatcttagtgtgaaaatatttctatttctaatcaattttatttccatatccaaaattaaattctagccatttggtgggggaatttttaaattatgattatgtttctaaaagtaatttaaaatgtccaggggtgaatttcatacagacaaaagatggtaatttaatacattgaccagtgactcccccttttttttcttgtgtatgcttcatttcagatgcattcatttttcaactcgcttccttgtaaatttcttgaataataacaggaagtaattatacccttgttttctccagttctctagccttatcctgatttatcataatattgaaaagataaaaataaattctctggccgggtgaggtggctcacgcctgtaatcccagcactttgggaggccaaggcaggtagatcacgagctcaggagttcaagaccagcctggccaagatggtgaaaccccgtctctactaaaaaaatacaaaaattagctgggcatggtggtaggcgcctgtaattccagctcctctggaggctgaggcagagaattgcttgaacccaggaagcagagattgtggtgagccgagattgtgccatggcactccagcctgggtgacagagtgagactctgtctcaaaaaaaaataaaaaaaattttgagaaaattctcttttgtgttatagtttatttttaatttcaacctgaaggtttatctccttacaaatttatttaaaataagaggtcttgagcttctttctgagagaaaatgaagattaaaatggacatacaagcattctcctaaaatatttttagcaccaaacatcttaatttacattcaaataaatgagaaccaccatatgcctttatttattgcaaagctatggattattgtactattgacataaaaatcagctgggaagcttaaggactttttcatattgaacagtttgtacttatgttgtcagagattctgattttcctttgaattttcaagtcagataccattagggtatggattaagcctctagttttctttgcgtttttacaataactaatttgcatgtacctatcttcaattaaattattttcagtattttataaaatgcctgagatgttttagaacacagtttatatgatagcacaatattcaaaattgcttataaacatcaaaagttatggattaatatgaaaattttaccatgtctgatagaccagattacattgggagtgtcggggaggaaaggggaaacaaactaaccagttaaggaatgaaggcagtactttcccttcaagtaaagacgggaacagaaaacctagtgtaaggaaaaagagatagcctgagatcattatctgtctatcagacgtatacatacaggttgctagatcagtatcttttaatttcacattaagcacactctctttgaggaaggaaagtcagtgtctaatgatgtgaaggccaaagaaaatgtcatagtgcccagaagtggttgctgcttttaattggtatttgtcattttaaaatgctttgttaggagacaagattatgaaggctgttgacatcaattcttgccggccatatgccttttattgggttaggaaatgtgccatcacctttcaacaaacatttacttattgtggttcgctaaactcgtaaaactattgttaaaataagggttaatttaatatttcagacaaggaagagaaattatatccttgtggaattttaaccaaaaattgatttgaaatttctacataaaaacataatttcagttttttacttgctttacgttttataccaaatttgagaagcctcacagtttcttttggtttctgtttgttgtttttgtttttagcagatggcccataccttcaaatattagagcaacctaaacaggtaagattaaaggggtgggactttaaatgttagattccagtgtctaatattgagatcataagcactgaagaatagtaaatgagttctatgaaggaagtagtttatctgaaagatcaacaacctgacaaattatgtaacagctttattcattcactttacatttctcttactcattgttcacactgtcctgagcctcagtatgtagttctgtaaaactgcagttaattacagtattagaattacagttaattacagtattctgctgtctctaccagcttaacttaccagccactcccaggaaaggcagaggtgatttccattcattttcatttataaggaaatacgtatgcatacagttcacatgcactgagcgatatccatctattatccttgcacatgtagtacctcttagccttcctccttcctttggtagccccagccttttctgtgctgcctttggaacatgtaacctaacatactgaaagtaccagtgggaagtaaaatgttagaatgaactattgaattctcttccctctggtgtcagcctctttggagtcaggagaggaacattttttcaggtgcttccccttaccactagagtctgtagagaatagctcagaactgaaatggcctcctcactgtatccaactctgtggatatttataggaaattggatgggaccaatgctgtgaaagagaaagaaaggcaatctttaatgtctgcctataggaggtttcagttattagggaatggaaataatggtgtagttccccacagaatgaggacagtcagtaaatctttggatggataaactaatcacatttgtgtgtgactgaggatatggatacctgtcctcttgcagctgtattacccaatacattttctaagtattcttttcattagctcaggtgagtgaaacacttttgcattttgtaacatttaacacatgctaactaggtcacaagcttaaataaagcatccactgcgttgtggtttccagaatcgtgacattatatatgtgttatatttggtcagcatttgatataaatgtcttaatgattgctgaacaggctatccttataaggttgaaattagatgaaagtttttgctgtgggggcaagaatgccacatgaaactttggggcatggttctagttcttgcaggtgtcacatcctgactcctcaggttgccagtaacactccattgctctacctccatgttcaactcttttaagcagttatttctcagagaaggtcatcaattcccagtgaaattttatcccttaaagttctgtgggctctggcatcctggaaaatttcccagcttttaagatctaggtagtctatgaaacagaaatcaactgaaatttgtctgcatatgccaaagtattttttccaatatcattttcataagcatagcactacaataagaatttttaaatgtaattccttattatggatccaacagttataaggaaaaattggcatttatgatttacctgaagggttaatgtagttccaaaattcaaaatttaattcatataaaagcttatgtgagtaaaacaatgtgtttaccaaagtgatgctattttgatatctgaattcagtgaaagtaagaaggttgtattcaagtcagactttctgactgaatggatgtagccttgcctttgaggttgatgactcattttaagcaaatggagttactgagatgagtgaatgtggattaaaggcaaaattttgatctcagaaatttagaatcagaaatgcatccagacaatgcatttgacgacatcttcctgaaaacagttgtaaattttcatcctcagattaaaaacttctgaggatttagatactcgtatgtaaccatgaaaaatatctattaagtattgtctatttgacaccactcccaataagatataaacacatacgtgtctatatttttccaactgtcccaaaggaattttgtgattaaagataatgaattgtgtgtgtgtggttttggggttttttttgttttttttttttaagttagaaaaagattcttttttctttgggacctcttagccacagattttccccagctctgacggagatgagtcatagcatagactactaatttttagaacatccagttctgttgcatattaatcagtgttaattaactaatactgttcaaaaactcaagttgtgtttaaattagcagtcaagtaaatctctattcttatggttagctaattctgcaggctattatacatgtgttgtttttttcatggttttagaaatttcatttaattatttaaaaaaccaacagtgtttgcttacaaaaggcatagggctgaaattgtaaattatttttaaatatgaattgtgtgagaaccaaaacaaaggaattacctctgaaacttcatctccaaaggcttcccttgtgtttagatctggaatctcccaaggaattgttttaggtctcactgtgatgagttgatcataaactttagacatttgtgtgcattaaggaaatttcccagaccggggaatttactttatgccttacttatctggtaaatgtgtttgaggactgatctttggaaatcaggaagtttttggataatataggaacagttccagatgcttcccagagatttaaatcagttcaaggcacctggactgctcagagactgcaagaccctacttggcataatgaaatgtagtatagtctaagtagtgcatacgttttacatttgttcatgagctcaaagctgtcaaaatctgcatgtttgctggggttccacaatttaatgagtaagggagtgaacccccaccagcagctagtgggtgtgatgagctgatgggcagatgatctagtgctgtatatgcagagttggtcccacaatagaaacaaaaggtgagaatgttccttaaaaaatcttaacgtattttcttttcaccaaaaagtgaatctgtaaaaagaaaatcatctgcttaagcgactatgtggttataaactactaacactaccacaaattgattgacatcattataaagttgaatcaggaaatacagcgaaacctcccttaatatgatgatgaggtcataattatccttgttttattctttgtatacaaatatgaataagttagctttataaatcataaaaagttagaactggagtagaccttaaagatggtctggtataatcttcccttttgtacaaatgaaaaaatatgacacttcttaggtgtttatcagcccacagtagtttatatagtgaaggcttccagctaacttcattaattaactatatctataaaatttctgggttagatagtatttaagggaactacctagttttggaatcattctggtaggttaatattcaatcttgagcttgaccatattaataatcataaaaacaaaaatcttatcctctgaaatgctgagagaagcttaacagatgcagggtctagcacagggtgtgttctacaacgctgaaacagtatatctaaataaacatgtctgtagtccctgctgaaccagctgtaatcagagtagataaaggaatgtctttaagtaagagtcaaggaagcataacttttattaatatggtacagttcagagcttggcagcagcaatttaagacaaggaagctctgactagaacaagccgtaacatgttaagtctaaagcctaaactcttcagcagattactctccacacatgcatagcatgagaggttccatgggcttaggtacctggctttttagccatatcttagtgtacaaatatcgattaataccatttttcgtagtaagattacgggaaaagtgattcttgtttacagagccctctttcagtttcatgtttttcttctctcatttagtagacataagatttaaaaatttgtatgtacctttgttgccgtaatttttaataagtatttctcaaacttaattggcttaacgttcacctttgcagagaggatttcgtttccgttatgtatgtgaaggcccatcccatggtggactacctggtgcctctagtgaaaagaacaagaagtcttaccctcaggtcaaagtaagtttgtggtagctctccttctatttgaattctggaaattttgatttcctacgatttccaaggaattgctttaaatgagtacgggttgccttcgctcctaagctgaagtgttcacatgattattaaaatttttaaatagaaatttgtctcctagcaatagaagtgacagatactaaaactttgttaacatttcaatttagtagaaatgtcttcagcattagctaacaaacttactatttcttgatcatcttaaatatttttaaaaattggatacttcctgaaactttagtaagtctttgaaagaaatggttgattttgactctttggagatttagtgaaaaaccaaacaagtgactgagtgtatggattatatagtatattatttaagattatgaatttggatccagactttgttattagctgtgtagctttgaataggtttaaccaatacttctaaacttcagtctcttaatgtataaaatacaaaaatattaatagtatatacttcataaggtcctttagagattaaatgagaaaatgtgtacatgttccatagagagcctgaaagtaccctagggccttggcctgagcagatgtgtggccctcttggaatgaactgctacgtgacatgctggtggtgtatttggtcataccttttaccatgttcaggctgtttgtttatttgagaatatttttctttaagttaatatgagacttttaatttcataatatgctatgtttcatagactgactgatgataaacatagactgataatcattttgcagataaacgcagtcaacaattgtaatttagttttttataaaagttattatttagtcagtaattcaaggcttggacaaaatagttctcactatgtgtgtgtgcccctcagggtgtaacatacttttggactcagtctttttattggtttgtttttgtaagtagatgaagctcagtagagcaggccctcagcaaagttgtgatgtaaagaaatctggccgggctcgttgactcatgtctgtaatcccagcactttgggaggccgaggctagcagatcacaaggtcaggagttcgagaccagcctggccaatatggtgaaaccccatctctactaaaaatacaaaaattagctgggtgtggtggtgtacacctgtagtcccagctagtcaggaggctgaggcacaagaatcgcttgaacctgggaagcggaggttgcagtgagccgagactgtgccactggactccatcctggacaacagagcgagactctgtctcaaaaaaaaaaaaaaaaaaaaaagaaagaaatcagtctttggttttgccagccttgcattttgtttcttccttttcctcttatccatcttctaggcccaggcctgttaaatttcttatccttattcccaaacaaaagacaaaatgttgtgacgtcgttctttacctttcaagtgaaactcacccattatttagtatgggtactactagtcatagttgcattttaagtctcttagctccaattgtggaatgaaagatgttttttctattaaaggtaattaggcgggtaaatatgatggcttaagtccacagaagcagaccacggtcttatggcctcacatcctttagaaccttgatgaggaatgaggagcagcaataaagaactaatttgcacttattaaacaccaaagacttgccaagtggtttgtataacattatctcttttaatctcttagaaatctcagtaggtaaaaagtgcaatgcctgtgaacccaaacagactcagagaatggaattataataactggcctttctcacaagactagtggctctatatcctgcagcaggctattgctcaccgaacctctcagatataatgtgtgcatttggggtactgggggcagggagataagggacaaattatgggcagacaatggtgtaaaaaggcatggtgaatgataactcttgaaaacaagggagagagaggctcactggtcaatgggtactcaggtattggggaagccaggcccagcacttacctttttaacacatgtgtctgtgtgtcacatgtataaatattgtgcctttatgtatgtgtatatttgtgagaaggggattgaaagacacatgttatcagcattgacactgactataatgactgaagaattaactttaagcgaaaaactgggagttttttctgactggcttggcacaaaaaatataaattatggtattttgtttacttctattgctctagtattttgtgactaagtaacaattcttgatactaacaaacacatggcattaactttcttataaatttattggctaagaaaaaactttatacatccatttattcccagtcttcatacatctttctcatgtagaggtttcatctactcaaaaacatattgctgcctcagtcacaaaataatttacaaatgaaacaacttagtgggcattagatgttcttgtagaatgaaagtttctatatcaaggagtttagtacttactgggaaatatagatatgtaaacgactaataataaagcaggttcaactacagtcacattatttcaccaaatcatttattttttattcactaattcagtatccatttattaagcatttaatcaacttgtaagaggaggaggaacttagaggttagagaatatgactatacaagctgtcattgttcccttagcttgtcattgttcactgaaaattgaaatggttctgctgttcctaacagttataggaagtaattttatttatccaagaaattcttaattggaaggatgggtaggagagaaagaaagagacaacggccaggtattttttttttccagagctcttctccaaatatcccttttaatagttatttctgctcaggatgacctttaagtttacaaaggaattttaaatccccttttcctctaatgtttaagcagaggaaaaaattgttctccatgcatctttctaatcaggaagacctttaaaattgtgcatgtcttttctgtggtactttactaagcacctgctcggcgagagactgtaagggaaacagtgggatagatacatctaaagtttctcaaacttggcattattgacatttggggcttgaaaattctgtgttgtgggaggctgtctgacacgttataaaatatttagcagcctccctgaccttgactcactagatgctaataggattcctataattgtgacatccaaaaagtctccacattgacaaatgtcccctggggggcaaaatcacccctctttgagaaccactgatgtggatgcaacaaagaatcaaccttaaccttacccatttgcatacttttctactataaagttgtctcgcatagattacgtagaatttccaagtgtattattttataaacgtgcctttcttggttattagtagatatttcttattttcaagatggtgatcatggtgtctgtataatttctgttagaatatcagagttagtgtacctggatactaaggagaaagatagaaaagataaaatatgtatcttcaacattttgtattctgtgatgaccctaaaagctaatgtgggagttctattgactgttataaactattacagaagaaaaagtgaaagtggagagttaggtccactgtgtgtgaacaatgggagggtctatggaatgatgctttcaggtgggcagaggcctcgtggagggtggccccacactcacccccagaatccagaagccattcccacaggaacttcagagggagagcatttacatttacaggaaagaaatgatacttctgagcctacatttgccacatattcattaagtgcatttgttcaggcattacagtaaaatgccatgggctgtgcttttcctcagctacagcctctctccctccaacctcacaccctgtcttcctgtcatgcctttgtgagagcgccaccactctgcggtgcctggagaggaacctggaaacgctgatagttcagtgcatactcggtcatatggagacagcaggaaagagtcaggggccaacttgaaagatttggggcctggctgtggtttgcaggctgtagacaccaaactatactttatagaacatgtgaaaatatagcctgtatgggttactctcttactgattgtctagatttgatgccttacattaaatcattttaaaaccaactctagaagtctactcaaatcctgcattttctagtggaatagtgtcccatgcataaaaccctgtttcgcataggtgtaggctagcttacagaccctcttaccatgttgagattatttctagaactcaggctactgaaccatctggtgctctgcctgtgtctttcacatagctaagaagaaaatttccatttagctttctgatatcttgctgtgcaagtcttcatgctctttttttaaaaaaaattttaattataaattctttcaagcatatagaaagtttaaaaattgacataacagacactatgtactacaacacaaatttaataggtattagcatcttaccttatttgcttttgatagctctctctctctctctctgtcctctctctctctcaaataaaatagttacagctaaaaccccacttatccatcactttgtcctccttccttctcttaggtaagctgctactctgaactttcactccccaagatgtttttatatttttactacataagaatgcatctataaatactggcattttcaagaaagttaatttttactaacttcaacccaaatttgccattgtataggatggctccttttcagggcaaacataggttcaaactggacgccattgaagattaactggtactcactttgatcctattgattcctctttgctgtctagataaaaatgtatttgtcacaatgtagtttgtactaactcttatagcaaaaaataatattcagagaaaaatctaggggaagtaagtatgcagactaactcttatatcttgtcctttcataagaaaaatttcccatcattaaacatttaataatctattatactgcctataaaatttccctttaaagttttttccattctaatttcatcacggagctcctaataggagaggctggcagaaaagcacaggaaccttcctctaggccaagcttgtccctgcctgcttttgactcagcaaggagtgccagggaaggctcacttccctatttttcccgaaagccacgcgtgaagttttaaaaatcaaactgtgttccctttcacagaggtgggtgacaagagaagcagccccatgggacttcagaaactctcaccaatcctcctctagagtgaccagaaagtaccccttcctatcctaactaatgtgacacgtccttctgtgtggtccactctatgcaaaaccagaaattgacaagaatgactttgattgtaaagtacaaatagcttaccagttagtattcttagtttctctttagttataaatatcaaatgcaagggacttgaaacccagctgatagaagtgtaactatttttaatcaaacattttctgaaagctggttctcacatatgttgtctttcctgagtgttttatgttgagtggaagacgtgttgaaatgtttaggtcaacaacagcttttttgttgtccccttccactactgatttaaaaaaaaaaaaaaaaggctccactcttcgtgcctttccttaaaaatcctaaatgttaagtttctgtcgaggtcgaatagagactacccgatctgctgtggcatttgaggatatcacatatccttgcataatctccctttcctttgtatagacttgtctgattcacgtggtttggatctatttggagtactaatttaaaataatttaacctgactcaattacttaaaacaacaggggagaaaatcaccaataatcagctatgtgtgcgtatagaacctagttcatatcatttattaggatttccattgaacccctaagctgttcactgcgcaagtatttaattagggaaaataaccatacccctatgtacattatactgtgtgttttgtaaaccatgagaaaagctgcttattgaacagaagggctttgtaacctggggtctatggatccctgttggtggtttcagacgctttttagattcctaaatttatatgcagacttacacatgtatgtatgtgcattttttcttgggagatgagtataactttttatcatattttcaaagggaaagatttaacatggttaagaatcatgctatagcttgtatcactttagctttttgatagcagctatctttttaaatgatctatgtaatattttttaagattttttctttttttattcttgcatttttaatcaattttaaatgaagtgaaatgctttatgttgctcaacacatagcccagaaagcctcccttcagttttccagtaggtggaaaaaagatgaaactgaattgatggccaaaagagttgaatgggcttcactgctttttctttcttgctcttccatacatttgcagattaagcatgaagctcaccattagtgattgaagccaaaagagagaaggcaattcattgaacaaatattgattgagcactgtgtgtcaggtactgctctagacaagcagacaaaactccctcccatatgtaaccacaattgagacttataggtaatttttgttgcaagtagttcagaagttttgtattttgtcctaaaacaaaatattactttgtaaaatatttttttaaatagccctctaaatccgctgtatatattcaaagtcactattataaagtggagaaagctactcattagagaaaacctatcacacagataatagctgggaagcttaacccttagaaattattaggagagatatacactccttgaatttaagaactgtctgaattttaaattttgttttgtcagttctggcttggtgaccttcctctattggccattcccatttttctgccctccactcttccttgacacatgattatttctgggaccactgttcaatccgaaacaaatctctggtggcttcttttaaacccagtggtctcagtctgaaggtatagtggggcaactctcggcattccattctggagtcttgacctcataaagtcacatattggcaattcgccttgataaggtcaagtgaacacacagaagcactaagatccccacatgtgttccactgcctcctccacagacaagttgtttttcaacccatctgcaggtccagaggtgaagctggaggctaccctgcagtctcagtcttttctccccaccctccagatggattccaaataagaagcctccagactaccttcacctccctggggtctcatggacatgggctggaaagtgcttgcagactttcacagacaatgctttttgcctttaggtccccttctacccaacagaatgattataataatggcttgatgtgcttacttacatcatctcatttaatcatcacagtaatccactgatgcaggttctgtgatccgcattttataaatgaggaaattgaagcctagagaaattaagaagcttaacttgggtctcacaggcttttagagatggagcccaagatttcagttcatgccatatggtttaagggcctgcactcttaaccatcgtggaataccattcattatcataatgttaaggatctgtttctactttgcaggaatcttttaaatctatggttcacaatcatgggtgggcttcagaatcgtccaaaaatgtttcaaccacagagacgcctgggaaccactgcacaattgctaaatcacagtgcatcatctagccaatcttggattctacaataattctatgacagtttctaagaatacatgccattatataatggcaacatattacaacagataattgaatagatattcaatgtataccgtggaatagaatattatgccactgtgttttaaaaagataattaagaggatacggcacaacgtggaaaactgcttataacataatattaaggataaacctcagctgggcatagtggctcacgcctataatcccaacacttttgggaggccaaggcaggaggattgcttgagcccaggattttgaggccagcatgggcaacatagtgagaccctgtctctataaaaaaaattttttaaagaaaaaaaacaggatttcaaattattgctaatatttgtagtgattacaaatattagcttctttttataaagcctgggtggaagcatatagatgtatctttagctttatttattcatccatgacttaaagaagattggttaacacctgactccaccttgagtagcagaacattggactgaaggaaaaaaaaaaatgtgaagctgtcttacttagctacagtttccagcatgttttctcaggagctctatgggagacagtgcagtgtggctctcaaaccttactacccataaaaatctgcttcaaaacctacttaaaatatcgattttattccatttccaaagcctggtagagtaggtaattctcccactacaatacacttagtaacactagaaaaaaaatataacattttctttaatgcatagctgagtttattagaaagtatgaaaactactggggcgccgtaagacaaaagaaaactttgggaaaacacaataggatatgggtggactttggggccacagctgccctggaaatatttgctgacctagataatcaagaagcttggtttttaacagcttcctagagacaaaagataaggccttgggcctttccaatctgaggaattgaaactgcaatcacccacttaattcaggactctctcagggctatagtttctgttgatgggtgatcctcaggcagagaggtgatgaggaagttgcctgtctcagcctagggggaatcagaagataaaatgcctctcttgagaatcaataactacaagcccaattcttacagattcagagttaagtgtatgctccctgaatagagtaggaaaccccaagtctagaaatgaatatgaagttgttccacattggggataccctcagagccttgcagaaaagcataaaaatgtatgtggctcaaagaatcatgagctcctgatcaaaaattagaaaatatgtatgcaaataagccactctgtttaagaactggcagaacaatgaaaagcagaattaaatcctcagaatcttcagataattgaattaccaattgtttgatatataaatacaaaataagtttggaatagaaaacagaccaggcagaatgaaaataaaaccaagtcgaatttttaaaattaaatgtgcgacactgaaaatgattcaacatagttaacatggataatttgaaagaaaggatgagctggcaggtacaaaagaaggagtaagaggtgtctagttgaagtcctagaaagaagtattacaactgcagatttctggctctacatttacagtttctaggtctggggtgaggtttaggtggttgtggaccacacttttaggttttaaagcattggctctgaagtcatttggttcagggctgggcatgatgttggttcctagttttgcgacttgcagtgttacttaacttggctaagcatcagcttccttatctatgaaactgaaaaaataatacctatgtcataggatatatgtgtaaatcaagttattcagtacatgccacacagtaagcacttaaaaatgacagttgcttctatttttatataaccaaatacactactacaaatattgagtggcagctttgctggttcatttatggattcatggagctacacaaaaccttcaccagtctattaatttatttttagtacagtctctctaatcagtattgcttccactgtatattgaccccatatcctttcttctgtctggggttaagataggagactgagatcagctgtgtcaaaagctttcttttagatgtaacacatgatttcttatgaaaatctcataggtaggataccagaaaggaatttattaaattcttgttaggctccttagttgtattagttttgtagggcagtgttttaatttaggatacttatgatagagagcaccccttccataatcaggagaaacacaagatggaaataaagattttattacttagtggtcctggggagcacacagcactccagggaaggccacacaccaagatcagggagcatgtggagaaagagagagaaaggaactcacgggccattgcctttactgggtccaggacattatccaaacaggtttcccacagggagttttaataggtgggtttcaagcaagcaggtatgagttccaggaggtcacagtgtgatgaagaagaagtcactgtggcatatctgcacagtccatgcgaggtgtgagcatcagtgaagaccagtcaggtaggctatatgtagctggcccatggggaggcgatcaccaggtggcaattgtataatgcagatatctagattggccacatagaggaaccgggaggaggtgtagtactggaaactgcgtcgacggtcactgagccctgctttaggtatgagaaagtccagcttatattcagaatggatgcaaaggcagcataaaattaaaagcattcactgccagctgccataacaagttaccacaaactaggtggtttaaagcaaccgaaatttattctttcacagttctggatgctagaagtccaatatcatggtcttcgcagggccgtgccccctttgaaggctctaggcaataatccttccttgcctgtttctagcttcttgtggttgctgacaattcatggcagtttgtgacttgcagctgcatcattccaatttctgtctccatcttcacatgaatactgtcttctctctgtgtccctgtgtccaaatctccctcttctttctcttagagacctgtcattgtgtttacggcatccataaccctatgtgacctcatcttaactaatcataattgcaacgaccccatttccagataatacaatattctgaggctctgggtagatgtgaattctgggggtacaccattcagcccactacaaacatattgtggcattgaggttataagccagtagccctacaagtataggatgatgcccatttcagcctgataatacactccgaaagagatcacatggtaacattgttgcctcagttaatcatagaaatactcaattagtatagaaataacaagaaaaatgctttgttattctcatgtgtcatttatcgagttcttactatgtatctgttattgttatccttatacacttctgcacaaaagatggttttatcccaagttttagcttagaaactgaggcttaatgagtaacttgaccaagaatggcttctctttctccatttccttcctctcatggtgttgttttatatacataaaataatatatattattctattaatatagattaatatatgtatttatatatgtacattttatatatgtataaaacttatgttgtaagttttatatacatataatatatattctgtttatatattgaatttatatatatataaaacttaacactattaagtcttaacactattaagtttcatggtgttgagttatatagttctattaattatatatatatggggggaggggtgtttctccagcctagacttccactttgaaatgtagtctccaggctcagccacttgtttgacattgccacttggatgtctggtagacttaacatattcacaactgaatttcaaatcttccccaccaatctgctctgcctcatagcttcccctttccggaatgtggttgctccatccttccagttgtacaggccccaaatcttggagttttccttgactcctctcttcttctcaaatcccacatgtaatccatcaggtagtcttattggctgtgccttcacacttttttcagaaactaattattcttcagcacctccaatgctgccaccctggtataagctaccatcctcagcatctttcttccagtggattttagcatccatgaatgattatttcctaaatcaattatcaataattgttataaatttgtgatttttctatttctatccttcctgtcacttttcctggtttttttaaaagagctttcttcattcttctttaaaaaaaattaaaattaacatcagtatgaactcgtggattcttttgttattcattgtactataagccattcctgtcattattcattttgattcttaaattgtcctattcttggccagtgggagtctttcatgctagctcctatgtctttttgatatgtccctatcttttttttcctaacactttccttatttctgaaattataagctattctaggttcaccctataccttcactaccccagtccaggcatcgtctgtctctctaagaagtcctagttccttttagcaggagaagtttttctagactctttcattaggcagagctacaaaattgattattttaaaaatctcgagttcatacactaattcataattctaattccaatccaacactgcaggcttcttccctccctcccctcatcccatacttgtatttggatttgagatatgaaatgtgtatctcatatcccatatttcttcagtaactgaaaaccctcatcatcaatgatagcagcatgcttactcattttgctcagtccaataattcacacacatttgtagaaaaatagaatagttttagaatggctataccaatatctgcaagcttactatattcggttcaaaatttctttgtagttcttttgaccaaatgtattcaacagagagcattcagtcagagtaatgtgtacaaaagttacttggattaaattttttccttctgtgtatttatgtttccattgagctatagagttaagctatttttttatttctattccattttaggggttttcccatccctgttgatttagtaattttattttttgaatatcaacatttgtcagtttcacatctttcatttatatgagattaactagaccctttagaaatcattataaagtcaggttgttctattaatttttaaaataggtgtataaaaaccaaagggatcaatcagagccttgatttaaagtacgttctgaattatttcagacacccgaatccatctaaacccagaacatttcatttgtagatttcaaagacttcttggccttcctaccttccttacatttatgtagcatgtgtttatccaaggcacaccacctgccaggcacagtgctgggctctgtgttgacacacatgaatgtgatcatctttctgtagcccccaggttacatggcaccacagccaagatacagacatgtgtgagagagtaatcagggtattactcaggatttgctggaggaatccctcttcaaaggatattctaaattggtgtgtgtgtgtgtgtgtgcgcgcgcgcgcgcatgtgtgtgtgtgtgtgtgttgaggtggactgggagaaaatataccctccttgagatcacctcctggctagatagtctctcccttctctgtttgtgatagaatgcaagtggaatttgacaggtgtacttctcaaactagaaactagagagctgctatctcagtcaccgtaagaagaacgaatcacaccaaacctacatcattgtcttctatgacaggatttctacaagggtgagatagtgagatgctggagatccctgttttggtagttcagggattcacagcatctcccatgctggtgatgtcaacctgaagagatatttctagtgataggttccagggatctttcaccgaacactttaatatattttatcattgtcctgaatacagccctataaggttcttactaaatttgcaggtgacatgaagtgatagacaacaaacaatttgaattcaaattaattttgaaagctgagacaatggacccaattcttcagcaattatatttaaaagatataaatacatgcagaaaacaaattacaagtacagagtggaagagagatgatttagcagcaacgcatgcaaagagatctaggagttttagttaataacagactcaacatgaaccagcaatgcaatgtgactacgaaacaagtaattcctcattaggctgcattaatggaaacacgatacataagaccaaggaagtggtggtctcatttgcactctgtgatgaaaggccacaccaggaatacagtgtagtactgctgggcaccacatttgtagagaaatagaaaccaacttgagtgtcttcagagcagaatggtgagagaactcaaacttcattcaaatgaggagtagttactgagcctgagaaatttatagcctggaggatttggttgtcttcaaatatatgaatggctgtgatggggaaaaaaggattaaatgtgtcctgttgtcacaagaggatgaaataaggagcggtgaatggaagccccaggcgatagaggtttcagttgctgctgacagtcagggctgtctgaggatggaatgtattgcctcaggacaaagtgagttcattgtcactgaattggttcaaaaatgaccaggaagactacagggcagggaagctaacttgtattacaataagtaatttttttcttttttatttgtatgcccttagaaagatgtttacttaacttgataaatctgtaacaagggataatcaagatttggttataggacaattacaattttctgacagatcccccaaaataatagaaattaatagcttacacactactttatccaagctgtagaatgtataacttacttcatatactttgtgtttagtcagtttatacaggctgaacaacataaagttaagacataaaagggttttttttgcaggtttaaagtactaccatttttccaaattactggctgatcctagaactttgagaaactttggtgtttccccccttcctacttttgtttacatcatagtacgtagatggtacaatattttggttaacctcagtctgacacttagattgtgttctcttttgccctattaatgtctagagtgtaaaaagaccagtaaagtagcaccaagaaatcaaagaaaatttcccagttctactcacttgtaattctcttaatttagtaggggctttccacaggaaatcacaatagaatagttgaaatgctctttatcttatgtactttccttctgaagaaagggacagttaattggctttgttcccaacatggtccaaatttttatacagggcagctgtatttactgtagtacaaaggagattctacaccgaatgatgtctctaagtattttcaataattaagaacctaattgcttctctagccagtgggtttcagtgaaagtgataaaatagattttctaagcaagaaaaatacataatgagggtggttgtatacctttaagaaaaaagaaatcagtgatattcaatcccaagtaaatttggatatcacagagtcagagatattcttaattattttaaattaaatttgagtcaaaaacaatgtgtttaaagactttaaaatcattttaaaagaatgttagaaatttacattaataatttctattttcaatgaataaatgagaaacctagaatttttgttttggacacactttgatcatatctaatgtgttctacttcctctaattatttttatgttattaggatttttaaaaaacctcttagattaaaatttctcagtgtatctttgtttgcgtgtctttttttctctctccacttatgtaattgaagcatttctgacatatcctcagaacacacagattcttatcaggacttaactacccagggcagggccctccttggatttactgaaaataaacactttgggtactcagtctcagttttaatgacaaaagttgaaatctttgcctaacatgaaggtttttctttgtctctaaattttgattttccatgctatcagaggtcccattgcaacaggtaatttgagtgttgattgtatgttttctcagtttgtaattgtggtgaaatgtatttaaaatgttcacaattttaaagttaagtttacctataaggttctttccaactcagaaattctgtgatggtaaactttttttttgtagtttgaaaatgtgatctttggatgttgtcttctgtgtcctatgcatatgactaggaatcatagaattttagagctggaaaatgagtgagacattatctagtgattctgcaaatgaagaattaaaaggcccaaagaggttaggtgactcacgcagtatcatagcagtacctggtgactagaactctggccacctactgcagcactaaaaattaacccaaatgtttttatctgaaaatttgcagacttcaggctaggcctgtaaataaataaataagaagttaaaacatatttgagaaaggtaagcttaatatgccacatttgggaaaagatgtgcctgacacaaatgtatttggtgtaatagagaacattcttccattataccgaaatgaaaattttgaacattctcaaaattcttgaattttgagacatttatgttaagcacagtttattcagactctctataaactgtgctgtcatccctgttgttttctccaagcggaatcatacttaaattacaactttagggagtttaatgtttcctatttttgcactcctgggatatttttcagtgactcagaagcataaactgacactgtgaagttaaggctgtgttccagtgggaatgacagcatgtctctaggacgctgatggagaaagccctcctcatgcagctgtcttgcggagtctccctgctggtggtgaatgtgagatcacacagggccagcagccagggcagtacatctctgagtctcgcttctggttttacctagagccaacccttggtgattgtttgcctccttggccaagcccccacacaataggaaaactgtgtctcaaggtcgaattctattaatacctgagaggtgaatttataaacatttaagatgttttagcatctctgcagccagtgtctctgtaaatgaaaattgcttctcgaagtagaaaagcataagggagtacaagggcttcaaaaaaaaatccttttaggaataagaatattgccagggttaggtgttcctaactggtttcaagcagaggagttagtaaaattccaaaagttaatcagcttcatgtactcaacttttgctaggactttgcagaaactcctcagggatccctcagagttagattagggagatgaaccctgccaaaggacagtaaccattcaacagctggatagcctgttgggccccactgtcctcagcctttcctaatgttgcctgggaacaccacttttctgctccctcctttttcagtgtagcctggagacaattatttatttattcactagctcttttaacaaatattgattaagtaggtactggttctgttctaggggttggaaaaacagagaaaattaaatagtgcctttgtcctcaggaaacaatccatttaatagagagacgaagatatgcccttaaatacctgaatcaccagcataaccagcacctgcggctgccatgtgggaattgttgaacaagataatttttgaatgaaagagtaaatgacctaattgctctaatgtaaagataaatttctaagagtcggctagttgggatgattatagaaggattcaagggagagatgtatgaaagcatagatctaacgagagaaaacagcacagcagaaaaagcagcaaaggctcaaaagtagaaatctctgagatcgaatggagaatagtaaataatttgctggaatgaagagcacgtggaaggcaagggtggtaagaaggctggagatagtagataaggccaaatcatgcaaggatttaaactgtatgtttttagaaaatgggtaagctatagaaattttatataggaatgagaaattatcagcagcattgtgctttaggactacaaatctggtagcaatctgctaactgatattggaagggaaaggcccagagacactagttggaagaattgcagtgattcttcatgagctaaactaagagttcaagctaagatagataaactaaggaatgagaatggaagaaagggacaaactgagatttttggggtggtactcagctgaagtttggcaactggttaaacataaaagacaagagacagagaggaatccaagatgaaaagacgattttgctgcacttttttagaaggcagcatttgtatttccatttccaggaggtggagtagctttgagaagaaaggtgattagttcagttttgggcacattgagctgtaacggtattatggacaggaagataccctacaaacagctggaaattttgcacatgcttaaaaagaagatgagaacatgagatttcaatttagccatcatctgcatggagtagacaattcaatccaggagacttgataagaatgtcaagggagtgatcacgataaaggtgagaaatggactgagcatcgatctctgctgaaacatctctttgagcaggaagaagagtgccttagcaaaagcagccagtgaaatggggagttgggggagactttcaaggagggaatggtaacatatcccattcccaaagaggtcaagtagggttgaggaataataaatggctagtgggtttggaaacatggaatctgtcatgacctttacacactttttcatttgatggatcgggggattacttacatttgcaaagggcctcagattaagtggtaatggttcagcattagtaattagagattttcttatgtactttgtagggagaaatagaatggcattcaaacaggtttaagttcctcttaagaacctttctcattggattgtagagaagagcaaatgaaagaatcgttcagtatttcttggtatcatgcccagcccataggtttcaattaatgttaacctttacagttgtcatcatcattatccagaaggggcttttttttagaataaggaagaaaagcagtgctcatctgtagacaagggaaaaaatcctttggaagagagaaagagaagggtaattcaagaagatcaggaataaacattaagggtaaaaacagaatggttagccctggaaaagggaacaaacatgtttctctgaattaggagaggatatgtgaagtaacagggatgttttgagcctcagtaacagtaaggagaagagagagtgaaggaacttgcacgcagtgacttctaccttctcattaaagtcaagagagaatctcaactgcagatatctgcttaaggtaggaagagagaaataagaattgctgtcatttattttgtggttttgatatagcaaaaactgtactagacactttacctcctttaatcctcagaaaacttagagattatatatttgtattcacattctacaaatgagaaagcaagtaaaaaagttaagtaactctcccagagtcccccagatggtcatgggagcccagattcagagccagctatgtcttactccaaagcctgtgctctttattgaaacatactccactagtttgagatcttggaggtgtacccctgcactactatcaggactacccctgataaagtcctgtggggtagttgttcctatccatcaccacagtgaatatcaaagaagggccctctcatttgaggaataacagacagtgaaattgagatggaccagaaatgcaaatcctggatccctgagggaaacaacaaaatgaagcatagaggaaatatctgagtctggtgccaagactcatcagtacaagagagaatgcctaatgggcaatagcagttagggtgggaaaagagaagtacaagggggtgtcttggaatttgagggaagaactgctgccttagttttcgaaggatgattattcgagagttgccctcccttcactttctcacagctggcagaattcctacctcttagtggttagattcctttttaccagatactgtagggccagtgcagcaaccagagcccccagccagaaaccctgcctccaatttagaccagtgttctgctctggtgtgtaataatcatattctaatttaaatagcctattgagatgctacattgatatctagccttttttttttttttttttacttttaagttttatgtgcaggatgtgcaggtttgttacataggtagacgtgtcatgggggtttgttgtactgattatttcatcactcaggtattaagcctaatatctgttagttctttttcctggtcctgtctgtcctcccaccctccaccctttgataggccccagtgtgtgttgtttccctctatgtggcaatgtgttctcatcatttagctcccacttataagtgagaatatgcagtatctgtaataatgggttttctgttctcgtgttagtttgctaaggataatgacctccagctccatccatgtccctgcaaaggacatgatcttgttctttttcatttctgcatagtattcaattggccattttttaaaagacaaaataacaaaaaaaagagtacagttatctccactcctcacccactacctgccacctaacccaaccctttatattttagtaattgccttccataaataacattttatcctgtcttaattatgcattcattagtgtattaattattgaatgcccacaatatgacaagcattatttcaagcactgaggatacagcagagaataaatcaatatcctcactgtttttattccatttttttaagagacagggtctcaccctgttgcccaggctggagtgcagtggtgcgatcatagcccaatgccaccttgaacttctgggctcaaaggacactcctacctcagtctcccaagtagccggaactacaggtgcacactaccacacccagcttccccactctgagcctccatcctaatggagaagagaggcagtaatcaaaatacatgaaatgtgtagttattagatggttattaatgtatagagaaaaattaagcagagaaaggagcaagggattagggggtcaaagttttggtaggggtagagtggtcagtgaaggccaccttgagagatggcaattatgtaaagcctgaaagcaggtaagaaatatacaggtatacagatgtccctggaaagagtgttctaggcagaagaaatagaaagtgcaaaagctaagattgctcacctggcaagttcaagaacagtgagaaactgatgtggctgcataggagtaagaagaaaaaggacggagaggacatgagatggtcagatagcctagggccttgtaagccattataacgattttgtcttttaatatagagaaatattaaaggtttttgttttaactttttaacatagaaaaatgtaatcatatacaaacacagaatagtataatgagcccccttgcactaatcactcagctttaacagctttcactttgggaggattttgagtgaaggagtgataagacatggcatggcatgacatggcttgaacaggatcactcaggaaaataagccatggggagacaggacaagcagaggaaacacaggagcaaaagcttaggagacagatgatggtggctggaaaccaagggagtagcagtgaaggtggtgagaagtgatcagatagaggatatttttttgaagatttgaattaatattatatatattatactttaaagaagaatttgaaaatgcatgtagtgtagtaaagatggtaagaaatacagaaaagaggccaggcacagtggctcatgccagtaatcctagcactttaggaggcttaggtgggaagctcccttgaggccatgagttcaaggccagcccgggcaacatagtgagactctgtctatatggaaaaaaaaattaaccaggtgtggtggcatgcacctgtagtcctagctacctaggaggctgaggcaggaagattgcctgagccaggaggttgagtcttcagtgagccatgatcataccactgtactccagcctgaatggcagagcaagaccctgtccctttaaaaaaaaaaaaaaagaaagaaagaaaaagaaatataagaaatggcactagaatatcagtattatatacattattttctgtttaaaaatccacacaactggcaaaaaaaagtgacatacatgaacatttataagacagtgcatttataaattacaaactctctgctcctcccatattattttgcagtgatgaatgattaggccatccaaacgtaaagatttatttgtaatttgctaatgatggaatgacaccttttgaggtacaagttcccagcaattcttggaattagcaatagtgtgttacttctttctcgaaagaagcatgatttgtaagcagctatatctgatgtagtaaaactgaaagttaaaataaaaaaggaaaccgtgggtcaaagtatgagggaaaagataaaactttcagagcaaagttatacatagagattttattcatcgtctctgtgtaactcacgagaacttcttagcttatttattatgtcaaatggcagtttgctcttctaatcccagcctgatatcatgagccatatatgctgttggtcattcaaaaagggcactaaacaaggtgaaagaatgtcagtgaatcaatgcaactccatgagtactaccaggaaaagaaaaacaaaaaaacatgccattaatagtgggtcaaagaggatttttttcatgccatcccctaccttactgagaataccacatttatattcagaagactcataatgaattccagagtcctctgtgtcttggctgtatgactttgggttatgtcactttgttaatctgtttgaacttctgttttcttatctacaaaataggggtaatagagtcaactctgcctccctcacagggactttcggaggcccaagggtctttacaaataatagagaaggaaagaaactggcactttaatagtacctaccatgtaccagggactgcgtagtccccacggcagccctctgaagtcatgtgattggcccattgtgtagatgtagagcttaagactcagagaggttatttaatctgtgtaaggccacagagctaggagggggaaaagctgggattggatcactgactagatcaacttgaaatctcctgcctgacagagaaagaagagactaactttactaagcatctttttatgccagaaactgtgttggacataattctgtactatcttatttggtaaaggtcattctgtccttcctggttgccctggttgctcaacaagtaataaacaataaagcctgactgtttttcatccctgagagaagaaatattattaaaatagcgttattctctttctttctttccttttttttttttttgtgtgtgtgtgtgtgtgcgcctgataatctgacttgcaacctcacagaaaagaatgaatgcatggtttcatgtctgtggcatgactctgtgaaggagccttgcaaggggacagatacacctctaccacttcttatagccattcctgagacctctcttctcacaacacataccagcaaagccaaacaaacaaggtgtttaggaataactgtcatctatcaacactctctaggcaaagtagaactatgaaacactgaggagactgcacacacacagaagaaaaaatgatcatgtcacatggtagcacagagcaatgggaaatgtgaatagtttgttgaggtggacagacccaagctcaaggattgcctgatcgctccatttataggaaccatggcaacctaccttatcttactgagcctcagttcctccagctgtgaaatggggtacaacctctgaccccacagggctgttgtggggattatctgagttagcatgttccataaaacacagtaagttagaaagtatagctgtataggctctgggagtttaacaagcaagagaaatttgacagtaatcatttagttactgaaccctgtcttcatattgcgctaggttgcatatggttttcctgcctgtcccttccaatcacatttcagaaaaaaggaggcagtagtggagccttgtgggctaaagtggtgaggagggtgtcatggaagattcaggttcaggtcttcctcttgaagaatgggtgcttctcaatagggaagtggaggaacaacctgggagttgtcagcttgaagaaaatcctgagacgtgataatgggtaggtccaaggaggtcctgagtaggactctgagcacagagcctttctttgcatgtgctgtttttcctgccagcaagaccctctaaaccctttggcctcacccacccccttgcctggttatactcctagccttctttcagatctccaccctcagtactccctcaggaagctttccctgacctcctgacccagtcaagtgcttcttatatatctcctttgtaagctcttctcagttacacttttacatttatttgtgagattatttgattagtgtcagtcccactctttaattctccacaagaacagagattgtgtctgttctgcattcaccatgcatcgcttcatcccctagtttactgcagtgtgtggaacataggacgggctttaaatactcgctgaataaatagagaaatgttggttattagtgaggtattacctaggtgggagagaggatttatatttgggattgctaatcccattaagtgccaagcactgcattaactcatttaatcctaaaaaaaagtcctatgaaatcaagtgtattattccttttaactttaaagacagagaaactgaaatccagagatgttaaccatctttccccgttgacacagctaagtggtaacagtcggtcttgagccgggcagcctggcttcagacttcctagactttaccacattgttctgctgcttagtgcagtagaggacaaagtgaggtgcacacgtgaagtcaggacagatttccgtttgaaaattgtgtattttcccctcctcttcttcattaccattgtcatcatcatcatcatcaatcacttcacaagcaaagctaagcagaaaagaactacttcatgtatcacctcttacattcatgttaactctacattctgccaaagtgatttggctgaatttacccaaagagcaaagtggacatttcaaatcctgattcctagaaaattatagactacatcctgtaaccacctttgaagaaccagcatgtactttaccccaacgtgacaaaattgttttaaataaaaagaggtaatttgactaagattggtatgatctgagacccatggtttctacatcttattcaaaaagcagatccagcatgtggtcatcagtaggtattgagtcataaagctcctggaagaaaatcttaagtttcatcaagaatgccaagaagtcctgggtgtctccaagaatgatagctgttactataataacataattactactggaaaattagcaaagcccaataaaatatggcatgcaaaaaaatatttaccctggaaatagaagtgacctaaatcagtcgtttattccagccacctgcttttagatagtacttaaaaaaaaaactttcaggatggtcatattgtttaaagttctctaggtggaagagtactttacagtaataaattaataaataagacaagttaatgcttttaaactactattatttgttgagcattgttgtaaaggctttacatgcattaatgtatttagtcctcacaacaaccctttgagatactattatcatcatctcccttttacagatggggaaactgagcagtgcccaaagtcacacaaccaggaaatggggaactatcttcaagcccagctggtttgcgcctaaagtccatgctcttacagtgtccctgggtagctgagtactcagttttgtcacctttgtctccttgactttaactgaaagcttaactctttttttttttttttttttttaaacggagtcttgctctgtcacccaggctggaggggcagtgtcttgatcttggctcactgcaacctccacctcctgggttcaagtgattctcctgccgcctgccgaatagctgggattacaggtgcacaccaccatgcccggctaatattttgtatttttagtaaagacagggcttcaccatgttggccaggctggtctcaaactcctgacctcaggtgatctacccgtctcggcctcccaaagtgctgggattacaggcatgagccaccacgcccggcccgaaagcttaactcttaataagagcctgcaatgttcagacgctttgaaaaaaacctaacagacacagttgctctctataaacttaattttcaaaggaaccactattcaaagaagtaaaagggagactgaataaaaagaactaagttctccgtagagcaaatgaatttctgaatcgattgcaaacagttctccgtcatcatgacatcctatgaagtatggtctcccccatgttagagtgccagtgtcttcatgtaccatataacttgcaaatagtatcactgtcttctcacacttcagctttcttctttcatcagtattttggaaagtccacaaaacccagggggctccctgtctgttgccctgtggtctctgtgaaaaccagatgatgcgatgctgacttggactctttcaaatggatccaacagcacatgagtcactggcagcatgttcagctcctttacctcaggaattacccagttcctcattcttgccacccttcagccgtgaagtagtaatatgaaaaatacatgagtactttttgaggatacctcggacctctttccttcagtaccagagactaattgcctcataatggtaacattgaagagcccagttatctgacgtgattgggctttaattatggattccttctggtgtcctattaaattggaaagcctagctgatttcacccaaatgaagcattacctcatgccttgctctcttgcattcctgtgctggtgtcacttaaaagtgtaattacatggtttatttcgtgttctttcactcttgatttattgctgaagaagcccctgtgggatatatcatcataacaaagactgatttcagatgtcaacaccaagaaacacaactggcatcagcaatctatagagagtatctagggacagcagtcagctttggagaaaacccagaacttctcattccccatcccacatttaagggcaaagactttctccttgttaaagggaaagcactgagttcataattagctttatacccagagttttttttttttaaatgttatacctgtttaagaaattttttgtgctttgaggtggtcaagatcaaatttaattagcaaccctcttcgtgattggcttgctctggggaccctgctctttgagaaggaggttagaaggtttagaagcaaacctttgcagcagttctagccaagtgcatgcatacaggccttgaggtggagctgcacagttgactgtaggggagtctgtcctttgttgacgagtgaaacttctctccctgcaaaccctctggggaataatgccaactctgatcagcttttcgactcttggatgaaatattgggttgggaaaaagtccctactaagaaaattgtaccaaaaccctgcttcaataaaatatgaatccatttaatgaagtttatagtagaagtaggctagtcgaaaaggattctgtctctttccaagtattattggcaggtttagggtcttcctcaagtttatatcattaggacttccatcaaagagttatctttaggtgtgattcccatcctccctccctctctccctccctccctccgtcccatcgttccttcctccctttcctccttccttttctacctttctttttctctctgtctctctttctttcaagctgtgggctgcttgtacagatttatgcattttgaattactgcatagttgagagatttggggcttaggttattcagttcttcaaaaagtacagtatgagctaaggagatagggtgaccaactaatctaggttttggctccaaaaaccctgtgtcccagaaaacccctcagtcctaggcaaaccaggatagtagttcatcttgtgaggagattatagtgcatttccaagtatttagctgaatttatcacagggctctgacttgataggatttaagagggttaaaataaggtcttttctgttatgttagtgtgactttagtcttggcactttctcaaggaaggaatccagtctactacaggggctaggtgactaaggagaagaaagaggatatctaagtgttttttgctaaaaatgtcattatctccatgctatttcctttttattgctattgtcatcattttaaagacataccaataagaaataaattactttaaatagaaaactctaattttatcaagcaacagcaaacaggggtgaaatctaaggatttgtacttaaggagtacacttttttgaattgaagaaacttactatgacctgagcatatgtaactcaattatcagaagtcagagagggctactgaaggctcaggttttctaagagatgactggaggccaagtcctcaggcttgagtgtttatagccaaacttcagaaccaggtccctggcaagattctcctgtctaatcacatggcacagagttaggatggactgtttctgcttacctgccttcttcctttgatttccatcaaccaccagtttctttctcatcaatcatttacccagcttttgtgaccaagaattttgatgaggatgcagaggaaggcatgttcttggttaataggaaaggaggcttcatgacaacacagcatcctctaagatgtgttgctccaactttcacaatacatattgtgttttaagtggcctgcttcttggagtgtatcttcccactacacaaaacaaccaccattaacattttcatttacttccaccctgtcatttgttcatcacatacttttaaaaacagggctgtaatcatgtatatacatatatgaataactttatattgtactttttatacttactggcttatcataaacatgtttccatgttgctggagagtcagatatgctaacttttggaatgtgcttcttatatagatctgcaactatgtgggaccagcaaaggttattgttcagttggtcacaaatggaaaaaatatccacctgcatgcccacagcctggtgggaaaacactgtgaggatgggatctgcactgtaactgctggacccaaggacatggtggtcgggtaagtaggggtatatgatgctgtggaaggtaggaacagatagaatatgggatgcaggaacttagaatgaacaggcccctttcattagggacctttctgagaccctcagatgacctcaaaaaactgtgtaaacttgtgctttcatttggactccaggaagtaaggtgaccacatgtctggatttgcttgagacagcccagtttgcccctgacctaattgtttatagcaccctcttctactcttaaaggtggcccaatttggatgatcacttatatgtggtcacttgacctacaaggtatttgtgccactattaattttttttctcctagaaataaaaataaggacaaatttaaagaaacataactatagcagaaatcatcactttatgtatatttttacattcttgatgatttcttcagtggatttatggtgtgaatatgtagggctttaagtgaatgcataaatatcatttcagctctctgctgcttagaaagtaatgcacagataagaagccaaggaatgcaaatttattttggcattcattaggcttgaaatgtaaataaaaaatgacgtattcatttaagggttgatcaaataaaacaagcaatttttaatgaatgaagttttatagaagtaatttcaatccaaaagaattaagcttttaaataagacatatttattgtgctaaaaaacttgtattttcatcttcctaatacactaaaatggcacacagaataatagtgtagcacacaatacaaactgatatgtgcaatcaataattctaaaaattgttgttttaagtctttctttggaagtccttaaatgcaaaagaagaaatttttaattttgtttaatttttaaaaacatttttcagggttttctaatcctggtttaaatagtttatgctgaaatcccagttaatctggcttattcactcaaaagaaaggaattgtttaaatcaactataattaagctgatggttgcatttcaggctttgaattccgatcaagtttcaaattggttattattttggaggttgtgctttcatgttcctaggtatttctttgtttgactgtgaaaatatttaagtgtgaaaaacctagagagagagctttcttttaagtcactaaaatcggattcttttgatgttagaaaaaaaaaagactctagattgaaggaagaagcttaaattgatttgaaaaattaaagtgtgctttatatgaacttgtttcaacatcctcttgaaagactggcgtgtctcctgttgtatgtcacagtttgttcatcatgtgttgtggaatacccttccagttcctgattgacctaggagagctttgaaatgcaggctaattatcacagttttagactgattgatcacttagtgtttctgcagatttattccagtagggttctgtcagtttgaagtgtttattttctttggtcttgtttaatccctattataatcatatcctttagaggaaattttagatgaagttttctactagtatttattattataaaacctccagtatggtgtctataatttggtgtttctgtggtttgctttagtaatctttcaggattttagaaagaactaatggttatttaaatttgagaccttaaagcgggaatagaagtaaattgtttctaaggaaagtgagggattctttcactcttgtagtgcagtggggtgtgggctcagtagttgggagaactcatcagtcattcactcattcaacaaacattttgagcatctcagctcctgaatttgatcattatgatgtctggttgtagagcagtgagattttctaaccctatataatttcagtgagaaatttaatcaagatgccacttgagagttacaatagactcagtagtcttaacgtttttagtgtttcctatgaaaagtcagtactcactttctaatttgatttttagctgagaaatttttgcttacaatgtttcccaaaatacactatttctttcataattcatttgtttctatctctctctatatatacatttttaagattttcaatgtcaaaacttattgcatttatgtagaaagaacatcgtgctagcattctggaaaccagtattttattcccagtactgttgctctcaacagaggactgggggcaagttacatgacttcttggggaccttaatgtcttccctcataaaatgagagagtttcactacagaatcttatcttcaggctgtttacatctccagaattctggactgaactaacattacgtaatattatgaaataacatgagcaaacttgccacacacatatttatggtatgacattgattattagtatttagttctgacttgtagataagagtatcacatagagaaacttaggaagatagccaaaattatgtcttagacttgtcaatactagaaatgaagctaagataacttgttttcaataatacagattaggcaaagagtatagattcacaagcaagacactaatccaacataccaaaaaagatatccaaaaaatggcaatgagaagacaaataacttttaaattgtcaaaaccaaaagaattactttctttggagtgtttatcttcatctttccctcagtatgaattcttaataaacttagtttctactttcaaaaggattttatctatgttataaatattcatgttttaaatagccaagtcttgattctggtttgattgctgtaatgtaggggatttgtcattttaatattttttaagttagctttaattttgtcttttttaaaattcatttatataattagcctttactgcctttcttggtaaaaaataataataataatcttagtttggtgttttattttaaaccctgaatatcaacaatttgtttcaacatattttagttcgttgacatttttattccatggaaaatatctgtgttccttgactttgctttaggccagttcacttaccagtaatcaccacactctctctgctttctggcagtttagagacatggaatttttttccaattaatacatatagcatataccaactggtaagcactaggagtagatatataaatatcaaaatacagaggagaaacaaggccttcttcagtgtctgttgttcccctttttgtccatgagttctcatcatttagctcccacttacaagtgagaacatgcagtatttgtttttctgttcctgcattagtttgctaaggacagtggcctctagctccatccatgttcctgcaaaacatatgatcttattcttttttatggctgcatagtattccatggtatatatgtaccacattttctttatttatttatgttattgatagggaatttaggttgattccatgtctttgctattgtggatactgccgcagtgaacattaacatgcatgtgtctttatggtagaatgatttatattcctttggttgtgtacccaacagtgggattgctgggtcaaatggtagttctatttttagctctttgaaaaatcaccacactgctacaaaatcaatgtgcaaaaatcacaagcattcctatacaccaataacagacaaacagagagccaaatcatgagtgaactcccattcacaattgcttcaaagagaataaaatacctaggaatccaacttacaggggatgtgaaggacctcttcaaggagaactacaaacccctgcttaatgaaataaaagaggacacaaactaatggaagaacattccatgctcatggataggaagaatcaatatcgtgaaaatggccatactgcccaaggtaatttatagattcaatgccatccccatcaagctaccaatgactttcttcacagaattggaaaaaactactttcaagttcatatggaaccaaaaaagagcctgcattgccaagacaatcctaagccaaaagaacaaagctggaggcgtcacactacctgacttcaaactatactacaaggctacagtaaccaaaacagcatggtactggtaccaaaacagagatatagaccaatggaacagaacagagccctcagaaataataccgtacatctacaactatctgatctttgacaaacctgacaaaaacaagaaatggggaaaggattcctatttaataaatggtgctgggaaaactggctagccatatgtagaaagctgaaactggatcccttccttacaccttatacaaaaattaattcaagatggattaaagacttaaatgttatatctaaaaccataaaaaccctagaagaagacctaggcaataccattcagcacatgggcatgggcaaagacttcatgactaaaacaccaaaagcaatggcaaccaaagccaaaattgacaaatgggatctaattaaactaaagagcttctccgcagcaaaagaaactaccatcagagtgaacaggcaacctacagaatgggagaaaatttttacaatgtatccatctgacaaagggctaatatccagaatctataaagaacttaaataaatttacaagaaaaaatcaaacaaccccatcaaaaagtgggcaaaggatatgaacagacacttctcaaaagaagacatttatgcagccaaaagacacatgaaaaaatgctctcattatcactggccatcagagaaatgccaatcaaaaccacaatgagataccatctcacaccagttagaatggcaatcattaaaaagtcgaaacaacaggtgctggagaggttgtggagaaataggaacacttttacactgttggtgggactgtaaactagttcagccattgtggaagacagtgtggcgattcctcaaggatctagaactagaaatgccatttgacccagccatcccattactgggtatatacccaaaggtttataaatcatgctgctataaagacacatgcacacttatgtttattgcagcattattcacaatagcaaagacttggaaccaacccaaatgtccatcagtgataaactggattaagaaaatgtggcatatatacatcatggaatactatgcagccataagaaaggatgagctcatgtcctttgtagggacgtgggtgaagctggaaaccatcattctgagcaaactatcgcaaggacagaaaaccaaacactgcatgttctcactcataggtggaaattgaacaatgagaacacttggacacagggtggggaatatcacacccctgggcctgtggtggggtggggggagggatagcattaggagatatacctaatgtaaatgctgagttactgggtgcagcacaccaacatggcacgtgtatacatatgtaacaaacctgcacattgtgcacatgtaccctagaacttaaagtataataaaaaataagcaagtttacaagggcaaaaataaaacaaaaaagaaaaagcaccacactgcttccacagtggctgaactaatttgcactcccaccagcagtatataagtgtaccctcttctccacagccgtgccagcatctgttatcttttgactttttaataaaagccattctgacaggtgtgagatcatatctcattgtgttttaatttgcgtttctctagtgagctttttccatatgtttgttggtggcatgtgtgtcttctcttgaaaagtatctaaaacagtcacttatcttttaaagaaactttttaaatcagaaaaaaggtgtttatatttaaccacgtatttatcatttgcagtgctgttcattctgtttcttaggtcaaaatttctatctggtatcattttcttctgcctcaggcacttccttttattatactgctgatctgatgctgattaattctttcagtaggtgtatgttttcatagctttttattttatctttgtttttcaaagatattttgaagagtatagaattttaggtagacaggccgggcgcagtggctcacgcctgaaatcccagcactttggaaggtcgaggcgggcaggtcacctgaggtcaggagttcaagaccaacctgaccaacatggagaaaccccgtctctactaaaaatacaaaattagccaggcatggtggtgcatgcctgtaatcccagctactcgagaggccgaggcaggagaatcacttgaacctgggaggcagaggttgcggtgagccgagatcgcacaattgcactccggcctgcgcaacaagaaagaaactccgtctcaaaaaaaaagaattataggttgacagtattattctttcacatccttaaactatgttgttccactgtcttctgatttgccttgtttccaagaagtcacctgtcaatctaatctttgttcctctgtatataatttttttttctctctagcagcttttcagattttctcttcctcactcgttttaagcaatttgattatatggatattagcatagtttccttcatgttgcttgtgcttggggttcatcgagatccttagatctctgggtttatatatttagtacgttttaaaactttttggccattattttttcaaatatattttctgtccactcctcttcatcttcttctggaaccccagttgcacatatatttggctatgtgaaatttcctacagctcactgatgacctgttttttaaaaaatcttttttttctctttcattttggaaagttttattactgtgtctgcacgttcaccaatatttttgtctgtagtgtctaatatgttcttaattccatctagtgtattttttcctcttagacattgtaatttgcaatttctatagatttgtttggggtctttttttttcatatctgccatgttactccttaacataccaatgctttcttctttttctgatcatatggaatatataatagctattcaatgtacttgtgtacaaattctgtcttctggatctatttttgtttagtttttgtcctaattatgaattatatttttctatttctttccatgcctgttagttttttattggatgacaggtattttgaattttgtatcgttaagtcttggattccttttttttttttttttttttgatgtgcttttaaatacgtttgaggattgggatgaagttaaatttgggaacagtttgatttttttgattctttctaaacttacttttaagctttatcagagagaccagagaaacctttactctagggttaatttgacatcattgctaaggcagtacctttctgaattttcaacctgatgctccatgtattacaagatttcttgaactattccagccccatatgtgttacaataatttttctgcctccacctctgtggtggttcttttcccagctttgacatatttcctcacacacagcactcagctgaagactccagtgatctctgagtgtatctctgtttgcggtttcttcctttccggtactctgcttgtgagttttagcctccttggcttcctccaatatttaactgtgtctcctcaacctcagagattgccaggctctgttggggttcctccttcctgtgctgcagcctgggactctttaggcattaagccagagtaattacagggttcaccttatttatttcccttttcttaaagattactgttctgtgctgcctgttttctagtgtctaaaaaccatttcttcatgtattttagatatttaaggttcaaaccagtctgttttactctatcgttacctgaagcagaagactgacttctgtactgtttcatttgttaaccagagtaaatccttcattattcacataataaattaataaggatgatgtttttctcacagggactagattaggcaatatacatgaaaagcatattattgacagtaaagtgtaagatgctacacagatgtttatcattgctattacaaaggagataaccccgttttcctgcagttagggaagttctatatgggagtaaggctgaaagggccaaaagatataggtattgtttctgaaaaactgcctatgcttctatgcatataagtatgtcatgttgcatatttttctgtgctgtattaattcatgcattcctttatcaacagatacttattaaacactcatatgtcaggcattgttctagggactagagatctctgccttcaaggagcttattttctagtggtatattttctgttctgtgtcttagctatccacttttttcatctgcctggacacgtgacttattctgtctctgggcctctggtatgagtgctcatttcattctgccttataactcctattttcttccctactttatctgaccttcctaccttagcttgttcattctttccttcaatccagttgtcatgaaatctctttctttcctctactaattttttttttctttctttctttctgagtaaaagccagagatctggccccctgcttacctctctgaattctttacttacttctgacaacttgctcatttcactccagctacattgacctccttgcctttgttgtgttttgaaaacaccggcgtggtcctaccgcaggaattttgtacttactgttccttttgccacattcatcattcatatgttcatgtcttccccatcgcttccttcaagtttttgctcagttgtcatctttttactgagtgtccttcctgacctctccctactttaaaatgttatgcttttttctactacctctcctgttcctcattcctaccttatttttctggataacacttattgccttctaaattgtatcgtataatttacttctttgtttcttctccgttgtcacactagcatataaattcagtgaaggtagagattcttttactgctgacaaaagcatctaggacatttcctggcactgataaggatctgcataaatatttgttgagtgaatgaatctccttggtaaagtccttttttgtttgcctgttatatttattgaatagacttctttgtttcatgtactttaatttcaaaagtgaatggctggaacattttatatattttcttataaatcattttcattgctttttaagcttatcacatattttgttttataaatatgtagccttcgtgagataaaagattctccatccctgtttacgtgtatacttagatgacaactctaatggtcataaataattccaaccttatagataactcaggagaagatgagattataagtagactttaaatcccattcagaaacccaaggacaattcaaaaggaaaataatcattccaaatataatattcttcttattcttaagaagttgttagtattttgaattttgaatttttaatacagctcccatagaaaatactttaaaatgaacccggtaagacttcctcattaagacatatagacacatatgctcccactcccgtaatcaaatttggaagtcaaataagctctgaaaaccaaaacattcttccaagtttattgcagactcatttggtagtaaaaaccaatctgacctgatgtgtagctgtttatagtctttatttttccatttggtgagtccaattatatatttcgctgaggaaatactaacatgtttgactacattgtgtgccccagacctgcttagagtattatgtaatatgcagtataggccatatattgcctttttaacatcaaaaataccctaaattctgaaatgcatgtagccccaagagatttgtataaagcattgagggcctgtgtatttttttttaatttacaagtgaagccagattccctagacattaagtgcctaacttttggttgttgttgctgctgctgttactgttttttctccagcttcgcaaacctgggtatacttcatgtgacaaagaaaaaagtatttgaaacactggaagcacgaatgacagaggcgtgtataaggggctataatcctggactcttggtgcaccctgaccttgcctatttgcaagcagaaggtggaggggaccggcagctgggaggtaagcatcattttcctggccttgatcctccaaggggtccaggctttggttttcatctgtatgaattatatgttcatctgcatcccttccagtctctaccccacactgctgtcaccttttccttgctcagaaacctttgatggcatcctgctacttctaggataaaaactatagctccatagcctgtcatacaaagccctgcttctctggccccagcaactttcagcctcatctccagcccaccttgcatcctcctctcgccatctctgctctctgaataactgaggcatatttatacctttgtatgtgtcttcctttaccaaaaacaccccaccgtttccatttcaccctctcgaaaaccaatgcagaaatcaagactttgtctaaagaacacctctgttttaccttccccaactcaccttattataaggcatttttctttctttgggctctgcagacacattataaactattatctttatcataaaaattgtatgattttccattttcttgccttttctcaaatttttttttcaaccccattccctgtcccaccacatgccccatttctacttttgtattttgtcctttactctggccgtccagtcgtcatctgatactcatgtgattcaaaaccgattatcagttttccactaaatatactccatcttctgatacccagactcaaaaccttcccatcctcactgactccccctcctcgcctgtgctgcgaggctgtggtccagccattccgtgctctctggcattccacactacattccattttcattgttccacttatagtagtcttctccctggtctctgtccctccccacttctaatcaagtttacatcttgtagccagatagatattactgaagttctgtatcttgttgctgctccgtgtctccgttttgcctacaaaatccaaattctgtaagttggctttttggatctcccaagagctggcctcaggctgcatttccaatctatttcccgttttgccccttcaggtcaaagtctactacttggtaggagcaccatgatttctcactttcctgccttggcacattctttctatttttgctctctcctcttcctggaatgcctttatccactctcttatatgaatgtgttcaaattctgccaccttttcaatattcagagcaaatacctcttctgctccaaagccctctgaactctctccttctttgaaatcccacatcacttcatttgtagctctcttgtagtacttgtctcttgaatcactaccttttatgatattatagcttaattatgactatatccatcagcgtgaaaactccagcaggagggaaggaaacagatgtccctgagtcattcagttccttcagaagttgtttttgagtacctactatgtgccaggctgtctgcttggcactgtggaatgagctcactccctgtgcccaagcagctcttggaataatttgcacacttctcaatacagctggtgcctagtagggttattcaattccattccatcacatcctgtgtgcctttaactcttactgtagagaggaaagggaaaggtgggggaaggacaggagaggagggaggcgatctgatacacggaagagagtttttactgtaatccggagaaaatgcaggtcttctttgatgcctttcatattggatgacataaatgagactgtttttaacactttattagcaatatgaagagtttcaaaagaggaaaaatgggtttttattgtaagtttacattatttgggctttataaaagcatggtcttttaaatgttcacacttccctgggcatgaatggactgtgctgtatggccctagatcgggaaaaagagctaatccgccaagcagctctgcagcagaccaaggagatggacctcagcgtggtgcggctcatgtttacagcttttcttccggatagcactggcagcttcacaaggcgcctggaacccgtggtatcagacgccatctatgacagtagtgagtacttcacttccaacagggggcacaccaagaatagacttccagccctgccctgccatttacttgctagctgagtcctggggaaggtaacttaatcactttaagcctcagctttatcatctgtaaaatgtgaataggaaaatctagcttgaaaggttgatgtccaggttaaatgaggtattttaagaggggctcaatacatgtaattctttttcctttgatgtacattttttagtcttttacatgaaatgtcacatctcatcttatttatgaatgtcttgctataaagatatatggttgatacttttagaagggagaataatcccaattttctttggtggtggggggactctggaaaggagtttataaaagacaactattattcttacccattttctttcccatatgttactagctttatcaagagagaaacttgaagttaaatgaatgagtagcatagacagcatgtgacttcaaaatcctatttcaagccgggtttggcgtcatgccctgtagtctcacctacttgggaggctgaggtgggaggatatggagtttcagcccagcatgagcaacataatgagaccctatctcaaaaaaaaaaaatatatatatatatatgtatatatatattaatttatagttcctaggactttttaagagttttacagtaaccttcagcatttaccatgcaactttcttgtttgattatgcataggattgattagacaggtattttcaaaaagcctgcaagcatagtactcagactcattgaaagtttatagaatttggcctgtgtggaaaactctgtgctccaagtacaacaactaactgaattctctaatttaaacaagtttgaagggaagtgaaaggttataaaatgatacagactcataccgcagaatcaccttaaaatgcagctgttggagaaaaaaaaaaaggaagctttatgctattaccacaagaaagttttgcctcttcaccacacagaatcctaatttagtttgggaaaaagaaacataacatccccattttccttacctgtaaaataaaaggtagtaagtagtttaagaaaactgtacttttcctaaagtttttaggactcttgtaaatagaataatagcagaatcatggaaacaaatttggaattgaagtcttgacctcattgaaagcccagaaatcaattagcttggtacttcccaatacatcagaaaagctctttctctttttgtgtcagtctctctgtgttagagggagaaacaaatacctgttcctttctacctcatttgttttggtgatcataaatgacccatgcccaagaagtgttccgagaatttcagaagccattcttgttttatttactttgttagtgaaagcatgtatttaagctttgttttggtcatgtgtgctaaggggagggtcctacctaaaggactggcttgttgagctgaggattaatcatgttatttgttgtttttcccctgtgaacagaagcccccaatgcatccaacttgaaaattgtaagaatggacaggacagctggatgtgtgactggaggggaggaaatttatcttctttgtgacaaagttcagaaaggtaaatacattctgtgatctctgatctcaagaggtgtgatcttgacacactacagttctgagtgtgtctgtgagtcacatttcagcagtggacaagaaacatccctctgctgccacagaaagtcttaaaaagcatttacgttttacctcttccaaatgtaaattgtctgtgttattttttcctaagtcaactaaatcacttttagatttcccatggaagtaaaaagaaataagaaaaccgtgataattataatcagtgactttcagtatctttatacattaaaattaatatctgtactttgttaaacaaaaataaataatagcccattcttgacacacatacaaacacacacacagaataatgttttacatagtattaaattgtttttatttcttttgcaatgctttgatataacactgagagaacttctctgaacacttccacagatgtgatgtttaagaaaaggaaagaaaacagggaatacagggaaattctcagagcacatttctctcacaattttccctttgaggaaaggttcttggcgtttatctttcattagatatattacaacattgatagattagtaaaagctgaggaaaatgtgttattttctcaaactgcattctttttttaaataaaatgatagttggaaagtgtagtataatatctatttactacagggtgagcattttcaaagtaagcagatacctaactgaaaatataaataagtaaaataaatcaataaaagacatgtggcttttaaaaaaattatcatatgagattaaattctctgaggtatatagtcagaaaaaaatgggatcagattttaaagtaaacacatatatactttatccaaaaaaatttacaggccaggcatggtaactcatgcctgtaatcccagcactttgggaggctgaggtgggaggattgcttgaacccaggagtttgaggctgtagtgagctattatcatgctgctgtactccagcctagatgacagagcgagaccctgtctcaaaaaaaagaagtttacactttctctgcctacactagtgtcagccttcttccaatccactctgtccaagtaatactcatttccagattcctgggtgtacatactgtgagtaaacacaatctgagtacctttatttgtaaatgagatccttagtcattatcattacattggaatggcttagtaagaaatgtcttgtacttggcttaaagaatctcaataactaggtccagtgtagtcctacctgaaggcaaaggagattgtaagatgttttatccattcctagtatttctaaaattctacttacatagagataaaaactttgaacaaagtcaatagtgtggccctttctatgaaacggaaagtgaagccaggaagatgccaacctaagttacattgtcacatttctgtagaagtgaatagagtatttataaacatgctgaacatggagtatttataaacacactccatgactagagtgtgcaatttaagcattgcattttaattagaagggacctgattattatagtattttgaccaattactcaatatgaactaagagactattatagtgagacagtttaatagtgtgttaagagcctggactctgaaattatactgtctatgttaaaatcctggttcctccaagtactagctgttcagccttggataagtacttaacctctttggaccccagtttctcttttgcaaagtgaggataataatagtacccatctacatcacaaggttgtggtgaggatgaaatcagttaatatgtgtatatatgaagcacttagaatagcatctgccatacattaatagtaaaacttatataagttaattatttttatgtacatctatatattgaattgcactgcctcgttggattctaatattcttccaccatcgttcgtgtttctcaggattggcttaaggatggagaagcagtaaggtcaaagattaaaagaaaattcaagttaactaggtaaatctagtattctgtcattgtgaatgaaagttggggcgcattactgtggtaaataatgaaaaaagtcagtgatttgtgaagattttaaaagactgaaccttttgatcttgttttttaaaagtgtaaatagatagtaggtagaatattaaaccagttttatttttcagcatgtttataaatactatttacactatgtgaaattacacacttcaatgtgattgtttgcagatgacatccagattcgattttatgaagaggaagaaaatggtggagtctgggaaggatttggagatttttcccccacagatgttcatagacaagtaagtgatttattattattattaatccttattatttttagagatgggatctcactctgacacccaggctgcagtgcagtggtacaatcacagctcactgtatcccccaactgttgggcttgagggatcctcctgtctcaacctaccaaatatctgggactacaggcatgctaccatgcccagctagtttcttcagttttattttttttgtagagatgatgtcttgccatcttgctcaggctcgtcttgaactcctggacttaagcgattatcccacattggcctcccaaaatgctgggattataggcatgatccatattactatcatcattttatactttctgccttattgaaatttagtacttagcttccatctataaaaaagaaaaatcataaatatttaacttccataaaacagtactatttttaagactcatgcaggtcatccaaaaaagttacctactgtagagttatgggcaaggttctgttagatcgtttgctctgagatgttggcaagatatttaattgctgcctaatcccctaacccataagacagtgccccacaggtcctttaatgaaaatgtttttaagtgttctaccaaagtaattatgatgagacctattttatgatagcacctaattatgataacaccttaaaagggtgttctaggagtcatcttctaattgaagctgatgtcatcctgttaaatgaagatttcccaatggcaactgattaaatgatcagtttaatcatttaataacatgataatgctgagcccccaccttaattattattctcctatttacaagtaattgaagagtattctcctatttacaagtaattatctggattggaaacaatccagatattcatcagtaagtggccagttaaattatggtctgtccttttgatgaaatatcatgtagttattcaaaagaatgagtactctgcgaactaatatagaaagatctcagttatacagtgttaaaatattttaaaagatgggtgtagaacaaagtgtgtgtagaaatgattctatgttcatgcataaagaaattctggaaggatacctaagaaattaataacagtatttaccactggctggtacactgtaggaactgcatggatggggaacaagaatgtcaaagagaataccactgtatgcttttttatattttataagatctttatccctgtgaatatattacatagtcaaaaaatcaaactgaaaaatgcttaaatccctaacataccaccaagaactaatgtgttatgatgccaatgtaagcaatgtttagtttcttctcttcatcactggcctgtagccatctctctctttccatacccagtctttctgatgttgctctaaataatcttggaggcttttaaggctgctttggaagagaagaaagtatatgcagtgaattttataagcatgatatttacaactagaagacatttgaaatagacaaatgaaataataaagcttcgtagtacattagcatagcattgtattttgattttacagtagcaatttcataaaaatgtatcggtatagaattctgagtttggaactttctccaggacacggtgttttttagtacactgtgtctaaacattgggtataaagaaaagcataaggaatgtgtttaatgagtagcattactgcaaaaaaaaaaaaaatgtagtcctacaccaacatgtggttcttcgtatcctgcagtttgccattgtcttcaaaactccaaagtataaagatattaatattacaaaaccagcctctgtgtttgtccagcttcggaggaaatctgacttggaaactagtgaaccaaaacctttcctctactatcctgaaatcaaaggtaagtcagttgtttaaaatcttatgctcatattttattttattttatttttggtttttgttttgttttgttttgttttgagacagagtctgactctgttgcccaggctggagtgcaatggtgcaatcatagctcactgcaacttcgaactcctggcctcaaacagttctcctgccccagcatctcaaatagctgggactacaggtgtgcgccaccatgccgggctaatttttttttttttttacttttaatagaaatgaggacttcctacattgtccaggctggccttaaactcctggccttaagcagtcctccggccttggcctcccaaagtgctgggattacaggcttgagctgccatgtcttgccattgtgcttgttctgagaagaggacaagctaattagaaaagatcagttagtcacctcctttgaacagctttctagtaacaggtccctggatccatggtgcttatttttagaagagacagtagtatattattttgaggtcatggaattagtctagctttttaaaataatgttatttccaccaagcttatatgagatttagacattgagaatttgtctttgaatttgagaatctaacatttattgactaactcagagttcaagcagctgagatgaaaaaatcaggcttgctgtttaggagaatcagccagttagtcaaccagcctcaggcggtggaacagaaaacttggccaacatgcactgtgaaactatgaaaatgagtaaggcatcattctttctctcacaaaagatgctttaagaaagggcactcataggtttcttaaatagttataatgtaaattatgattttaataagtaccgaaagtgaagcatccataaaaatataagagaatgttgaagagagagcccttggtccctttattctaaagcagcctccaaaaagaaggcttcgtcaaggagatatcatttggccctcagcatttggggtatatttcagcagttgggtgttaaacagagaaggagagggttctctaggtttaagttacttgaggagcttaaagagagaggtaaacacagcgtttatgcagagggaaaaaagtgttctgagcgctcggatggacatgaaggccaatgtgggtaaggaaggccagggccaggctaaagagggctgtgaatggcagcttaagaattttgcattaattctggagagggatagccgggcctgcctaggtttggaatgatggctctgacttctttatgtcaccactgagggtaccatttaggaggcagatgatgagtcagaagagtaatgcaagaatccaagtgagaaacagtgcagttagtaaaggtcctagtgccaggaatgaaaggagatggtggacttaagagagagtgcagtgatactgtgatacagtgatactgtcaagagggcctagaggtcggaggtgtaggagagacggggagtcatagatgggtctaagactccctgaccaggaagcttgtgatgtggttgacttgatgaaaggaacaagggagcaaaagtagatttgggtgggaaaagaaggagctcagagtaaaacatgttatattttaggtccctgtgggaaaatcaagtgtaagttcttagtaggcagatcaaaaggcagaactggaactcaagagaggacagggtgagaaatttagcattagaatcatctcaaaacgagatataacaggcaccaactgagtcatcattcaaaggtatttcttaacctagagtccactgacccccaaagagtctgtggatagaaatgtactttgatatcatcagcttcttttataatcctgttttgtattttacatactgaaaaccatgattctgagaagagatccatagagttcaccagactgcagaaggggctgtggcacaaacaaaattagaaacccctcagttggagggaagtgagactgggaagggaggtcagtaaaatgattgccacggggcacccagatccttgctgaggttggaaaccgcaaaggtgcagcagcaacaagccacatgggtgggtgttgtctcctgtgagagcaagatgtgataggtaatctttgaagagggctttcctttcctagaattcgtgctgccacaggagtgtttagaaaacggttctacaagttcttgtttcttttctgaggttgtggcctctccattgtttggtcagatttgtagtgcactctatatcctggtggtttgaaaacattgtcagcacaataacttttctttcttcacatgagatttcatacaaaatcccagtgtatggacatggtaggctttgattaaaataggggtgaagggccctgccagctcggccttccgagaggctgtcccacctctccttacttccctatcaggagctgctggaggtcttttgaatgcttctgcctacacaaaatgatgtgaaaatcactgctttaatttaaacacccttctttaaaagtagacacagaagaaaaatatggataatttttttagactttctgaggaaaaaaatagatttcttctccagaaatatgtcttcaaataatgccagtttttgctaacacagagaatcatgaagaaagaaaacccaggttacctgtatgtgtatgaacctagaaacattcaaagctcagcttggtatctaggctgcctgtctccctttcccagtggtatctatgcctcagaaaagtatgttatagtgggggtatattcaggtgattactttaatgcctcgttatcatagtaggaactatccaatgcagggattagagaatggggtcacctgaaagttcaaaattgcacctgtatgcttcatgcacctaccttccaggctgtcattgatgaaaagcttcatacaatacaaagtttaagaactgtctggagaaatacttacccattgagctctgaaggaaagaatggacaacatatatatatatgaggacaacaaattacttgattctatagaaaccttctggattataaaaactcaagataataggaccaaggagaaataatctgaccaggcaatataactggtcagaaaagtagtaggccatttagcattagagtaagtagatagaaatggatccaaactgtacaacccagggaaacattgcatacatttctcagaagtcattgaacacacttttccttacccccagtctctgt

SEQ ID NO: 1131 - DNA, 3625 bp, Homo sapiens
ggccaccggagcggcccggcgacgatcgctgacagcttcccctgcccttcccgtcggtcgggccgccagccgccgcagccctcggcctgcacgcagccaccggccccgctcccggagcccagcgccgccgaggccgcagccgcccggccagtaaggcggcgccgcccgcggccaccgcgggccctgccgttccctccgccgcgctgcgccatggcgcggcgctgactggcctggcccggccccgccgcgctcccgctcgccccgacccgcactcgggcccgcccgggctccggcctgccgccgcctcttccttctccagccggcaggccccgccgcttaggagggagagcccacccgcgccaggaggccgaacgcggactcgccacccggcttcagaatggcagaagatgatccatatttgggaaggcctgaacaaatgtttcatttggatccttctttgactcatacaatatttaatccagaagtatttcaaccacagatggcactgccaacagatggcccataccttcaaatattagagcaacctaaacagagaggatttcgtttccgttatgtatgtgaaggcccatcccatggtggactacctggtgcctctagtgaaaagaacaagaagtcttaccctcaggtcaaaatctgcaactatgtgggaccagcaaaggttattgttcagttggtcacaaatggaaaaaatatccacctgcatgcccacagcctggtgggaaaacactgtgaggatgggatctgcactgtaactgctggacccaaggacatggtggtcggcttcgcaaacctgggtatacttcatgtgacaaagaaaaaagtatttgaaacactggaagcacgaatgacagaggcgtgtataaggggctataatcctggactcttggtgcaccctgaccttgcctatttgcaagcagaaggtggaggggaccggcagctgggagatcgggaaaaagagctaatccgccaagcagctctgcagcagaccaaggagatggacctcagcgtggtgcggctcatgtttacagcttttcttccggatagcactggcagcttcacaaggcgcctggaacccgtggtatcagacgccatctatgacagtaaagcccccaatgcatccaacttgaaaattgtaagaatggacaggacagctggatgtgtgactggaggggaggaaatttatcttctttgtgacaaagttcagaaagatgacatccagattcgattttatgaagaggaagaaaatggtggagtctgggaaggatttggagatttttcccccacagatgttcatagacaatttgccattgtcttcaaaactccaaagtataaagatattaatattacaaaaccagcctctgtgtttgtccagcttcggaggaaatctgacttggaaactagtgaaccaaaacctttcctctactatcctgaaatcaaagataaagaagaagtgcagaggaaacgtcagaagctcatgcccaatttttcggatagtttcggcggtggtagtggtgccggagctggaggcggaggcatgtttggtagtggcggtggaggagggggcactggaagtacaggtccagggtatagcttcccacactatggatttcctacttatggtgggattactttccatcctggaactactaaatctaatgctgggatgaagcatggaaccatggacactgaatctaaaaaggaccctgaaggttgtgacaaaagtgatgacaaaaacactgtaaacctctttgggaaagttattgaaaccacagagcaagatcaggagcccagcgaggccaccgttgggaatggtgaggtcactctaacgtatgcaacaggaacaaaagaagagagtgctggagttcaggataacctctttctagagaaggctatgcagcttgcaaagaggcatgccaatgcccttttcgactacgcggtgacaggagacgtgaagatgctgctggccgtccagcgccatctcactgctgtgcaggatgagaatggggacagtgtcttacacttagcaatcatccaccttcattctcaacttgtgagggatctactagaagtcacatctggtttgatttctgatgacattatcaacatgagaaatgatctgtaccagacgcccttgcacttggcagtgatcactaagcaggaagatgtggtggaggatttgctgagggctggggccgacctgagccttctggaccgcttgggtaactctgttttgcacctagctgccaaagaaggacatgataaagttctcagtatcttactcaagcacaaaaaggcagcactacttcttgaccaccccaacggggacggtctgaatgccattcatctagccatgatgagcaatagcctgccatgtttgctgctgctggtggccgctggggctgacgtcaatgctcaggagcagaagtccgggcgcacagcactgcacctggctgtggagcacgacaacatctcattggcaggctgcctgctcctggagggtgatgcccatgtggacagtactacctacgatggaaccacacccctgcatatagcagctgggagagggtccaccaggctggcagctcttctcaaagcagcaggagcagatcccctggtggagaactttgagcctctctatgacctggatgactcttgggaaaatgcaggagaggatgaaggagttgtgcctggaaccacgcctctagatatggccaccagctggcaggtatttgacatattaaatgggaaaccatatgagccagagtttacatctgatgatttactagcacaaggagacatgaaacagctggctgaagatgtgaagctgcagctgtataagttactagaaattcctgatccagacaaaaactgggctactctggcgcagaaattaggtctggggatacttaataatgccttccggctgagtcctgctccttccaaaacacttatggacaactatgaggtctctgggggtacagtcagagagctggtggaggccctgagacaaatgggctacaccgaagcaattgaagtgatccaggcagcctccagcccagtgaagaccacctctcaggcccactcgctgcctctctcgcctgcctccacaaggcagcaaatagacgagctccgagacagtgacagtgtctgcgacacgggcgtggagacatccttccgcaaactcagctttaccgagtctctgaccagtggtgcctcactgctaactctcaacaaaatgccccatgattatgggcaggaaggacctctagaaggcaaaatttagcctgctgacaatttcccacaccgtgtaaaccaaagccctaaaattccactgcgttgtccacaagacagaagctgaagtgcatccaaaggtgctcagagagccggcccgcctgaatcattctcgatttaactcgagaccttttcaacttggcttcctttcttggttcataaatgaattttagtttggttcacttacagatagtatctagcaatcacaacactggctgagcggatgcatctggggatgaggttgcttactaagctttgccagctgctgctggatcacagctgctttctgttgtcattgctgttgtccctctgc

SEQ ID NO: 1132 - DNA, 2907 bp, Homo sapiens
atggcagaagatgatccatatttgggaaggcctgaacaaatgtttcatttggatccttctttgactcatacaatatttaatccagaagtatttcaaccacagatggcactgccaacagatggcccataccttcaaatattagagcaacctaaacagagaggatttcgtttccgttatgtatgtgaaggcccatcccatggtggactacctggtgcctctagtgaaaagaacaagaagtcttaccctcaggtcaaaatctgcaactatgtgggaccagcaaaggttattgttcagttggtcacaaatggaaaaaatatccacctgcatgcccacagcctggtgggaaaacactgtgaggatgggatctgcactgtaactgctggacccaaggacatggtggtcggcttcgcaaacctgggtatacttcatgtgacaaagaaaaaagtatttgaaacactggaagcacgaatgacagaggcgtgtataaggggctataatcctggactcttggtgcaccctgaccttgcctatttgcaagcagaaggtggaggggaccggcagctgggagatcgggaaaaagagctaatccgccaagcagctctgcagcagaccaaggagatggacctcagcgtggtgcggctcatgtttacagcttttcttccggatagcactggcagcttcacaaggcgcctggaacccgtggtatcagacgccatctatgacagtaaagcccccaatgcatccaacttgaaaattgtaagaatggacaggacagctggatgtgtgactggaggggaggaaatttatcttctttgtgacaaagttcagaaagatgacatccagattcgattttatgaagaggaagaaaatggtggagtctgggaaggatttggagatttttcccccacagatgttcatagacaatttgccattgtcttcaaaactccaaagtataaagatattaatattacaaaaccagcctctgtgtttgtccagcttcggaggaaatctgacttggaaactagtgaaccaaaacctttcctctactatcctgaaatcaaagataaagaagaagtgcagaggaaacgtcagaagctcatgcccaatttttcggatagtttcggcggtggtagtggtgccggagctggaggcggaggcatgtttggtagtggcggtggaggagggggcactggaagtacaggtccagggtatagcttcccacactatggatttcctacttatggtgggattactttccatcctggaactactaaatctaatgctgggatgaagcatggaaccatggacactgaatctaaaaaggaccctgaaggttgtgacaaaagtgatgacaaaaacactgtaaacctctttgggaaagttattgaaaccacagagcaagatcaggagcccagcgaggccaccgttgggaatggtgaggtcactctaacgtatgcaacaggaacaaaagaagagagtgctggagttcaggataacctctttctagagaaggctatgcagcttgcaaagaggcatgccaatgcccttttcgactacgcggtgacaggagacgtgaagatgctgctggccgtccagcgccatctcactgctgtgcaggatgagaatggggacagtgtcttacacttagcaatcatccaccttcattctcaacttgtgagggatctactagaagtcacatctggtttgatttctgatgacattatcaacatgagaaatgatctgtaccagacgcccttgcacttggcagtgatcactaagcaggaagatgtggtggaggatttgctgagggctggggccgacctgagccttctggaccgcttgggtaactctgttttgcacctagctgccaaagaaggacatgataaagttctcagtatcttactcaagcacaaaaaggcagcactacttcttgaccaccccaacggggacggtctgaatgccattcatctagccatgatgagcaatagcctgccatgtttgctgctgctggtggccgctggggctgacgtcaatgctcaggagcagaagtccgggcgcacagcactgcacctggctgtggagcacgacaacatctcattggcaggctgcctgctcctggagggtgatgcccatgtggacagtactacctacgatggaaccacacccctgcatatagcagctgggagagggtccaccaggctggcagctcttctcaaagcagcaggagcagatcccctggtggagaactttgagcctctctatgacctggatgactcttgggaaaatgcaggagaggatgaaggagttgtgcctggaaccacgcctctagatatggccaccagctggcaggtatttgacatattaaatgggaaaccatatgagccagagtttacatctgatgatttactagcacaaggagacatgaaacagctggctgaagatgtgaagctgcagctgtataagttactagaaattcctgatccagacaaaaactgggctactctggcgcagaaattaggtctggggatacttaataatgccttccggctgagtcctgctccttccaaaacacttatggacaactatgaggtctctgggggtacagtcagagagctggtggaggccctgagacaaatgggctacaccgaagcaattgaagtgatccaggcagcctccagcccagtgaagaccacctctcaggcccactcgctgcctctctcgcctgcctccacaaggcagcaaatagacgagctccgagacagtgacagtgtctgcgacacgggcgtggagacatccttccgcaaactcagctttaccgagtctctgaccagtggtgcctcactgctaactctcaacaaaatgccccatgattatgggcaggaaggacctctagaaggcaaaatttag

SEQ ID NO: 1133 - DNA, 73634 bp, Mus musculus
  misc_feature (10357)..(10454): "n" at positions 10357 thru 10454 can be any base
  misc_feature (30446)..(30465): "n" at positions 30446 thru 30465 can be any base
  misc_feature (56069)..(56088): "n" at positions 56069 thru 56088 can be any base
  misc_feature (71991)..(72107): "n" at positions 71991 thru 72107 can be any base
  misc_feature (73254)..(73441): "n" at positions 73254 thru 73441 can be any base
ccaacacgcagtcccagtggttgggagacacagggctccctgtcattcttcagaggagacgcctgcctcacttcagacttgcaatgcagatggcggctggcagattctgctgtggctgtttccacaaccgtgcttccgagcaaaggggcaagcgatggggatgccacgcccactgtcccaagcttgctcctttcgatgcgcttttcatgttttgttttgtttttttttttttttattacacttttacttaatctgtgtgtgtgcccgggcaaagcttccatgcaaggcgtggcatggaagagtggaggtcagacaacttgggagccatcagttctcccctctagcaggaatcaaactcagacctgtgggctttgcagtaggcatccttactcactgagccatcccaccctccggccatctgcttctgtgagagctggatcttcgtgactagtgctactgaattaaaggaagagaaagaaccccctgttttctgaaaggctggggctcatgcagaatcatctgtccaggaacccccatgctgactggggggatctgcggagtgaggttttgtcctgcctgagaaggaacctcctgggctctcatcctcctcctacctatagaaaggacattggcgatgcctgttcaggcagccgctttgttctagtgtgtttgcttgtgcctatgccaggtgacactgtgactcctggcccaccgccagtcccgctacaactgttactaaaacagaggaggccagagagccaggctttgcgactgagccgcagatgtgacactggctttcctgcttgtgctagtttgcgactagaagcccgtggttctacagagcatgtgcagagtgggggaaacaagcctgactggatatgggcagtgagaagtgatgtatccagcagaccttagtgtttcagaagagtgctaagttgtataaagtggggctgctccctcctgtgctccaccgggattcaggaaaactagctcaaaagtcaaagctagctgggcagtggtggtgcaagcctttaatcccaacacttgggaggcagaggtaggtggatttctgagttcgaagccagcctggtgtacagagtgagttccagggctacacagagaaaccctgtctcaaaaaaaaaaaaaaaaaaaaaaagaaaaagaaaaaagaaaagtcaaagctgtgtcagctggaaagggtgaaaacaacaagcataaggacaaatccccctgcctctacaaccagcagcatccagagagtgagtgctggttagacctcccttccctagggctggccagtacacagctcagcccagtccaagccctcagttccaggaagagcctgcttaattaaggattgtcattcctacatggttagggtctccaagcatataggacttagaactgaagcatattcattgcccccaccttgtctgcctgtaagactctggggagccttagcttacctgggaccccctgagtgaaccacgtgaagccgggatcgatgcaaaaagcaagaggaatttattgctccagtgcactggggccatcccagacccgaaggagtggtggctactcccaatatcccagcgagttcttatatggtttccaggggcagaatagagcatcagcaactaggcacaataagattggtggaatagtgcaccctttaaactgattggtctttagggaatgaggtgacaaagactttccttgtctgaaggtggcaacagtcagtactgtggaatgtgtccccaccggcaggtccgatcctgccatgtggtctgagaaatggtaattagcctctcccttccggagggtcaggtgtttcatgaccttcccaaagttcctaagctgaccttttcatgcccaggtctggcgtgatcacccattgcgtcctcaggtttgacatcagtgcctctgcttcccttgccacagtaaggtttctgcagctctctctgtgtgttctcactgcctgcttgctgcacaacccctcagcacccagcaaggagtagaaagcacgctcactgctcttgactggttagctattgtgccttccagaagttgcctcttaatgtgctcccctcccatctccagttttatgctttattactatgtgattgtttcaacttacatacaaattcagttgagaactgaaacaagggaacttgaactcatcaacatggtgcattctcacagtgcagtctctgtcacgcgcctgcggtgattcagcctgtccccctaaagcgcatcgcaggcatccattttgtagctggaatggcccagtgctgccttgacacagcgcactgcttcagagtactcaccgtgtctgttttctcctctgcttaccattctgtcgtagacataccttataaattcaccacctctcattaaacacttgcatgttttctaatttccaaagtgatgaacagcattttataaaacctcacttagcacatactcacaggcccaaaggcaagcctgtcttaggccccttgttgacattaccagtttggtttaccagaagtccccacagtactgtaggagcaaactcatttcaagggaccctctgtcactgttgggtagaggattcatctgtgaatttagttactaattaaatcacttactaatctaagtgtttccctgattacttgtggaaactggtgtttcccctaaagcttcagtggtgtggggggagaggaaggtgctaccaatagtgttccctcatttcctgcctagttggtttgtcttatctatataaatccattttttaaaatatctatctacaaaataaacttgtacataaatgtggataacagaattattcaaaggaggaagtatccaggatattcatgatttctaaatggatgagcaccttatgatatagtcatacagtgacagatatttagtgattaatgtaatgataactttaatacaatgctatattactacactgcagatgaatcttaaatgcgttgtgccctgatgaaaaatagaacgaaaccaaggttgtgtatcatgtgattaaatccataccaaatatctggattaggcaaacccacagagacctaggtaggttagatgggcgtcagggaagataggggtcattggcaagtggctgcttagagcacaggggtttctttgaggatgaagaatgtgttctggaattaaatggcagtaatggctcctttataaaaaccaactgtgccacactcttctgtggtctggaagagttggggaaggtgtgccctgcctctccagaatcccttcgtacaaacagggctaatactctcatttgcatcagcaccttctctctctcttctgtcgactcagagatccaaagcaaactgggcgcaagaagcatctctccctctccctggagcccttccatgattccctgttaaaacttcatttggccatttaggtttgggagcccatccagtggctggctggctgacagcagtgtgaatgctcactctcgggggctcacgcttctgtctcccttccattaagccttcagagctccaggcgcagtgaggggggtggggtgggaaaaaggaaaagactgcagtttctcagcctaggggttatctacacaagcatcgacagagctgattccaggtgccgggaatgcgcctcttttctgctgtgccatggtgttctatgagtgattggtttcatccattgctgtcagggtgggacaggatccatcctcgtcccctcagagcctttgcagtgaccacacacatggatgatccagacacttgctgtttgtgaagtaaagctttgatttgatgcgtagcaggtccagtcttctggccactgcatgtggtcagtgtctgcgttgtgcacactcccctgtcccgtggccttctcacctgagagactgcagggtgtcagaaggagcgtttggtaggggctttccttcacagcattctaccacaagtacatacgtcttttgtgtttggttgggggtggggcagattatacgaacacttcacttcatgagttaatttgcctgtaaagtgaatcatgtcttaaatgcaataggagagctcatttttataccaaggaaactttccgctaccgcctccctcgtggtatgtataaatacccttgccacagatagggaagacggggaaattgagggctgctttagttttgttggctcaaacagtcattaagatgccaaaccataccaaggaagaggtgactcactgtggttccagcacctccatagaacccactattcacagtgtggaatgtagatggagacagaggcaccaaggctaacagaggcactgtgctctctgtccctggacgtggtgtcaagaggcgtccttccctctgactttcccgccatgcctcttttgtacacttttgtgtggacttaccagggctccatggtacagaaagcagctttgttgcagaagtcctgagttctggacatggactctagtcacctgttgtcacctctcgtccccaccccgagctgagctgtggacacattcccctacctctctataacagggcccatgtttgaggacttagaatgtggtggtggggttgcgttttccagtgcagtacagtgcagtgcctggcatacatgagtatgcatacatacacttcggatgttggctatgactgccaggatgtggaaccaccacctctacagtgccccatcccgtaactaggcattcatcttctgcaggcttcggacagcatccgtgtattagctcaccattctgtgggccgtaagccggcacgtagcatgaccggaatctctgatcagcgaggctgaactaagggtgtcagctgagctgtcactggggccttgctagggaagaatcggtttcctgactcacacagactcttgatcagtctcagttgctctggtttgctgtggtcttggaactgacatgccagttccctgctctgccagctgtgagcgctcctcagcagtggagagcccacatctggccacgtgttaagagctgcaggagagaggatcctcactttgaatgcttcttctcacacttcggctctgcatgtgcaagaagagccatgacctccagggcttacttgatgaggtcagctcacggggacactgtccttcctaaggttggctacgccaagtgacacagcctaacacaggagcggctgtttaattcacacatcctggagactgtacaggaagttggaaggtagcttacagttctgcgcaccacagcacaacctcagcagggccagggacaaatggctcacttcttccatccatctggcagcaagtatactttgccaagtgggcagaactgcactgcactgcgctgacacagggtggacccagcactaaggctgtctgcggctcagcccccaaggtcttacagttgcacaatgcaaacccggctggatctttcctttggcttaggacctccaccagtgcttatgcaaccaagaggcaccaaggcaccctgctttttctccatccacctaattcctaggacctctctgactgtaccgaaaagacagataaagacccttaagctgccagggtcatctggctgtgttctaggaagaaggaacaacccattgggcaggatggaaaggtgttggtgaatcaggaaacttggctggcaggttctgtaacccagctaccactgctccgggcatagtgttgagctgcctaaatgaggctctagcagttatgtgcggaaaactcctaatcagctgccctggctcctcaggggattcactgtctgccgagaatctagtaaagttccttaaagtcctagtaaagttactcatcctgtggatggtgttgattttctcagcatcaaaagctgtgtgccaggagcctctctcctaaggtcgcctcactctgactgtgctccgcctcctcctgccctctctcatcccactgctgttcattcatgaagcggtccacttttgcctctgcccctgacacagtgtgaggagctgcaggggacctacaactctgctctgaattcctcattgcttatgtgtcgttggtccggctcccatccttttcttactctccattgtcagctttgcccaagaaagagcgatgctagagtggaagggaccatgaggcaagtcgtgtcagagttctgtggccagacctcactgtcctttcccaggccagcgctgcccactaggctcccagggtgagaatggggcatgggagggggatagggatgaagagctaagtctagagctgtcacttctcccattccttcttaagttggctccaaggtagcagcctactctgctaagatggcggctactcattggctcttttccctgtatgttgcagagaaaggcatttgccagcatgcccggtgtctcatccaggccttgttacccagcagctgtagaacttgatcatgggcattgctcttgggttggcagctgaggaaatggaagctttctcattgtttgtgtgcccagcctcagaagttgagagtgggtacccacctgggcccacctctggtcagaacgtacctgacctgtgatagctgagccccccccccatactgcagggccccctctgtcacagaagaactgtgtggagggtttgaggccacaccatgaccgtagtataaagcgatcatatctgctgtgctcatgggaggagggtgtggctgtgtttcagtgtgtctggcaactcttcccctgttgtgtaacttaaatagatttgtgggactatgtccatttaaggaaacagggtcccttagctttcaaagggatggagaaacaggctataatctggatatctggactggtcgcacaaggtcaggttagtgaagacgctctgctgccagctcttctagacagacacattgactaggtacatggatgtggtgtcttacgagtcagcactccagggccccagtgttgtcagagtggcactgacagtgctttgcagtgacctacaaatcaaaagcaactagaatagttagtacacttactccatgttggtggacacagaaaacaccgaataatagagatattcttttctggttttttttgtttgttttttgttttttgtttttgtttatcgagacagggtttctctgaatagccctggctgtcctggaactctctttgtagaccaagctggccttgaactcagaaatccacctgcatctgcctcccaagtgctaggattgccgtgcactaccaccgcccggcagagagattcttatcttagtccaaatgcccagaagtttgcctcacagtgaggagcctgatgacacagaatgccatctgtatagtgtctcctcacactctgtctaggagtagttaggctgcctgggccacatgggagggtgaagaccacagattctcacacagatcatcatgatggactcttagtgtctgcattatttctgttttgtcttgctcccatttctctcgttactcctgattcttcctctaaatcagtcaagaatagagcgagatccgagtagaagcatatagttaactcagaacatcaagggcatgcactgcgttccctctgcaaagattaccttctccaaaattgttttttgatcattttggtttagtcacttgatgtctgtagcatgcttagctctgcaccaggcttgtaaggtgcacacagctgggaagcagaggaccagcagccaggccctgacttcaaggggattatgcctttcataccttcactgtgaattctgtgttaacactgtggaactctttttagggactttagaatgttgccttttctttgttacgtgagacacgatatcctgttttctgcaagagttctaatgaggtggctttgttgcattaaaaagatggtttgcagtgaaagttctcattggttttaggtttcggagaaaatcagggtttctcccgggtaatacctgtgacactgggaattgcttgttgcaggagactattctgtgccttgtaagaagtttgacagagtacaagtacccctttccctaagttttggcaactgaaaacatctgcaagcattgcctactatgtctcctggtggacaggggtgccaggtgtgagcgtgaccctctaattctaggctcacatcttctgcttaaacaaatcaatgaaatccccaagaaaaaaagcacttggagcaagtatgttctgtctggtccttgccaaagctcaaagcaacgttgtaccatggaagagttaagacaaagtcagcgaggtacatacccatctgatggtgcagcagtggtggtgaaatgcctcagtagattatgccttggcgatagtttcctgttggaaactcattaaaatccttcgctgtccataaacaagagaacgccttggacacagcatgctgtaaattcatcttgaatgatttatgaggaaatgggttccagatttggtgatctcagctcaagtagtaggcgactgcctgacaaacattctcattcccaagaacttgaagtcaactcactaagcatttgctgaagtgtaggttgtgagagctctggagtgtctaatgtgtcctggtaagacgagcgcagtgcttaagaactgccaccagcatctcctcagcctgtgacagctcctacgtggatatgagttaccctttatggtcttgaatctcttcctggtctgtgccagccctgccttccccagagagtgtatgctattagacatcatgtcacgtggttcttatttgacgctttggtcccaaagcgacttttcagagtcttggcagggacacttcctgcaagttctgtctgcccacagtgcacttacagtggtaacattcattaccttccctgtatgtctgagttctcacttctcacctacataccagtaacattagaaaatgcaggacagtatggtgatgcacagcttccaggtcatcctagtctacatggacagccagttacatagtgagaccctgtccccaaaaaggggggatggggtcgagggaagcaggacatattgttgatgaaagtcactggcagaaaggttgggtttggtacagagagaaagaaaaagaaatacagcacaaaacagactttttcctcatccggttgtcacttcttcagtaactcctgtgtgctgggcattggccgtatatctgtgaagaaatggacctttgtccatggggcagagggacagtagacaggccacctcttaatgtggcacagtgggtcccaagctgaaggaaagcatagaagccagtgggcactgggacatggtgggttccttgcttgtccggaagaaagggcagatgtggtcaaggcctcatccccagcaggaaggtaagagctgacgcaggaagagtgaagtaaacagagcagccctgaggaggaggcccctcaggattcggataggagcagctggatctttggggatttaccagatgaggagccctgggaaggcaggagagaggagggtggggcggcatagctcagcctttccgtccaccactgcctctggaccatagcaacactctctctaaatgagcatttaagaatgtcaaactctaatagaaaattgaaatgctaattagcagcgtcaagtgcttgtgcttctggaggctgtcatgacagcctctggtcctgcccagctttactttcacgcagtcactacttctcagttttaatgcggaccatccttttgtgagtagtaagtgctcacagtgggagtgtctggtaaatagtcctggggctgcatcctctcctgtccaggtaacccagcatcctccttagagggcactgtattggaaggttttgctctagtgttgaaaaactcactttattgctcatattagtccttgcggtgactaaagaaaaacctaagaaattggtggccaactttgggcagtggttggccgaggactgagatacctcctcatccttgccccttggccctgctttgatcagcctgatgcatctcctgcccgtcttccgtgttagagcagccaggaaacctgcatgctcacagcctcctttctcttccatcaggagcttggataatgggctgtgtgcaatgtaaggataaagaagcagcgaaactgacagaggagagggacggcagcctgaaccagagctctgggtaccgctatggcacagaccccacccctcagcactaccccagcttcggcgtgacctccatcccgaactacaacaacttccacgcagctgggggccagggactcaccgtctttgggggtgtgaactcctcctctcacactgggaccctacgcacgagaggagggacaggtaagccattgtcaatcaggatgggtgagggcacagctgtgctctttcacagtcattgctgtgtgtggatggggtgggtgcaagcatgccacaggtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacacacacacacacacacacacacatacatatacatatacatgcttcagttgactcattttaacagagaagttttggtcaactttaggcccaagttgactatccaagaaccaaatgcctggcttctcaggagcaggagacctcttgtcactgctctgagaattcagcaccagttagtgctgctaactgcactgcagtgtccactgtggcctgtcagccaagggctcccagtcctgcctaccctgaatagggccagctctgggggtacccaagcactccagtgtgatgtacccttcctgacttacggggtagtttctgtccctcttcccactcttcggcctgcctggccagtgtgggtggttgtcagcatgttcctcatttccgtctgcttgtcagtattccagcctggacagccctcgagttttcattcatctctatattctattgttacattctctgtgtgggttgttttgctttgtgtgacttttgagacaggctgccattttgtagcccaggctgtcctcagactgttaataatccctctgccttagtgagcgttgggagtacagccatgaaatatcacaccggctgtgtgagtttcaagctgagctctgtgtgccaaaaccatttcatattctctctcgtcccttcctcccccagggctccttctgtttcccaccacagggctgggtttcacccgcacatctatttgctgacttagctagtgctctataacgtatctgccatacatcctcacacacattccctacagtctttgtaagctgcctcgtgtatttgtagtcttccaaatactgtcccagagtgtgaaccatggtaaccagatattttgcattatttgttccaaaattgtttattacaaaagtttaaaagaatgtagcgtctcttggctcatctgggggcagatgcctcgtgtctgctctgacaacctatcatggctttttacccggagagctgacgctgccgaggctagggctctttctctgtggacagcttatgcagtggagttggaagagggtcctgaccggcctttggacacgtgtctcttccagcactgcactgtcgatgtctaccctgtagaacaaaccctatgctcacccctgtgctgtaatgacaccagcttaccctcaaatccagccttgtatgaggccctaaccaaacctccatggcctgtacctgccccccacctcaggtgcctggaaaggaaacagacaaacagtctagggccctctgtccttagaaaatacagaagaagaaggaaagccaaatgaatactcaacacacatgcacctccactgtgagaggtgtttgttgagatttttatgtttgctgactcttaattaagcaaacagaagcatcaaccctgttcattcattcatgaaggctggatgtgaatcccaagtgaacatgtctcattcattaaggtcaccagcatgggctccttggatagacttaatggaagaggccatctgactccttatattatttgaagtgtacaccgccagtaccctggggctggagaggtgccctggcttaggggttaagagcccttactgctctgacagatgacccaggttctcttcccagaacctccatcaatggctaataaccactggcaactccagttcagaggaagccagtgtcctcttctggcccctacaggctctggcccacatatggtgcacataggcaaaagcacatatgtttaaagatatattttcaagaggcagagcctgggatatgggcgggcgttccatctttggggagggggagtggttgcattgtgtgtcctgggctttctggatgccttgctgtcagacccctaaggtcgtgagcagtcttcattgcttcctcctccatccccagggcataaaaccccccagtgatggagaaagagtgcaggaagggctgttttccacgagtgaagatggcttggatctgctcttataaaagaagagacatctgtgaatgaagtacggaatcagagtaggcatggccgtagaggctcccacagtgtgttctaagccagactcccctaatctcagagaaaccttaagaaaggaagactgaaggagcccagctccccggtcaggacatgcacctgagacagatgaaaggcaggtcctccctggaaaggatgatccccacagcagtgtggccttgggagaggggaagccaggtggtgataagccatcacactgggaaatgtgccgaaattaaaacaagaagccaaattacagagaaattcaaagctcccattaggtatcacatcctgtgtaacaaccacaaaattaacagcttaaacagcacatacatttatgatctatatctattacctgcgttctgtgggtctgaatctggaagggagagcccggttagaggctgtaggcatgagtggcagaatcaggtccctggccagggttagccagtctgtcatcatgctggcgtgacaccctccttaaggtagtgtggaagtagagaagtcaccttcttctgaaacatgtgtcacactggggacatctgtcccctttgtacactgtgttaagtaaatcaagttgttatgttcctaaggaagagtgtgctgaacaagggcatgagaaccaggcaggagtcactgtgctctgtctactgcatggggcaagccctagactgagtggaatgctgggctgatttttgctgttggaacttctgggatgtgggacagtccatgggagtcggcaggtgagagaacctaagatggacgtgaggatgagggagtagccagagtgagagaagtaaatgcaaggcagaggaagaaccaagggggcaggaagtagcaacagcaagaccccggaactgacaaccatgaccacagctgcgggtgggggccaagggcactgcatctcccacctggggtgagcattgcagagacgactcgatgtccccgagccacagaacaagtctcttccattcactgctaccttgtgctagggatggaagagtgatccatttacccagaccttagctcaaccttcagggaaacacgtgggggataaagtaggccagtacttgccacagattgatgtcagtcagagccttgtctcttactcagtgctcatccagagtcaacgtccgtcagctctagggttttgtcataaagcctcctctatacagaccacattataaagccagccatgtgactatgaccatattaattacaatgcctcaatatgtttattaatgctaagtgtagatttttaaggatgagactttaacaaaaatgtgatttcttagtatcaattccctgtgtaatagtctccgctcttttttttggcaggagtgacactgtttgtggcgctttatgactatgaagcacggacggaagatgacctgagttttcacaaaggagaaaaatttcaaatattgaacagctcgtaagtttggggtggagcacacatgctctttggtttgggggaaaggttctcacagcaaatgcatgtgctatctgaaagtaaggaaagaatgccttctgcactcactagctcatggcattcgagcctgagcgaactgaggacaaagtgcaatactacatggtactaagtgctaaagagggcaccagagtccttttagagcctacttcttaagtgtgcacgcgagagagcaagcttctgtgtgtgtgtgtgtgtgtgttgcaaggtcagaggaagcaatcgggtgtccacctccgtcactttgaggcagcgtctctccttgatcctggagcacctaggtttcagctcggctggcagccagcaagcttagcagtggcctccccccccctcccccgccccacacccccctcggccagcactgcagttacaggcttgtgagagacacgctgctgggatgcagacttgtgagcgagcactcttaaccactgagcatctctctagcatctctctaaccccagggtccgtgcgtttgcatctcagtaaagaacataaagcagccgtgcccatccccgggaaaagccgcattctcagatgactggcgcacggcttgggtgccagccacgtgctctctgctctgagctgctctccattattcaggtgtgggcattgtcagaggcctcgcccttcaggccagcaaccagatccccccatcttcacaactgtgaagcctgttgaggtggtttcctgagggaaaatatgggagtgtctgtgctcttaagaagaaagcagaggcctttcaccgacttgagaatgtgaccaccaggaacaactgtcaccagggagcaggcaaacttagggtaaaggttaacacccttttcaagccccacagttagcacctgtggaggaaaagcagttgtgcctctgctttctgtcagtgccagagcatcacctccctcagcatgcatagatgagagaacggaaggaaaatccactcccaaggagatggtactgtcgtgcctcagcacctcaagtgtgttgatgagtgctccccactcatgggcaaagactgccacctgggacgaggcacctggggtgaggtggggtgggcgctgctcttgctaagaagtctgattgcgatttctctggctgaatttcaaggcagttgaatggcttgaagcttggcccttctgccccccccccaaaaaaaaagaggaacctaggggttgaggtaagaggtaacacatactggaaagaggagggtgtggcaatggagaaccccctgtaacctcaagagtgtctccatgggaggcctgcccttctccagggtgcccctggctctcagcactgcacggagaacattttcaacagcaagaccccatgcctccagacacactagtaactcttctaaatgccagcaggcactgtctgcataaagcaggaggcttaaaattaggagcagttgtcaacaccagaagagaggtggctgtgttttggtgttttaatttattgaaatgcatggcaaaggtgtgtataaccacgcctggtgctggttgggcagcagtgtatatgctgacttactgtttcgtaacctcacatttaaaaatacaaaaagtgatacattgatgttacatgtattttaccacaaatttcaaggacagaatttactgtattctcacatactaagcatgtccgtgcagccagaattacctccccctccacccccagagagctcctgcaggcacaggggtttttaaaatagtaaatggctgccatttattgaaagtgccgtatgcactgaccatgtcattgctgtcgctgatccttcacaacagctgtctgaagtatgtgccgtgacatctgagagcacgggttagggagctgcccagtgcaccgtcctggcaggtggcaaagcccagggtgagatgtggggctgagaattcagagtgtggtgtcaggtgtgacctgggaaaagcccagatgctgccatcaaaggcagctggagtgtcttaagtgacggtgggaatggagggaggtggctgcagcgttggagagaggggcgtttgcctttgatctcttcccgtttatgattgcttattgttagtttgagtctcagatgagcgctgcttgtcagagtctattgactgggttttgtgtaaagctccccagtgggtacaatgtcctttaactgacaaggtcactagaagtttgaaactctgtaggccctaggaagtaagaagtagaggggtagaaaaaggcacatacaattctgggcacctgtgcacactcccgacataggcctgttttgaggttgcagccatggcccagttagtcactggcaaagtcaagtccctgtcattgtcctttgttatggaggagtctacacagtcaacatggaggagtctacacagtcaataaagcggattttagaggaatgtttaggggatgcagcctatctcactgtgcattttatttgactgcatagcttttaacggttgcagagttctctggtcctctgaccctgttctcctagaagagaacattgctaagggacttttcctttaaggataaaattctttgtcctacatggtatttaagtgccccttttcacggttatggaaaagaaaagtaaggtttgtacagcaaaacgatatcctggagtcaagggtaataacagggaagggaatacagagcaaaagacagagcagatggtgtgaaggcctccctccctccctccaccaccaccagccctgacaggagaggaatggggctctgtcctccccggggcagctgcccccccatgtgttccttctgactacccctcccatcaggacgtgctcagaaggctcctcccagtgcacacagggttggaggggtcctcgctgacccgttgggagttctcagtagtaaaaggcttgcgttcacagcactgtaagttcaccttctctccccacccccgttctcacactttgtaactggtgatttacccaccttgaaacagcatgtccttaaaatgcagtgggtgttttacataggtgcaatcatggcctgacccaggacctactgaaagctagtttctgtcataatcaggaaaaaaaaaaattggtttgattttttttttttttttaataagtttggtggtttggtttggtgttcaaaacagggtttctctgtgtagtcttggctgacctggaactcactctgtagacaaggcttgtgtccaacccagaggtcctcctgtctctgcctccccagtgcttgagattaaaggcatgtgccaccaccacccagctggggaaaaaaaaagtttgtattacccagacatgtgataaaagtagtttcaagagtcttatctttgagtaagaagtacagctgtggaatgcaggaagaatccagtatccctggctggccagacagctcaaggctggctgctcttggcaaagccacttcctgcctccatctgatctccaaagtatctggacttccagcacctgaagccgcagccctgtgagggacttgaggattaaagacgggatggaagaacagagtctgttacaaaaacttagaagccattctcaaccagtgtcggattaaatcacgggtttgggtcagacaataagacagtatcttaccaggtacgagtgaattaaaaagctgaactgtaagaacagtttaaagaactgcagctttataggctggagagacagctcagcagctcaggccagggaacctactacagttcccagcagctcaggcctgggaatctagtccagaccccagcagtcagtcctaggaaccttgtctagtccgcagaaagctgagtgtggcaggcagcactacttgtaacccattcctgggaaagcagacagacaggaggagtcactgctcacccagtctcgctaaatgagctagctgcaggttcagtgagagtgagagtccctttctcaaaaacaaagaagagaataactgagaaagatgcccatgtagtcctctggcctctgtagacatgcaaacacactggcaagaatacctgaacagcatgcatcacacacacacacacacacacacacacacacacacacacacacacacacacacacacacacacaggcacagattttcaaatgctgattaactacagtagctcaagtcaagaataagggtcctgggctggagagacggctcaaccgttaaaggctaggctcacaaccaaaaatataagtgtaagggtcctgttagagatcccgctccaaaccaacactgtgtgcaggactgtggaggtgaatgggtgctgccagtgaattaaatagtttttgcttgtttatttacctaacagcttgtagtagatattttgagtctaggaccagtgagaatagagtgtgagaaaaatgccacaagatgtgacatttgccttataatgtgtgactgtttgtcatttgtgtgtcactcttgtgagggggaaaaatggcccagaaacgttaagtccagagtggtgctatctttcttctgaacaactgttacattctaatgtgtgtaaacttatttagatggctacaccaaaacaagacagctgatactaacttaaattggaaattgcctcattagtgagtcaattcatgattactcagtcacctgagtaagactgggcttgtccccgattgcagcaagatcccccaacatcctgacatcacctgaaattggtgctcgctctttttcactttgatttaactagaagtaacttgatgaaggttagcatgcgttaggagacaagcctgggctgccagctcttcattcttcttcactgtctggagcggttcccaggctgggagcagtgaaggttggttgctgtgaagagccagtgggtgatctttatgtttttcaatgatgaaatgtctccatctagtggaatttcagagcagtaaacactcactattaaaatgaaggtaaagcctttttcttaaacacatggtggtcagtataacttccaatatgcatttagatgctagacttacaactacatatatttctgtggggctagaaatgggaacagtgctgacttaaaatgttaacttggttttctccttgggggtggggatgggctcctggccttgtgtgcactaggcaggcacgcggccacaaagcatctacgtcatgagatgtacaaggcagaggcacacatgcacacatgcacgaatggtagctaagagagatgttcacttgacaaaggacatggctctccttgggggagttttgtctatgtaaattctttgatgtgtataaatatttcaaataagaatatggacacaatgtgattataattaaacagttttctgggtaagagaactacagtatcactctcatggttgatctgttagtttaataaggttaaaaaggaaagatgctaggagtttctttgtttgtttgttgtctcactatgtagccctgactgtcctggatcccactttgtagaccaggctggctttgaactcattgagattcacctggctctatttccaagtgcttggactaaatgtgtgctctaacacccctaaccaagaaataggttttataatccctcaaaattagagagatagctcaggagttaagagtgtgctgccagcacccacatcaataagctcataaccatctgtagctccagcaggatagaggtctctggtatccaagggcacctccactcctctgcacattactgcatagagaggcacacatgcctacacataattttttaatataattttttaaaacttatattagcactttgggtgtgtgtgtgtgtatgtgtgtgttttctactgttatttatctcatagccacacccacttggatgagttcccattttattcttttattctgtgactttctaaagccccaccagatgtcactggtccttggtacccctgctcagaagttttttctgtagggaacctgaaggagggaggactctggcttaacaggaggccagggtgtctacctaatgttgacctggggaaggtcttcccagcccaaaatcagtacgttttcttccctgactgagcatcaacagagcccagccaaagacaattttaaaaaaaagaaaaagaaaagaaaggcctgaggtttctcttgttaccttcacagactaaaaaaagaagaaaaggaggtgatgtgtctgtaatggtcagaggctgaggcgcctaatatggtgaccggcaggcctgtttccctggccctcatagatagagaggctttcatttggtgcaagtcacagctaaactccacgcacatgatcattggcccacccactgttaatgggaggaagctcacatgccataaaccttcatgaatccaagcgtatggataatagttctatatatagtgactgtaaactgagagtcggaagtgcccttcctgattcacactctgagaattttgctgcagtggctcagagatctcttctgccctccagctacacaactgcctggcctccatctgaatctgggggtgggggtggggggagctatgaatgtttaatagagtaacatcctgttgagagtgtctgaggaaatcctgttatgtggtgttcttatactacctgcagaaggtcatgtcttcttcctacttcgtcaagagcaagcttgataggtccactaagcatacatccaaccctcactgggcctcctactgcttctccaaagtaaactgaggctggtgtgtgtactccacacacacacacacacacacacacacacacacacccctcattcaagattgcctcctacccagaaagatgctcctccccgagccctaagtgggaaagtttccgtttcaggatctcctgatgatgcccttgaactcctcaacctcctactgggatttccacccttagcttatgtggggccgggtattgaacctagagcctcgtgcacgtaagaaaagcactctgacttcagcgcgtggtgctttggatttcttagggcccgtgttgaaagtttgcagaagggggcacaaggctacagaaaaggcatagggtcggcctgcagaattcccagctggatggtgcgttcaattcatgtcccttcttttcctttgcagggaaggagactggtgggaagcccgctccttgacaaccggggaaactggttacattcccagcaattacgtggctccagttgactccatccaggcagaagagtatgttgttgttgttgttgttgtctgtctaaatatctgcttttaattgtcacataaaatgccagtgacacagcacaggagcgagaagacctttcccagtggttaagggttgagaggctacagtcctgctgtgctgtcgagtctgcgcagtacactgttattcacttcgtggtttcctttgagcccgtccgttttctgattgagaagctctatgtgagtaccctagatgaaaacccagtaacttgctccagatgaaaaaccaatgtggggaaaccacagctgcagtgtgtgttactgagagcccaccgtgcgcctgcagtctgctccctgagcacttgggaggcagataattatgagagattaagcccacacacacacacaggagtcctctgcttgataatcagaaatactgagccttctgaaaagacatagctttttgttccccaggcagaagagcaacttggaaactactgcagttgtgggcttcgagggatattttccttggactgaggtctcggttggtgttgtggctggtcgaccttgaccagcagttatttggccccaccctcccactggagggaggcagttttggaaagtggtaggagtctggggctctcaaaggatggctgactggtcattgttcattctctttccagagaaacctgtaggaactcttaggaaatggggagggaggttgatgtcccaagctcaggaacatggatggcctctaccccacctacagggacagacctcaccagaaagagaaaggagtcactgtcggttgctcacggcctgcagcctgctgtggatttgcggaggcacagcacagaggagtagaccttcaccctagcctaatcctcatgcgtccatcattcttctttaagtcttttgtactcctacacttcgatctgtttctgcttctccagcactgtgttttgagctgttttacccccttcgttactagtgtgtttcattatcagaaaataggaaatatgtgtatttgtattgaatttttaggacagattggtaaatatctcctgtgtcttttcggaatttaaaacttaactacaaagtaacattcctttgatttaactgagaatccacttgggggtgcatatttaagtcatatttataatgataaggtttttttttaatattttgggctttttagagtataagttagctttttaaaatacagcctgtggtttttacacgtgcaattaatcggtattttgcacaagcagcgtgtggttaagtgtaacctcttgttctgcaggccttcctctcaccagttttacacagcattttaattgagttactgatacaaaccaaaaaaagacatttctcacatagctggtgtcgtatcctttacagcagctattgctacgctgggattgtggagagtttgggtacttctcaagtcactgaaggtgacgctccttcggtgaaattctttgactcacagaaggatctgatggtgaacttcctagctacattcaggcatggtgaattgaagcttcatttttaaaaccatttgctttcatagatgaatactgtgatggtttggtcctgaaagctgctcctactcacagattctggtggaatgttccagaactctcccttgggctcttggcatacttatcctctcatatacaatccagtgctgaaatgtgaacggattgccgggcgttggttaggactcagcagctcaagtggagagacaaaagacgcattccggtcctgaggaggcctgtgaggcttcctgccacggcacaagtgtgctgtcagtgctgttgcaagggaatgttaaaatgtctgcaccaccgactcatttttatggacatgcccattaaccgtgcacagctttctctcagatgtgcagtaagcaatccctgcagctgtgtcagagaagcgcaactgcagggcacaggccaggtacttggtaaacgctcctcacgaatgctggacagggagagaaaatcaaaccaggcttccaagaacagcagccatctcagatcaggggtagagctgagttcccgtcttcagaattcctgtaggtagagactaagtagaagtgttatctgtcttccttctttatccatcctgagtgggctcctttaaaaaaaaaatcatgcttgattgatgatccttatactagagctgagtcttggtatttcccaggagttgtaattatgctcagaaatcaagggtcgtacagctgagctatggaatcgtcccctgcagttggcatttcaaacaaggtggtgggtttctctctgtgcgtgcaggtggcatttcacacacacatccctgtcgtcctggagggaaggaacacaatccatgattcaagatttttttttttttaagaatggaagagatgcagagtggatagaatcaggaaagattgaaaaaggactgaatgaagctagaaaaaactagtttggggcagtggaagcaacattagaggcgaaggaatttgtggaggaaaagctagctacattgctcagtcacaagtgtatttattttcttgcctgtgtctcccttgaaggtggtactttggaaaacttggccgcaaagatgctgagagacagctcctgtcctttggaaacccaagaggtacctttcttatccgcgagagcgaaaccaccaaaggtaagctaaggagagggcaaaactgatgtgctgttcagatctgaaggtctttgggatcggaaggcgtggctcttgcctggtccggggccttctagcctgagcctcctgctgctctccagctcccctgaagacgctggaactgcatttagctcccagagatgatcgggctcagagggaggcgcctccagaaacagaggccaggcttccgcctcagctcagactccgtcctgttctcctgttcgagtgaagggcgggaacttggtttttcttacctttttgatttggggtgtgtgtgtgtgtgtgtgtgtgtgtgtgtgtattttcaagacagtgtttctctgtgtagccctaactgtcttagaactcacactgtagaccaggctggccttgaactcagagatccacctgcctctgcctcccaagtgctaaaatcaaaggtctgcctgccctaccaccacccagtttaaatttgtttttctttccttccactctgttttgttagtggaggactccttcctcttccctctgtttaataactcacttcagcaggcagaggggcagagaaccatgctgccacacactggtgacctgtccctgtgcagattgccaagcagagctttggagcttcctgctaggggatagacttccatttcttttgttcccaccctctgttcctcccgcacccctgcctcccatcaaccacctctgtccccacccctgcctctccaccaaccacctctgtccctacccctgcctctccaccaaccacctctgcccccaccatccctgcctcacacacacacacacacacacccacagccccaccacacacacacacacacatatgccatccctgtctcccagcccctcactatccctgcctctcagctaggccacaggaaatgaaagcaggaggcaagctcacctggagtctgctcttcatctatcccagtgggatttggtctgtgcaatattagacaacacaagaaactgaaaggaaactttgagaaaaaccagaagtttttagttccaagagcaaagtcaactgtattgctaacatctctgaacactggcaggatagcaaaagttgtctttgtcctgttacagagtggagatatatctgtctctttcgtatgtgtgtgtgtgtgtgtgtgtgtgtgtgcgcgtgcgcatatggtttgtaataattattaatcagaatagtcacataaatgaggcctgcagagcagactggggctccgatgattggtgtggctaatgcttgcacgtttaccaggtgcctactcactttccatccgtgattgggatgatatgaaaggggaccacgtcaaacattataaaatccgcaagcttgacaatggtggatactatatcacaacgcgggcccagtttgaaacacttcagcaactggtacagcattactcaggtaaccccagtgccgtcaccgtcaccgtcaccgtcaccggttagaaactggaggctgtgagggaggaggaggagatacgggacagagtcactaggtagagctgtcctctgcccgcccacccccacagtcagacagacagatggagtccggggttctgttgctcttctgccccagataggattttcctcctgtgttttccagaagttccccccagtagaaggcagtagtttaaatcttgaaagctgtatttgtatattaattttcataataaaaatccttgcacgttctttacctttgccttcattgccatgcagaactgtgagaggaaaggaggaaaggagctgtccctaggcaggctcagacggcccccagggagcctcacttgatccttcaccgcagcagagggaagcacattcttgcactctgtagaagaaaatctgtgctgctgcagggttcccctccgccccgcccccactccccccccccccccagcttgcctgctgaggccacagctcccttacctccatctcctggactttcttggttttttgtttgtttgtttgtttgtttttgttttttcaatttttaaagactgggtctcgctatagccctggtggcctccaactcagaaatccccctgcctctgcctcctactgctgagactgaaggtgtgcgccaccatacccggctactgtgatgactttaaacaaagattagactttgtctttacgtcccataatcctgttcttctgctgttcttggccattcagttattgggtgtatgtgcgttcatgtgcgtcttatgtaaatatgtagctctatgcgcagtgtttagtgtgtgccgcttgccctccttggttaacaagtgtgtcctgctaaacaatgcatgtgtacatgacccctccttttttccaaggtaaggtctcacttgtagccctagggagcccagtatccactttgtagcccagggtggactttcagagtttgagcaatcctctagtgtcagcatcccaaatgctgggattacggacggagccaccacaccctttttaccaccattgaaaaatacctgtgctgtttctgccacaccaaagagacttgtagccttttaaaaataacaatacgaaatgcctatgtactgattctggccactgatgagcagttaagaaattaacagtggctgagccagtgatttgggcattagctctctcactctatgtggattctaatgaaatactgagagaaatggagcagaaaacctccttgcacttcagtgatatacacaaaacgcctgtatgttataaggatttttttcaaatgctgaaatatatttcattacaggcaaacatccgcagggtccccagggtttggatcatttgaaaatagtgtgctggaaagggcaccttaataacatcataaagctgaaggagggagccgatgtgaagcaccctagacgagttttaatctcagggaaaaaaatccatcttgagttagatttgtttttatattggcttttcctctttcctcttctctcttgcacatagaatgcctttgaaataccgacacataaataatttcctgcctaaacatctcagaaacagatttaaaaaaaaaaaaaaaggaatgaaaagtaagttaagaattcccagaaaagagacagccacagtttgtgcttagaatccaagaggcttccagggacgtagggggctttggccccctcggttcagggtctctctggcccccatctttccctgcctgcttactctctgttggcgtttagtcagtctccccatacctttgctagattctcaaaggaatattcttttcaaaaagaaggggtgggggaagaccaagttcccagtaacctgaatggaagctactgtttccctgcttttcatgtcactgagtttctgtgaatgttgttaatttccattacttctttaaatccagactcctaaattatgcatagaaagctgtttaaaaggtcgtgtttttgtttttgtttgcttttagtggaaaattgcaaaaaagcaatgtgagcacacaggagcagtagagtcagaaggactgcagagaatgtgacatcctctcccgctgcaggtgtcctcctgagaccggctagctctaacagaccagaggtctgtgggaggctcctatgccaaagtcacattttaaacagacatttaccagggagagtccctcagtccctagataccggaagggacagggacagtttttatttttatatgtactttttgaaagtagcaagggcattttgaatttgaggcagtgaatacgagttcattagactaaagtacacagaagccaaagcaggccgtgcctgtgagcagcgagcatgcccgatggtacagcggtgtccatatctgacacatcctcatctgcctccagcaaatgtttgctcatgtgcgtcgaatctcctgtggcctgtgcgtgttgtcgttacatattctgctcttctctccctcaccgctgccctgctcctccagagagagccgcaggtctctgctgccgcctagtagttccctgtcacaaagggatgccaaggcttaccgatctgtctgtcaaaaccaaagatgtctgggaaatccctcgagaatccctgcagttgatcaagagactgggaaatgggcagtttggggaagtatggatgggtatgctgagattcaattactctcttattagcttcctcgtttggaaaatcccaaacatcaagatggaaggtggaaataaagatattttatgatcaggacaaacagacagtttgaattattcaacttttatttggaaaaatttggaatctctcaaagagagctagaaacaggcaagaactacagctgtctccagttgtgctacagtgttccaacctggctcaatgttgccgtcagggaagtcaccttccatctttcctagtgcatgcatgattatggattataaggactgttttctttattaattccctttcctgtagagaaagctgatggtttgtgttttaacttaactgtggtttcatcaagttgtaccccacaaacttctggattggctaaagatgcttgggaagttgcacgtgactcgttgtttctggagaagaagctggggcaggggtgtttcgctgaagtgtggcttggtaaggcagagggcacattctgttttggctgcatctcaaagccaatgaaaaggacagttttgaacagaaatgtgtatgtggccgttgggacaaagacccttaacctttgtgactagatgggctcaagccacccaggtttgcagaagtcagtggcacctcgctgtgttcacctgtcctatttcatgtggctcattaaacacctgcaggacaggaacccagtgatggtgacgctttctcttcctgtgaaatgggatggtaagatgccatagagtaaggtcctgggctttcttcacaccaagcctgggtctaaacccttgctgggtgattaagtataaatgcagggcctgtttaactcctctggctccagtcctcatctgtaaacttggaatagtacctgcttcgctggattatttaaggattatatcagacatggttaaaatctcctgtagatcttggatccatgcacacatatcttcattgtgtgcacattcttcagtaacggcaactgcactgggcccttgagatggctttcatagccctctgggtcagttgcaactttacttacagacagactataaacttagacccctccccaaaatgtttgtccataaaatgataacaaagtgtattggggtctcccttccttagagtctacaagaatacaacatgtacagatggtcgtaaggtgtcaatcttaagccattacataagcaccagggtgtttcccacaggacatcagagctggcgtaggtgcctaggcagttacccaagctgtgaggagtggagatggcactatgcttaaagttacaaaatgttatcagtcagatcccgtagaccacctaaatgatgtcagagttcccgttacaccaaaaggcagacactctctgagatagaagaactctttacacctgccactggttctttttcacttgtttttcccctgtaggatgcatgttgtaattttatgttttaacagaataataaatgcttcagatatagaccccttagagtggaaagtcatagatgacacctaggtaaatcttagtgtgaacctggattctctttcaaattgtaagcaatagaatctcaaattagatttttattttccttttataaaattatccttcaaagccattggttagaaatagaacaagccagaattctgtctttttatttgagaacagaaagccaagctagttcattcctgttttactgatgaactgacagtggccatgagccaggtctggcctttgggtcagcttgatttttaaagacgtacttaaacatgtcacatgtacgtacttttctttcctggctgctctttgatttcccagcccacctgatagaaggcattgttcctgtggctaactcatgggaagctggagaaattgaccttacctgggaaagtatgggcaaggagatggtgtgctcctggcctgtgcttaagggtgcacttagcttgtcttctgaaggactcagtcaagtgtctcatccagtagacagttgaaagcctactccaagcatccttggtatggccagatttttatagcctctaagatggaatttaatctaatttctctcaggcttttcctttatctaagggacagctgttggatactcaggccaattctaaatcctagactgtcatgacttaaataagagcccagagctttctggtgtaaattcacaattatatgcataagccataaaaagagtgatacatatcaaatgggaaaagttagtgaattattaaacagctgtgagtaaacttgcttttccttaaatacttgacagagtccttgccattatctttgctcgtaagaactactttaaggtttcaaaatttaaagtctgattttatgcacaaagttgctggtcaaaattatttttcccatcaaaagagtacctttggattgacttactgttgtggggtatctgtaggtacctggaatggaaatacaaaagtagccataaagacccttaagccaggcaccatgtctccggagtccttcctggaggaggcgcagatcatgaagaagctgaagcatgacaagctggtgcagctctacgcggtcgtgtctgaggagcccatttacatcgtcacggagtacatgagcaaaggtcagccgcacccctccccctcccctcctctcnnnnnnnnnnnnnnnnnnnntccctcctcccctcctctccctcctcccctcacagggctgccggggaccggaatcctcagggattccactctgctcactcaggataacacttagaaaaggggaacatggagtttgcccctggattcctgagaagtgcagtgccttttgcatgttccacatcaggaacgttcctctgcacagttaaaacatccatctttctatccaagctaatgcagagctgaggctgtgagagctgctgccattttgaatgggtggcttctgttcggtttccctttttagcgctaagtaatcaatagcagatggttgctgagttaagttctgtccccatctcaacatccttccccccagctttccccttaaacatcaggtgaagaggtgacacgcagtcatgacctccctccctcccctctcggcgcatgcatgtgttgacgcacacgtgagcatgcgtacatcattataatcaaaccggcattgttggggaatgaagccagagatcattttgttttggaaaaataaatgagccaaacaagaaacagccttaaaaggctgtgtgcattgtacatcagaagacaccagggtaatttttcttctctgtgtactttcttttaaaatataattggaattttttcctggcagattatatgccctttggatccagggttattttgtaaataactttgtgattaaagcattaaaaaaaaaaaaaaaaaaaaaaaaacactgacagccatccagcccctgcaaatgattatctccgcctcggtgtcagatccgtgcctcctcactcagcctcacacgagtggctctgaagctctggctgtccgaggcacaggcgtgactggctgggatctaattaggaagctcctgccccacccatattccttggatgcttaaaatctgaaaataagtcagcagttctgaaagtcccttgtacctgaggcacctagagagcttctaaaaatacgggcatctgtgtctgactctgggattcctgatgtagtggatagagcctgaggacacgcccttccagcaaatactgtcactactgttgctacttgtcggagcctcagcctgctcacctgagctggctctccacatcagtcgcctgtacgtcgtcggttactgggacatgaaggatggtttggttcctcctggtgacaacataaaaggagacgttcatttcttctggttttactaactcctttctcactgcttattttcagaagctacaactcgcttcttaaaacataaacttgatttcttggtttttgttcaaagctttctttttccattgatgcaattatccttttcatctcccttttacttccactaaggaaatcaaatacagccactattgagaatctttgcctctctgagtaaactaaaattgttttgtttcattcataggaagtttgcttgacttcttaaaagatggtgaaggaagagctctgaagttgccaaaccttgtggacatggcggcacaggtgggcctggggtcttaattcaggctgtggctgtaccagcacggactctcaaggtgttgtggtgtaacagctgtgcccccttccctgggtttccacaggttgctgcaggaatggcttacatcgagcgcatgaattatatccacagagatctgcgatcagcaaacattctagtggggaatggactaatttgcaagattgctgactttggattggctcggttgattgaagacaatgaatacacagcaagacaaggtgggcacttccagggcagtggctcctgattgatctttgcctgcacagccttctccttaccttcatttcctccctcttccctttgtttgtctgatctggcgcgagctgcacagttctcaggtgggagctagtggatctagttggcgtgtgcagtgctggtctagtaagtgggcgtctgttcccatggcttgcctggcttttgggaagtatctaggcccacggtgttccacttttggagaaagaaggctttgagaagccaagttatagctcattctccattagccacctctgagcagaaatcaggtgacactccaagtcagacaagttcctttacaaaggaacaggcgtggtgttggaaaacggagaacataataaatagcaggggagccaaggctcagaatgcaacaggagtaggtagcgccagagcaaagacacctcctggtagagagcctgcacatggaggcgattcctgatctcagtcagcagctgcctgccaggcccagccaggaccagctgggaccagcctgagactgagctctgcagagcgctgaggagaaaagaaatggtctggagggcctggaggactgcagtgctggagaagccgtctcttctcctgcctcacccaccccctgcaaagggtcaaagacattagttttatgtaaaccacgtaccagaccagaagccaacccacttggggaggagggattgtttgtcaagcaccagatgtcaggaaagaattcccaaggtgttttctgccttcctggctggctgcttgcatggcagtgtccaggcatagcactgaggaactagcaacagtggaggcctctgtgtgggttttaaagccggaactcaggcagggagtaggtttccttggtgaaactaaccgaagcctggccaccccagccaagctgagcagtagtggggatggattacaggatggtgcattctgcagttttatgttgaatagtagttgtttcgctcatttttggcaattccttccgcctttcacttgcctcagaatggaagtgcagtgaatgatgtgagaaaatgttaaactggggccctgcctaggtactgacactatccaagtgctcggttgcatgtcggacaaaccgcccagctatttgaattccccactcccacccctggcacacgccatctcttgcccttgtgggatcctggggggtacggggggggggggtatgcacacagacacacacccaaagtcaggggtcacaaaagcaggctgtatctctaagcagagaggaatacagacgtgacttggtgacagggcatgccaagagggtctgagtgaatatgatcagaggccttgccctgagggagagcctgtgagggttgataaccagcatgttccatttaggaaatggctccaaagaaactcaggagcttccgtctgtgtgtgagaaagtctccgtggcagagggagcagtgcaagactgtttacttttaactagactttgaactctgtagagtctatggttaacacccttgacccatctgtgaatgagaggtgtcaggccaggagctaacagatgctaccagagtactgttgggatggactgggtacataagtcatgcatcattcataagggtgcctaagactgtggcctcaggcggctggcacctctcatgtcaggttctgcactggaacccatccagggccctctcagcctggccatgcagccttccttcccacttcccaccatgactgcctctctgccctgcctcccccccatgacatccagaccacagtctgaggccctttccaaggacaagcctcagtcctttgttcagcatttccttgacagaagagtccacctttccctcttagaatattatttcttctttcttatctttgtcaactgtcttcagatgcataccaaacactgaaaagggtaagcaataagggttacaggagctagagtatgacaggagagacgggcagtctgtgctgtcctgaagctgagaaccaggaaaggccaaggcacgtcaggacctggaaggggcaggaaatagacccatagttagcatatttgttcatacaaatcacaaagctcacaagtggaaggtccggatttgaaaacagtacagcccacctgaccaggtgtgctcttgagctgtgcccactgtctccccccaagacagtgaatcagagaatagaatggaaaaccagagagaattagtcctaagtcccacttcccctttattttatggaaaaagcctcaagggacaacctctcagattcacatgtgtcaggggaccagagagacttttccttttgcagccttggctagcccagctgttcctacagttccttcactgtgcctgccctgccctggcctgtccacgagatggaaaggtccggcatgtgtttgccaatgtattctgcagatggcatgtgtgctgcatgccggcgttcctgccggggattaataagctcctctagacagctggtccatgtgcctaataatatttgcaagtcgggttttatgtcacccgcaggccacagccgtgccgcgtgttgattatgggagtgcaggcagtgttctgaaacatgtgccaaatgtagctattttaggaccatgaatgacaaattgtttgcaaaacagttgtgagtttcccatctcaaggtgctctgaaatgtctgtcaccacggacagacacacacacaaggtgtgacagcacaggacacaaggacactgcagtatggagctctgttacaggtcttccatgtgtctttgtctcctacaagccccatactcaccccctgcctgcctggcttgtgaggagaagcccagtgtcaaagaagaattcaagaccaggcctagtgcctatgaaggttacccttcacttgacagcattctagaagcaactagaatcatttggggttccttgtaatggcctggacacttcaaaataagaactagttcttgtttagtcataagctctgcactaaattctgtccatctggagtcgcttaaataatccatagcaagtgtttgaatagtttgtttatcaaaggaacttggctaaaagttgttaaggagatacccaggccaaagcagaggccctgtgtggtctcagctcctctggggactgaagagggaagatctcatcagcccaggagttcgagactggcatgcacaaaactgtaagattccacgtcgaaggaagaaaggagggaggggggaacgcagaggaagcctaagggcacataaggacagttggctagcatgagaaagaacacaagaacattaaactcatgcagcaaagcccagcaatacccactgacttgggccctgggcaagctgggtgattcgtccatgggcagattacttatttttaactgcaaatgcatcttccctgtctgtgcgtgtttgcagctactggaaagcacttgtgtgtctaacctagccccagcgagtaggaactggacagtgtcgcttgctgctgttctgtttttactatacagaggaccaggctgctagagaataaacaaatgggtaggttgcagttgtactggaaagagccaattaccattcagggttaaaaaagaagctaaaggccctttccaggaggcaggtgtaggctatggttagagtggcactgtcagcagcagagaagggagaacgtcggggccatcttaacatctcagcgagagagaatgagtatgagttgggatttgttgtatttgaggtgtctgtgccggtgcatctaagcccagagaagctgctgcagcatcgcagctgatccactgccacagcagggtcctctgaccctcatccttcccactctgtcacctacgcctctcctagaactctactgacagccacctctctacccccagtcccacgatccttccagaagttactggagcccccagctgggcccagggcttcgaggtgaggctgtgctcttgagccacaccctctcctcagcatcagttgtttgctcctctgtcacagcccctggccatccgttccttctcatggaaaatgaaaatgggtgggagaactctccacagacttggtctttttcctcattcctcaagcagctgagagctggctaatgctgatttgaacctggcacactcagctcagctagacctggccatgtttagcaatgacttgctcttgtggacacttgatttctcttctcttctcttctctttctcttatcttctcttctcttctcttctcttttttttttctattttcttttttaaaatttacattcatccagtaaagtagacaaatctggtatgcaactgggtatgtgtttacatagttttgaaagcacctcacagagaaagacagacctataaagaccatttcattccactctagtccacaatcggccccagagagggctgttttctgttgcttcagattccctctgcctgtaaggaagttcatgagtgtgacttcacagatcccttccttagtaagccaccactctcaggaatagcctcgcctagccgtgacgtactctttgatctgcttcttgcttcctgtaacaggccttggcttctcacagcagactgatatttcactgagcagaggtaccatgtgccccatcactgtacggaggagcagtagggcaaactctacttgggctggtacagatgaagctgccgggcgggagacacacccctatctcccgggtactcaccctgtcagaagggctggtactggcttgtcagcagcaggtgctgtcccaagaacaccgatttaaaaggcaactgcagctaggtgacttgcctggtttggaaatcagaacccccaggtttaaaccacttctgtcactgacacacagggtggcctcaagcaaatcagctacctctttggagcatcatgtttatcctctgtaaaatagatagtaacagggcctgcctcacatggatactatatgattgagtaagcaatctataaaaatttgagggtggtaaaatatgaagaattattttaaaacttcaattttttgtgattgacatgttttccatagagagggttttatggtattaaaaatcatttaaagagaaaaaaatgttagtaatcaatagaggaaaggtacttataaagccataatacacagccagataggtggatgattgattgattgactgattgatagatgatagataggtgagtggatgtgtgtggaatgtgtgcatatgaatgtgcatgtgtacaagagcacacacatatcattatttatagcccagaccagtctatttttctggttctatctacatgtcccacagaccctctgttctgaactcaacgaagggagagtcaactaaccctgcccctccattgtcttgggcaggccttcattctttcctcctgttaagaaccattcatggctgggtgggtatggtggtacacacctttaatctcagcactaggaagtcaaaggcaggcagatctattgagtttgaggccagcctggtctgagttccagggcaaccagggctacatagagagactgcccactcccacccccaccctcacccccacccccaaaaaagaaagaaaagaactatccacagccccgagctgcatgcacatggtttttatttatatttattatatatcattattgtgtctgacatcacatatgtacataagttctcacatgaatcctggtagcaattctcctggatatcactaacacaggtctcgctgttcctctgtggggatgggggcctaaagactgaatacagccctcatgagcacggaacatttattggcactgtctgtgtacagcagtggacatagctcttatcactgcccttctcctcgctctctgcagacacacttttctgctctctgtgcagtatgtacaggcttcccagaaatggagtgctagaattctgtaatcctgcaagaacccttagagaaggttgttgcttatgtcggtgtttgctgcacactgtgagctggtctctgggggaagttcaggagctagcttcccagctagatagacctgtgctcagatgctagcctagctctgccttcccttgggttgcagcctctctgggcctcagcatagtcatctgggaccccctctctggtggctgtggcttagaaagggcagagctgtttggtgtcctttgcttctgttctccctcacaggactttctcctcccagacctcctacctcctttctctgtattcctcactctgttcaaaaagatggccaggcctgggctgactctgagcctggccggagaagtcgtggcattatcttagtatgagtcctggaatctctgcagatctgctcgggcacctgggataagttgctttgaacctgccttcttctgcaaacaaaattgtcacacggtctgagaacagacaggaagcactcaccacagaggacttagtgcagttggcagtggcattaacaaaagcagtgataagttgaccctatagacacatacagccgtcctctgcatacacgcccacagatagtacccacgagccatgctgtacagggccttcccactgcctcctgccaggccttgtccccatttgaatcatgaagagcaggaacatggagtttctctgtgggtttggtgggttggttgatttgttccaaggcagcaaccaaacgagcatataggaaacacatgtcaaaacgatgtaatctttgagtctgtggactatttggacaaaaggagaacactcagaactctgggtaactttgttactggtttatatattaagtagaacaagaaaaatgtgtctgttcaaatactcccagtattgagcatttaaattgaatagattattgtctagagtaaaattcacttataaattagactacaaagaattcataattgttacagtttccatgttcattcgttcacgttaaaaattgttactgcataaattaacacgttctttcttggagaacatattttagaaagatttgttactttaataactctttgtgtattagaaatcccagatgccggtgctaattaaatgtaatcagattttggattcaaaaagcacagtagccatttagcacaaaggagcaggcagctaggttgacaaacacggtcaggaaggactgggtccctgattcttttagctttccagtttcacaatgcagagctgtgaatgcagttcctgtctttcctttgttctgatgactggggattattagactcaggccgcccgccgctgttccagctcaaggactcctgcagaattattaatcagctgcttcagaggccctgtaatccagtggcagatcaaggctgatctcaccacgaggtgccctccctctgctcccctcagcgtatgaatttcttgttctctgtcaacaacagcatcgccattcccacactgtgtgctgtgacctgaacagcaaatgtcagcagagaaggggggaggtggaatcctgttaattgttgaatttaatttaattctttccttgctaaagaactgaacccatcttttaagaaaagcaaacctcttcccgtctcttattccccaggcagagcttttaaaaggctgtagtgaagtgaccaggccacaccaccccacaggcccacacggggagtttatcatccccagagctgccagaagccatgtgctgagccccacgtgcagaactgagccaagctgcctccctgaactgtccagggccagagtttggtgcacctctgtccctgggcagaagtcggcttcatttgtattccgctgcctctgtctctaggcttcctaccactggtgtctctgggagggacagctttgttcatctgctgtagcttccgcctagattagtagtcaggggagcagggcagatgctgggaaatggagatgaactgttgggagcatcatcccctcctagcaaggctgtgctgacagccagatgaaataaacgaagggggcttttaaatcactcatttctccctagtcccttttaagattaaaaatgcttgcagggtggcaggaaactgatttctaccacttccatccttggacagctctgtgaggtggcctagggaatgcagacagggcctggtgccagcacaggtccctgagccgactctgagcaccttcctctgtctgcccagcccaccagtagtcctgctttgtgctcacaggggcatcgtcctctcctctgtgctgttttgggcagagctgcctggcagttgtttatgaatggtcaggagcaagccctcactttgtacagcccacgtttcttggtaatcgtcactaaggaagcagatggtcaccctctgtgattttaaagtgtttaaataggaactgcagactgccatcaaacatcagaaacgtcttctggcttccttgtcgtactctgctggctggcagaaggagcctgcatttgcatcagctggagagtgagggacaggcagagcacatgcacactgcctgcagctacgagcctttctcctaaccaaaggaaggtacctgggcccaacacactgctctccacagggtcccagaaacataggcactttgccagattggaaagcagaagacagtttaaaccaacctgtggtcatgcttgtcttctgtacgtcccctcctcttgggacgttttttctagactcagagccaagccccagtatgatgagcctgtcccactcagtatccccactgtccacactgcctagcacagtgtggcctggcgtcgcccaggtccctctggtgggtggctcactctgtctgtgttctgctacattcttaaccgagtaatgggcctgccaagaaccctctctatccatgctcactgttcagcccccggggagcttgctcacgctttcagcttgaacgtttcttccatggatttatcccaaacagaccttggatctgcgcctagttaatcagcccagagttttacattatgttcaggcccaactcctgtctcctggcactcaggtttcactcatctctcccctctcagagtccctgatgagacagcactgtcttaatccttgtcaccttctctgtcagactccttcctccacgccccatccccagccccgtaagctaaaaatttcaaatggaatatcaatcatcctttcgtgcagctggattttcctttatatttattctcaaaacatgacgctaaactctatgaacttagagtggaaatttcagcagaatatgttaccaggggtaactggaaacactcagtttatgatttcagaagcatttgggaaatttgaacgtcatccttggcctattatgagaattaggagttttcctctgccaaatttgaccgggtttgaaattattattgtacttgaatcaccaccaaattccaggttgggtcagctttgcttcagctcctaacacaggatatcctgtcctagacttcttgctgtctccaccatccagtcagcttactgttactgccatagtcatggctgctgttcttctctagggtgactgtacagtcaaagtactacatactgttcagcattgtataggataattcgcacagtctgtggctttggagttaaagaggctttgggggtggctctttggtttagaaacctaggctctattgttgaagccagtgcattggatggcttcctctgctgccctggttctttggatcgcttcctccgatgccctgcttctttagctggaggagataatctctgagacagtgcagtggaactgtcaccgacagtcccaggctggactgagcttgtggtgtgtgatggccccaacaggcttgtattgaccccagctgtgatccgttctgtgtctggggaagtcatgagtcacactggtcccttctctgtcccccatctccctcatctcctccatggcccgagccatcatcttcgagacaaaccactttgtagctctgtaggttcagcccagtagctgcattcctccagctttagaacattcctacaggaggctccctcctcctggcgaccctggagtgccccacgctgtgctcagggactcggcggctccctcctcctggcgaccctggagtgccccacgctgtgctcagggactcagtggctccctcctcctggcgaccctggagtgccccacgctgtgctcagggactcggcggaggacacttggaattctcggtggctgatggatgagtgtggggattctctgcatcctctttccagcttttggaagtttcgaagggcagtgatgctgagggcctttgtcagtgcaactccatcaaagcattttctcagctctcagcttgttacttactgggcatcagacactctgctgagacctgtgtacctcctgccatcccaagttacagacaggaaactaacactggggcttttttttttttttttttttttggtttttcaagacagggtttctctgtgtagccctggctgtcctggaactcactttgtagatcaggctggcctggaactcagaaacccgcctgcctctgcctcccaagtgctgggattaaaggcatgcgccaccactgcccggctgacaattgggcttttaagggtctggcaaacccagtctgcaagcccaggtttgcctcactccaaaactccttttcttcatttattttaacgtcattaaattccgtctttaccagctccactcgtatctgcagagcctgatttctacatgaccattcttgccctttggaagaacattctagcccagcccaccgtcgggcttgctgccactgtcactacagagaggtggtcctttttcctagctcttccttttacatcattcagaaagcagccttgggacaaaaggtatctggagtgtccctgtgagcatttcaaacattgtcaccatcttaacgtatgaaggagagtccgctacaggaagctactaagtcaagacccgtttctgtctgaggcagaagtagaggacaggtttcctggctgaccattgggcatgcagccattcctttaactggactgtgacttgggcttggagtggcccatcctgatgtgactctaaccggacatcgcgtcttcacttaaagcagagagcactaggctgggtaggctgagaaaagccatcatctcttacattattatatcgctagtattttctttgtagtcagttttttttttgttgttgttgttttggggtttttttttgttttttgtttttttgggttttttgttttgttttgttttgttttttttaaatcttggtcaaagaagacaacatatttggccattggggattgagtaagtcactgctcaagtgggcctttgttgttttgttgttgtcgctgctgctgctgagcagttgtggtttaacagctttagccaaagtactgggacagtgtaagtatagaatacgccaaccttgaaggtctgcgctgtgctcggagctacactcagcagcatggagcacggggtctaagtgctctgacgctgcagccagtctccttccacacatcccgtttccatgccttacacttgttcctcgacgtgttgttctctcagctgaagaacagaaacgtctgcgtgtgtcagatgtgcggcacacagagctagtaccgatgatctgttccataatagcaggcgcttgtagtgtccagcattaaattgccacttctgatcaggttcctcccagaagacttcaggaagaagtcttgaggagacagacagaaggctgcagctaggcaagtggagggaaagatggcatttcaaacaagccgatacaacagaaggtctgtgatcacgccaggtgtggtacctgctacaggagcgaaacgcaaactaacctggattagctgtatgtttgcaataggaaaaaccgaggctgactggatatgtgcgccctggaaaccaggtggtggattctgatttaattcagttgggaccctcccacatggctacagaagctgccatttacaaggattaattggaggggcactgctgaaggctaggtaccaaggcagggggactcggcaggggcactgctgaaggctaggtaccgaggcaggaggactcagcgggactggtgactagaatctgggtaattttgagagacaggtcaaagagcagaaccaaggtgccaggttaacagcaagaggacagtggtctggaaagagcaaggggaagaaaagtcccagcttaaggtttctgccctgaagcctagcaacacagtgaccaaaccccagaaagggatagtaaaacacaaacaaatgaagggattttgttcctttcttagatgtaaaaagtaagaattaatttctttttttccattttttattagatactttctttatttacatttcaagtgttatcccctttcctggtttcccctcccaaaaaaaaaaaaaaaaaaaaaaaaaaaaaccctttccccatccccttctccctcctcaaaaaaaattaatttctaactcagtcatttggtgacatttttctgcccactgcaagactctcttataatcttgcacatagtaagatgatatactgaacaataaattaagcttacagttgctgtattttaggtaaagccaggagaccctagaaacccataaatatttggaaataaagagccaggagttcaaatgagaaacatctgaatgtgcccatccccctcacacacgcagcaggaaaaattagtgacaagagaggacatagtggagagaagagtcgggaacactgaagccccaatggctgtggttagagtgagtggaagaaaattggacattggagacgagagagacaggaagaggctatgcgtagatcagatgctaggcctgtggggaaaactccaggctcacttatggtgggaaggagagagcaagccagctcagcagcggtcaggtggggtcttgttgttgttactgttcttagggacaaacttaggtaattgagtaagacctgccatgcctcttcccctgactaggcacacagatgattacaaacctgcttcgatggtaaggaccagtgcccagcaagccagaaatgactactgcccacttcgtcttgctatgactactgcaaggccccctgttgcctgctctttctgccaccaaaaccactaacatcccagtagcagcccaggaactgccccctccctggtcccctgaagcatagctatggctccctctacatctctcagattcactctgacactaaggggctctgagtactctgcatttggtattaaaattcggaatctgcaagtgtttaggtttcattagtgtgtggcagatgctttctcattgtagttaattagcagttgttagacccttaaacagccatccagacatgacactagtactgtcaacaagaacaagggaagacacctcagagacaagagaccaaataagttacccataggaaaccaaggctagtcagcaggaaggagagctggacagctaacgcactgcccagctctgctctcatccagttggttctctcaggagtcttctgtgtaccagacatgccaggctctgagctggagacacacacagttgtcccaaagacatgttccaaccctcagagacagtgctgccaagagatacactaatgataacctatgcatctgtcacatttcaagctataataactcggaaaaacaggctgctatggcagcatggagttggggaacctgtccaaatgttattgatcaggcaaagtctttaagcacgtagcactcaggccaagagcagaggggtggggagggtggcacagcagggagtttcatctccttctgagtctctaagctctctaatttggcccaaatgaagcacttactccagcccctagcaggaccccttatgtgccccattgctgggtgaccttagacatacccttctcagtctcaggttttacccctgcaccctgcataggcatatgcagagagaccaggagaaaccaactctctgacatcccactctcagaaccacactgtcaggcctgggactttgtaccctctggagggaggaagctaagacaagagcaaatagaagtcggaaactaagcactgcttacttcttttcagtaatagcttgtcattgcttcattttaaccttttgtcttgaaaaagaaaacattaattttattttttttttaaaaatctgaaaaccaatacaaacaaacaaaaactacacctttaatcctgccaaggcagaggctggtggatctcttgagttcaagaccagcctcatgtatattgtgacttccgggcagtaagcgacacagagaaaccttgtctcaataaacaaaagaacaaacaaaagttgtgttgaggctggagagatggctcactgttcaggctccagaagccctcagttcagtcccagtacccaagtcaagtggttttacaacctcctatcactcagactccaagtgagtccacattctccttccgcctcagagggcaccagcacacaagtgcatagacttacacacaaataaaagaaatgtttttaagcttgtgttgaaggtagctactaaaaatatggacaaagccattctttaaattttatccttttaaatacttgttgcttggtgtgaaaaatactttgtcttacaaagcaataatgcaaactgactgtatgtaagtcccctcccacccatcacatgcatactcactaatgccctcctgtcagaaaccctcagatgatgcagactctgttctttatgtaaattttgcgtatcttttttgtcattgttttgtctttgttttgtgatttttctgtgtaacagcctggctgtcctagaacttgctctgtagaccacgctggtctagaactcagagatccacctgcctctgcctcccaggtgctgagattaaagacatgtgccaccactgcctggtttaatatctttattataccttagaaaatgagaaaatgagaaagcagattagtatagctggctgatacatttactttttaaaacctgaaatcttaaaaaatctttactcagaaaatcagagtgaaagccacaggttaccacatctgtaatcccaggactcgagccacagaggcaggaaggaccaggagttggtgggcacagcatcttcagctacatgagtctgtctcaaagaagggagaccaagataactgtctgaattgtgcgtagtttactgccagaaccccatccactggccattgttgcaggagtctgaggaggaccccaggattcttttcctgccatttatggtacagggtttttatgtatgccagagagaaatatcccattttactttagatattgtcagattatagagccatggattgctctaagtgaggatgtatttaatatctgtccatccattcatttatttatgaacaagagaattccagctgaggtgcggtcctggctgtacactcgacactgaggaaagcctgaccccctgaccccagtggcttggagttgaagctggacggacagaataccaaggacagagagctgtgtaaagaatgcttttaacgaaatgttaaaacaaaatgactgctcagagaatcccagatcatgcaggcggtcgccagcacttaaggaaagagagaaactcactttaaatggaatgcataagagtggaagagagtgataagcacttgcctgctccagtgttagggtgagatgccacagagagaaatcagaggattttctgcaattttgatttcatactggcatgaaagagatggaaaagaaaattgcattgctggaaaacgccagggtatatttgttaacattgctatggtgtactgtatttaaagcaaaaatgtaattgctgtaatttatcacgtctggctattaaaacctccataatttaaagattttaatcatttgccacttttgcacatagtgacttttcgtagatgatgctgtgacaattctgatttttatcagcctttatatgctttgtggcagctcctaagcatcattagtgtgatttcagcatgctattgtttgcataactaatacaaaatccttgtgtttttttcctttgggctgttcaagcagtgcccagaactgctttatagttgctgaccctaacatgaaaacgcaggctgctaggtccatcttcatctgtccacatctttctaactctgagacaagcagggtgggctgtgcctgtcctttagatgtggaaagcggattcttctaataaccagagactcttgaaagtgtctctgcctttgaaatgagtgtgtgtgtgtgtgtaatgtgtgttcaggtgtgtgtgtgtctatgtgtgtgttcatttgaataagaatggtcccccacaggctcatatatttaaatgttagccatcagactcataagctgccatccaggcatgccctgtctagtagtgttattcacttgaaccctctctggctggtaggagaaaaataggaggaaagcagtcacacagtgcagaatgaaaacgtcccaggaataaagatggacagaatgggtaggaggaagtgagaagtcagccacgggcaaaatcatttccccatggtatgtgtaagaaatagaaaatatggcccatttcagtataatgtatgggctctatccattcactccatcctaggggaagctggaacttctgtgatttgtggcacctcataagaccaatttgtgactttatatacctcaggacacaggagaatagtatgatgacctaatcctgtgtgtatttattaaaatatagcattatttgagagagatatgggagtattcatgtatacatacatattatcttagacactgttctgttgctatgagagacaccatgaccaaggcaactcttataaaggaaagcatttaattgcggatgacttacggttcagaggtttagttcattatcatcatggtgggaagcatgatagtgtgcagtcagatatggtgctggagcggtagctgagagttctacatgcagatccacaggcatcaggaagaataccactagcctgccttgggctttgaaaccccagagcccactgacacactccatccataagggccacacctaccccagcaaggccacacctcctaatctttataagtagtgtcactgcctgctgactaagcattcaaatgcaggaccctctgggggccattcttattcaaatcacacacacacacacacacatgcacaaatcaggaatcatactccagaccaagcacataccattcagtgtgatcatggaatcgtgttcagaaagctagctagctcttctctttactgacatacaagagttttgaagtccaactctttgaagaaagatttaaagttatttgcttaaagtcactgagccaggcccagggcataattcatcgccacacccgctattccttcaccatcttcttcctgttctcgtcccccaacctgtcccctgcagatgactttccaatacttcgtcttccctcttcaccccagtgtaggatctccggctcgtgagtaaccgcgtctccattctgcaggtgcgaagtttcccattaagtggacagcccccgaagcggccctgtatggaaggttcacaatcaagtctgacgtatggtcttttggaatcttactcacagagctggtcaccaaaggaagagtgccatacccaggtaaggacacagacccgagaaacggtttgtctgttgggttctattttaacttcattttacaggagtcttgcccagctgcctttctaagccctgtgctcagccttctgccaaggtatttagccaggggaatgcagaactcagaattgccgtgacctgtacaccaaattcaatgtgctaagcagctggtataaatgttccagttcccacaggtcatggaatttgtcctgtctcagtaggtgcatgtgtcatggctcccacagcagaaatgtccctggcagagcctgtgcccaaatggagcttgtagacacgtctgggaaagggaaggagaaagggtcctgttgccttttgatctcgtagcactgacccacagagcaagcctggcaggaagatgcccgtcctgttctctctgaggctccagccccagatggccccaggcggaggtgcaggaaaggcagtttaggctgaccaacccattctctgcctgtggctgaatggccaagatacacaaaatggagtgtattatgagggtgcgggggcctctgggagcctgcagttgttctgggctgtcagatgctccctctgtgaagaagctgtgggttaaggttgcccatgcttaaattcattaacttagccagacggagacataaaggacacgcaccatttcgcctccacactttactggtttcagggcagggacggtctgctttgtgaaatgttaaggacatatttttcagttactgctgagcaaagaaagagcatagctggctcactcccttcattccctgcctcttaaaaagggagaaaagaaaaggcccacagtgatggcaccgatagtagagattaatgaggaatgtagggctcttgcaaatcctgggcttgtaatcatatctctgcagtcagaggagccagcgagagccgattaatttgtaatccctttgttcattttgtctgattgtttctggtcatcatcagagaacagagaagtgttcataaagagcccctctgtctaggctagtacagcctcaagacctctaagggaggaagattggcactgaggcaggattcacaagtgccaggctctgaagccccagcccagcattgggaggtgtgggtgtgtgcgtcttctttattgctgctgctgctgctgctgtggctgcggctgctgcagcggctgctgcttccggcatgcacaagtgggcagacactctgggaatagtcaactggcagagaagaaagggctgcccaggagggggtggggcccagcaggggtgcttttgaattgcttctcaaggatgaaaatataccgtctccaggttttaaaagtgagaaggcactttttaaaaattattattgtctatattttgaactaatttcttcctgatctccccaggtttatagacacccggtgtgttaaaagcaatcacaggaaaaggttaatgttgttttgcatttccgtgaagctttctcttacagtaacacaaagatgctttttgttcttgggtcacacacacacacacacacacacacacacacacagaggccaagacaaagaggtgggtgtgggggctcagaagaggaagtatttggagaccggggttttgtcaggttgggttttagcacaaagaaaataacctaggtttacaagtctgagtggatgccttcactcagcatcattttgtgtggcctggcctagcatttgttcccttgggaagtagcacaaatgagccattcagctctcaggtggcactgatgagttcctgtccccgagcaggtactattcgagctggagggaaaaccatgagccactaaatagtcctgccctcacggagcgttactgcgggagagtgtttgtgccgtgcttatggaggggaggttacttagatgggcagactgtgtgtgctccccgacctgagttctcattatatatatggcagaatcggggacacaagatagcccttcattgagagacccatgaagagagcagaggagttaagtgagaactgggtccagcagagtatgtgtatttactatgccttccatgactgcagctgcctgcaggggccatgggcaagggagaaggcaagtaaatgagaccatggagagcaagaggctcgctcacgatgaacaagatgtgtcgtcctgcctgtcacccggaaaagctgcagagactgtagggagggtctgagacgatggatgaggtgacgtccttgatggccttagaaaggggaccgagccagttgtgaggggtctgtgtgctgccgtgaagagccattggagcctggcaggttgacttgatggcccagagagctgcctgcagcagagaggccattccagacctgttctcatagccacggacactgcttagttttattttgtaactcagctactcagttgggcttctgaaagtgacagaaactctaagggaggagctcctgcagagacattatagttacagggttgctagcctagcagagggtagcacttagcattgtccacatgtcaccatggttgtcgctgtggcccagtcggccagcctgtgctgagtgctcaccttgcttcagccctcctgcactggatctcccattccctgctggtgggagtccaggagaaagtccaggtctctgtgtatcagatgcttccattatgcactttgacacactaatttctcagtttcctagaacatattttcatgtaattctcttctcaagaatggaaggtggtgataaacttgcctgagttctttcatacctgagattggccctttgtccccacgtcacataggaaagtgctctggctcataagtgacagtgaaaggagatgggggctgacttacaaatgagcttggcaaagatccccagacatttccacccagcatgtaagtcagtgcagtcagcgtagaagggagccttggagaagaactgagtgatgctagaggcgtggccagatgaagggcaacctagcactgagtaggcgctgctggtgtcctcaggctgtgctcactgaactgaccagagacggaggaaggaaagaaggacacactgaaactgaacaaggccttgaagccgtagaggaatattgaagtgttgtcctgaggttaaagggagctggtcaggtccctatccacttccaagatgggtgacagagacggacaccattgcaacgcacagctcgcctgctgcagccctgtgggctaaaaatggggtcccgcatcctgcccagggctcaggctgctgggtaaggcaggacatgggaagtctgacttggtgcaccccatgccactgtcaggcttgagaagctgcaggaccctgctctgggggcagggtagctcattctgaggtctctgcggacctgccggggttggcttggggtccccgggcctgcacagaggctgaggacagcaggttctagctcttgggtaccacagaatgcctcagaagagctgagaacagagtaggggccttaggggctggctctggaaaagagtgggaagagagctcaggctggttcccgaggggaggagagtctttggcttgctcagtggtcaactcaggttggttaaaagggtggctgagaatgcagagaggccttctgtgtgagattaggttctgttctttagagcattgttccccactgcgggtccccatgagaagagacagtccatggtcttaaggtgtttaaagagaaggaagagactagggaagtagagaccggccatggccacattggagggaggggggtgcggagaggagagcaagagagaagcaacccagaaacaggagtaagagagggagtagggggcaaacatcccttttgaaacctgagcttgccaggtaacggtggggaggagcatatctggctgttgccaagtaaccgtgggggtggagtccagacagaataccaggagcttggggccctgtgtgactggtggccacagaattatggagctggggcctcatgtcaggagcccagtgtctgggggcgtagcaaacgccttctgtcccttgcaggaacacctgctgggtctccagggtttaaacctaactcaaccagaaaacaggctgcctttcacagtcctagacagcctatcagctgtgccatccttgctggagtccagcctgctttctgtatgcagcgctttaagtgttctttgcatcgagattagaactgtgtttaggctaagggattgttgtatgtgcgcaatggtaatgctggcgccaaagctgtttcctgagcttgctgagtaaaatcgtagctttgcattttagcatgacatttcacctctagaagctttctcaaattctttccccctccgccttccctgcccctgcctgtatcaggctgtcaccactgggtggtgacctcctaatggaacttcctgccccccccaccccgttcctctcccttcctcccctcatcctccaccattttgtcattgtcgccagcagaaatgttatcctggaaaacagatgaattatctcactctggtcctgattaaagatgccaagggctcttgcccttgccctccagataactccagaaggccgcaccctgcacaagtccacaaatatttattgaatgcctgttatgcattgagtgcttttccagacccaaggattatagcagtgaagtaacacgagagttcctgccctcaggaacgttttttttttcttgaagaatataggcaatacaaaccaacaaactacactcaccctggctagtagcattgagtggagcaaaagaggaatgtggttaggagatggtgacagtggaagtcactaagaggtgctcgctgactataactctgataggagctagccttgggccaggtgggtgtctaggggcactgtgccacctgcagggagccaaggagccagggagccagaggcctggagcgatgactggtggcttgtggggttgtaagcaagcatgctttttactctttttgttggggtttagttttgagcttgtattctcgttacaatgtttctccttggcctttcctccttctaaaccttcctagttacccctccccacacactctttcaaactcatagcctcttttttcatcagttgatattgcatgcatagatgtgtctgtatacacatgcatatatatttctaaatacagcctgctaagtccatacagggttgcttgtgtcaccattccacactagatgacgagttggtgtgcttttccctggggagggccacctctcgctccagcttcactcagttgccaatagtttttgtgtagggttcaggtctcattgggctttttttccattcagttgacataaccattggtgtcctccttcgtcaggtcatgtttaggcagtgatgctggtgagactttacaggcgtagcttctgatgttactaggagacaaaacctcacagaatgctggtcccctggctcttagagtctttctgcctcctctttgcagtgtccggagccttaggtgtagctgtgtattgtaggtgtgagtgttctcctaacgtgtgtgcagtgagcagtgtgaggggaagacttgacttcgggtgtctctgctgtctctctccctttacatcttggacaccccaaggaatttgtctatgacagcatctcactgggttagccgagaagtggctatgtagaccaagctgacatcaacctcacagaggtctctctgcctgcctctgtctggaactcccggcagctctgccttccttgagaggaacggggcatcttccatgttctgattcccagcagtgtctgcccacagtagactctgtagaagcaaataaagggaatgtgtgaataaaaggggaaacatttgaactttttttttaaaaaaaaaaaaaaggaagactcataggtttttaaacatttttaaagctgccccatagcctccagagccttataactctgcccggttatcctcacatatggccaacacggggtgagtgttcccagccgcaaggtagcctctgtccccagagttctgagaagttgaccccacgttcaaatttcatattccagtaacccgataggcagaatgtcctggccatgccaagccgtggccctcgactgaacacctgcttgtgtgctggcgggatctggcagaacagggctcttctcttaagcaaatctgtttgtctgtgcattggaagcctcctcaaatcgttctttcagcaagtgtcagctgcttaacttccttgagcagaactagtcacttggtaatgacctggaggagtaaggtgagcaagcaaaactgctcgcacctcctgtaaaagcccaagcgccgctttttgcccccttccttccccccccnnnnnnnnnnnnnnnnnnnngcatgatcacatgccatgaagacaggtattcttgtgttcaagctgctgacaggggcagactccctcaaggaggcaagtgtggactgtccaggtagaggggccatgagaaacagtctgaaaacagctgaccttagcagtgcatgatgggtcctctgcctccgcagcccatgggccccagggccaaagcactgcagtacactgtgttccttcagagagctcggaatgctgtctcctcccctgcaaggtttctcttggctgacgtggctgataaggggaagaaaggataggaggctgtccgtgaagctggagggcataagaaggggcagtctcccagtacagcctgagcgcagcgctctgccgctgtctggtcttagctgtggtcaggcccctgcctcccacactggcaccttcaccctcttttttcactcctctcttcagaggacagaggagttctttgtagcactgtattatcgaaagctcaggcttggaatcccagcacttgggagacaggagcaggattattactgttagtttcaggtcagcctgggctacgtagcaagcccttgtctccaaaaataaagaaaaagaaaacaagaaaggaaaagcccagaaagtataatgctgcattatccacttcaaatcacctttgtgtgccgcagctctcccaaccagcatttctgattttattaatacagcggttttaataaaaactgctgccccaggtgactggtgagggggctaacagtaaacaaaactagtaattattgtcttctcagggtcagtccttcatctccatctgtaccctctggtcagtatccctctgctccacatttgtactctgatccatggagtggctctccaaacctcctggttgttcctgtaagataagggaaaacactgggtaatctgataacacatgcagcggtgcactgcaggctcgctgagcaagcaccattaactccactggcctctctctcagcacccgtgtggcagctcacaacagcaagcagacagatgggtttttaagagagcttatacagggaagcaaggggcctgagacagaaggccccatccatacacaatatagtatcattctctttgaatgaaaagctcagttcgaaaaagaaatttgatatcagatagcctgagtatcatctccattgttaaaacatttatttacaccatgcagttgtcccgattcccacagccatggtgaagtccacgcatgactagaaaataaaccacagactacaggtacgtctgctctgaggtcccttgagaagccacacaagtgggaagcagtaaagtattaatacttttttggtgagaccttgtgctaaggtgatggataaggtgttctgttaacaaaaggaggcgctgaggctggagcaaatcgggtcccctgccaagaggtacagagtctggaagtgacatctgttcggcgttctgcctgttgaagtggcttttgttcctttcctcaagagccagaaagaaaagtgaggagggtctactgagttcttggacagctcaaagaataatactgatgcctacaagaagaggagaggcaaggacccaaaggataagggaaagaaaacatgggtacatatgacagtctgcgtggcaactgcacaatgtctgagtttgaaggaagagttggagagctgacttctcgtgtttgagaaggaagccagcaaaatgactcagaaagaataatacagagatcatgtcaggaagtgagtgcagtccacttggccagaggctcgcagctacaatgttttaggcagaaggactggagctgttacagccatgaccatgtttgaaaacatgaaagaaggagttgaagggacatctcagagcagcaggttgtggagttctgtgaactcaggcccatcacctgggtcctcggaaagagtggagacatgctgttctcctgagctctggagcagaggagagctgagatcaaactgggtaacggaagggtattttttaagaatattatcatgcatggtgtacttaattgaagtactgtttatgaatggcaaactcactgagtccttgctgagccagaacatcttgaccattgcaaaggttcactgcagaagtggcaggtttgcagggccgcccacccacgtgtgttctggcctttggttggttggaagacagctattctgttgcactcgtcactcagtcagttgcagtgtctactcttttgacaaagctgccgttggtatgtgtctgtttcagccagtgcgtagaattgttcatatattccctggactttgggaggtctggagagagtacctggaaaaataaaaggagaaatggggtgggggttgggtgctgcaggaaaggaggcagcaagctaagaatgcatatcaaagctgacagtgtggccttgcagtctagtccagtcctcactctgcatatactgagtatactgcatatattctgtcccatggacggaggccttctcagcaaatgtgacatgctgttttgggttgtcacatgtactatgtccaagtcttgggtggagcactggaaaaataggcttgacccaaatggccagttaaactttccattggcagagactgaattaaacgtttaaagaaaagaagtatttccatttgaggaatttggatttttaatgaaataaaccatttactgacaaaaaattcacggaattctgggaaagtagttaattgaatcctgtggtgctgtgctgtgcactcagggccaggttaaagccttgagatgtatttggggagcggttggagcggttggagctgctccctagaagccagattctagggagagtctactgtcatacctctgagcttcaggcctctatggacctttcctccaggggctcctggcaggagccagaacaagggagattcctgcagacccaagctgtgtagttccagaagcaccatgaaactaagaggtttatctacttaattgtgcagcaaggaattgcctgagagaataccagcccctatgtatggctgtgttcttgtcttggccctttaggcttcctggaatagagacaggtggctgtcttggagccccagcttctcagctaacctcccatgggagcaaatgcacattggaatcagacattgttttaaaggcagtgcactgatgtgttacataacacagaaggggagtctgggatggaacataggaaggaagtgccatcagggcttcacaacacagagggtttatggctgcttcatgtttgtagaaatttttaatcccagtccaatgtttctagccacttttgaccatttagttagcaggtaaaagatgcacacaacctctatatttagagtaagcctcaatcagcactagagctgggcagatacctaccatctatgctattaagcctactttcctatcgataaccctgagctattacttactgtttcatttgagctgcacttaattccaattggccaaccctcagggccacagtttcaggcctcctaacccatggcacttctccttcctcctccaccttctcctcttcctcattcccccttgtcccccaccccaggcccaggaaacctgaaccccacctatgtctcttctgtccagctattggctgttggcatttttatttaccaatcaaaaataacttgggggcagagtcacaggtctacatgaaaactccaggtcttgccccacacacacacacacacacaatattacaatagacaagaagaccaaaccccaacaggttcagctctgttattctgccgagtgccatttcctgagcttactggggtttgaactgttcctgaggaagtgctggcctccgttccttccctttctgtctggagtatctcagaagagagctgcaatccgtgtaccttcccttgccttcagctctccatcctagatcctggctcctcagtatctgggggaggaattgagctcgttggctccagggaacacccaacagaaaaaggtactcccacactggcctcagcattctcccaaggcaaggggcttgcctggctagagtgaaattatttggtcatattaaaggtctacttaaacacagtcaaaggaatgctaaattttgtcaccaccagaaattataagtacagagaataaaagagcatcctacaaggacttagacaaacagatgactgaaatagttgtcatccaggaagacctagctaggataggtccagcttcaaagatgagagcaacccagaagcctggatgctccctccagagggaaacaggaatgtgacctctggccaagtgacaggttctgacccagtggtcacctcccccagaattaaagaaggctgtgttgaatattatgtcgattccttactagtgacaaccctgagactcatgctgtaaattacagcagattcttgctgctgtaaactaactgtcaagagttagggaagattttagatgtcaggctcacaaggtcttggcagagagagggagaaggaagggaggaaagggagggagggtaggcgggtgggcggacaagggagagagtacctggaagcagctgagaagggagcacactgagtgatgcctgcttcagcttcccatgatgccttctgctctgcagcctgagaatgtcagcattaggcagctcctgcagaggggcagggaggtctcagatgatagatggccggatgctgtcattcataagcaaaggccccagagacaccctgcctccctgtcacagttcccaaacctcagagcactgtgagggtcaccaggccagatggtgccaagccctgctggcatgaaggcaaacctcagacgccatgcctaagcatgaggaaaactgtgacattcactgtagctctgcacatagaagacctgttgcttttattctacagggtgtttgtgtgctttagtcatacaaacatttcttttttaatttctttaactttacattggtgttctgcctccatgtctgtctctgtgggggtgtcaggtcctctggaactggaactacaggcagttgaactaactgccatgtgggtgctgggatttgaacctgggtcctttggaagactgagtcatctttccatctcccgaagattcctttttaattatgtttcttgttaattgtgtgaggatatgtgcacgtatgtaccagtatctcctgaaaccagaggtgtcagttgctctggaactggaatgacaggccgcctagtatgaatgcatgctgagaattgaacttgggtactttgcaactctaagcaacattctagcaacattaagccccttcccctagtcctgtgttttacctttcctagtgagtataatttacacataacaaaggttaatttaaaagtatactcccatgagttttgactagtgaaatttgattgttcacacggactaactacactggggtcatggactgcagcctgagttatttctcatggcagagcatggctcccaacctggctttgttttaaactgtttcagtgacagaaataagacagagcttgcatgtagcccacacaaacaaaatatttgctgttggcctttcacaggaaaaacatgggcattcaaccatggcttctgtcacctctcagctccctctgccctttcacccgtggcccccaccccaaccccaacccccatccgtgcgcagcaacctctgatctggtttctatcatgcagtctctggcctttctagggtctcatccaggtgaaatcgtacagtgcgctgcctcttgtgtctggcttctttcacgtgtagtgctttgagagtcactgtctgggcttttgcatctatgagttctccattcctttgttccactccttcgtgctgtgatagcctattacaggcatggttcccctcctgagagggaggacggcctccttatgctttaaccttagccacgtgcccattctcactggcccctgtcttcgcaggcatgaacaaccgggaggtgctggagcaggtggagagaggctataggatgccctgcccacaggactgcccgatctccctgcacgagctcatgatccactgctggaaaaaggatccggaagagcgcccgaccttcgagtacttgcagggcttcctggaggactactttacggccacagagccccagtatcagcccggtgaaaacctgtgagagcctgcgcttcagacgcctcttcccgaggcctccctacccctccccattagcttccaattctgtagccagctgccccagagcagcgagaaccgtccaggatcagattgcatgtgactctgaagctgaacttccacggccctcattaatgacacttgtcccccagtccgaacctcctctgtgaaccatctgagacagaagcgtgttatttctcagacttggaaatgcattgtatcgatgttatgtcaaaggccaaacctctgttcagtgtaaatagctgctcctgtgccaacaatcccagtgctttccttttttaaaaaagaaaaagcaaatcctatgtgattttaactctgtcttcacctgattcaactaaaaaaaaaaaagtattattttccaaaagtggcctctttgtctaaaacaataaaattttttttcatgttttaacaaaaaatgatcaggacaggtgtttgggttttttttcccttttttatacatatgatatatatgttaacatatgttcctgtacatacaccatgtgggtgctaccatggagactggccagcgtaggccacatagctacaggaccggagtggggattactgcagaaccctgccagcaaagcactggtgtcagcctgcaagccggtggcctcattttttgacttctacgaagcatgacgtcctctccatttggactgcacttttttggttcctaatcatacctatagattgttcatgtgacttttttcaggtcccagggcctagtcacgagttttagtgccagtttttgctccagcgaactgtgattcgttcttgaaacttaggagtgagcattttaagcaaaaagcagccagccagttctaccacaagagctgcaagacggagaccacacaaacttcctgtataaatatgaatgctgaagggttcaggtgttttccttttatttaataaatcttgtaaccacatttaaatggtctaaacccatagcattgtagtcatggcaacctactaaactttctcatgcaactaaaaattatgggaaggcaagggtggggggttgtacacgtcccattgtaaaataagtgttttactgtcctgtactgctaatgagtgactctccgtgtcaggagtgctccagtgaataactatgcactactttacatttcatgggggtgcacaaaaaaaaaaaagtattacatttttagttgctgtttgtaccaacctcgaattacgtatgtttaacaacaaatcaattcctatttctattgagttttttaatactgactagcaattctgaagtcttaattccttttttttgttaatgatttacttgtgagtttacatttttaaattgtttaactttcctaatttagtaattaaaaagagagcattttacatttgaaaaaaaaatttttgtttatttgtgtacaccacagaaggtaccctaggcgttctgtgacatacctggcccgtcccagatggtgaggaagcacctggtaaatcgggccactgtgcagcgatttccaaacgacagaaacatgcagagcatctggagaccctccccaccaaaaggcaaagcagttatctggctaactcagagtggctaaagcaaaactgggcgtacttgagcgccatagtgtatcccgcactgtctctcgctggaattcaccgtgtcctatttgtacaggagacagtagtctttcttggtctcaagtcataaatacatttccaagtatcctacttctaaaatgaagttgctaagcatgtgaccatgtggtatgggggagagggggaggggggactgggtagccatccaggcctggatctaccatggttccctgcagaactccgaacctcccctgcaggccagtgtgtctggagacaaagtacagacaagatgctctcccagcctctggcagccctgccttcttacaactctaagtccaccgtgtcatatggagccatataaggaggaaaatctttcattgttgtggaaataattacctttagaaaagattatagcgttttggggaggaagatgaaacattttttaaatcaaaattgttactattttggatatgaataccattgatagagttttgaaaacttacgaggtgcagtttttatcacataggattagtcattagcaggttttagatttttgttaagataattttattttcaatcctcactttgcattagacaatttgcaaatattccctggagggtttttgttttgactcattgaaagtctttgagggaaaaaaaaatgcacttttaatttcatacagctttttaaatttcatcaagtgagttctctgtgggttcctgtatataaaagaaaactaaggacatgcatcactgagagagcacgcttacgaggtcagagtcctggagcactctagaatagaagaactacagtcaggaagaaaccaaagaaatgtacaggtttttccaagagtccagtgtgctttctagggaggctcaactcccatctggaagtgtctgcttcgtaagtgatagacactgggatcgggaaactgaagttgctcaccagaaagttctcttatgacaaaggaaaaatagcacttactgtgaagcaggtgaaaatgtttggggagaaaacctctttgttgtttctctttaaaaaaaaaataataacatttttatgtgtattggtgtaagggcgtcggatcccctggaactggagttacagacagttgtgagctgtcatgatgggaactgaacctgggtcctctggaagagcagctagtgttcttgaccactgagccatctctccagcccctgttgctttcctttagtaacccagaatgaggactaaggacttactctctgagagccaactggggttacctagtttgcacttggatacctttttaataagctattctcttaaaagctcacataggaagctcactggagaaggccattttcataacacaagagtaaacattggttcactccactgtcgttgcaccacacactcaggctgctgcgttgagggacctgataggatcccagcagatgcggggtgccacatgtcagcagcgactcagtggactttaagggccctgccccagtgaccaggtgtttccatggggaaagccaagggtaaccatggtccctcgaaacctgccgtgtgactcaagatctccaggcacctggctgtgtttactcacccggagacgacaggaatcctgtgagtaaagtcttggcagcagaggattctctagtaccagcagagctatgaaatctatctatgatttctcacggggctataacagcgcccgccgtattaattgggatggttctttcctgggaaggtaagatgctcagcggtacacccaggagaaaagcgccatagctttgctgcagaaaagatgccatgtctattgttggccctgacgcagaacaaggcggcccacagggtgggcgtttcctaatggtgtatttgagtaaaatggtatttggtcagtttgttctggaagatattttaatacattcagatggcttttgttggctttcttgccactgtgtgttacactgaccttctttctgttaggctagtgtcagaaatatactttctggaagggagatgagacggagggaaggaaggagattagctttgatcctgaaagaaggggaaaaacagcctgtggcatcattatctaagtttaattttttttttaattctcaaatgtagattccaactctacagaatgtaataaaaatgcctttattatcttctaaatatcaaatgaaccttcacaactgtgtttatatcaatattccatgaagttttatgacaaacatccaaactattcctcatttttcccgatgtatgaaatatacagaatcctatgggaaggacatggagacctctttatatatctttattttaaaataaaagcgggagaatatagctaagtggtaagccacttactttgcatgcctttgtctcttgtctctctctgactccctctctctctctctctctctctctctctctctctctctctctctctctctctctctctcaccctctcaccctctcaccccacccctctcaaactctaggcattgaaatataaagcggtttgtgattttgtaggaaccaccctgtaagaatgcagtcctagacagcagccagaacaagcagacttcctctctggagtcctcagaactcatgtcactgtgtgcttcaaaccacccgtgtgttcagtaacacttctcttctttcagtgggttttctgtggcagactgagcactcctggagaccagaaactgcccagcattaacgattctcctctccctcaccttgaacggagatgagcttctggcagatgtggggccaatgcatgagtggatggttagatggatggtgcctaccacccagtggggtggcgctttgccttcagatgacacgcttatctcagagcctgctgggtgtgggggagctgcggcatgcggccccagcactagcctggcctgctacaactcgaagtcatcagtcttcaggataactgtgaaagctttctctccagcctgaaccaggcacaaccagtgaccccactccttcccccaggtctcggcacaacaccctcggtagaaagtcagacttcttggaccgtgctaggtgactgcccagagtaaaagaccaagtgaggtatagttcacaatgcatgcaagtgaggtgccatttgaatttgataattttatgacaactggatattccagttcctaagataaccatctttgtgttcatataaaaatgtatctcaactgggcgtgatggtacacgcctttaattccagcacttgggaggcagaggcaggcggatttctgagttcgagtccggcctggtctacagagtgagttccaggacagccaaggctatacagagaaaccctgtcttgaaaaattaaaaaaaaaaaaaaaaaagtatctccatgccctccagatgttcagtgtccacggcctgtggcttgcaatgcccctattgcagctctcatgacccaggtacttctggcctacgtgagaagctctgtatgaagtggtaacttattgtagtgtgaagactaaacgtgaaaaaggtattgttgccccctacgcatggggctttcctgacttccccactcaaacaagaacagcctcatggttgagtgggagggaagccaagggagagctttatgacagaaaggaaaagataagccagctggagcctctggaagcagaggtcagatcagctttcctggccagtctgttgcaaatcagagcaggagggatggaaaccttaaataaaggagaagactgagctgggaagagaggcgccctggtcatcactctctggaagagtgggaggaaggcagacatgacaggaggtacacatgaggactagttattccttgctttaaacttctgatgaacgttcactccgagctagaccacgtgtaccagaaactcaaaggtgtatgttaatattcacaccccagtgaagacagagacccagagctgtctgtagatgggaagcccagggctgagtcgaagggaggcacccgtgcagcatggggtctgcagggcaggcagcacaccgtggagtgggttaggtgtcacataatagggacagaacttcttgctttcaaggtgacacctgattctcatgcattgaacacagaagctggtcagtaaatggatctgaacaaagaaaaagcaaagctacatgcatcacctccccacacacatctgtccttctagatggaggtgtggtaaatggctgcagtcaaagacgggtaaggtgcttcgatgtgtgggtgggggaggtgtagcgagtgcatatggaaccttccttacctgccagcctgtcagagatgcggtgtcactgtgcgcctgtctctgcctcctgccttgtgcaaagaatgttgggattacagacatatgcctctgcctccaaatttacatgggcacaagagacccaaattcagttcctcacaaaggcaaagcaagcacttttttacccagtgagtcatctctccagtcccaagaataagggaccagacagggtgttgattcccagggtccctgctggagtatgactaggaatatagaatccaagaattgctggcaaagaacttgtactaactcggtcgctctccctgggacatttgacagagctctcctgtttgtccgttcttcgcttgttggccgcttcatttgctctgtcatacaatttgcaaatttataaaagttactgctcagagtcacaaggtgctctggttgttttgttctgggtatttttcctttagttaattatctagtgcttgctctgtaataatcaatgggtagctaattggaagcaagagagaatgaaatgagtattatttgaatagtgtttttaatgaaaagcacacatgaaatactatagggaaacagcacaagagaattttttttcttttttttttttttttttttttgcatgtgtttacaaacagattcacataagcttgtcacaaaccaaatccaagtgtatggatcattttgtttcattttccagatccccccccccccaagggggtgagtgggcattggaggataccaggcggaggccaggcctcaggagatggagaactagagccccagccgtcctaaatgaagctgaagggctgtcagttcccaaagagtgcatgaggaaatggttagcacgagacagcacttgcatagagaatcagagatgagtaacaatggttcctggtaaattagccatattacatcatgcacacagtaacggagggacgattaggaaaaatgaatactaatttgcccaaatcctttacataaaatgcattgactctttttttaatttgatagactttttgattttttaaaaacatgggcagctccaggaagctcccagcagagcatcattgtgagaggaggaggaggagggggaggaggaggaggaggaggaagataaaccatcgaaggccttcataagccatttcacccccctcctctcaacctgcgaatatcagaaaatatttgtttgtacattcctgaaggtctctaagtgaaaatggaaggcattaatcattgtctctgctatcactaaaccatgacctcaccatgttggagggcaggaaagtgatgcttccttctatctgtatgtctgcgctgactcagacggtctctgggttttgagtagtagggggaggattggaatggagcagagctgtacttaaaacggcaaaggcaagaacaaaagcagcatgcgtgcagccaaaggggaccttggaagttacacagatgaaacaaaacgctatgcttgcctgagagtctggtttccaaagcaaacgcaaaatggagagccttgttccaaccataaaggtctcaccatctatagttcctttgcaataaaaggggccctgtaatctactgtgacagccagaagctgcactggtgctctgaattatgatatttgctcacgactaatacagatttttccaaagcagcgtagcatttgtagctatagcatcctctgccctttggcagaacacagccatgtccgccagctttccctgcttccgttccttcctgtcccagcccccacgcctttccacctcttcccattacaatcagaccattcttgcttcctcctttgtttgcttcggcacacctcccttcataggatccctgttaatttattaaaatcagacttttttttctttcttttttaagatgtattctcactatgcatcccaggctgacctcaaactcaagacctgcctgcctcagcctccctcccaactgctaggatctggggcgtgtatcccttaggtctctacccttcaaggcaaacctgtggctgctggactgcatcctgagcaggcatcctgtaggagagttgcccagtctcctctggaaacttactggtctcaaagttgaactttgtaaccctcaaatctcaacacttctctcctgggagcccattttaggtaggcagttccctgaccccagttctcctccctgcctcgcccccagcccccagcccccagccctgcccccgacctatgatttatcagactttatacctgagtctccagcgacttgctatcaatcagctttatgcaaatagaaaaggcgaccctacctcaacaagctttgctgccatctgccaggaaattgctacaataaatatgcaaaaggataatgattcaaatgtgaatgccaccctttcaaatcctgcagtacaaaaaaacggcacaaactggggtgtcaatcctgcagtgtgaaatcaccggagctgtcctgaaaccctgcataaaatcatggccccatgaagtcagccttgcctgttcgtagcaattttaaaatctaagcctttcaaccgtgatcagaaactgtggagaggcggtccccaggtagcagcctgtaacaatgacagacttctttctagaactcagccagagcgtggactctagtgtagggcacacaaaagcatccaagttaaggagtgggcacacttgaccatgagggtgctagggcagagaccatgctcaaccagggtggggcagggggtgcaccacacccctctgccttctcactaatcactccagcatcacctccactttctggtaatctacaacacaaatcaaccccaaaacctcatggcagaaatagatgcacatgggtgcattttgtacagaactctgcagttcagagggacttctagctacgactggcctctgctcctcagggccgcagctgggactgcatggaggaggctgggcatctttcacaatagctcctagctgctgagcaagaacccagctgggactgtgggtgaggacctgagctcccaggtggcccgtgggctggctcacaccgtggggatcaaccgtgttgagacatcccagctgactcatggcaaagcagagacaagctgctcccaccaagccccgcccaaaccaagtttctaaacaaaagaaatgactgaggactctagctatgaggtttggggttgttttatagcagctcatcaccagaatgtgtaggctatcacagctccctcgtatgcctcccctcatgctgtgtctaggaaaatgaaaaccgaatctcccaggctgctatactgtttgcaccacaaccgtgaattagactataccggtcagatgtagttgtggaaagtttgtaaggccaaagggaggtatatgccaggcccctgaagcttgtgcttgtgtatgccctaggaagcaagaacatgtagccacagctctgtagcagcagctccaacattggttttctgtctctcaccctcctggttcatgcaggagaccacagttccgctgtctgagtggttcccttggtgaacctcttccagcccttccagtaagtccataaattgttacattacatctctcttcacttaaaagccatagggtggggcatgcatcctaggctgacctgagtcagcatccccaggtgagccccactgttccatctcctatctctctgtccttgcttgcttgctcgttttctctcactgggcactcttgttttctttccatgctgaggatggaaccgaagcctccaatacaatacacttatcaagcactctcagcccgctggtctttcttttagtatttatctatacttgtgccggtgggttatttctctgcccgttgaaatgagccagttcaagccagattagattatatataggcaggtttatttgggtggggaggaagggtggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttcacccccacctccacacacaatccttctttttttttttttttttttttttttttttgctcctccaaaaaaaaatgtctggattgtatagggagtagcctctgggggaagggcagcccagcccctgggctggaaagttcagggttgggggcagggtatgccaggtaggaactgagagatgctgggagaacctgcaggccaggtctgctttgatgtgtaaaacatgcacctaagtccctaaacccaacagtgccaacccaagtttctcatggctgagaaaaaagtccattagctaatgggagacaaggagtgaggactagaaaaggacaccctccggggcctgttgggttgctttcttttgtatgtaaagttttctagaaacacagccatccccatttgattctgtcctgtccagagctggcttcactcaacactgacaatgttgggtgactggttgacccaaaactctgaaaatacttagaattgtctctctgtggattctgtaggcactgtgggtcaagtaccgccgcgttcgggctaagcacttcctgaacatccccgctgtcatggggacttccatctgtcatcactattagtctttttctgctgctttgttttgtttctgtgcaaacaaaacaaagactattctggaactcactctgtagaccagccaggctgtgaactcagagatctgcctgcctctgcctcccttactagtcatgggagtaacaagtaataacttacttgtcagttattactgacaaggaaaccaatttagagagatctgggcccagttgattgagcacatggcgatgctgttagcagggatacaagagccaaaggaacagaaaggactcatggactggtgactggtgaggcacctgcagccccatgtgctgggctgtgccctctcatgtcttgctacatggctaggaagggtttcaaatcaatacagcattgggattcaaagcacagttctgtcaccagctagctgtgtgactctgggcaagctatttgacctctgagcctcttgcttagcttcagggtcctcagttagtaaaggggacttttgaggaaaaaaaaaaagtcctatgtgtaggatatgaaagcagaaatggatagtgtgtggaggtggggtgaggatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaggtcaggacagggcagggtgggagtggggtgggatggggactgggtgaggtgagataggggtgaggtaggaatgagctggggccggggtggcatggggatgaggtagggtggggtaagagtgaggataggagtgaggtggggtgggatggagtagggtggggatgggataggggtggggtgggagatcagca

SEQ ID NO: 1134 - DNA, 3258 bp, Mus musculus
cctgggccccgccgcggacgcgcggagccgcctgggccgcgccggaggagggcggggagaggaccatgtgaatgtgctccggagctgagcgccaagccaagcagtgtttgaaaggaagcaggatgctgatctaatcgtggcaaaaagtcagtccgaccgctggtttcgaagacatgtggtgtatataaagtttgtgatagttggtggaaatttgggagcttggataatgggctgtgtgcaatgtaaggataaagaagcagcgaaactgacagaggagagggacggcagcctgaaccagagctctgggtaccgctatggcacagaccccacccctcagcactaccccagcttcggcgtgacctccatcccgaactacaacaacttccacgcagctgggggccagggactcaccgtctttgggggtgtgaactcctcctctcacactgggaccctacgcacgagaggagggacaggagtgacactgtttgtggcgctttatgactatgaagcacggacggaagatgacctgagttttcacaaaggagaaaaatttcaaatattgaacagctcggaaggagattggtgggaagcccgctccttgacaaccggggaaactggttacattcccagcaattacgtggctccagttgactccatccaggcagaagagtggtactttggaaaacttggccgcaaagatgctgagagacagctcctgtcctttggaaacccaagaggtacctttcttatccgcgagagccaaaccaccaaaggtgcctactcactttccatccgtgattgggatgatatgaaaggggaccacgtcaaacattataaaatccgcaagcttgacaatggtggatactatatcacaacgcgggcccagtttgaaacacttcagcaactggtacagcattactcagagaaagctgatggtttgtgttttaacttaactgtggtttcatcaagttgtaccccacaaacttctggattggctaaagatgcttgggaagttgcacgtgactcgttgtttctggagaagaagctggggcaggggtgtttcgctgaagtgtggcttggtacctggaatggaaatacaaaagtagccataaagacccttaagccaggcaccatgtctccggagtccttcctggaggaggcgcagatcatgaagaagctgaagcatgacaagctggtgcagctctacgcggtcgtgtctgaggagcccatttacatcgtcacggagtacatgagcaaaggaagtttgcttgacttcttaaaagatggtgaaggaagagctctgaagttgccaaaccttgtggacatggcggcacaggttgctgcaggaatggcttacatcgagcgcatgaattatatccacagagatctgcgatcagcaaacattctagtggggaatggactaatttgcaagattgctgactttggattggctcggttgattgaagacaatgaatacacagcaagacaaggtgcgaagtttcccattaagtggacagcccccgaagcggccctgtatggaaggttcacaatcaagtctgacgtatggtcttttggaatcttactcacagagctggtcaccaaaggaagagtgccatacccaggcatgaacaaccgggaggtgctggagcaggtggagagaggctataggatgccctgcccacaggactgcccgatctccctgcacgagctcatgatccactgctggaaaaaggatccggaagagcgcccgaccttcgagtacttgcagggcttcctggaggactactttacggccacagagccccagtatcagcccggtgaaaacctgtgagagcctgcgcttcagacgcctcttcccgaggcctccctacccctccccattagcttccaattctgtagccagctgccccagagcaggagaaccgtccaggatcagattgcatgtgactcttgaagctgaacttccacggccctcattaatgacacttgtcccccagtccgaacctcctctgtgaaccatctgagacagaagcgtgttatttctcagacttggaaatgcattgtatcgatgttatgtcaaaggccaaacctctgttcagtgtaaatagctgctcctgtgccaacaatcccagtgctttccttttttaaaaaagaaaaagcaaatcctatgtgattttaactctgatttcacctgattcaactaaaaaaaaaaaagtattattttccaaaagtggcctctttgtctaaaacaataaaattttttttcatgttttaacaaaaaaatgatcaggacaggtgtttgggttttttttcccttttttatacatatgatatatatgttaacatatgttcctgtacatacaccatgtgggtgctaccatggagactggccagcgtaggccacatagctacaggaccggagtggggattactgcagcgtgatcatgcaagctcacccccttccagcaaaacactggtgtcagcctgcaagccggtggctcattttttgacttctacgaagcatgacgtcctctccatttggactttttaataacctaatcatacctatagattgttcatgtgacttttttcaggtccagggcctagtcacgagttttagtgccagtttttagtccagctcaactgtgattcgtcttgaaacttaggagtgagcattttagcaaaaagcagccagccagttctaccacaagagctgcaagacggagaccacactaacttcctgtataaatatgaatgctgaagggttcaggtgttttccttttatttaataaatcttgtaaccacatttaaatggtctaaacccatagcattggtcatgggcaacctaaacttttctcatgcaactaaaattatgggaaggctaagggtggggggttggtacacgtcccattgtaaaataagtgttttactgtcctgtactgctaatgactgactctccgtgtcaggagtgctccagtgaataactatgcactactttacatttcatgggggtgcacaaaaaaaaaaaggtattacagtttttagttgctgtttgtaccaacctcgaattacgtatgtttaacaacaaatcaattcctattctattgagttttaatactgactagcaattctgaagtcttaattccttttttttgttaatgatttacttgtgagtttacatttttaaattgtttaactttcctaatttagtaattaaaaagagagcattttacatttgaaaaaaaaaaaaaaaaaaaa

SEQ ID NO: 1135 - DNA, 1605 bp, Mus musculus
atgggctgtgtgcaatgtaaggataaagaagcagcgaaactgacagaggagagggacggcagcctgaaccagagctctgggtaccgctatggcacagaccccacccctcagcactaccccagcttcggcgtgacctccatcccgaactacaacaacttccacgcagctgggggccagggactcaccgtctttgggggtgtgaactcctcctctcacactgggaccctacgcacgagaggagggacaggagtgacactgtttgtggcgctttatgactatgaagcacggacggaagatgacctgagttttcacaaaggagaaaaatttcaaatattgaacagctcggaaggagattggtgggaagcccgctccttgacaaccggggaaactggttacattcccagcaattacgtggctccagttgactccatccaggcagaagagtggtactttggaaaacttggccgcaaagatgctgagagacagctcctgtcctttggaaacccaagaggtacctttcttatccgcgagagccaaaccaccaaaggtgcctactcactttccatccgtgattgggatgatatgaaaggggaccacgtcaaacattataaaatccgcaagcttgacaatggtggatactatatcacaacgcgggcccagtttgaaacacttcagcaactggtacagcattactcagagaaagctgatggtttgtgttttaacttaactgtggtttcatcaagttgtaccccacaaacttctggattggctaaagatgcttgggaagttgcacgtgactcgttgtttctggagaagaagctggggcaggggtgtttcgctgaagtgtggcttggtacctggaatggaaatacaaaagtagccataaagacccttaagccaggcaccatgtctccggagtccttcctggaggaggcgcagatcatgaagaagctgaagcatgacaagctggtgcagctctacgcggtcgtgtctgaggagcccatttacatcgtcacggagtacatgagcaaaggaagtttgcttgacttcttaaaagatggtgaaggaagagctctgaagttgccaaaccttgtggacatggcggcacaggttgctgcaggaatggcttacatcgagcgcatgaattatatccacagagatctgcgatcagcaaacattctagtggggaatggactaatttgcaagattgctgactttggattggctcggttgattgaagacaatgaatacacagcaagacaaggtgcgaagtttcccattaagtggacagcccccgaagcggccctgtatggaaggttcacaatcaagtctgacgtatggtcttttggaatcttactcacagagctggtcaccaaaggaagagtgccatacccaggcatgaacaaccgggaggtgctggagcaggtggagagaggctataggatgccctgcccacaggactgcccgatctccctgcacgagctcatgatccactgctggaaaaaggatccggaagagcgcccgaccttcgagtacttgcagggcttcctggaggactactttacggccacagagccccagtatcagcccggtgaaaacctgtga

SEQ ID NO: 1136 - DNA, 78313 bp, Homo sapiens
tctctccctcttaatttttcagttgacaaagtatacttcatcaatgtgtagttgtttcaacttacatacaaattcaatcagtaactgataatattaaagggaactttcttatagaaaaataaaggtgatttattctcattataaaaaaagtacattcttggtatagacaaatctgagaaaaaagacacagagagcaaagaaagaacagttgcccatagtgttatcatctgcacaccaccataatctcagcatgtttccttccaaagagttttctaggcatttgttatatagttgcaatcatgtgatccttcctaatataacatgaacatctttccatattgctgataatttcagtaaatgtaagttttaatttctgcttaacttgtctttatgggcataccttacaatttactttagccattgccctcatgctaaacaactaacaagttttctaatttttcaaatgataaataatacttcatagaacctcttcatgtcatttttttaaaaggcgtgtctttagcacacatttacaggttaaaggacatgccacccccgacaccctttttttttttttttgaggcagtctcactctgtcacccaggctggagtgcagtggcgccatctcagctcactgcaaacctctgctttcctggttcaagcgattctcatgcctcagccactcgagtagctaggtttacaggtgcctgccaccacacccatctaatttttgtatttttagtagagttggggtttcactatgttggctaggctggtcttgaactcctggcctcaagtgatccacccacttcagcctcccaaagtgctggaattacaggtgtgaaccaccacacctggccgagtatgcccatttttaagaattttttatattgccaaattggtttaccaaatggttttacactgatttctggtcttctatcagcaatgtaagagagtcatattcatttcaaggaaacttcatcactattgagtatacttatttttttaatgtgtgaatttagaagtgatacatagtatctcactaatctaaattgtatttctctgattactaccaaaggcaatattctcccatatgtttcacaaattgtttttcctttttttgttgccaatatatgtttctgtttcctaaacttagagtttctcttatctgtataaatttcttatatattgaaatattaatctaagagagttgaaaacatatctccacagaaaaacttgagcatgaatgtttgttgcagtattattcataagagccaaaacgtaaaaacccaaatgtccatcagttgatgaatagataaacaacatctggtatatccatacagtagaatatcttttagccataaaaaggaatgaagtactaatacatgttacatgaatgaacctggagaacattataccaagcaaaggaagccaatcacaaaagaccacatatgatgtgactctgttgatatgaaatgtcaagaataggcaaatccatagagacagaaattagattcgtggttgccaggggctggggagagaagggagtgggtagcgattgcttaatgggcatgggtttctttctggagcaatgaaaatgttctggaattagataatggaaatggtctcctttgtaaatgtactaaaaaccattggactgtgtgcttcaagagggtgaattttatggtatatgaattatatctcactttaaatgaaattttaaaaatattaactacaaggggcttttctatggtccaaaaaggcttgcgggcagggggtggagcctgaaaaaactttacaacctgtgctctaattctttctgaaacctttggcatagatggggttaaaacatatcatccttgttttcatcaccatttcactcttgtcttaaccctgagatccagagcaaaatgaatttaagaagaaaatgttcttactcttttcttggagcctttccatggtttggtgttaaagcctcatttggccatttaggtttgggactggttccagcattcagttgactgcagtcttaaatctcaccactggggtctgatgcttccatttctcttttattgagcgcttttgagtcttcgggctcgagaaatggaaggctatgcagaaaggaaagaacatgtttgttgcagggatgtgagcagctgcctcttagcctgggggccatttgaacaagaaaagccagagatggggacccacaaaaatattctaggtgccagcagtatggcttattcttaaagtaacatgacatttttaagagtgatttatattactttggttcccttgctgtgcggtatgagagaaggttgatcctcttccccctccagagaacctttgcaaagtcatgcgtaaatgatcgaatgggttcaactccacttatttctgaagcaaagcttgggtttgatttttaagtaggctctgttctcccatgattgcatgtggctagtgtctgcattgtgtatattcccacttttacatctatcttctcacctcagagactgtaatattttaatacttgcatttggcgaggggctctccctcacaggcttcaccaagagtagaaagctgttattttgtgcttggtggaggcattatatgtgtatctcagtttatgcagtaaatatgttccagaaagttttgcctgtaaagcaaatcatattttaagtgcaataggaaagctgatttttataccaaggaaaccagtgccaactccttcatggtacttatgaatacccttgccatgactaggaaagatgaggaaattaagggctgcttcagtgtcatcggcccaaatagtcattaatatgccaaaccgcacgaaggaagatggtgactcactgcacctagtatggtccagcatctctacagaatccactgtcttgggggaatggaatgtgcattggggatggaggtgagacctagtccctgaaatcagtgcctccgttagtaatgtgtactagtccattctcacactgctgtgaagaaatacctgagaccgggtaatttataaaggaaagaggtttaattgacttgcagttccgcattgctgggaaggcctcaggaagcttacaattatggcagaaggcaaaggagaagcaggcaccttcttcacagggcggcaggacggagtaagtgcaagcagtggaaatgccagatgcttataaaaccaaccatcagatctcatgagaactcactcactatcacgagaacagcatgagggaactgcccccataattcgattacctccacctggtcctgcccttgacacatggagattatagggattacaatttgaggtgagatttggctggggacacaaccaaaccatatcataatgtgtgagatattgagctctgtggaaccaattcttccctataggatttttccctcaacacctccagccctcacacccacacccttgcatggactggccaggattccatggtcaggaaatagctctagtatagagactctgtgtgttggccatggaatcaggctatctggtttcaaatcccatctctatgactgacatagctgtggacaaattccccaacccctcttttcctcccttgtaaagtgtggggaaatagtaatacctgtgttttagagttgttactagattttaatgggacagcattttgcagagtccagcctgcacctaggctacagggaacactgattggatattggtcatgactgctgaaattggagccatcatccccatggtgcccatcccaccaaaacatgtattagttttctgctgctgcctaacaaagtactacaaacttagtagcttaaaacaacatccatctgttagctcacatttctgtcagtcacaaatccaggcacggaggggattctctgctcagcaaagccgaaatcaaatgttagctgattatgttgttgtttgaaggcttgactagggaggaatccatttccaggttcattcaggttcttgaccgagctgttctcagctctgaccacccatgtgtctggccacatagccccttcatctttaaaggcagctgtggagaatctcccccacaatgaaggcctctctcacttttaatctacttttccaggaactggcataccgttcacgggttcacctgattaggtcaggtccacccaggatgatctctcaaagtcggctgtgccaaataacaacccgatgatggagtgactaccccatcattcataaatcctagggatttgcagggcacatacaccgggagtaggagtcctgggggacagctcagaattctccctaccacaatgtcatttagcaaggcacatattttcactccctccagttggcagcaaagagaggactttcccacattggcagagtcctgcatgctttttttcatagctgggctggggccattggctgaacccagcatcagtgctgaaagtgtttcatccctcaagtattaacatctccagagggccaacccagcagtgactttttctctgcttcagtaccttgggaaatgcttgtgatcccaagagtggccagcatagccctgctttctgtccagcctccccagtcctccctggcccttctgtcccgtctgtccccagaaggcagcactgcctgcactctctcatggggtgtcaggatcatctgatgcagtatgctacagaggagaaaagccccattgtaaaggattgaaaggtgctgggaaattaggaaatttgggtgacagtttctgtggcccaacctcattgctgctgatgtggtactcaactgtctctgaatgtccttctgctcccagtaatgacaggggaaaactaaagaaggctttcctaggctttcaatggattaactctctccactgagaatgtagcaaaagtccccaagtagattcttatgggtgtttctaattttgcgaggatcaagagccctctgccatgaatcttctatcctgaagtcaaataatttcagatgtgtctctgccacatcttatccttttcctaatgctattcctgctgactgaaaaagtgtgtttgcttgataagcttccagtttttgcttttttccgagaaaagtgtgaaaccatgcagttgatctgcagttcagctttaaattcttttttcaactgcccccatctcagttgcttgcatttggtttctaggttcttagttcagttcccttccttgttcttatacttccattatgataccaggaaacatgccacctctaagtacgggccaaatgtggctttacctgtcactctccaaagtctgctggaggctgtcagaagcagggattatgcctaagggctgtcacttcttcacacccacctaggttggcttctgagacaaaagagcatacacccctgaaattaaagttatttgttgtcggtttcacttcctcttcctgccattcctcctctgcctgcaagtgtatgtgtctcaagagaaagtaatttgcttgtgcagaagactgccagtggcctttttcccattttggtacctagctcctgcacacacctgaaatcttatcacacgtcctgcaagcttataacttgggcttactggcattgctttattgattggcacatgacgaaatatgaatgtgtctgtgtttaatgtgcatcttgtagactggactgtggtctgtctacatcaggaggagggagtgtatgttcaaccagactcatcttggatcgaagcaccctgtgcctgtggtagtaaaggattgaatctatcctttaggtcagtttccgtcaatcactacagggctatgtggagaagcatatctcccatagcatggcagcagaaagggctgtgatctgttgataatgtctgccctgcttatgggagcagggtgcggcgttccttgaatcctgtgtccggcaattcttcccaggttgcttaacactattggcacatctgtaaagaaccacaggactagggaaattttaaatagatcaagttttatttgcttagtagaaaaagggcccctccctttgcaaaaggattggagaatagaggcttcacagctgtaatccagacaccttgatcacaggcacaggatccaattggtgaaaatgcccttcaccagtttttctaggcatgataacttgcagaagactatagccatgagttcatggcgtgtggtattttcctgatcagagtaactccagggctccacattcacgatggcatcattcagtgtttcccggtgccccagagatctatagcaagtgaattagtacattctatgtcacgatgcacttacagcattggacattaaagccacagcacataactctgcataataaaggatacttttattttagcatgaatgatcaaaagtttgccttgtagcaaggagcctgggcacactgaatacagctcatgtagcgtcttctgactcttctgtcacgaagcagttagtctgactgccccacgggggagaaagaagaccacaagttcctacataaatattttcattgtgattaacttttaatgacttgaaactgcatttactgatttattttcacttcttcctatgtgtcattgaagagaaaagagtaagcaagatctgtatagaaacattacttaactcagaatgtcaaatgcgtgaagtggtgatggtgctgtctcttctataaaagaggattgttttctccaaaatgattttgattatttttaatttatttatttaactaatatttattgagtgactactgtgtgccaggcactgttctggccacgcaagatgcagcagttaaaaaaaaacaaaaattcctgccttcaaggagctgatgatttttcttctctattacttcataaaattatagataagctgctagttgcttattatagtatatttcttttttaaagtggattttgaaagattattttttcttagtttggttaaatgtaggatcctgttttcttcagggttcttatatggggcttattttgttttgctggagttggaagagtggtttgcaatgagtgttctcattacttccaggttctgtttctctatcacagtgcacaagcttctagagaaaatcagagcacttcatgtcactctttaaaactgcctgcttctacctaacatgcctgttcgcctgaagaaagcatgatgggttgcatgttaatcacatccatgtaagggaaacagctgttaaactgcttcaaagatgtagatataaattctttccttcgtgtaaatcaggatttcttgaccttgacactattaacatttggggccaggtaactcttgtttgtaggaggctgtcctgtgcattgcaggaagttttagcagcattcttggcctctacccagtaggtatcaggagtatccctcccctctgagtgtgacaacccaaaatgtctccagacattgcccaatatgtctcttgcaggggagtggtaaagttacccccagctgagaaccactgctgtaagtgatatgagtctgtgattcaggtctcacattctctaattacagtagatcagtgaaattcatggaaaaaaagaaaaaacatctgggacaagaagtgttttctgtctggtctttgcagaaatgtggagcaactttccaccacgaaagagttaatattatatgagcaagttatcagtctgatgaagcaacatcaacaacaaatgatgaaattcctttagtacatcatgccttggaaatagcttgcatttcctattggaaacttgttaaaatcatatccatttaccataagttacaaagcatgttgggcacggtatactgtaagttaatctcaaatgatttaggagtaaatgtgttccagatttggtgagctcagctcaagcagtaggcgtctcttttccaaacattttcattctcaagaactgacattcaattcaataagtatttattgaaatgtgtaatatgagagagctttagaacagtctgatactgctcccatcacccagtccagcagaaaagcagtgctcagaagagtgcccagggagcactcttctgatatggcacctcctgcattggtttgcaagatagtatagaaaagcatgccttctcctttgctgcctcaagcccttcccatcctgtgccagctgtgccctccccagtgaataaatgttattacacatgatggcatgtgtttcttatgtgattctttggtcccaaatgggctagtttgcggttttggcagggacctccactggcctgttctacctgacccctgttggcttgttggggtattgcaagtccaaagggggaccatttaaccaacttgtatttctgaatcttcttcacttctcacacacataccagtagattttaaaatgcaaggtacactgctgataaaagtcacaggaggggcctgtcacggtggttcacgcctgtaatcccagtactttgggaggccgaggcgggcggatcacctgaggtcaggagttcaagaccagcctgaccaacatggtgaaaccccatctctactaaaaatacaaaaaattagctgggtgtggtggcaggcacctgtaatcccagctacttgtgaggctgaggcagaggttgtagtgagccaagatcgctccactgcactccagcctgggcaacagagtgagactccatctcaaagtcacaggagggatcggctttaatacagagagggtaaaagagaaacataataggctacagaatcttcactcatctggttgctatttattgttccaggcactggcaatgtagctgtgatgaaaacagacagggtcccgctttcctggaacttgcagtccattgggcaatgagacaaataaacaggccctgttttaatatggcgccaagggtgccagaaggagggagatgaggatgccatgggagcacttcagaaagcacaacccagcctggaagggcagggcagtcggagaacgccttgcagaggaagcggtgccttattaactaggacatggatacgtcacatatcaaagaggaaggggaaaaagtgttcaaggttatgttccaaggcccgaagcgggtgggggaatggagtctttgaggatctgagaagttgggcgtgtttgaataggagagccgagacaggaagagtgggaagtaaacaaggaggaggaaatgaggatgcttctcaggatgctgactggagcaactgggacactggtggtcccatttacttagatgaggagcctgggagaagagggtttgaggagggtggggtggcaacaactcgagtttttaatccgccactaactctgtaacatgggaatgatttttttttaatgtttttgaaggatgtcaaaagctaatggaaatttgaaaagttaattagcagctttaagtgatttcattactgtagactatcatgacatcctgcaaatatactctgacctcttaggttctgccgattttatttttcatccagtaactagttcttagttttgatacttagcatcatcttagtgcttaaaattgaccagttttgtgcctgaagatgtggtacccatgagtgaagcagtctagtgacttgattgaaggttgtattctggcttatccaacactcctgtgccctcttccttaaatttcctgtgccctgatggaagtttttattctaatgttgcatagactcattctacagagcatgtattattttttttagatggctaaaggcagaattggtaaatatgattggaccgtctgtaggcaggtgtatgctgttacagaattttacgagatacaggccttattcgaggaaagttgctgcatggtgaacattgtgctccgtgatgatgctgtcatccagaacatatggggaacaaatgcgattgtggggtcaaggaactgaacttcctcctaaccatctccccagccactgcctttcctcatgccccctaataggcctgaaatagccaacagtgagccttgtcaattactcctcgtttactgtagagcaacccagcaactagggagcatcccagcttacgtgcccccttttttgtctttggcaggaatttagataatgggctgtgtgcaatgtaaggataaagaagcaacaaaactgacggaggagagggacggcagcctgaaccagagctctgggtaccgctatggcacagaccccacccctcagcactaccccagcttcggtgtgacctccatccccaactacaacaacttccacgcagccgggggccaaggactcaccgtctttggaggtgtgaactcttcgtctcatacggggaccttgcgtacgagaggaggaacaggtaagcccccaaagtcacagagtgcagagagggggcagccacccttaaatcttttggcaattgaacatctgggttcccatcacttccctttgactaggggtttcacatgtaagtttctaatctgtctcctctactagatgaggggttgtaagaaaagccagagtttgatgtacaaacaaaatgcttggctacagggttgcaaggtgccccaagttgctgctttctgaggattctatatgggttagtgagctacaacattctactgaggcactgtaggtcaatgactctcagcctcacctggctggttggcacagaagaactagggcagccttttcaaaacacggatgcctgagccatgtcccagtcttttgaattagaggctccaggactgggtctgggtgtgtgtattttgagttctctagatattaatgtactccctcttcccactcacttcttcctaatcctcagcctgcctttcttttttttttttttttggaagtttccttgtctttcataccacaaggctatattctgctgccatgtgtatttgctgacttagctaatactttgtaaaatatctggcgtacgttctcagacatatgttttccgaaatatttgtaagttatgtcatgcatccctagtcatccaaattttctctgagtatgtgaaccatggtaactagatatttcacattatttgttccagaattattttgtttattgcaaaagtttgaaagaatgcagcatctctcagttcatctggcagcagatgtcttatataaaagtttgaaagaatccagtatctctcagcccatctggcagcaggtaccttttcacctagggaggaggcactactaaggcattagcaagttttttttccctctgcacccaacacacatcacacatcagtgtagttgtatcaaggagcctgaccctgagcctttggacattatctacttctcttctgctagcatagcacactctgcccagtagaagaagtatttatgttcaccctcatgctgtggtgactctagctttccttttaacccaggccttgcatgggttgaatacgtgctaagtacctttacccatccttcccaccttcccaaaggtgcctgaagagacacagacaggcagtctaaggccatctgtcttctgatgatgcaggagaaaaaaagaggcaaacacaacccccatccttgtgcctaccgtgagaagcataagggctttgccagcccagactgttaattctactgacacagccattgtccttgttcattcattcacgagtgctggatatggacccctgggtctgcaggtatcattcattaaagtcactagagagggccacttgtgttgagcatgtgggtctccaccgtagtcaggaggagtctttgtttaagaggctacctgatcccttataaaatttgaaagttaaaacacagtactcccaaatgttggcagatttttctgccttgagttatttggttttaatatatatgcatgtcctttctcccaatactgccttcagtcctgtaaggccaagaacaacgtctgtgtttctctgtaacctcctttgattctcccctcagctcctggaacatggaacataaaagccctcagtgagaacttgtcagctgatgcaaggagagagtggggtgctggtcttcatgtgccttgccttccacacagtggggctggcttggcttcatttttaaattgtttttaaagaagggaatctggtcatggagtgttaaataagaataggcatgaccttacgggcacccacatttttgttttaagccaatctcttttcttacctttcaaagaaatctaaggaaagaaggaaagttgccaaatgagcctagctttgcatggtcagacctctgaatgctaactctcctgaggaaagtcccacttgggatggggcagaaagacaagccccactcttctctgtggtccttgaatagtgccatgacacatttcttcccttggaactacctacacagcaaattggcagcttggtaaaaaaggtggactctggccgggtgcagtagctcatgcctgtaatcccagcactttggaaggctgaggtgggtggatcacttgagcgcaggagtttgagaccatcctggccaacatggcgaaaccccgtctctactaaaaaatacaaaaaattagccaggcgtggtggtgggcgcctgtaatcccagctactcgggaggctgaggcaggagaagtgcttaaacccgggaggcggaggctgcagtgagccgagatcacgccattgcactccagcttgggcaacaagagtgaatctccatctcaaaagaaaaaaaaaaaagtgggctccctgtcatttctgtaggtcatagcaggcactctgaagtgcagagagaccagaatgaaaaggcagactgcagggaactactattagttatcaactgctgtataacaaattgccacaaaacttagcagcttaaaacaaaacacatttaatttcttttttttttcaatttcagatgttttttattcagaggttcttaaaagaaataaaacagaaaagctaacagtctgatcaaacatacagctcaaaaatgtcttttgacgtttaacaacaagtcctaggaaagaaaactacagagttatcttgaatggggtaaataagttaccactggcaagtctgtggcactagtaaaacaaaaataaaaaattaaatctcggccaggcgcagtggcttacacctgtaatcccagcactttgggaggctgaggcaggcagatcacgatgtcaggagttcaagaccagcctgcccaacatggtgaaaccccgtctctactaaaaatacaaaaaattagctgggcatggtggcaggcacctgtaatctcagctactcgggaggctgaggcaggagaatcacttgaacccgggaggcggaggttgcagtgagctgagattatgccactgcactccagcctgggcgacaagagtgaaactccatctcaaaaaaaaaaaaaaaaaattaactctcttgatcatatagatatctctatatctctttttttcaatcgggtacaaaagatctttcttcataattttttttataatttaatggctatctactatatgatgtttaactaattttttttttaatatacagaggttatgtttcccaaatcttacccagacgagtatggcacttagttagacatttctggcaacagatttcccctcccctctaaccaaactatcaaatttctgccttaactaatgcagaagtatcaactagtgggagacccaggtttataactgtactaggtacacagagggtgctgcgttcagcctgggctttcacaaagcagtaatattccagggagcatagaaccagtgataccgtgacttttaaaaaataaaacaaaaacaaatttatcttatgactatgtaattttcactagaatctacacttctcagagcagccaggactttggaaactatgaaatgtcactgacatttatcatcaaatacaagcataaaatgtaagaactaaaaaatactcaaaagaaataactgcttagccctagcttctgagctaggaggatttgggctgtggaaacagggagggccagcaacctgtcccagcacaaaagaaaatagactctgaggtagataactgatcatacacagctgaccagacaagtacacagttttggaaggcaacttaatttaccattgcttttaagacatatgcaattgccttaataaaagagctttaataacagtgtattatcttatatgtactaaagtagaaataactgtgtatttatgaatcaggaatttcatagtttcaaaactggttttctttacacttgaacacttgtagtgatgacataaagtgtggcaccgcttggatccaaatcttccttcatgcttttttgtttatgtgtgtccatacatcaattaaaattataaaacctaaatttacagtttctgtgggtcaggaatctgcgaatggtcagttcggtccttcagaatctctcacaggctgtaatcaaggtacgttggctgggctatagtcatctcacagtttagctgagaatgatctgcttccaaactcatgtagtgctggcaggattcggtgcctcgctggctgttggccagaggccaccctcagttcttggtcacatgggcctcaccagcatggcgccttgcttcatcaaagtacacaagctgaagtggcaatagagagagtctgctagaaagacggaagtcaccatcttttgaagcctagtcacttaagggactgcacattctgttgagtagaagcaagtcgttagatccagcccacactcaaggggaggggcttgcacgagactgaatactaggaggcaggagtcactggggactatgctagaattatgcctgttgggttgggcacagtaggtcacacctataatcccagcactttgggaggccaagccagggggatcacttgcacccaggaattcgagaccagcctgggcaacatagtgagacccccgtctctatttgaaaaaaaaaaaagaattatgcctaattatatggaggaaatcctaggccaaatgacactggatattctctgctgctgctagcaaacttctgtaaaccaggaagggcctctctagagagccagatgagaggacatagggtgggtgtgaggaagagtgagtgctacaagacagtgtgaggagaggtgagttcaaggtagggggaggacaagggagagggttccattttcagcagtggggcgagcagcacaaaactgcaaaatgaactgcagatgccaagggcagtacatcctctaattggggtgaatattacagaaacggtcttctctaaatttccccaagctgcaggaggcatttcctattacgttctatgttactgttttaccaggagaaagggtggtgcattttacccagaaactaacataggctccaagtggaggagaagatacgaccagcaaaggatgtcagtaactgctgcagagccctgcaaacctgaaccctgacgctgacgctgcccttttgtttgggatgcaattttaatatttccctgctcctcagccctcattaaaagctattacagaaagaagcccttcaggtctaggtttctttcagatacagtaaggcttcccctacaaagaccaaggcataaacacagccctgtgactgtggttttgacacgttaattacaacacttcatcatgttattagtgctggctagatgtagattgtgagaatgagattttagtgaagatttaatttcttggaattaatttccccttgtgtaataatctcccttcttgtgaatttcgtttcggcaggagtgacactctttgtggccctttatgactatgaagcacggacagaagatgacctgagttttcacaaaggagaaaaatttcaaatattgaacagctcgtaagtttggagagggaggagaagcatgtatacctttcaggttgggaaggggtcttgcatttctggtctgcatctcttcagatgtctgaaatgctaaaagaacatttgctaaattcactggtttacaacaatatactttgagaaaaagaagagtcagtgacacagtgcagtattttatggcactgtgtgtccaaggagatttttggagagtaccaaaaatactagcacagtccatgtttattggttttggtttaggtttaaaggttgtaaaatcaccagcatcgctctccacagccctgagtgtttctacaaacctacagtttcaagtgattggcacaagccttggctacccacgtttcgtgctctctgccttgagattttcttcacatttcagatgttacactagctaagccctcacttgaggcttgcaacaagttctttattttataaactgctaaacatttctttggtgaagcctgtggaggcgtttccctataacaaaaatttgggagtgactggaatcttttggagctagaagaagtgatttcacccactcttgaatgaatatgctgcatggttgtttaatgttggccaggaggaacaacagttaaacaagcagtggggagatttcaagagtgaggatcactcacttttcaaatcctacattcagtacctccataagaagagtaaacacgggtcagattttcttagggtttataaatactgcctctattagattgaggcagtgtatgtggatgaggcccttcagaaaaaaatctaggttctgaagaaagtgtgggggggtggggttccacatcagcaagccaggcatctccagcgtccctatgagtgctcccggtggttgggaaagaatgccacccaggggctgaggggcacaccaggaagttcttctatgccaccaagtctggttgcttctcctctgctctctgagcaaatcagattccatgttggcagaaggacttggagccaggctcctcagctttcccagaaggatatgccagagggagtaagaggcagccctggtcacactgcacatcccaggaaagaggagtgctgattgccacagggacctccttcaggcctgaaaactgcctccttggaaagcccacccttttcttgaatgccccctggctcacagaaccatgcagtgagaatatgccgcctttcaacagcaagaactgaatactgccataaagggccaacgactctcttcgagacatcagaaggcacagtctacatagccacagggttttcaaacatatattaggattgtcatcattaacaaaggtgtggggtggtgtttttttaactttttgttggaacacatgcagaaaagtgcacgtatcaaaagtgtacacagtgatgttgcacaacagtgtgaacgtacttactgccgctcaactgtacacttaaaaatgattaaaatgataaattttatgttgcctatattttaccacaattttcaaaaagtatacagtttgctgaattttcacaagctgaacatgcctgtgtggccaccagccaggtcaagaagagtgttacctgccccccaggagtcctcctcctgtagccacaggaagtttttaaaaaataataaacagctaccattcattgaaggctcctgatgtaccagccatgagctaagttacaaacattctcatgcattcttccactactgtctgaggtatgcatcgacgtcatcgtttgatatctgaggagccagaggcccagattaggaaactgccccagagcacagagctggcaggtggcagagcccagggcgaggtgcagggaggcatcctgagaacagtgtcaggtttgatctgggaaaggcccagatactttatcaaaggggatgggaaccttcaagtgacaggaagctttggagagttgactggggctggggaggaggggattgggctttgatctctctgggtatacctccttgctgttattttgctgcttgttggagtccattaactttgaattctgaaatcctccgccccttagcctcccctacatgccaaggttgattagaaatttcaagactatttgtaaactttcaactgcaagaaccaaggaatagtaagagtgcagacccagctctcaggaggctttgtccacactgcacgtgcgtctgtgcattacgctggagggcgttggaaagtcagtccctgccagtgtcagtcccatggcttcttcctttgttaatctggaaacgatctgcagtgtcaccaaattgaaattttagagaaacacttaaggaggatccaatccgtctcaatctctattttgtgacttccatgcacggcctttgatgtttacggagtcctttgagcctccaaccctgttcttgtagaggaaaatattacaaaggttctcttcctcttaatgttcttcctttctgccaatggaattccatatcagtggaattttaaaattccctttctcaaggttatagaaaagaaaaataaggtttgtgtaacaagacaatatcctgaagtcaagggtaataacagggaagagaaaatcgtgaaggaaaaacaaagcaataatacagaagcagatggcacacggctcctcccctcccccatcctctcccgcctctggctctggtcctcagaggagagggaggaatggggctctgttctgccagggcagctgccacacctcctagtgtgtgtcctcccactcccttccctggtggagccctggtggcgctggaggccacagggctggctttgttaaagtacaacatacaccgtgggatgtgcatgtatgtatgtacccagaggcggtgttcctgctacccagcaaggggcaaaggtgcttcattgacccgttgtaagtgctcagtgtcatgtattaggacattattaaatttgaaccccttttgcaaagtatttaagttcatccattttattccttgttttcacatttcaagactagtcgtttaccatctacgaacagtgactctttaaaatgtaatacatgttttacacagagtggagtattggtcacagctgagggtaggtttgttgttttttttttcctattgtgataaaaagaaatcctggtttagagccccacccaagcatttgataaaattgttaccgacataaaatgctacactactgagcagatcaaggctgacttctgttggcaaataactactccctggctccaaggctctagggctcccagctccggggcccacaagcctacgagcaactttggggtttgggggtagacacttttcttggtgtggggtgtggtgggggcacagaatcttttagcaagtctttaaatcagaggaacagagacagctgttataaaaccttaaaagccattctaaaccagcgccaggctttaaatcatatatttgaattagagcaagataacaaagaatatctcaccaagtgcaaactgaaaaatctgaactataagaaccgtttaaagaaatacagctttaacaatgctaattacccacagtaactcaagaaataaaagataacatagtagagatcctattttcctaaatcaacatgaatatagagtatatctatttataggtgaattggtgcttctagtgtatcaaaaagatgacttaattcactcgctcaacggctctcaatgaatattttgagtctgtaccagcctctctaggctcaacatgtgaggtttactacataataaacattgaatctttgtcactttatgtctcctttgatgaagaagatgaccctagaaagcctagaaaaagagaaatcaaggattttatctttctcatgagtagctgaaaacccttgtgagattaatagggtcaagtgagaaaatcatgaattcctgattcatgacttcagaatgagctgataattgcattctgatctgtgctacactatttaggtacctagaccaaaatgagatagttaatgctagatttgaattggaaatgacttcattaatgccagatcacctgaataaggctgggcttgtcccaacctgcagcaaaatgtattggcttcccgcccctattgacagtctcagataccctaaaattgatgctagccatttttttcttaatttaattcaattagaactaacttgatgaaggttatcttgcattaaaaaacaataagcctctgctacaagcacttaattttttcctcgccattttggagcatttcccaggctgggcgggagagggtggagggggaggagctgggtattgttatttttaatgatgaaatgtctccatctagtggaacttcagagcagtaaaccttgtcactatattaaagtgaagattatgtctccaaagccattttccttaaacacatacagtgtttaaagaaaaaaataaacttccacatatgttcttagatgatatccttacaactgtatgtattccttttggaaggcatagaaatgagaccagtacaaactgttaacatttttaatgtcatgatttgaacctcaaagagaggggtgcttacaataggggagcagcacagtgcagatcccacccagttggtaacgatctagctcttaagttgggcagtgggttcacggggttcatatatactgtacctatattcttcagtatgtataaatatttcctaacaaagatctagacatgaactaaatttaagattatgaataaatctagacatgaactaaattttatgaataaagaactttctgaatatgagtactgtacttttgctggatttgtaatagggtaaaaaggagagattaggaaactaaattaaagcataaggttttaaaaacctttgctggcaccttggttttttttgtgggctattctgttacttatgccaccaaacattttcccacagcagcacccccagcacatgctggctggtcacctttgttctgttgctctattaaatcctatctggaggcgttgctcactgctcaccttgctcagagagtccagctttagagagcggcctctggagtaatgcttgagtttaatgtggaggctgattattctctacctgattaaatctgtctggggagcatctttaccatggccagaagctaacacattttttttttcccctggctgaaagctttgacacagaactcagccaaaagaacgatttttttttaaaatgcctgaagttttgcttgctgcctccaaggaccaaaaaaggaggaaaagaaggtcctgagccccaggagatcagatttgctgggaggtctgatttgcttgagggcaatcatgtcgttgactgcaggctggtggaaggttctgcagatactcagtggatgtcagagccgcagcgccacatccatggcctccccgatgttaatgggaagaggtacacactccattcctgctcttcatcacaggtagccctgtttgaatctaagcagatgaatttgaactgcttaatgtactcactggctttaagatgagagtagctacaagatcccctttcacctcctctgagagctccccagattgataccacactgctgtgctgtggcatggagcctaaggcagtacaaagtggcgtgactaaaaatctcactcccttgccgagtttctgtgcttcacctgtgcgagcacacgcagccattcccatcctcaccccttgcccatgagcctcaggccagtgctctggacatttgatggaatcacttcagactgaaaatgcctggggaaggtgatcctactgtagcatcattctacctgcagagaggtgtctccccatctttttgagagcaagccaggcacgtgtttagagcatgccttcatccctcatcagacctcctaacctcccaatgttaagatgttaacatttctaatgtcatgatttgaacttgaaagagaggggtgcttacaatagggaagcagtactgtgcagctcatattgacctcagacctcctaaaaagcttcccttcccagatgatctgcagctaacatgttctgcttaattaggctgaggctggattccttttccatccatccaagttaaggacactaaccaagcaaaatgccccctaccaagagagacttctcatggccaggattccacattcttaattcacaaataaggcaagagacaactgtgggttcatctcatggctgactcgaactggaaccttctgaccttcacagggggactatgttggagttcagagtaaaggaataggttggagaaatcgggtggcaggatgattaggtgacagttatacacttcagaccacagtgagtctctaactgcaagctgttgaaatggtcaacatatttacttttcttttttatttacagggaaggagattggtgggaagcccgctccttgacaactggagagacaggttacattcccagcaattatgtggctccagttgactctatccaggcagaagagtatgtttcattttgttttcacttaactacttgattttaaaagttgattgccgcaataaaatgccatcagcattgggcaggagggagaagaaattcacagcagtgattaaggctgagtttttcaggctttctgccccggtttttaccctgtgtaatacttgcactattattaacttaatgtttctcttgaagcctgctcacttattttgaaagaaaactttctatcaataccctaaatgaaaagccagtaaaacttgtcatagattaaaagtagccataaaaatatgaaatgctagctagagcatatattattgccaacccaagtttctaagcccgcagtccactccctctgttgggaagagaggggagagtagcaagtaattgccacagattaaactaagatttttctcctaagtgtgatcagaaatattaaaagagtgctgaaaagacaccttctatgcccggtaaaagtgactcacatacagtgtgtccccccaacttgggaaatactacagtgatttggaacctcagttggcttctttggtagtaaacagtgacgagcagttatttggcccaactattcaactggtagcagtttaggaaggtgttcagtaggctgaagggatctaaaagggataacctttctcccttcttctgacccatgaggattaacaggcactcccaaggggaagaactgccagtggctgtttgccagccctgagggaaggagagatggagccatgatttcccaaatgcaggaacttggcctcctcctgacaccttgggtcttgcctctctaaaaaggaagttgagaaaagtcagtcaccaagcccaacctttggctctgctatttaatttcaccatggatttgtttaagtagtgcaagagggattagactccacaccctagccaaatccccagttggattgttctattctttaattcctttgtatttcctctaagaggatctgttttgtttcccactctcaaatactcagtggttcttagttgtttctttctcctagtgactgtgtttcgtcatcagtgaatcaaggtatttgtatttaatttgtattttagggcagatttgcaaacatctttgtgttctttcagaataaaaagtaccaccaaaatgtagcattaccctgatttaactgggaatttgtcagctatatatttaagttatttttataatggtcaactttttaaatattttgtttttaaagaatattattttttaaaataatgccttcggttttacatatgcaattaactatcattatcttaaaatactattgttttggtgcaatccattgttctaacaattcctttttcaccactgttttacacggcattctaattgggttattggtacaaacccagaaagccatttctcacaaataattgacgtactagtctttacgccacctaatgctagattaagaattgttgcacattttggtgtttctaaaagtcactgaggagctaatacgcaatgtctcttttcttcagtgaaacttaattcacaaaagaatttgacagtgaactcatgatacctatattcaagcataatgaattgaaatttcattttagaatctggattctttcacagttaaatattctaaaaatggttcccacacacagattccaattgaatgctccagcattctcccttgggttttgggggcacctgctgctcattcagcacctagtgctgaaatagtaactaattgccaggcttggttaaggcttgaaagtgcagggggaggatataaggcaaataacaaaagtcttgaggtgacttaatgtgatgcctcctaaagtggcacagagtatcattagtttcttcagggataatatattgaaatatctgcaacaccaagtcattttaagggcatgctttttgactgggcacagatctcaaaggtgtacagtaaccagttcttacagttgtgccaaagaaaagatgtacagggtccaccgtgatggctccctcctgtaatcccagcacttgggaggccagggcgagaggatcacttgagcccaggagtttgagaccatgctgggcaacatagggagacagtctcactctgtccccaggctagagtgcagtggccctgtctcggctcactgcaacctccacatccctggttcaagcaattctcgtgccccagcctcccgaatagctgagattacaggcacatgccaccatgcccagctaatttttgtattttcagtagagttgggatttcaccatgttggccagggtggcctcgaactccagacctcaggtgatctgcctgcctcagcctcccaaagtgctggaattacaatcatgagccaccactcttagcctctacaaaaaaaatttttttagttagcaggtgtggtgatgtgcacctttagtcccaggaggctgaggtaggaagattgcttgagcctggagaggtcaaggctgcagtgagctatgattatgccactgcactccagcctgggtgacagagtgagaccctgtctcaagaaaaaaaaaaaaaaaagaagaagaagatgatgaacacagatcacaatccaggtgcttggtaaataaatgcctttacttatccaagtcctcacacacctaggggaggaaaacaaaatacaagtaagtactcatgggcgtttttctcagaattcttatagggaggaagttattgaaaatactattcctttattcatatcatatctatctaatctgactttttttaatgcttgattatcttcatatacattaagactgtgttttgttatttcccagcagttacaataatgcttagatatcaagagattcaagagttttgtttttttgtttattttttgttatgagacagagtctcgctctgttgcccaggctggagtgcagtggcgcaatcctggctcactgcaacctccaccttccagattcaagcaattctcctgcctcagcctcctgagtagctgggattacaggtgcatgccaccacacccagctaattttttgtatttttagtggagatggggtttcaccatgatagccagcattgtctccatctcctgacttcatgatccacccaccttggcctcccaaagtgctaggattacaggcatgagccaccatgcctggcgtttgttttttttgttttgttttgttttgagacacggctttgctctgtcacccaggctggaatactatggcacaatctcagctcactgcagcctgggcctcccaggttcaagtgattctcctgcctcagcctcccgagtacctgggattacaggtgcccaccaccacaccaagctaatttttgtatttttagtagagctggggtttcaccatgttggccaggctgatctcaaactcctgacctcaggtgatctgcccacctcggcctcccaaagtgctgggattacaggtatgagccaccatgcccagactagagtcttttagataagtgtggaaagggtctcctgcagtaaccatttcaaatcaaggtcttagatttctggttttttgcatacaggtggcagttttaacacaaaccagttctggtcatgtctagaggggaggaaaacaacccacaactcaaatctgattttttttaaagagtgaaagagatgaattagggatagaatccaggatagattgaaaaggaactgaattaagctagaaaaaaaatacatccagggaaaggttaaggactaaattggaggagaggggaattcatgggcaaaaaaaaagcctatgctgttgcattttgtaaatgactatttcaaaatattttctttccttgatctaatttaaaggtggtactttggaaaacttggccgaaaagatgctgagcgacagctattgtcctttggaaacccaagaggtacctttcttatccgcgagagtgaaaccaccaaaggtaagataacgagttgaagaagttggcttgtcattcaaatctgtggattagtcagaggggatgaaaggcttatctctaatgtacaaggattttaaaatggcacataccctccctgccttgtgagtggagtcctgttttcagtcttccctccaggctctaaaactgcagacagcaccaaaagaactacagaggccccaaatcaagaccttcctcctgaaacgggctggatgcagctacactgctccaggcacacaagatcgtagaattttcagaagtcctttagaattttgattttctgaaatcttagttcctcaggtgccagtcatacaggttgtttttgctttccttttgttttttaaataactgaggacttcacttctcttcctccaactgttggacttttcattatttaacaactccttacaacccacaagaggagacaggtcaaggaagaaaagagtagtggcctctagcttaatttgccagattatccattcctgtaaaaagtgttgtaaagcagaagcttgaagctcacttctagagaaacaagccttagatttcttttgcacatgctgctgctacctcccagtatgcccctgggtagagaagacaagggaagcaagctcagccattcatcgtggtccttctttacccttgggggaaaggagtgttggaattgagtctacgctgtattatgcaacaaggggtaccgaacagtgtgtttaagaaaaatgtccaggaagctttcagtctcaagggcagaatcattttattgctaatatattctgacatttgcagaacatcaagaagcatcttcttcctgttactgagtggagatgctgtgtgtgtgtacatgtgtgtgtgcatccttggtaattattaatcagagtcaagaaaatgaggcctaaaaagcaagctgatactctaaatgattggagctgctaatgctttccacgtttaccaggtgcctattcactttctatccgtgattgggatgatatgaaaggagaccatgtcaaacattataaaattcgcaaacttgacaatggtggatactacattaccacccgggcccagtttgaaacacttcagcagcttgtacaacattactcaggtaaccttaattctaactacctactaaccatttggatgctggagggagtggataggcccagagcaggaaagtggaaaggggtaaaactaatatgtacaaaatcacttatagagtatgttttctttgccagcccttaatggtagggcttggctgtataggttctattgctattgttctactgttgttattattagttccacatgtttgtccgaagattctataatatttttgtttcccaagtagaaagcaataggttaaattttaaaagttgtttgttttttcatcttcaagttgtcttttcccattccccgcgttgcatgtgagaaagcagtctctcggagggcgcttacatggggactcctacaaggaatattgtgtttccactatcactttaccctcagcactgttgcaggaatagctgcacgtacatttcattctcatgcaagccatttatcatgttccccaccaatactgctgtttcctaactaggcttagacttacacaacccacagctcttagatctattatgtctattgtgttaaattaaacttttataatgtacatcagtttctgtcctaacacccagatatcaccattattttgttctttctgaaaacatataattattagatatgcagtttatacattttatcaaagactggttttatgtgcaattgttaaaatgattgctttctttcctagattagcaagtattatatgccactatataatacatgttcacatgtgcctatagatataggtgcacatgtatagacacatgtctatatcctattaagcctagagatatttttttgtgtgacccatttctccattttctattgttctccaggacaaaggcaagactcaaaaatagtatatgatttacctctactattgctctgtgcacaatcattgaaatatgtatgtataatttttggcatgaaaaagcaatctttcgaaaatgacaataagaaatgtctgttgatcccttgcactaatgaacaatagaaaatattaacagcacttgcagtactagttgattatggcattggctaactcggtttatgtggattctaatgaaacatttgggagaaatggaacaaaatatctccctgagcttaagtgatatactcaaaatgcctgcatgttgtaaggatttttcaaatgctgaaatatatttcattacagccaaacatcagcaggatccccagggtttggatcatttgaaaatactgtgttcgaaagggcaccttaataacattgtaaagctggaaggaaagaggggatatgaacaatagacactttttttaatctcggggaaaaaaaatccatctcacgttagacttgtttttatattggctttccctcttccctctttctctctcacacaataaaatgcctttgaaatgctgacacataaataatttcctacctaaacatctcagagcctgattccatcaaaaagaaaggagtaaaaagcaagttacagcccagcagcacatctgctttccctgggtccgggggctgccaggagggagcgggaggtctgtccacctcacaaggcaggctctgtcagcttttgtcactccctgatttcttattctttgttaccttttttcgcctgactgatttttacttggcatttaagttccccttagcactgccagattctaaaaggttatattctttttaaaaaagaagagaaagaaagaaggaaagaagacaaagaaagaataaaaacctccgagtgttaactactttttcctttcttcttttttttataaagaatacattctttcacatcttgaatttctgtgaattttagtttccattctttctcctttcaaaccagacacctaaattatacgtcgaagactgttaaaaagttgtttttttttttttaatggaaaatatccaagaagcagcccaggagtatctgacatggtggaatggaatcagttagaaagcgaagaaatcactaaaaaaagttacttctttttttccccaccagttataatcttcaaccttactagtttataacagtttaatgtcctatagaaggatcctccactaaagttataattttaagtatagtcatatagagagatccctaatcccctgggtaatctagatactaaaggtggggaagaacagtcatattgacattctttaatccaaaaccactgtttgaaattagtaaggatattttcagcattcccaaaaacatgttattagcacgttgagctgaaaacgtttttcttcctcagtgagtacagaaaccaaagcagtctgcgtgtatgtctatgtatagactgtatcgtacctgggctcatggagtagtctaaatttaaaacgtcctctcttctacctccaatgaaaatgtttccgtgtgtggcgtctgatcttccaccgtgtgtgtggtcgtctgctggtgtagcgctgtttaaggagcgctgtgtgctgctagtgttccacgatgtgtgtggtcgtctgctggtgtagtagcactgtttgaggagcactgtgcgccgctagtgtgggtttacacttatgagtgttgtcattacatgtgttctgctcttctctccctctcctgcccctgccctgctccatcagagagagctgcaggtctctgctgccgcctagtagttccctgtcacaaagggatgccaaggcttaccgatctgtctgtcaaaaccaaagatgtctgggaaatccctcgagaatccctgcagttgatcaagagactgggaaatgggcagtttggggaagtatggatgggtatgctgagactcaattactctcttattagcttccccgtttggaagatcccaaacaccaaagatggaaggtgaaaataaagactgcgtgaccgggaagaaagtttgaattactaatagtggggaataataatttcagttttggttttaacattctggaattcctaaaaaaaaaaaaaaaaaaaaaaaaagatagtaagtgggcaaaattggcaaatggctcaagttgtactattacatgactctcaattcataaaccagcaaatggtccaaggaatgttccagctgccataaaatatcttgctcttcatttccaaaagcaaatatttgttgagtgtcatcctaacgggcaagtcaccttccatctttcctagtgcatgcataattatggattataaggactgtgttttctttattaattccctttcctgtagagaaagctgatggtttgtgttttaacttaactgtgattgcatcgagttgtaccccacaaacttctggattggctaaagatgcttgggaagttgcacgtcgttcgttgtgtctggagaagaagctgggtcaggggtgtttcgctgaagtgtggcttggtaaggcagagggcacattttgttttggctgcatctcaaagccgattaaaaggatggttttgaacaaaaatgcacacacagccgttgggacaaagacacttaacctggataactagacgggcacaggccatccagattttcagaatatgctgataccttgctgtgctcatctgtcctacttcatgtggttaattaaggcacccgcagaacaggaaaccagtacactatgaatctggtgtttcctcttcctaagaaatgggaaggtaagatactgtatatgggcagccataagaaagaccatgggcgttttgctcaatgggcctgggtttgaatccttactagctaattaaccacgaacaaggggcatatttaactcctttaagcctcagttttttcatctgtaaaattggaatgatacctttttgttgttgttgagacggagtcttgctctatcactaggctggagtgcaatggcgcgatattggctcactgcaacctccacctcccaggttcgagtgattctcctgcctcagcctcccgagtagctgggattacaggtgcctgccaccacgcccagctaatttttgtatttttagtagagacggagtttcaccatgttggccagaatggtctcgatctcctgacctggtggtctgccagcttcatcctcccaaagtgctgggattacaggcgtgagccaccacgcccggctggaatgatacttatttaaaggattatttttaggattacatgggttaatatgtttaaagtcccttgcagatagtagatattcagtagagatacatacttctctttatttgattgtcattgataaggctggctgcactgggcctttgtaatttcttttatagcccttttgggtcagttacagctttgcttagaaacaattcatgggtttaggccccactcaaaaacatgtttcagtaaaacaatattaatacttatggaatcctctatcttccttcctcagaactcattaaaaacaatatcgatcagtaccctttgctacgtgtgggtatagatctttaggtgtggtctgcattaaaagagttaatacaggtggccgggcacagtggctcacacctgtaatcccagcactttgggaggccaaggcaggcagatcacctgaggtcaggagtttgagaccagcctgaccagcatggagaaaccctgcctctactaaaaatacaaaattagccgggcatggtggtgcatgcctgtaatcccagctactcaggaggctgaggcaggagaatcacttgaacctgggaggtggaggttgcggtgagcggagatcgcaccattgcactccagcctgggcaacaaaagcgaaactccgtctcaagaaaaggaaaaaaaaggagttaatacagttaaagcacttaaaacatagcccagcaaatgataagtactacaaagatgtatgtaggtatgttaggtggataaataggtagtagacagacatacacatatatatgtatgagttagctagtttaataaatccacattattgtgtccatctctctctggacttaatctcaagtatcgtaaaatatatgacctccttcttcctcattcaccctctaataatagaggattttagtcaaattactcacacaatcacagagaattggaccctattagaaaatttattttcaaattttacaaatatcaactttaaatcattacatatactgttcacattttgttttccaataaacacaagacaacatgcccatcagaattgggatggatgtctgtgtaattgacgaagtttgtattacagaggaagatcttaatgtatttagaattttgggtgctgactcttaaatagcaaagatcacttataaattgtcaaatttcccatgaatgcttagtgggcagatattttatgaagtttaaatgaacttttctttaagccacttgttttttcataatttatattttgtaggttgcatgttgtaattgtatgaaccatgtctttaacaggataataagaactccaatttacagaatccttaaattccaaagtcagttatattaaatataaaaatcttaatttaaaccagtcttctttttcaaatagaaaataatctaaattagcagatttcttcccctttataaagttattcttaagcatcataggtctaataatggaatacacaaagaacctaggtatggttttgttttttgaatgctggggctgaaagagacccaaaagataatccagttccattcctatattttacagatgaggtaactgaggacaatcataatccaggccttgccttcagatttgctagatttttttttaacatgctaaatttaaatatttctgttccctctcagctgctgtttaatttcccctgtctacctacctgacagaagccattgttcttgtggctagccatcagtaaagctgaggaaatttgccttaccttgttgaagtattggcaagcagactgtgagctccttgccagtgcttatcagcatgcttggcacacctgtgcaaggactcagtcaagtaacttgtccattgcagacattgaaagtctagaggtaatttccagacatcctcatgtggtgccatatttttaaatggcacaccccataaacttaaataatctaatttcttccatgcacactgtactccctaagggacagctattagatggccaggcctgttccaacccctggactttcatcactgtatggtgcagagcttttggtataaatgtgtaatcatatgactgagccaaaaaaagagagagtggtaatatatcaaaatttaaaaaaattttaatgagttataaatcttaatatagccatcttagccataaccacaaataaactcattttttctgttaaaatacttgacagagtccttgcaattgaatgtctttgttcaacaaaaactgtattaagtgttttaaatttaaaatctaatcttatgcaaatagctggtggtcaaaacctttttccatcaaaagaagatctttggtttgacttcatattctgggatgtttgtaggtacctggaatggaaacacaaaagtagccataaagactcttaaaccaggcacaatgtcccccgaatcattccttgaggaagcgcagatcatgaagaagctgaagcacgacaagctggtccagctctatgcagtggtgtctgaggagcccatctacatcgtcaccgagtatatgaacaaaggttgggcaacacctctcctgtctccagctcacagtgccttaaggggttgtttaggggagagaaatggaagtttcctacttgctacttttctagtttctgcctgggtcaagtattcccattaggaaccaccagttatgtgctcgttaatgaaaacattttttaaaacagactaaccttgcgtttaccccaccccaaatccttatgaaatgccaaatactttttacatgttatgtgtgtcagaaattcaagctcctctccataattaaaacattcatttttaatatcagggtggtacggagggttatgatagtttgctgttattttgaatgtagtagcttttgttacatttcctttttgcagggctaaacaattaatatcagacactggtctctaagctaagtttagtctccatcatttcaacatcttttttatttccagctctcttcttaaacgtcaggcgatgaaattacatgctttcagagaccacatttattctcacattctctcccctacaacccctctgtcttcctaatcaaaccagcattgttagggataaggccagagatcattttgttttggaaaaatagatgaaccaaacaagaaacagccttaaaaggcaatacattgtttatcagaggataccagtgtaatttttcttttccatgtactttcttttaaaatttaatgggaatttttttttctggcaaacggtttgtcctttgtatccagggttattttgtaaataactttgtgattaaagcataaaatatcactgatgaccatcataagcctccagcttctgcaaatgattatccctgctttggtgttagttctaagccttcttaggctgtgttataatagtggctctgaagcttccaatgtttcatttcagatgtctgatttaaggcttggctggctgtgatctaattaaggggaaccatctgccccacccatattcttcagattgtcttttcttgattcaaaatctgtaaataagctaagctagtgagtctcaaactttaccttgtattattagaatcacctgtaggccttcttaaaacccaagtttctggacccaaccttcaaagtttctgatttactcgatctgggatgggacctgagaatttgcatatctaacaagttcccttgtgttattgtagctgctggtcccaggaccacagttttggaccactcagctgggctgtattttccccacatcaattctttgtgcaggggtgattggggaatgggattgaagaggtgcagttcttcataggttcctctttatgacatacagggagattgagtcccatttcttctagttttatcaaatatatgttgttattcctagaaatggaattaatgctgtttgtttttaaaaggtaactgttacttctccatgcctatacttttttctaccctgcttttttatataaacctttttgtccccccatgtggatggcattattccatttgactaccttattacttttaataagaaaaccaaatacagctctctgttgggaattatctttcaaagtaaattgaaatgattttatgttttgttcataggaagtttactggatttcttaaaagatggagaaggaagagctctgaaattaccaaatcttgtggacatggcagcacaggtaggccctgcagggtaacttgatgtgccatagatttaatgacgtgtctaagtacattgggtcgtggtgtaacatgtcctgttccctgggtttccacaggtggctgcaggaatggcttacatcgagcgcatgaattatatccatagagatctgcgatcagcaaacattctagtggggaatggactcatatgcaagattgctgacttcggattggcccgattgatagaagacaatgagtacacagcaagacaaggtgggcacttgaatgacaatggctcgtgatcacagctgtgagaacagtcacttactgcacagcccttccttcctccttcccttcccttccttcagaaaatacttgaaatgtcattcttcagcttggtttggacaccttgatctggcaggaatttgacagctctgcaggtgggagactgttgtgggcccagtggagggatgagatattggtttttggtgggtgggtgggtattggtatttgctgctgtggtcctcttggctcatgctggtctcctcacagcgtccaggcctagaatactctgtttttggagaaagagaccacatttattctcacattctcacatgcctgtgttttttacaaaggcacaggcagggtttcagaaagccaacagggcatggtgcagtgtctcagagcttgtaacagcaacagaactaaggcctcaaaggtaagggggcagagaagtgggcacaagaagtcagaatgggccactgcacagagagggcctcctcagtaaagagagacgtcagggatggatctggggattcacacccaaccccactctagcccacttctgggtcttctgccagacccaaccagaagtagaggtcacaggagctcagcgatgaatccttatgggtccagagcagggagagggagagtggagagtggacttacactacagatggtaacagcatagttactcgaaaatctctacctcctttcatcatccccgccatcccaccctctgcaaaaatttatagaaattagcctttaagtaaaatatatcccaactcagcagccattccagtggggcagcttttcaggtgctattagagcaccagatactagaaaggagtttttaggaatattttccttcttcccagatactgacaaagtggtcaccaggtaaaagtgtgtgattaagtatgtggtttgcaatcgagtataggctcctcatgtagaatataatgtttatagctggggcaagggggaactttcattgttggtgtttctaaccaaagcctagtcatcccaagcaaagcggagcagtgactggaatgtattacagggtgatgctttctactgcatttcataatggccagctctggagtccttttctttctctttttccttctccttctcttgcccctgttcctcctcctcttgattctttcatttcatgccaattatcctctcccttcatttgatctgagaatggaagcattcttagcagcctcaagtgatgaggaaaaatgttaaactaagaccctggctgctaccgatactgtccaaatgctgaattacatgtcggtcagacagctcagctatttgaatttccccaacacgtggcagttcttgtcctggagccaaatgcccacacagcaagcatacccgtgcgttacacacacacatacacccccggtgctgggccagatggcatgctgtatctctaatcaaaggcgcactgcagctttgattggcactggccgtccagagaggaatgtgcatgtgaatttgaggcaaggtgagccgagaggacctgagtgccagtggatctgagacttgccctgaatgagggactttatcctgaggcaagtctgtcagatcccagctcctcagactcagaaggagagtgggcaaaggttgtgagacatgaatatttgattaaggaaagggctagaatagagccgtgtgctcacccttctgtgtgtgagtcgagtttttccccttttcctggactttgaactctacagggtttgtggttaacgctcatgaaccatgggtaaatgaaaaggttgccaggccaggagccagaggatgctggcaggggtgctgttaatagggcctgggggtttagtccacgccttattcactggagtgaggctcctcaggctgtggccctaggtgattggcaccctcgctggttcccctcccatcaggctgctgccctgagcgggtcccaggctgctgccctcagcctggcccccagccgttcctctgcattagctgtcctgattgcccttctgccggctgcccagctgcaccatcatgtccccaggtgccgtcagagcccctttcaaaaggccaaccttgttcttttagcctttgtactgcgtttccttacttaatttccaaatcgagggtcccgtccttccttcttcaaacatttttcttctttcctccctttcccaaacaccttcaaatccatgccaaacactagaaagagagaagtaagaagtaagtgaactggagagctgaactgggggggggggaaatgaagcttggcaaggcaggtcccaggatgtcccaggagaataaaagacatgctgtcctgcagcagaggggtagggagtggcagagccatttataaaacaccttccaagtgccaggcctgagaggaaacgtgaggaccaagcagggaaacaataggaatagactcagaggggttaagtaacttgtacaaagtcacacagctaggaaaatagcagagccaggatttgaatccagaaatggctgaccctgttgcatctaccattctaagctatgctgaccacatctcatcaagtcagtgatcaaaagaacagaaaataaagatagagaggattagtcatacatcccttttcccctttattttatgggactgtttttaaggagcaccttctagtgtgtctgtatgagggagttggagagaccttccttttccagcactgggacaacccagctgtttataaaattcctcccgagggcctgccctgccctggctgctttacgaggcagaaagggcctggtgtgtgtctgctggtgtactctgcagatggcatgtgtgctgtgtgctgaagtttctgctgggaattaatcagctcctccagacagctggtccgcatgcctaataatatttgcaagtcgggttttatgttacccacaggccacagccatgctgcatcttgattatgggaatgcaggcggcattcggaaacatgcaccaaacacagatattttaggaccatgaatgacaattgttttcaaaacagttgtgagtttcccatctcagcgtgcacggaaatatctgtcaccccttgggcagatgaggtggcattgcatagggcacaagcagaattggagtgtggagctgggttccacagtccttcctgtgctccttacttcgcaccatcccagctacccaggactgagcagcagcccatgtcagggaggtggtcaaggccaggccctgagcctgtgaggtggtcttccactgacagcactctagaagcaactagaaatttggggcgattgcttattctctattccctggacatctcactcaattacagcagatagttcgtctttagttacaaacactttgctaaattctgcccaatcagagtctctaaataatgccaacatcagttatttgagtgccttatctatgaaaggactttactaggagctactgatatcaagaagcctaagactgcacgacagtcagcaagcatgaggaggaagacgtgggggattgttgaagtcagatggaactggttttgaaatccagcgctaccacctgatgttctggggtcttaggcaagttatttaacttttgcctacctcagtttacttatctgtaaaatggaaagacattttgtctgctgtatgcatttttgcaaagattaagtgaaacaatgcatgtaaagtgtttaacagggtacccagcacatagtgataaatgttgcttgttactgttggtatatctggtacaatactaagttcttggggaataaacaaatgagtgaatggattgtagatacatggaaagtctcaaacactattcaggaaagggagagaagaatcaaagataattcccaagtagtcagatgcaggtgattgtgagaatggcattaccaataacagaaatgagtacttgggaagatcttactttcagagaaagaggatgcatttgggtttggatctgttgagcttgaggtggtggtcttggtcctccaagcccagaaagatgagtcggggtgccctcactgggtctcactgccacagctgggccctcagccttccagccctcccctgagttctggtcacagccacctccctaccccaccactgcaccttcttcccagaatcattccagaactcaccacaggcaccacaaggatctgctgtccatcttcttgtccataccacacctgtctcctgtgacccccgacataggcaatgtcacaagccttgcttctggaaattcacagcccctccagccctcacttccttcagagattgcacaagcaggagagaagcagtgggaaaatcctctgcagactctagttttttcttcatgagctttcagtgccgactaatgttgatttaaacctaacaagttcagacagacatggctgtgtgtaagcataacttccttttgtggatacctttttgttctttatgagctataacacacatacagtaaaacgaacaaatctgaagtgtgcagcccgatgaatttttatgtacatatatgcccctgaatccaccccgaagataaagatacagaatacctccagcactccagaagaccccttattcccactcccagtcagtaaccacccccacaaatagccttttttccccttttcaccatagattggtaagttttgcctgtaaatgaacatcacagacatgaatcctatagtattactcttgtgtctggcttctttcccattatgtctgtgagattcttccatattgctgcatggaacagtagttcttttcatggctgagtagtattccactgtacaaatatatcacagagcctccattctactgttcctgaacatttggggttatttccaaattggggccattataaatacggctgctgtggtgatacacacatgccctcatctctctgggctgtgttctccagtggaattggtaattacagggcaaacctaggttagcaattgcagttactgcctaacagattttgtggacatatttttaaaaaggtgaatacacacttagtgtgtcatttgccagtactgtacttgcctctaagctgctagtgaggcagcctagtgagactgaggaaccaggggttggacattaggatccctggctttgaatcagctctgtcacttacaagcttggtgtccgcaggccagttacttaagctctttgagcctcatttttatcatctgtaaaatggtgataataaaaatgatcacctcacatcattagtgtgaaacttacatgggctatctataaaagttctttgagagttgtgaaatgtaaaaatcatccttatcacctcaactttttgtatttgacatacattttccttgaaaacagtctaaaaagtttttaaagagaatcactattagtaataaatagggaaaaaatcaatctttcaagaaaaaaaatactgtctccctattttatagcctaggccagtcagtggatctgggcagtcaccactttgatatacctgcatgctccaagggccccctcaccccggacacagcggggagtcacacatccactgtcctcatctccggccagcttgcctattttctcatatttgcattctctgttgagaactatccctgcctctgcgctgcctctcttgtttttaatcttgtgaagtctgaatatcagatgggccttctcagcattttcactgaggcatgtgcatacacacatcaacatgagcacacatgagcacacacacgctgcatgagcacacacacgctgcgtgggcacggctggagcagttctcccgagtatctgtggagtcggtcttactgcttctctatagaagtgatttagtttaaagactagcagcgggcccttgtagacacagagcacatagtagtatttaataaatatttgtttacagcaatggaaataaccaaggtcaccaacccccccacactcttgtgagacatgctctcctgctgtctctcatcaatgtgcatggctctctctgggaatcaaatgctgttgtggctgcaggaacctccagaaagggttgtttattgcattgatattccttgcacactccaagattgtctttggagtgatgggaagcacaagagctttggagctagataagcctgtgttcacatcctgacgccgtattcctagagcataagttctggcccctctgagcctcacctttctcatcataaaataggattggtgttggttacctttaaggtggttgtaagaattcaagaagacaattagtagaagttgttggtattattcacttcttccagctcctccccacaacactttggagtttttttgttctgttttattttggtttgttttttgttttttgggttttttttggatagcttgacctcttttcttcttcccacatacacctcagtcccctcccaaagagggcagggcctggactggttaagagcatgacccatgagatcaaagtgtcttggtataaatcctagcattgctgccaattcactgtgagaccttgaacaagttgcttaacctgtctgagcttttatttcttcctcttaaaatagggataataatagttatctatatcatagaattgtatggcttccctgtgaataaccataaagcagttggcacaaagccaacactgagctgatagtggtagttggcagtagtagtaatagtaatattattataatattgatccaatggatgccaatagctgtgtttctctctctctctctctctgacacacacatacacacacacacacacacacacacccacccacccaccccactttgggttttcctgatcgctcccatcagggctccttccacatggaggctctgcctctatcatcctttctcctgatttgaatcctcatgaaggacaggaactggggttgctctatggttttggttggtttgttttttaagttcaaaattaatgaaacaaatgtcaaggaaacataatctttggatctttggactgtaaataaaaataggaacattcgggtctttgtataagactgctgtaagtttaggcttatgtattaaatagaagaagaaaaatgtgtctgttcaaatgctcccagtattgagggtttaaattgaatagattattgtctggaggaaaattcaagtataaattagactacgaagaattactaactgttgcagttttcatgttaattatttcatgttaaaaaattgttaccgcataaattaacacattctttcatagaaaacatattttagaaagatttgttactttaataactctttgtgtattagaaatcccagatgcctgtactaattaaatataatcagattttagattcaaaaagcacagtagccatttaacacaaacaagcaggcagctaggttgacaaacacactcaggaagaagtggatccctgtttctttcgaattttgaatttcacaatccagaactgtgaattcaattcctgtccttcctttgtattacaacgactggggattattagactcagagcgccagctttccagctcaagggctcctgcagaattattaatcagccgcttctgaggcccctgtaatccggtggcagatcaaggctgatctcgccatgagatgccctccctctgcccccgtcagcacatgaatttcttgttctctgtcaacaacagcattgccattcccgcacagtgtgctgtgacctgaacagcaaatatcaggagagagaaaaggaagaaaaaaaaaacctttttaattactgaatttaatctaattcttcccatgctagagaagcaaaccatcctttcatgaaaagcaaaccctttaaaatgcaagccattgtcttaagcaccgactagtgtgttcccaactcagtggtgccgccataaaatgaccatgccaacccccacctccccagcccacattgagagtctatcatcctgagggctgtctagggagagaccccaggggacttgcccgacagaatgccctgccctccgaggtcagacacggctttcccgctgagctgagtcgcatgcctgaaccgtgctgcttgtaatcaagcttcccggatccgagtttggtacacttcagtcactaagcagaaaagctccttcatttgtattctgtcgcttcaagctctgagcttccacctcgtttctgggagggacggctttgtttatctgctgagccaccgtggagcttcggggcccagattaatagttagggggagcaggtcaaattggcagggaaatggagatgaattgtagagcgcatccattttcctcccggaaagggtgtgttgaaagccaaagattaaaattaaaagaaaagggactctaaatcaccctttcctactacagtctctctttaaagattaaaactgtttcaggtcggagatgggaccaatttctttcattcccaccctcgggcagctctgactctgcccagaggatacaaatggattggaggtaagcagtggtcacctcaagcccagcttctttgcacacctttcccctttatctgtgctggtcagtcccattttgtattctgtgtgagcatctctttctcctttgtgctgttttgggcagagccttttgatggttgtttatgaatggtcaagagcaagtcctcagtctgtgcagcccacgtttcttggtaatcatcaagaaggaagcagatggtcaccctctgtgattttaaagtgtgtaaataggaactgtagactgccatcaaacatcaaaaatgtcagttggcttccttgtcttgccttgctggcaaaaggaactcctgcatttgcatcatctgggtaatcatggacacgcagtacatttgtaaactgccccaagttctgaagcctcatttcttacagccaaaggagggggctcagtggcattgctctgccatccccagggtggctcccccattggcacagacactgtaccagattgaaaaggggagcggtttgaaaaagccaccccaaagtggtgtttgtcttctgtatatcctattatcctttgatatgttctgagctcccagtcaaaccccatgacctccaactgttcccacacagtatccccaaacccagtgctgcccatgcagcccagctcgtcatgtggcatgaagtcagactgacacgggccctctgccccttctgggggtggctggattcttggcatcatttctgtgttgagctacatcccacacatccgttgatcactcaggtgagttcctctcaccaccctgggcagcagtgtgcagttggttacaaagctcttgtcttttgttctggattgaaagtccgcaaacatagcgtttatgctgttgaagctgtgaatcagaatttttattctgtttgttttgttttgttttgttttctctttacagaggtaatcaagttacagaatttttattctgatattacttcctttctggctcttcggaaactggaaggataattggaattattcagagcctcagtattctagaacagcaagcagggctccttttttcttcagtcccacccaagataaccacttaaataagcctccataacacagtctgtactccaaggaaagtcccttcgatggttctcagatttccttcttaaaaggactaaatacccacagtttcaggagatgcccattaatgttatcctctacttttgtgttgcccccataagttaccctgggtttgtcattggtcaccgttgcaaggagggtgatggagaaaggcaagcagcccagagtttcctcccttcacttcctggctcctctagggatatttggaaggaatgtcacagtttaccttctggtagcctccatgtctggatcgaatgcccttccacaatttatcctgcctatccttccccgactgcaaaaccccaggattaatacctagagtccagccttgcccctgcattctccctggtagctgagcctactcccctgtgtcctctagttgtcctgggttcaatttttaatacccactgatggaccttctgtctcttctctgtccagtcttgaactctgggctctcttggaactttcctcacccctctcagcctgaatattccttccatggattccactcaaccagactttggatctgtgcctacttaatcaaccttatctttgcaatatgttcgggcccaccttccactccttggttcttgtcctccttggcctaacttgtcccttctccactcacatccccggtgggacagcattcctccttcctcccaacctccctccttctcaaacttcttgctcaacattatgaaatttcagatggaatataatcttaacccattgtaacatatacttttcaaaaaaacatgatgctaaaactttatgaacttgaagtagaagtttcaacagagtgcgtcaccggggataactggaaaacacccagttgtattacttcagaagcatttgggaaatctgaaagtcattcctttggcctagtgtgaaaattctgagttttgctttgccaagtttcattgggtttgaaatcattgttttgtttaaataaccacaaagttccaggtcaggtcagctttgattttgcttctttcacaggatatcctgtcctggtaccgccttgtcacctccccctcctgtaaaccaaatttctgttattggcattgtttgtgattttttttttttgttttattacccagagtaactttcaagttgaattattgcatactattaaatattggatataataatttgcagagttagtggctttataattaaaaagggctctgggtggctctttggttcagaaaaacagtgtctattgttgaagttaatgggtttcctccttgaaaatgctattagggcacagctcagattctctgtaggaaggatttggcttcttttattcaatactgacttcaccttctccaccttggcctagttttttagccagaggggatattctctgagactatggaattggcctggtcaccaagaaaaataaaaaagagagagacttggcagttcagctctccggagatgtgagctgggcccacccaggcctgtcctggcccctgccgtgaccctccccaccgcaaggagagccatgggtcatgctgcatcattccaatgcggctgcctctccctgaagccctcatctcctgcttatgttctcttttcctgtctctgctgagccctcttcttcctaaaggcagtgccaccatttagttctctgttgggtttgcccgtgaagtctgtctccctggctgcctagaaaccccaagggcggaggcaacctgtgcttggttttcccaggagcgcctcacagggtgctggggacatcatggaccctcagaagattctcagtgattggttgatgagtgttttgattaggagggttttttcatcttcttttcctcttctgatgtttggagagctttggcattgctgatggcatttgccagtgcaactcagggactttaggcctttactatctgaataaaataacagctggtatttattcagctattaccaggtaccagacgctgtgctgagccttttacatcaactgttcttcccaccacaaccttaggaggttatcatccccagtttacagacaaggaaactgagacttagggatgttttaaatgatcaaccagcaaatccagtgtgcaagcacagggatacctgactcggaagctcctttcctaaatgatcatagtggtccttccacaagtgaccactcaatcccagctcagcccacaatcggaccactttgcattgtcactgaagagcatccactcctcgtttcctggccggcttatgtactcttactgcaggaggtgatttggcagcaaaagtatctgcggtcttcattggagcatttgaaatgcccatgccatcatcttaatgtatgaaaacacataaagaacaggaagtaactgagtcaagtaagctatttctatttgaggcagaagtgaaaaacagattacctggccactagggatagagggacttcattaactggaatgtggcctggggcttgggatgggccatcctgacatgatgactttgggcagtcatcctgttggcactgaaaaaccgagagcatcagtcaggctgtgctgtcgtatgaaaggaagattttattcctataacttttaagagtgaagaaaattattagtttattacaccactgtattgacactctttgcgtttagtttgattaagtctgtgtaaaggaagagaattactttgaccgtcagggtgtcagataacttactgcctggctggaccctttagctagttagagcatttattgctgtttaaccagccttaggcaagttgctatgaagaaatatgtgtctccaacctcaaaggatttgcattctatttaaggagattttttaaataacttatgaaagaactagtaaaaggacacagaggagacatggacacagtggaacagtgtatagtgtttatgcagtcaggctctggcaccttcggttcaaatcccagttctgtcatctacacttgtcctttgtttggcacattgctttcctctcggtgttccgttttctcatctgtagaacaagactattgctggcatccacctcatgtgcccagtgctttgcatgcctgactcttagcaagcgctcagtgtatgtttagctattgtggtagctgctattatcaagcattaaactgttgtttctagcactggcgctaggtgcattggagagattagtgaaggctggagtaatcacagatggcttcatgaaggaggtgggactggagctgaggaggctgtagctaagcaggtgaagagaaagagagcatttccaaagccaatgtaaaagaaacaagtgtgagcatgctaagtgcaggacacaggttatagtaaagcaaactgaactagattaactgtgtttggggtagcaagaaccaagttaggtcaggcacggtggctcacatctgtagtcccagcactttgggagaccaaggcaggaggaccacttgagcccaggaattcgagactagcctgggcaacatagcaagatcccatctctacaaaacataaaattaaactaggtgcagtggctcatgcctgtaattgcagcactttgggaggccgaggtgggtggatcacctgaggtcaggagttcaagagcagcctgaccaatatggtgaaacaccgcctctactaaaaatacaaaaattagccaggcatggtggcgtgcaccaatagtcccagctactcaggaggctgagacaggagaattgcttgtacccatgaggtggaggttgcagtaagtcaagattgcaccactgcactccagcctgggcaacagagtgagactgtctcaaaaaaaaaaaaaaattaaattaaattaaacattagccaggcatggtggtgcacatctagcatcctagctactcaggagaggcaggaaacttgcttgagtaagcccaagcaagaagaagagcccacaggggagacacacaaaatgcttggaaagaaaggaaggacatggggaagaataaactcagaaaaataattcatgcatttctcatagaaatgtttgagctttgcgggttggaatatgctaagttttactgctttgttaccgaaattattggtattattcacatgtgagaagtgtgctaaaatagtacaaatgtacccagagccactcgttaagtaaacatgacagaagtgacaatggaagcatcatctacccaattgctaattgctgatagacacccatgggccttgaaatgtcacgatgcttttgaagagttttgaaaagtcaaaacacttttcccattctgtctcatcataagtcattctcaaggtaatgatgtgttatcttccatgttttaaaagacaaggggaaagaacgacgtgggaagtcatcgcacttctgctcacagcccagtgactttctgttgcgcttaggatggaatccaaaatcctagtacaggttacagagtcccacaaaatctgtccttgtaccccatcttattattcttcatagcactttattgtagttgacatatataatagccattcatttattttatctccctcaaactaagcttccagctccatgactgccagagactgtgttccctttcgtcctcctggcaccgagtgcagtgccaggcactggggaatactccagaaatacttgtggtaggaagaaagaacaagccagcccagcagtggtgggtgtttgtgttgttatttctgtggacaaactttgataactgaataaatccacagccctctcctttctcttgcttgaagcatggatgattattaactttattttaaatgaggaagaccagggcttggtgaggtcaaaatggttgatgtctagtcacttgcattcatcccagtctattaagaatttattcttaatccagtctattaaggattttccactttgtttcactgtgaactctcccaaggccccttgccacctcgtctttctgctgttgtaactaaccacccccatccccagctgcagccccagtgaactgggcccccttgtcctcagagaacaaagtatggggctcccccactcagatacattcactccgacccaaaggggatctgaacacacttcctttggcagtgaaaatgcagggttctccaggtgttttaagtttcattagtgtgtggctgttgcttttctatttcaattggcaattcttagactcttaaaaggacatccagacagtgacactggtgctgtcaccaaggacaagtagaagactcaccagagggcagggaactgataatacgctctgtaaggaactgtggttattcagccaaaaagggaagggctgggagggctgaccagctactcattcattcattcagcacctgtttatcaagtgctttctctgcagcagacactgtactcagtactggagatgtggccatctgggaagacatgctccagcactcaagcacagtatttatctggggcagagacagccttcagacaattcatgcattcattgccctttaataataacagcttcgttaggcaatatttactgaaaaaaagtagtgacaactacaaagagggaggtgctctggcagcatagaagtaggaaacctaccgcagtctttagtgatcaggcaaaggttccctgtgcaagtaacactttggctaggagcaaaagagaagtaagaattagccatgggttaagggcttttgataaaggaaatagcctgtccgtgaagcaggtaggagcttggcatttgcaaagcagtcaaagaagggcaatggagaggttgcagaggagagaggagggaagcagaggagaacaagtctgggatgataagaagcagctggggaagtaggtagggaccagattatgcatgtagattctattagaaggctactatagaaacccagggggggacatgctgagcaagtgaggactagaggaagggtagtgaattcaagatcatgaaatggtcaggatgtaatggacctgacacgggcagggacaaagcaggagagcacagagatcattcagtaaagatgtattgacctccttcaataggcaggccctgtgctgggatctgagtgcacagtgatgaaaaatagagtgtccaggtgaggatgattctcaggattctgttgtcaccaactgggtggtttacaaagtcaccaaggattgagaagccaaattgtggggaagataaattttggatgttgcatttgaggggcactgacttgtataaccaatttcatggagagacaattgagagggaaattggttatgcaagtcagggactcgagagagaggtcccatctggtgatataaatgcaggcatcattggggtcaagatagtcattggagccatgggattgaataagatccctgatattacacagagtttgtgaccacttatttcatatctcaacagaattcagagaaacaggattgagctgtatatcagaaattatttaaaacatcgacacatttattcattacaggaataattcagcctaaggctaactggtcttatatatgttcctgggagttaaatgactaaggcacaaagatcctcttacatggaagttctaggacatgggtaccagtgacaacaccaggttgtcaagttttcacaatgacaagtcgaggtttcggcaatgagtttaccttgggagtttggtaaaatttgcaaatagtacctggaaaacattcagtggaaaagatgcttccaagtacacacaccacacacacacacacacacacacacacacacacacacacacatattatggccttcgtgtattggcttatcctaaagaatcctaaactgttaagctaattcagtaagaaatgacagagtggtcacttctttttttgaattcatgtaaacatggaacaagtacagtaagtgttacagtgaagctcaagatatcagtgacatagatgatcattacctgcatagtttgctctgtttcctctaaataaaatgcaaggaggagaaaactgttttcatatctaaatcctgctcccaagcagaagaatttcaaagtgtgaatcagctagttacataacaataccaagttaactgcattgcggttctcctgatgttttctccgttgttctgtaagtccatactacttagaagaccactttgattctgactttttgcctgtcagaactttactttcaagggaaaggcaacgtttacacccaggagatccttccttcaaggtgtctgaagtctcctaacttacagagctcactgcagcagccctgcagcagggacatctgtgggattgtataggttatgtactacacaaccttagggatgctgttttcatagactgggattttacactgtgcaacctgcaaggctagttttaaagacacctgccaaaaatccccagttaactccaccacatttagagctgcattttagggccaatagctttgtaccctcaggaggtgggaagccaagataaggggaaacagaagtaatgagatgtgtccaagaggaagcagggattagctcttttcagtagaaacctcagttaatcattaataccttattgctgctttgatttaaccttttgtcttccttgaaaaggaaaatgagttatctataaagaagcttcttttgttgaaagcagctgctgttttaagacagagaagaagcaggagaagttggacaaagacattatgttttattcctccaaatacattataaatacattgtttggtgtaaatatattgcttgccttagaaagaaaattaatacaaaacaaatttaagtaagttccgactagtagtaactcagaccacatatctacaaatgacttcctttcaaagattccttacattaatgcagcctttgttttaacattttttgaaggtttatatattataatccttattgtagattataaaatgagaaaataataaagctgactaatgcaactggctgatattgccgttggttttttttaatctgaaattatgaaatcccttggaaaatctaacatgacagtatccaaattttaaatagtcactttcagcaacacacacaccttcaccaatgttgagtgattcaaagaaggggaaaaacaactcctttggttgtcattttatttacaggatttgtctgcacagcagagaaaaatgttccatttacttcagagatggtcagagatttccaagccatttggctcaagagatggtttaaataggaatgaatgtagtatacctttaattctctgaagtaagagaactccagctgaggtttggtccagagcaaagtctgctctcaacattgaagaaaatctatcacattaatcccagtggctcagagtccaaagctgcgtgaacagaatgctaaaggataggaagtgtgagaagaatgctttgaaagaaaccttaaaaacaaaacaactgactattcagagaataccaggtcttatgtggaatcatctagcacgtaaggaaagatataaataattatgcctgagaaacataactaattaaaaataactccatgcataaaaggaaaactatagaataacttttctgctccagtgttaatgtgagatgcctcataatgaaatagtaggatttttttctttcatttcatttcacacagacacatgagagatggagaggaaaattatattgcctgaaaatgccagggtagatttactaaagatgttatcatatgctgtatttaagacaaaaatctaattgctgtaatttatcatacctctggctattaaaactgtgccaatttaaatattttaatcattcgccacttttgtacatagtgactttttatagaagattctatgaaatgttctgattttgtcagcctttgtatgattttcaggagctccttaagcagaatgaacatgctttaagcatgtaactgtgtttccataagtaataaaaattccttgtgtttttcttttagtttgttcagtaaaatacctggaactgctttataattgctgagctgaatgtttgagagcacaagctgctgaatcccttttattttattttattttatttatttatttatttatttatttttattttatttcatttttttctgagacggactcttgctctgtcacctaggctggagtataatggcacgatctcggctcactgcaacctctgcctcctgggttcaagtgattctcccgcctcagcctcccaagtagctgggactacaggctcgtgccaccatgcctggctaatttttgtatttttagtagagacgaggtttcaccctgttggccaggctggtcttgaactcctgacctcaaatgaccgcccgcctctgccttgtaaggtgctgggattacaggtgtgagccaccacacccggcctgaatcccttttaattccctgcacacacatcaagcttgtagaaagcaaggtggaccacacccttccttttggtttagagacaggattctttcaatgatcaaataaatttttgaaaaaaaggactccactgactttgacatgaatttgcaccttggtcttgaaaagtcagagactcataagacagtcatggaggcagaactgctctttaaaaaacaaacattaaatagtactcttgctgggtggtagaagaaaaagtggtaagaaagtgatcttacagtatggaagaaaaaactatcccaggagtaaagatggctactacagggagaaagaatggaggaaaaacagcaaatgtggagagagaaggagctggaggcagattcctttccctgctgtgggtgtgggaggcctttgggaaatctaacacatttcagcagaacacatgggcagtatccagttgtccccaccctgggagcagctcagtggtttaatcaggttttgtgtacccagtgagaccacactatcttatatacccgaggactcatgagagcagcattatgactaaatcctatgtatgtttattaaaacatagcattatttcaaagttaaatatatatataattttcctaaatcataagaaaccagggcttcttcccccctttattgaggtactaaggtgctttgagctggattacttacggtcacacagtcaagaccagaccctacatcttcccaatcccagcccattcctgcttcacctcctttctgtcttcccctctaaacctgctctcaggaaagtagcttgccaagtgcctttccctcccacaccccatgcccattgcagtgccctctgcctgatgaataaccaagtgttcattctgcaggtgcaaagttccccatcaagtggacggcccccgaggcagccctgtacgggaggttcacaatcaagtctgacgtgtggtcttttggaatcttactcacagagctggtcaccaaaggaagagtgccatacccaggtaagagcagggcctcacagacatgggcctgagattggaggcttttttgacaccatttgggaaaacttcatccactttgctttctaagccccatcctcagctttctgctgagcttgagtttgaagaacatggccaggtattcagcgagagaaaagcagaactgggagccaccatgtatgtagacaagcagccaccatgaactgtgtgccaggattaatgtaagtagcagctggtctaaatgcttcagtccccctccagttcatagaatctctcctctctcagtaggagtatgtgtctgtggttcccagagcagaaatgtcactggcagtgcctctgcccaaatggagtttgcagacatgtctgggaaagagaaggagaaaagccccactgctttttgattacactgtagcactgacccatggagtgagcctggcaggaaggtgccaggacctgttctctccacaggacccagctccagatggccaaagagagcagaggcacatgtgaaatgcaatttagagcccactcactgcctgttgctgaacagtcaaaacatgctataccaaagcaagtataatgtaaagaaattggaaattcttagactctggaatgtttctgtattatcagatttatgctctccaaagaaaccacgagtttggcttatccatgcttaaattgattaacgtcgacagatggtgacataaaggacacccatgccatttcacctccacgctttagtggttatagcacagggacgatctgcttttttgaaatgttaaggacatatttttcagttactgctgagtgaagaaagaacatagctccccctcattccctgcgtaagaaaggagcttaaagaaaaaaaaaaaaaaaaaaacaatgatagaaacgatagtgacgattaatgaggaatttaggtctcttgcaaatcctgggtttgtaatcatagctttgcagtcagaggagctagcgaaggcagattaatttgtaatccctttgttccttttttatgattgtttctggtcatcttcagagaacacagagaggggcacatcaagataatctcgttctgggttggtgtagccttgagactcctaggagagccaagttgacatggaggcaaaattgacaaattcccagtctctgaagtgccggcactgggcgtttagagatgcgggtgtaagtcagttttattgatgctgcggtgactgctgctcccggcatgcacacacgggcagacactccgggaatcgccaaccagcacagaagaaagggccgccctgggggatggagcacagcgtgggtgtttctgaattgcttctcaaggggggaaatgtgcgggtctcaggagggcgaggatgtgaaggcatctcttctttatttattgtctgaattttgaactgatttcttcctgatccctcccaggtttatagtcaccctgtgtgttaaatgcaactggggagaaaaggttaatgttgttttgcgtttctgtgaagccttcccttccagtaatacaaagcagctttttgtttctcagggtctcacacagaaaccaagacaaaggggtggaggtgggggccttggagaaggaaggcaggtgcgtgtttctgagggagtcttttgtcaggtttggttttagcataaagaaaatgccctcattttaccacttagaccaggattcattcattcagcgtagcttcagtcactgtgaactgtgccaggcattttcctctatcggggagatagtgcaaataagaccctcatactctaaacaagccttgattagtacctgcctcaggctaggcattgttagcacagtgggcaagtaaataaatttagtccctatgttcatggatattacagtcagatagataaaatatgcatcaaatccaggaagaaaccagccttctttattccttgtttattatcagagggagtcatcctgaaaggatggactacttggctttacctactatggggcctagatcttcattctgataatggggtcagggacacctgatccaggtatccacacacagcaggtcctgagagggactcttcaagctgagtcctgtgaggatggcagaggagtttgaagtgagaactaactccagcggctcctgcagagagagctgtgagcaagtgctggtctgcagtgggctgtgataactgcctctagctgtggaggagtgctggagagggggctgtgtagggaaggcaagtaagccagaccttggaagccaagtaggtttcctcaagcccagaaggcgggaagagcatcccaaggtctggcacgtgggaaggcacataggcctgggaggacagttccagggaccacaggatgaatctgagaagatgccatgtgcaggggcacacctggagatgtgactggaagggtggccgagagcctgcgttggggccttgctggttggcagtggcaaccagggaaccgtgtcctcattgggggtgtcgtgagctggtcctcattcaaagaaagccacaaaaaattgttcccaggcctgttcctagccatgggttcttcctgggttttgctttttaacatagctataatcctatttaattgggtttgtgaatccaacagaaaactcttcttgagggagaagcttttacagagggattccaattataggattattaccctaacgaaggataataattcctaaggaacaagaggtttcacgaagcttccttcagatgtcactgtgaaggcaaagaaggaccttcctctctgcattcttgctatttgttggtgtggcaagtcagtcagtgtgcgctgaggggtccttctcagcttcccacgttgcgtctttgtgcctgttgctggtacctcaggacagactcccagtcccggtccatcatgatttccattctgcattttgatgtagtcatgtctcatgtctcagttggctagagtatattttgaagtaattcttttttggagaacagtagatggtggtacatttttctgagtcttccatacctgagaatagcctgctgtttccttgacacataagaaagctcctttgcctggtaggtgaagatggaggtgcgggaggagggggtgacatataaattggttttataaaagctttccaggcatctttgcccagcgtgaaagaaggtccagaagtgacaatcccagaaggaacttagagtggagtatgtgaggtgtgaccaaataaagggcaaagggaggcggagatgttagaacattggcaagttgtgtgagaggagtggacaaaagaagggaagacgacaatctcaaactgaatgataacctggaagccgaaggaaaaaatactgaaatatgatgctgagattaacgggggtggtagagaaaagttacatcaccttaccagatgaggaaggttgctttcgagatgtgtaacaagtatggatgcagttccaaagaagagctccatcagttccccgctagcagcctgagctgaacgcattctctgcattgcagtctagcttgcttttctgcaagcaagagttcagaagctttctttacttcaagattagaactgatttcatactgatggattgttgtatgtgagaaataaaaacacttaagtaaaagcagttttctggggttgatgcataaaatcagttatgcatttttacctgtcatttcaccttaatacctttctcaaatccttcttttcccctctgcttccagtttctccccgcctccccaccacccacccacccaccattctatcattgttgccaacagagttagtattctagaaaacacagacctggttatctcaccctgctagttaaaaacgtccacggcttccctttgcctttcagataaatcctagaaaacgtaattctacatagttcttcataactctttttctgtagtcattccacaaatatttattgtgcacctactatatgccaggtactgttgcaagcaccaagaatacagcagtgaagcaatagacaaatgctgctgccctcatagacttccattcttctttgaggagacaaacaataaacaaagataaataagcaaaatatattgaatgtttgctgctggtaacagctagggagaaaaataaaacagggaaggggagagaggggagagtggcaaaggagcacctcactggtgagtagaagacctaaaggaagcaagaatccagccaggtgggtatctgggagcacagccttccatcaggggaagggagagtgcagagaccctccagaatcaaaggaggccagcatggctggagcagagggagcaggaggtcccagaggccccaggggcaaatcagataaggcctttctagctcatggttgaaacttttgcttttagtcttagtgaggtgggaagtgaggggatttgagcaggagagtgacatgatttctctcttgctgtcttccatccttcacacgttaccaagacacatcaagagatgtctcttgaacatgcaggtctctctttgtggctcccctgtctgcctcagaacccttcaaagcccaactgaacatcatctgctttggaaagccttccccatgtccagaccaaatggggtgctccttctgcttgcctccatgacacctagcatatttctgttgggccccccgtttgtgtgtatttctcagcagcttcagagaagggagtccctttgatggattcccgaggtccagcacagggtccaccccatagtagactgtcagtaagtataagcaaataaatgagtgaatgaaacagaaaaaaaagaactcacctatgaggtttttgaaacaaggtttttaaatttagcccatagcctgcaaagccttttaactgcattccatcatcttcacacatggatatatattttcctagccacaaggtagcctctgtcctcaaagttcttctggaaaattgaccctgtgatcatttcaaacatcatgttccaacactattctaggcagagtgtcctggctattctgtgccctggctcttaaccgaacacctgttttgtggatttggcaggacctggtagaacaggaacactttcttttttttttttttttttttttttttgagatggatggaatcttgctctgtcagccagacgggaatgcagtggcatgatcttggttcactgcaacctctgcctcctgggttcaagcgattctcctgcctcagcctcccaagaagctgggattacaggcacccgccaccacgcccggctaatttttgcatttttagtagagccagggtttcgccatgttggccaggctggtctcaaactcctgacctcaggtgatccactctccttggcctcccaaagtgctgggattacaggtgtgagccactgcaccaggccaggaacactttcttaagcaaaccacacttattcattcattggaagcactttcaaatcattcaacaggtgactttcttgaatacatctagtcgcttgataatgacctgaagaaataagggaaattaatgaaactggtggctttttccttaaaggattccaaatgccactctggtcctccctctgccttagagccctgaaccgtagatacattttcctttgtgttcaacataacaacaggagcaggtttttcatgggagaagaaagggttaggactctccaaccaggaggagactgggaagccgaatgaaagctctcatcttagccgagggtgcgtgtctctccctggctcgtccacagtccctggggtttttcctgcagctcatgatgtcccctcagagagggaaccctgcctggaatgcccagaggtcatgctgtcacctccttctacaagatttctcttggccagcatgtctagtgagaggaggagggagaccaggggagaatgcgtgtgaagagggtggccaaagagggactttcggcccccagtcctgtgttccagcctcacgtgctccttgttctcaggggtgcagttccggggccttcctcatgggcaccctgcctctctttttcactcctttttttttttttttctgggacaaaggagttctctatgatactgtattatcaacttcaaatacagaaatacctgtgtattcagttacatgagtagctgtctttctgtgtttattaatacaatgggctgaataaaaacagctgtcctgaggttatctggcaagatgaggaaagagaaacaaagcaagtcattattgtaccttctcaagataagttctttattctcatccacactcttccatcagcatctccctgcccagaattttcacaatgatcctatactaaaacctaactcagtgtcacggttattaaccagtacgatagcaaggacacatgagaatctgttaatacaagcacatgcgatggcgcaggctcatgctgagcaagcaccattaacacccctcctccttcccagcgccagcacagcactgctcaacagacatgtaaacaccgggccttttatgcacagaagcaaggggagcctcagacccaaggccctatgcacaacgttgtgtgattccctttgaacggaaagctcagttagcaaaaggaatttgggtatctgataatctaaacatcattcccattgttaaagtgcttaattattcacatggcacaaaaacccaggttttgcaacccatagtcaaatccagatgcaaacatggacgggtaacacttaaaatccctgattgtacagatatggcccatctgagatccatattgggaagctgcacaaatggaaagctataaaacacaaacactcttctttcataaaagacattttttcagatagctgaaagcacaatgaatgttgaggtattttgttaacaaatggagaagccaagttcaagggaagtcaagtcacttgctaaaagatgcaaagttagaagtcaagaagtgacatctatttcggtgctctgccaatgaaagtgatttttattccttccctatagaatctaaaagaagaccaggtatagtggctcacagctgtaattccagtgctttgggaggctgaagcagggaggatcgcttgaggccagaagttcaagatcagcctgggcaacatagcaagatgctatctctacaaaaaaaaaataaataaaaataaaaatcagccaggcatggtggtgcatacctatagtcctagctgcttgggagactgaagtgtgaggaggatcgcttgagcccaggagttcaaggctgcagtgagccatgatcatgccactgcactccaggctgggtgacagagcaagaccttgtcccttaaaaaattttttttcaaagaatctaaaaggaaaaagggaagactactgagttcatgtacagctcaaagaagtggaatagggaagtttaaaagaaaagggaaaagaaaacacacacacaagaatagacactgttggcaaccctacagagtcagagtttgaaagtgagagttggaaacttgacctctgagtttgctggaggaagccagcaacatgatttagaaaggataatataatcataatggcaggaagtgagcacagtcttcttggctggagaatctcagttgcagtgtttggggcagactgactggaaatgatgctatgtcggggaccatgtttgaaagcctaaaatctgagttgacaaggagatgttccatggaggctctgggaaagagggactcgaaggcagacccccacacagcggactagtaaggtctcgctctgtcacccaggctggagtgcagtggcaccatttcagctcactacagcctcaacctcctgggctcaagcaatctttccacctcagcctcctgaacagctgggaccacaggtacatgccaccatgcccaggtaatttttgtactttttgtacagacagggttttaacatgttgcccacgctggtctcgaactcctgagctcaagcggtctgcctgcctcagcttcccgaagtgctggaggtgttttatggattgagtactgttcagttgtaccctatgaaagtgacccaccacaatggcctgttttcctgagcaattctagagagacagcagaaggggctggtggctcccgtgaggctagaagggcagaacagcagaggaggagagggttggaacaaaattgggcagtggcctctgtgcttgctggctccccagccccaagccgcctctctgtgggaaccagggaacattcatactgctcgaacgtggctcttcccacagtcagacaccactggccagccaggatctcccctcctgttgaaaaatgctctcccttgcagctcccactaggaaacctggaaggccaaactgtttatgacattgtttccctaaaatgtgctcagacaccatgttttataaagtttctgtctcttctttctgttaagaaaggagaaaaaggatcccagctactcaggaggctgaggcatgagaattgcttgaaccagggaggtggaggttgcagtgagccgagattgtgccactgcactccagcctgggcaacagagcgagactctgtctcaaaaaaaaaaaaaaaaaaaaaaaaggagaaaaaggaaaaacatttccagcactcttgtccacctcctcagttggaagtgtaataaaaagattcttctggctgggcatggtggctcacacctgtaatcccagcactttgggaggccgaggtgggcagatcacttgaagccaagaattcaagaccagcctggccaacatagtgaaaccctgtctctactaaaaatataaaaaattagccaggtgtagtggcatgcacctgtagtcccagctactcaggaggctgagacaggagaattgcttgaacctgggaggtggaggctgcagtgagccgagatcacaccactgcactccaccccagatgacagagccacgcttcatctcaaaaaaaaataaataaataaaaaataaaaggattcctctctctagtgtacccatgtctctcaagacactctcccaactgccctggtgcccaaactcgtgtttattcccttcctattcactatccttcacctctcaggtattaggtaaagccaatgtcttggggaaaagtggctaaaaagaggaaatgacagttttctttctaacaaaaatatgaaaccatctaagaagaaaaaaatgaagtagacctatctttttgttagtgtgcagagtaaaagccatttaaaaaaaattatttaaaaaaaccatgattttcaaaattcatatagctgagaatactgtattttaaatacaggttaagtatccctaatccaaaaatatgaaattcaaaatgcaccaaaatctggagcttcttgagcactgacataacacgcaaagggaatgctcaacttactggttgagcagccctataatgcaaatatttcaaaatcctaaaaaatctgaaatttaaaacactcctgatcataagcatttcagagaagggatactcaccctgaattaacacaatccattcaatttagctattgtttataaaataaaaactagcccaagccttgctgagtgggcatatcttgattgccaccgttattgttgcagaggtacattgtgaagttgccaggtctgcaggtcagcccgttgcaggtcctggtttatggatggttggaaaagagctagtcccattccaattgtcattgtcagccaagtgcattgtcaaaatatcccactttcctggcaaagccctcattggtatgtttccacttggcccagtgcgtggaattgttttcatatactccccttgctttgagaggtctgggcagaagaaagcaggagaagaagaggagtggggaagagcggaggggtgcagacaggaaaggggagagcgagaaggagcctgaccatgtgggtctgccaggaccctgcatgggccagcttatgccctgtcccctggctccaaatgcccaggaaagactgcctcgggagacgctacatgttgaggttcacatcaccaagtgtgctgtgtctgaggcttggaccgagcactggaaaaatgacccagtggccaattaaactttccattggcagacattggatgaaaactttttttttaagtgaaatctttccatttgagtagtttgttttttaatgaaatgaaacatgtactgacatgcgctctgtggagcaataggagagtgattaattaaactctgtgctgccattttggagggaggcactcagagccagagtcaagcattaggaggcgtttcaggggctgtaaccgcacccagaaggatctgtcaggcccttctgcctgtttcccctcagttcctgtggactcctggaagggacagagacaagggagatttctgctggtccaagctctgtcattgctgaaatatgaaaccaaggacagtactaaaagatgcggcaaggcaaatgctttggagagtgccagttctgctacgtgattacacactcttcctaatctttctgggcaatatgtatgaagaaataaaaacagtaaatagcctcgtaatcagttcaggttttgtggccagatgaggtcagttcagatcagttctgtagtcaagtgagttacaaaaacttgatggtgttcagagctcgttggatggtggaattgtggagaaggaaatgctggcctctgtccgcgtttatctagagccggaggaggctgcctttcattcccgagcatgctccagttcctcccttgcttccagctccccgcccccatcccccattttcagccattggaggaggatgtaggctaattagccacagcgctgcctctcactcctcccatgcaactgaggaagtcgctggtaaaggcatgcatggcacagaggcagggaccctgactccttcaccaaacctctctccctaaaataaggggtcgccctgacacgtgagtgaggttattttacaataattgcattgaaggcctacttcagtacagcagaaacaatatgtgaatttttattacctcaagaaatgataatggcagagaataagaaagcatcctgaaaaggtctggagagacatgtgactgacaggctgtggttgacagccaggaggagccaggatacactcagctccacaagtaacaacacaaccaagaggactggcaacagaccccgaagtccgagtgttccctctgcagggggacaggctgtgctctggcccagcgcctctggctgtgctgacaagtttctagctaacgggtcgccacctcccctagaagtaaaggaagctccatgcatatggtgtgtgctcctgctggctgtagccctgggaaataggggaagaaatcttggtttctatatggcttgacatcgggttcttgctcctgcaaattaaccgggtcagatactggggaggattccagatgacagcctcaccggccaggaagcaaccaaagcacagcacagcttgacggggagctggcagaaggtgatacaatgaaaaagggaagcaaaactagagaatagtggctggcagtagttgggaggaggtcaggacactggccaccccctaagcatggtagttcctgtagtgttaaggcagccagtgtgcaggaggccgcactctctaaggagttagcgatctgtcttctgttagtgctatgcagcccagtgtttcaacagcttcccaagagtcagaaaaacctcaaatgatggatggcctggctgaagtcatcagtagagataggccccggacatggtctatctccccatcaaattcaccaaacctcagggcactgtggggttgcagggccagacagtgcccagccacgctggcatgatggcagatctccaacagtggggaactaagagtttgcccaggcatgaagaaaacgaatttatgaagttcataaatggagtttataaatgctataaacaaggggcagcatgctttcattctgtgtggatttttttgtctgctttattcatacattgttgtcagtttaattgaagtataatctacacacaataaaattcaacaattttaaggatgcagtttattgagttttgacaaacataaacagtcacaccaccccatacataatatagaacaggggttggcaggtctggctcccaacctgtgtttgttttgtacgtttttaaagggttgttaaaaagaagaagacagggatcatatgtgacccgcaaagccaaaaatatttactgtctggccttttacaggaaaagtttgttgacccgttgaccctgacagaacattcccatcccacttggagttccctctggccccttggcagggattcctcccctcccccaggcagccactgatctgctttctatagatgtagttgcgccttttctagaatttcgcatgaatgaaatcataccgtatgttgcctgttgtgtctggcttccttcacttatcatgttttgagagtcattctgaatttttcatgtctcagttctgcactccttctttactcctgagtagcatggcagggtttgactcctggggggatgggagtactccgcatgttttagccacatgcagacgcaaagaagaagaaaggggatctgcaagtgcggcggtcagggcctggatccccggggtgcccactctcactgcgcttgtctttgcaggcatgaacaaccgggaggtgctggagcaggtggagcgaggctacaggatgccctgcccgcaggactgccccatctctctgcatgagctcatgatccactgctggaaaaaggaccctgaagaacgccccacttttgagtacttgcagagcttcctggaagactactttaccgcgacagagccccagtaccaacctggtgaaaacctgtaaggcccgggtctgcggagagaggccttgtcccagaggctgccccacccctccccattagctttcaattccgtagccagctgctccccagcagcggaaccgcccaggatcagattgcatgtgactctgaagctgacgaacttccatggccctcattaatgacacttgtccccaaatccgaacctcctctgtgaagcattcgagacagaaccttgttatttctcagactttggaaaatgcattgtatcgatgttatgtaaaaggccaaacctctgttcagtgtaaatagttactccagtgccaacaatcctagtgctttccttttttaaaaatgcaaatcctatgtgattttaactctgtcttcacctgattcaactaaaaaaaaaaaagtattattttccaaaagtggcctctttgtctaaaacaataaaattttttttcatgttttaacaaaaaccaatcaggacaggtgtttgtttttgttttcttttttataaatatgaatatatataatatatatgtccctgtacatatacaatgtgggtgctaatgtggagactgtggccggcctgagccaccaagctgcgggacccagagggaggattttactgcaagtcagcatcaaagcaccggtgttattctgaaaacaccagtggcctcatttttggcttttgcaaagcatgaattttttcatttggattgcactttcctggttcatgactgtacctgtaggtggttgttactttgactcttttcaggaaccaccccccaagctgaatttacaagttctgttagcactatttgcttcaacttactgcgatttgttctcaaaacttaaaaataagcaagcaaatggctgatactaccaagagaactggaagatggataccacacaaacttcttgtataaaaatatgaatgctgaaatgtttcagacatttttaatttaataaacctgtaaccacatttaagtgatctaaaacccatagcattgtagtcatggcaacccgctaaactttctcatgcaactaaaatttctgggggaaatgagggtgggggttgtacatttcccattgtaaaataagtgttttaaatgtcctgtactgctaacgaatgactttctatatgtccaggagttctccagtggaataactatgcactactttacatttcatggggatgcacaaaaacaaaaaagtattacatttttagttgctgtttgtaccaaccttaaattacatatgtttaacaacaacaaatcaaaaatcctatttctattgagtttttaatactgactagcaactctgaagtcttaattccttttttgttatgatttatttgtgagtttacatttttaaattgtttaactttcttaatttagtaattaaaaagagagcattttacatttgaattttttttttgtttatttgtttaaatcatggaaggtactcgtagttctgtggcacatctgtcccacaccagatggtatggaatcacctggtgaatttagcctttgtgcgatgacttgcaaatgacagaaacattcagaacatctggagagttcttttccctctagaaagggtaggctcttgaccagctatttcagaggatcattaaagcaaaagtaggcataccttaccatctgaatttatcagacattttttctaaccggaatttactgtgtcctgcttgtaggagaaatagacaatcacaagaagaatctttcttgtcctggagtcagtatatttatttccaaatgtccccctacttctgtaatgaaggagctaacggagcgacaacctggtgtggtaggaagggcagtgggtggacgcaggctacctgtccacgcctggctctgtgatcattcagcttcaggaccctgagccacctcctggcatctgtcattttcagggcctgtctgtagaactgaaggggttacatgagattcactccttagatctctacagctctaagatcctgtaattctaagatcactgatgccatgcggggtcatacaaagaggatggttttctttgttgaaataacctttacatttagggagggcttccaacattaaaaaaaaaaagatgaaacaggttctctgattaatcaaaactttatggtattgtttttagcattaatagacttgctaaactgataaaatttatttatttatttatttatttttgagacagagtctctgtcaccgaggctggagtgcagtggtgccatctcggctcactgcaacctctgcctcccgggttcaagggattctcctgcctcggcctcctgagtagctgggattacaggtgtgcgccatcatgcctggctaatatttgtatttttagtagagagagggtttcaccatgttgatcaggctggtctcaaactcctgacctcatgatccgcccgccttggcctcccaaagtgctaggattacaggcataagccacagtgcccagctgataaaattttaaagatcttatacatatattattatcacattattaggtagttgattaacatattctatatctttttcaagataactttgcttttaatcctcacaccccactaagttggataatttgcaaatatttctggaggatttttatgttctgattcattcaaaacaatctggaaaaaaaagaacctgttttaaatagaaattatttttaaaaaaaagtctcttcaaagtatagcctttaatttatcagttgagttcatggtggactgtcttatatgaaagaaagctaaggacttgggtcacctcaagggcactcttaggaaacagcgtgctgtagagtgaggttgcagagtgaaagtaagagaacatctgtaaatacaaagaagtcaaagacttccaggttttttcttccaagaggcaaatgtgctttcaagagatattcctgaggtagaccattccagagagtccccacacctcccaagaagcctctcttcctcataagttgtacaagcttagggtgaggaaacggaatttgctgaccagaaacttctcctgttaagaaagaaaagtatcgccttaatgtcagggtgatggtgagtaattttttgtcttcagtaacctggcagtgaataagtatttgctttgttgccttaggaaagctggcatctagccctcctctgctggaaagggagccttcctaataaactattactttttactttttttttaagacagggtcttgctctgtcacccaggctggagtgtagtagtgcaaacacagttcactgcagcctcaacctcctggcctcaagcgatcctcccagccacactagctaatttttatcatgattattttttgtagagatagggccttgccatgttgccgcaagctggtctcgaactcctgagttcaagcaatcctcctgccttggcctctcagtgttgggattacagacgtgagccactgggccaacctctttttacttctttcaaacaacgggccagatgcggtggctcacgcctataatcccaggactttgggaggccaaggcgggtggatcacgaggtcaagagatcaagaccatcccggccaacatagtgaaaccctgcctctactaaaaatacaaaaattatccgggcgtagtggcatgcgcctgtaatcccagctacttgggaggctgaggcaggagaatcacttgaatccaggaggcagaagttgcaatgagccaagatcgcgccactgcactccagtctggcgacagagcgagactctctctcaaaaaaaaaaaaaaaaaaaaaaaaaaaatcaaataaacctatcggagaagaccatttgcaaagttcagacattgtaaactgcgactaaaggatttctgttcactccattctctgtagctcctgatctcctctgatgatcagttcacgggctgggaggattagaaagcctaggagacagagggtcccatgctttagaacatcagggtagataaagacaaatgatgcatttggctctgccgtagtcgtgacacagaaagatgtatggggaaccaggcatttccgtgagaaaagttaagagtgtatataatccctcaaacacagccacactgttgaagatttccttacaagcaccagaaggtgtttacctgctttgagaaagataggaatcctcctgtggctaagtgttggcaccagaggattttatagtagcattagtgtggcaaaatgttatctgcaatttccccgggagtcttaagaatgtttactatattaattggaatggttctttcatgaatcttgaaagagtatggttttcaacaacaggcagaagagaattgtactaaagcccacagcaaaagggatgtcatctgttcattagtcatgactcaggacaaagaatgtcacatgataggcatttcctaataagttgcattggaataaaatgatctttggtcagtttgttcctgaaaggtattttaataggtttaaatgacttttgttgaccttcttaccactatatattatacaatactgttggaattcaattatgctatcaaaaatatttgttagaagggagggaggagactggttttggtttgggggcaggggaaggaagcttaaacacatttttattctaaaaatgatacagggggatatagattactaaagcaattgccaaattttaaatatattttttatctcaaaaatagtttataactacagagaagaaaataatgaaaaatagtacctttactgtatttgaaatatcaaatagacattcataatttatgtacacctatgttcccagaaaattctcatacataataaactcctaaatcatacctcattctttcccaacatgcaaactattcagaatcctatggagggacaaatatacctttattttaaaagttaattctgagcactgaaaataaaaataaatggttttccagtgttgcagggaccattctaacaaaacgtaaccagtgacaaacgacggcttcctcaacagccagaacactgtgctcctctccatacggcttactactctctaataacctgtttaatgccaccaatgtgtttaatactgctctcctctaatgtgtttgccctgccagactgtgagcccgagaacagaaacttcctgattggttcaccattattctccctgcacctagaacagtgatgagcttctggcagatgctggctggactgatggatggactgttaggtggatgaggcccactgtccagtggggccagtggtttaccttcgaatgacacatctacctaagaacctgctaagcacatgggactgactgcatgctgcccacagtgctagccctgagcattatgaatgtgtggccaccagtgttccagatatgattgaagtcccaatctatagcctgaagtgaacacccttgatacttcccaactctttccccagaactgtcacaatgccagtgaggataaacttgtacctcttggaacctgagagacagcatgaagtaaatggcaccaagtgatacatactcttattttgattccgtttggttttgagatggggtctcactatgttgcccaggctggattcaaattcctgggctcaagcaatcctcccacttcagtctcccaagtagctgggactataaacatgtgccaccacccctggccacagtctttgttttttggggatgcggggaggcgacagggtctcactctgttatccaggctaaagtgcaatggtgtgatcatggcttactgcagcgtcgacattttgggctcaaggcatcctcccaccccaggctcccaagtagctaggactacaggtgcatgctaccacattcggctacattttttttttttttttttttttttggagagacaaggtcttactatgctgcccaggctgtagccttaggtaaagtgccttcaaaggctcgttttagctttgtcattttatgaaaagttgatattctactccctaagatatccatctttgtcttcagataaaaattattttcccaagtcatcaagttgtgccatgttacccagcctgtggcttgtagtgtccctgacacacccttgcataacgcagggagcccctgtgccctgtgtgagaagcacagcgtgaagatgttgtccataatattgtacatggaaaaggtaacgttagcccccattaatgtggattctctcatctaatttcctcttttcacccagcaaagtgcccagtgactgagaatgagacagaagatgagggcgtttgaggatgagaaggaagaggaaagtcatcagagccacctggaagtagaggtctggtcaggttggcctgcttaaccaagatggcagccaggggagtaggaaggatgaagacattgcacacatttggaggaagaaaccaaagctggcatgagaggagtcctttccagggctgttcaaggcaacgggatgcaggtggatatgactgtagatgggtgtaaagacttaccattcactcctccaaactttcgttgtatacttattatgggctaggccctgggcctagccccagaaattcaaagacagacaattaatatctacagtctagtaaggataaagacccataaaaatcgttgcaataagctttcagatggaagcacagttgttagcaaagtagtaacatctagctcagaatgggggggtacagcggaggcttcctggaagaggtgctgcctgaactctcttaaagacaaatggaagtaggttacatagtgtttagcggggcctggtgctccttgcctttggatttgtttccttctgatttctagcccccattagggattacctcatgctttcaatatggaaaacatcaacaaatgggtctcaatgaagaaaaaccaaaagtacacacaagcatctcaatcactgtctctctgtttctctcctctctttctgtctctctctctcctctcccgccaccccattaacagtatataggtacaccatttattctgattagtggccactaaatagagggggtggtagataatagcattcaaggacggaggaaggttttagcaggttgttggctccagtgtctcgattaggatatggtctgaaatatattcacattctcataaagtatgagaataaaagaattgctagaaagaagcttggaataataataactcttcactacttctcttaataacagctggtgggaggctttctcctatttacaaatccattgtcattcttccacttactagccaggctgtttcgcttgaatcatcgtgcgatatgtacattcatcatggaaggtatatactagcagttgcatggtgttctggttgttttgttctgggtagttttcctttagttaattatcaagtgcttactatgtaataatcaatgagtagctaattggaagcaagagagaatgaaatgggtattattcagatagtgtttttaatgaaaagcatagacgtagtactgtggggaaatatcactaaatagcaagagatttcatctgtgtgtgtgtgtgtgtgtgtgtgtgtgtgtgtgtgtgtgtgtttacaaaaggattcatttaagccactcataaactaaatccaggtatgtgaatcttttctttttttttagactcctcccaatgggtaaacattggaagacaccaggagggaagccaagcctctagagattgctcaggaacccaaaccaccccaaatggagccggaaggtctgtcaattcccagagagggaggaaatggtaagcaaatggcagcagttgcttagaaaattagggaatgaataacaatgctttctggtaaattaaccatattacattgtgcaggggaaagcgataggaaaaccctgttaaaaattgaataataatttgcccacatcatttatgcaaaatgcataattttcctacttcagtggactttagtttgatttaaaagatgagcagctctaggactattcactaaagcataatttgtaagataattgggaaggggaagagaaatcagactgtaatcagcacaatctttcgtaagtcacttcaccttcctcctctcacctgcaaattttggaaaatatttgtttaccctttcctgaagttctctaaatggaagtgcaaagcattaatcattgtcattgctaccactaaaccatgacctcaccatgagaggggggaaagccatgtttcattctattcagtatttttctgctctaattcaaataagtacttgttttgaatagtggggaaaaaaatggaaatgtagcaaagctatagttaaaacaacaagccgagaacaaaagcaacatgcatgcaggcaaaggagaccttggaagatacacagataaaacaaaaagctgtgcttggctgggattctgtttcagaatcaaatgcaaaatggagaatattgttccaactgtaaaggttttgcaatctacaatcagtcagaatgaaaagatatcatgtaatccaccttaacagtcagaagctgcactattgctgtgaattatgatatttgttcatgactaatgtagattttcagacccagaatggttgaaggtgggcaggaatttgtaggtataccagatacccttcacttcaacagggcacacccatgtcagctgatgtttatatctcttcctctcctccttttccctcctcctcaccccttgctccccaatctcattagaatcatgaaatttttacttatatattcattaattctcttcatccccatctctccacaaaagatcattatctacttattaaattcagcccttacacagtgtctcatgcctgtaatctcagctattcggaaggatgaggcgggaggattgcttgaggtcaggagttcgagaacagcctgggcaacatagccagatgtcatctctaaaaaaattaaaattaaaaatttaatagggcacggtggcacacacctatagttccagctactcaggaggctgaggtgagaggggatcacttgaaccctggaggtcaaggctacattgagctgtgattgtgccactgcactccagcctgggcaataaaacaagaccctgtctctgaaaaaaaaaaattttttttttttaaataaattcagcccttagagttctacctttcagggcaaacctgtttcctttgttggactaattcctgtctcttctacaaacttgctggtcccaaaacgctgaactttgaaccccacaaatctcaacacttcttatcggttgggtgcccattctggttaagcaaaaggaccttccctaatcctaatactcgtccccactctttccatctctatccccaaccgctgctactggctgaagatttattagatactagttttgtacctatgcgtcctgccacttgctataaatcgcctttatgcaaatcgaaaaagctaccctgcctcaagacactttgctgccatctgccaggaaattgttgtaataaatatgcaaaaggataatgactagaatgtgaatggtgccccttagaattgtgcagtacgcaactggcacaactatatgtgacaaccctgttgtttgaaatcacctgaactctcctggaaccctgtgtaaaaatcacaaccaccataggtcagttttgccttttcatgacagtttgccatttcaaaatctaaatcttccaccatgatcagaaattgctgaggggcagtttctaggagagacagagtccccacgcagcagtaactataagattatagggctcttccagcattcagcccaagctttgacctgctacctgggcagatacaacccaaaccatacttggttgattttcgggaagcatctaagttagaaagctggtaaggctgaatgttggggtgcagggggaggtagacctagcttacattcaggtcagccattacccatctctggctttggcggcttcatttcttgttgattgccccatctgttctcctccctccttcccattcagcacaacctgcacgtactggtgatctctcactacataacaaaccactccaaaacttagtggcagaaatagaaacagt

SEQ ID NO: 1137 - DNA, 2452 bp, Homo sapiens
cgcgcttctcccagcgcaccgaggaccgcccgggcgcacacaaagccgccgcccgcgccgcaccgcccggcggccgccgcccgcgccagggagggattcggccgccgggccggggacaccccggcgccgccccctcggtgctctcggaaggcccaccggctcccgggcccgccggggaccccccggagccgcctcggccgcgccggaggagggcggggagaggaccatgtgagtgggctccggagcctcagcgccgcgcagtttttttgaagaagcaggatgctgatctaaacgtggaaaaagaccagtcctgcctctgttgtagaagacatgtggtgtatataaagtttgtgatcgttggcggacattttggaatttagataatgggctgtgtgcaatgtaaggataaagaagcaacaaaactgacggaggagagggacggcagcctgaaccagagctctgggtaccgctatggcacagaccccacccctcagcactaccccagcttcggtgtgacctccatccccaactacaacaacttccacgcagccgggggccaaggactcaccgtctttggaggtgtgaactcttcgtctcatacggggaccttgcgtacgagaggaggaacaggagtgacactctttgtggccctttatgactatgaagcacggacagaagatgacctgagttttcacaaaggagaaaaatttcaaatattgaacagctcggaaggagattggtgggaagcccgctccttgacaactggagagacaggttacattcccagcaattatgtggctccagttgactctatccaggcagaagagtggtactttggaaaacttggccgaaaagatgctgagcgacagctattgtcctttggaaacccaagaggtacctttcttatccgcgagagtgaaaccaccaaaggtgcctattcactttctatccgtgattgggatgatatgaaaggagaccatgtcaaacattataaaattcgcaaacttgacaatggtggatactacattaccacccgggcccagtttgaaacacttcagcagcttgtacaacattactcagagagagctgcaggtctctgctgccgcctagtagttccctgtcacaaagggatgccaaggcttaccgatctgtctgtcaaaaccaaagatgtctgggaaatccctcgagaatccctgcagttgatcaagagactgggaaatgggcagtttggggaagtatggatgggtacctggaatggaaacacaaaagtagccataaagactcttaaaccaggcacaatgtcccccgaatcattccttgaggaagcgcagatcatgaagaagctgaagcacgacaagctggtccagctctatgcagtggtgtctgaggagcccatctacatcgtcaccgagtatatgaacaaaggaagtttactggatttcttaaaagatggagaaggaagagctctgaaattaccaaatcttgtggacatggcagcacaggtggctgcaggaatggcttacatcgagcgcatgaattatatccatagagatctgcgatcagcaaacattctagtggggaatggactcatatgcaagattgctgacttcggattggcccgattgatagaagacaatgagtacacagcaagacaaggtgcaaagttccccatcaagtggacggcccccgaggcagccctgtacgggaggttcacaatcaagtctgacgtgtggtcttttggaatcttactcacagagctggtcaccaaaggaagagtgccatacccaggcatgaacaaccgggaggtgctggagcaggtggagcgaggctacaggatgccctgcccgcaggactgccccatctctctgcatgagctcatgatccactgctggaaaaaggaccctgaagaacgccccacttttgagtacttgcagagcttcctggaagactactttaccgcgacagagccccagtaccaacctggtgaaaacctgtaaggcccgggtctgcggagagaggccttgtcccagaggctgccccacccctccccattagctttcaattccgtagccagctgctccccagcagcggaaccgcccaggatcagattgcatgtgactctgaagctgacgaacttccatggccctcattaatgacacttgtccccaaatccgaacctcctctgtgaagcattcgagacagaaccttgttatttctcagactttggaaaatgcattgtatcgatgttatgtaaaaggccaaacctctgttcagtgtaaatagttactccagtgccaacaatcctagtgctttccttttttaaaaatgcaaatcctatgtgattttaactctgtcttcacctgattcaactaaaaaaaaaaaagtattattttccaaaagtggcctctttgtctaaaacaataaaattttttttcatgttttaacaaaaacc

SEQ ID NO: 1138 - DNA, 1614 bp, Homo sapiens
atgggctgtgtgcaatgtaaggataaagaagcaacaaaactgacggaggagagggacggcagcctgaaccagagctctgggtaccgctatggcacagaccccacccctcagcactaccccagcttcggtgtgacctccatccccaactacaacaacttccacgcagccgggggccaaggactcaccgtctttggaggtgtgaactcttcgtctcatacggggaccttgcgtacgagaggaggaacaggagtgacactctttgtggccctttatgactatgaagcacggacagaagatgacctgagttttcacaaaggagaaaaatttcaaatattgaacagctcggaaggagattggtgggaagcccgctccttgacaactggagagacaggttacattcccagcaattatgtggctccagttgactctatccaggcagaagagtggtactttggaaaacttggccgaaaagatgctgagcgacagctattgtcctttggaaacccaagaggtacctttcttatccgcgagagtgaaaccaccaaaggtgcctattcactttctatccgtgattgggatgatatgaaaggagaccatgtcaaacattataaaattcgcaaacttgacaatggtggatactacattaccacccgggcccagtttgaaacacttcagcagcttgtacaacattactcagagagagctgcaggtctctgctgccgcctagtagttccctgtcacaaagggatgccaaggcttaccgatctgtctgtcaaaaccaaagatgtctgggaaatccctcgagaatccctgcagttgatcaagagactgggaaatgggcagtttggggaagtatggatgggtacctggaatggaaacacaaaagtagccataaagactcttaaaccaggcacaatgtcccccgaatcattccttgaggaagcgcagatcatgaagaagctgaagcacgacaagctggtccagctctatgcagtggtgtctgaggagcccatctacatcgtcaccgagtatatgaacaaaggaagtttactggatttcttaaaagatggagaaggaagagctctgaaattaccaaatcttgtggacatggcagcacaggtggctgcaggaatggcttacatcgagcgcatgaattatatccatagagatctgcgatcagcaaacattctagtggggaatggactcatatgcaagattgctgacttcggattggcccgattgatagaagacaatgagtacacagcaagacaaggtgcaaagttccccatcaagtggacggcccccgaggcagccctgtacgggaggttcacaatcaagtctgacgtgtggtcttttggaatcttactcacagagctggtcaccaaaggaagagtgccatacccaggcatgaacaaccgggaggtgctggagcaggtggagcgaggctacaggatgccctgcccgcaggactgccccatctctctgcatgagctcatgatccactgctggaaaaaggaccctgaagaacgccccacttttgagtacttgcagagcttcctggaagactactttaccgcgacagagccccagtaccaacctggtgaaaacctgtaa

SEQ ID NO: 1139 - DNA, 36048 bp, Mus musculus
  misc_feature (17933)..(18810): "n" at positions 17933 thru 18810 can be any base
  misc_feature (26477)..(28993): "n" at positions 26477 thru 28993 can be any base
  misc_feature (31779)..(32471): "n" at positions 31779 thru 32471 can be any base
cctcccaggccttgggaatacaggaatgagccactgatccagcttcagttcccaactattaaatccaccacaaggggaagggtcagccaaggaactgaaagtctattagttttttggcaaggtataatgacatacagccagaggcacaggcacacagacatagacaatgcctccagattacaatctattttcaaaatcctaggaaaaagatatataaatacgctaaaatgtttcagaggccagtaagcttgcacacagacaggttaggaaaacaatgtctaatgcttggttatgccgagcaatggaaacctcagagatcacaagatctctggcctcctttagcattttgcacatactgcctttccttttcttcttctagaattcccccttttaaatctgtcatgctgggcggttgtggagatgctcgcctttaatcccagtagaggcagaggaaggtggatttgactcaaaggtcagcccagactgatccaagctgctctttccccaccctaaccagaataggaagtctgcacacatctctctactcacagggccagcttacaaggcctttcaaacccagcaggccactcacccaagcatggaaatatataatctcaaaagttccaaaggatgccaactgtgaggccacaccacgttccttcacagaggacacaggccacttgttatgacccccggaaagctttaaccactctagagttaaagtccacaccagggctgttttaagagcatctagcttcctcttgccacatacaacccaactctcaaacaatctaccaagcaattcaggagaacagaacagaggctctggccaagccaggtggcaaaggcctgccccaactactcaggaacctgtggcaggagcctcaggttcaaggcctactatctctagactaaggtgagttcaaggcctaccaggacaacgtggtggttaagagacagtcgtgaacataaaaacaaaggacccaggggtggctcagtcccacacatagtagctcaaggctctggaatggaatctgcaataccaaaaccaactaaccacaaagtgttgcggtggtatcacctaaagctacgaactctcaggaacacacaggtgtattcacagtatggaacctggaagggcagccacagaagggtgtggcactaactgaagtctctcatgtgaccacaccactgacagcacagggatgcccgaggacagccaacctccctcccagtgcctgtctccccacagcctcctgtcccaggtttctttccccccttaccttgacattcggcatgtacttagagaagcgctcatattccttgctgatctgaaaagccagctccctagtgtgacacatcaccagcacagacacctttgagggagcaaatggagacagacacagtaaagtcagcccctcgtcacaagagcatccagcaacttgtcagtgatgttggtgaacattccccttgaactgcagaggacaccagctgagagcacatggagccagaaatggcctcctggtgattcaatctccacaccctctccagcactgcccccaacatacctgcccagtaacgggctccagctgctgcagtgtggccaggacaaacactgctgtttttcccatgcctgacttggcctggcacaggacatccatccccagaatggcctgcgggatgcactcatgctggactagaaggagaaaggagagacatttttgcaccatgccaaacccctttctccccagccgactcatcatatgtcaccttgtcacctttcagaccccatcctttccctgaccctcatcactcttacactcaagtcaaaccctcctaccccagctccccagttccgctaagaaagaaccctcgagaagctaccaacaggccaccttccacgttcctggctaaacttacttttcttacaccgtaacaatctatgaattcgactgccacaggccatttctcctacataggttgctgtgcttttgggtcatgtaaccctgcaaccttgaacaaaatgaaggacttggtacctgacccagaagccacagaagccagcatcctgatcgttaaggtttccggaaacgacacttggcctggcccaaaagaagggaactaaaggtccaaccaggccctctctgggagttcgaacagtcagaatgacaaaaaccaagcaaaaaagccaggcacagaacaaatggcagccctcggtttaatggagaacaaaagcctcttctacagctgccgtcttgggtacattctcagagcttggcctatcccaaataaattcaaatcctatgaccctagacttgaacctcccttttcttgcaccagaggtgctaaataaggtctctacacacaacaataaaatgtaccctctgatggatgctcaaagccacagtcaacgatggcccggagcagctctggcttgagtagaaaatctcggaagccggagctatggatggagacgtaggagcccttgacgtctttcttggcgggagcctcggtcccatctgccccagcggctgtctccacctcgtcgtcttcgtagtccaagagctcattgtccacatcgttctctgccataattgggccggcagggggagaagggaggtctctgagttaggtgtcccagagcaggtgaggaagcaagggccaaagagaggggttgaagaacagcaaggggaaagacaccagtttccgacagaagagctgggagaggggacaacaaaaaaaccggaaaaactcatcagtcacgaatggactcgtcacttctcgtcgatccctacacccgtcctattcttccctaaactgtgaaacctttgtcccgaaagaagagttaacaaagagtctcatgacataagaaacgggaacaccagacgggagagacagagtgggctccaccgctaaccagactttgtaacacacacttcgacaggcaggagccaactgggagaccgcagtaaaataagcgtgactaacgactcacacgagggttgagacacaaaggacaagggaagacagagactgcgctttctcctgccacctcacggtggtgatccccaacgtcagccatcagtcaagggtgatagataagggtcagcactgcgcagagcgctcacttcccaaatgcaaacatcatgtggctgccgctattctcttgctcagaaacccccgagtggccgtcccagcggcgcacacctggaccggggaacagaagcaggaaggagggtggtgcggggcggagagtgggaagtgtatgaatggctccatttcaagaaaaaaaaattttttttttgttttgaaaaagatgggtgtgtgcagttcaatggcagtgcttgcttagtaacgcgagaggccgcaaggttcggctcagcgctgccaaagttaatttaaaaagtcgcactaaggaattaaggtcacagctgagaacgatgcaggattaagagtgtgagctgggtggccttagaaaggaacgccttgcagtgctctcggaaaagcttccccagaagtgcgcgacaccatcggccacgcacagaggcagccattcacagagagctccaaataaggcagcgaaagcggggtcaaagggctggacgggccccggagcgagatcttcccatccctgggcgagcaagaaaaggcccggaggggagatgcgaggggccccgccctcctcctggcgccgcctccggccgccgcggccccgggtgggcagaggacccactggaacacccaggaagcgcggagacacaatggcggccgaggccaccattttggatcgttccccccttgtctcccagctccccgccaagatctgctctcagaaaggggtgaagacaacagaactggacgcccgcctgcgcgccggcggccacggcgccgacccggcaccgggtatcagggacccgcgcggcggggcgagccgcgggagaagcagatggcggtggatggtgcacagggccaaagcttacctaagcactgcgagcgtgtatggcggcagcaacggggacggaggcgggaagctgccttcacttccggttccaggctcgccccggcctcccgccttcccggccgccagggcgcacgcgcaaggagccggaagcaggctttcgccgcgcgcgctccgcggctggctttgcagaacgcccacttgaaatgaagcttctgacgacgcctcctccggtcgccagtagcaagagcgcgacaggaaactcacgtcttcccccgcagagctctccattttgttcttctacgcttatgcaacaccctccgacggtcggctctactttagttttgtttgccacgccaggcttctccctgggcacctctctgtgggcatggaggactccgcgatcgaatgagaagcgtttctcacggggtccttagcctcgtagtcaaggtgacccgagagcggctaactcaggcctctgctggaggggagggggacacgtgaccacgcccattacagtcgtgcagagaataggcaggatttacccaaaattatatcgaaagatggaggcttacattctgtctaggtgctaaataaatggtggggtttgaggttatgcacctttccataattcttgctaactagagcagcagaataatctcagttccattattcagcctggacatccccctccccccatgtggtattccctttgagatgttacatatagcagaagtgttgtcctgttgccttgctacataaacacaagctcgggctttccctattaaggacacttaatattaatacaaagtaacactaagtatcagtgttgccaaccagctggctgtgtcctgctcatcgcataagctctctgggctggggcttggtagcttttgatccctccgcatttggcagccctaagcagcaggccggcgggttttgtataaatcagagaggagtgggaattcctcggctctggtaacttattacgaactgtagctccagaaagtgcggtacctgggcctttagctttgaagcgtttccaggaactctcctagtgacctagttggcgggctcttagccactgtcttcctgttactggacctaatgtggtgacattgtggagggtagcatagtaaggtttgtcccagctgacccaagtgagccaaactttctgctttacagccagcaaagggtgtttgcaccaaacacagcaaacagcaaactcgtgcaaatgaagacttgtgtttgcaccaatcataatattgtccctttggcatcagtgataacacatcttcctgctactggactatgggaagttccaccctccactgggggaggagagagaggacagaaacaatcctggctgagccattagctgtgtggtttcctcaaagactttatagaagattcaaaatggccatgctgacagtccttgttaaggtagccagggcaggaagggattgtcttaacagctggctgtgattttaacaatgcttaaaacctgggccactggggccacagcaaggtgagtgcccctcatctgtcttgccatttttttcttcctttctctgttactgagtttgagcagttatatagactggcctcaagctctcaattctcctgctggaggatttgaatgcagacccatgccccgctccactcttcctgtaaacatatgaaaatagagaaataaaacaaggtggccaaggcaatacagctagcagggaaacaccagggtgtaagcaccccaatttcctatcacatgtgtccctcctcttcaaaaatctccttgcttttgtatagctatttcccccgaaacatttcctcctgatgagagtggagaaggctcaggaaattcagaaaaaaagttgcaagacacggaacacttctcccagattgtgtcaccaataaacagctcctggtggcaggactctttggtctgcatacaagtcacgctggtgggcgactttctgatgggaagctactccagtctcactcctataagtaacctatcacccaccatactgccaataactccagcgagctctttggtctgccaagtgagacttgggtggtgagatatctttggtgtttcatgactgccttatttggcatagattttttttttttcctgagacagggcttctctgtgtagccctggctgtcctggaattcactctgtagaccaggctggccttgaactcagaaatccacctgcctctgcctcccaagtgctgggattaaaggcatgcgccaccacacctggcttatagatttttttttaatgtctctctacagaaaagtcatataagactatgaattacctcattgattcaagttcagggtgaaatgagcagtgaagagaactgataaaggaatgggggtcagagaccagtagtgtcccaccccctcaccccctaccaccaccaccccaacttcctccttccccaccccagcatctttttattccaaagtattcctcaactgccaagtgtgtgccaagtgctatctaggctctggggatacaacgacctttatcatcagatacataatgagagccaatacccaaacataatgtcaagccaggcgtggtggtgcacgtctttaattccagtactcaagaggcagaggcatgtggatctcttgtgagttcaaagctagcctggcctagcaaattccagggtagtcagagatacttagtaagatagtaagtctctgtctctctgtctctctgtctctctgtctctctgtctctctctctctctctctctctctctcgtgtgtgtgtgtgtgtgtgtctgtctgtctgtctgtctgtctgcctgcctgcctgtctgtctgtctctgtctctggtgctgatgagcagtgtaaaaccaggaaagggacagagtgctgctctgccaacatttcccttacaactatctatgcaactctctgttcaagaggggacacagtactgtgtccttttgtttctccataaagcttccaggacagccctttgcagtgttttggaaactatataaatgcataactctgaggacagcgaaccaaagtgagcaacggcaaggcaaaaaggaggctgctttcaccgacaattgactcatccaccagtattttattgacactccgctgttacacaaggaggcaaggtgctgagggcacacaaaggaatgcatgcatgtgaatgtcatagatatcttcagctcccggaagcagcaagatttgggaaaacagagaaagaggggggccaaccatgagaaagaccagctcaggagaaacagagaggtgctaagagatttgatatatatttgggactcggacagaggggctaaataacattatcatttaactgttcgggggcatgatgtgccaagggagagccagagaaacaaattctttagagggttactagtgtcacagtggctgaacaaagctggaacacgaggaataaaaaagtcaggagagggggttagaattctggcaggcacgcagagtgcggtcatgatacaggcactccgtcatctggaactatgctgaattctcacagataattcacagcagccaccttacaaagtgagcgttgttgctgtcattccagtcacaaagatgaggacactgaggcttccaggttaaatagttgtcccagttgtgtaaccagcaaggaccaggggtgggagaggaacagaggttcccctgctctgaagtcagggtgctttcataactgtcaccaggacatatatttcacagaggggtccggtggggatgacgtgggcattcattagtaaacttccagtgggtgtcatggaacagagagattcgggtttgtcgggtttgaacaggctacttgtaagtctcaggggggaatattggatcctgtcacatagaagcctcccctccagcaacaggttattatgtgaagcgatttggtgggtgggggggatgatattatggattgaacccaaggctctgcgcatgcgacacaagtggttttgagttgggatatttctctgtggacggagctgacagaaggagtcactctagggatgtgtccctgagcgatggttctagacagtaacccgatagttggggtggacctggggcctgacttcacagaccatgccgagaagctgagccaggacgcgctcccgattcctctgctgggaactctgcatgccctgaacctgccgtcttgtggcctgctccacttcagcagacaggttcccctgagagcccatggcctgggggatgggggcggaggagagaaagaaaaaagcagacacagagaaaggagggtcccagcatgtaggaggaagggttcagaggaaggcctgggaagccttttcgaaactattcccaccccacaaaaacatgtagataccaagcaggtgggcacaatccttacttctgagactgaccataaaactgtccccaccatacagactgtgaaggccgccccacaagtctcatgtaccctttaaaaccctcagaccttacagatcccgtcaaagctttaccaatgtgtggtccttgtcagagcctcttcagctctcagacaccctaatttcttagtcacctgtatacacctggcaagaggcacccaccgatttgcacctgggtggggccatccctgtccccctcaactcaccgcctgctgcttgctctgaaactcctgctcccgctccctgcggtattgctccacctccatttgagcctcctccttcgcctgcttcagtcgccgggccttccctagaggcagaaggacagtgagtgtacacacacacacacaaccaggtgcgttaatgggatcagtgccctctagaaagttatccagtttcctgtcaaccaaccaaatgctagactgtaaaacccacccgtttcttctaccctaatagcctcagtcccccatctgccctcattgtccttgggcttttttttcctaaggactcaaatgcccgctatcctctattcctaaattctccttccatattcctaagagaggaaaggggggctcactcttcctggcatcggccaccttctccgctgcccgcttctcagcctggaggagctgctggataccctgggtctgactggccatttttatcactagagaggatgctgttccgaaggcgaccgaggtaccagacggctcccaccctccagcgcctactcctccgggcccttgatgcggtcctccactcccactgggtcttagcgctcccgttttcactcagtctcctgcaccgggagggtgtctgtcatcctcacactgatgactggtcctcctctcgaacctcactgaggtagtacccgaaacggccgcccgagggcagcagagaccagccctgtgctgactactgcagcaggtgcagggcctctccgtgtcaccagggtccacagagatgggtctgggggaagcggagggcagagtgtttgggtgtgagatcttgattggtggtctcgaaggagacacaaaggcgatgagaatggtgtgggaaggtaaggatgcgcttggacacagtacgctgggtttcacttacactcccaactgtgtctccacgcctccctccgcccttcccccctcttttcagcctccatcttctcttcagactttccccccaaatccgaacgtctgcacacatctccctgctctgtcctacgtttgccttgttagtgtctaaccatgtgtttttcttttttgatctacccatatatttggcctcattgtggttgtgtggtgtgtgtgtgattatgtgtgtgtgtgtgagattgtgtgtgtgtgtttcgagacagggattctctctgtagtcctggctgtcgctgcagctcgccctatagaccaggcctgcctctgcctctgcctcccttcgaaagctcgcctctcatcttccgcttgcaggaggaccctatgtcgcaaattgtcttgtttcccctccggagacctaatcacaagtcacccagtccgagcgttcggtacgatttccgggatggaacacacagttcatttccgcccgaaacttgcgcgtgtgcttgcgccatttcctgcatcctggcgcgcctcctccctccccacctcccttctccgagcgtcttaagcccaggcctccggcctccgtctctgagggtccttggggggggcggggagcaggtctgatgagtaacccctccccccaggccccagaggaagaagcctctacgtctgtctgtcgggtacattatattccatttctagatcgctctttgaatttgtgacttttctccagatttgtggctaatgaaaattgcccccatctggccttacttgatttttgttgttgttgttgtttccctccaaagttcagaattaacttttttcttgggctctggaaccttaaaacaactatgtatcattttctcaaaaattacatcaaaaattaactctgtgattcccccctccccaccagcccccaactccaaccccatccccaccctgcgccccaaacttgccatctgctaagggatgagagtttagaataggccttatctcttgctggagatgcaagggggaggaaatgggaggtaaagggagaaacggggaagagcggagctgggacctcaccgctgccatttcccacttcttcctcagccccagagttgttccatggcctccgcttcccgccggcaccgccgagagcgacgcttccggcggtacttgtctgcaggacggctggtgcgagcccaggctctcctccagcgacatcccgggcttgatgtggacgctgggcagcccccgcctctccacagggcctgcgcccgccacgatgcccctgccctgtgcctgctgctgcgtctcggcgctgaccctgcccaccaggaccgccatggcgacacggcgctgcacgctgctgcccgccagggccctgatggtgagtgggtccgtgggaactggtcttgagaagctggccaggtctgaactagaaagaatgcgtgggaaataaaggcctggtgtggtggcgcaggtcttttgactctgggcaagcagaggcaggagaatctctctaagtatgtagcctacacagtgagctccaagactacagagagaccctgtatcacacaacaaaatagttgggaaataagctagttctttggtccttgggaactgttgaagatccctggttgggatgtggccatacctctctagtaacagaaaagcttatcctaacatcgcccaatcaactaaggggtgtgtgctagcgtggtgtgattgtttgtttgaagatttatttattttatgtatatgagtacacactatagcggtacggatagttgtgagtcttcatctggttgttcggaattgaattttagggcaaccgcactctctcctgcccatatttattattataaataagtacactgtagctgacttcaggcgtgccagaagtggacgtcagatctcaagacagatggttgtgagccaccatgtggttgctgggatttgaactcaggaccttcagaagggcagtcagtgctcttacccactgagccatctcaccagcccgattgtttttgtttttgagtcagggtcttaccgagtctctcaggctggcctctgcatcccaagtgctgaggttgtaggcttgtgtctcccacacccagccgcatagctcgcaactctttctttacatttcctagctttcagctcagtgactactttgtttctttgatggttttttaccttgcagttgactgctcaggtcagatcccagctccactcaccccacccccacccccttagttttgcttctctccttgtaataatgccacaaacaccttacaaagtatccatgctttgtcacatgatcagctgggccggccagaggacttgaaacttttacttggtgttatgccggagatctgctgctgtgtgttagggatggactcatgtcccttgacacttaccaggcgccagaccagttttcttcattctcaccaaaattctgtaacaaaaatcctacttaagctggtgggtgcggtctggaggcggaggcagtccgggctctgcaaactcaaggccagtctgctctacatagtgagttccaagctagccggagccacggtagagagacgtcaacaaaacatctccagtcagcatcggtagtggctccacagtgcagacagcctctttctagttcatttgtgttacttactggcagatagccagcccagaaacagcctccccgcctagaaagacaggaagttcacaacacactcctgtaatcccagccctcgggaacacctcaaggccagtctgggcagggcctaagagtctcaaaaagtgaaggaaaaaaaagccatcaagcagatctcacctaacctacatggcggctatggtgtgactagttttatcccgctgaggttaacactcaggggtttcctaccagaaccctgcactctcctgcccctgctcccccagcctcttgacctagccccagatggcatacttctagatcagttttgccaaatcccacagttctggaaacagcgtaggtgttgcctttgcagtgacagcagaagcagttccctggagagcagcttccagactagaactggaggagaggcccgtctgttaagagacggacggccttctgcccacagatcaacaaccctgctcactcactcatctccagcttggcctctccttgatcaaaaccaaaaccaaacccaaaatcctctaacacaaataagatgggcctgcgtagttgattttctttaagcttaaagagaggaaggctgcagctgcctggctgagtttattatgggatacctgaagagaagaagtccccagactcctgaatacatcctgtggaatctttatataccaccagtagggctgttccaagcagagtagcaagccggaagcagcctcacttccagtttgaggttttaagagcaaaaaaaatgcaattgtggcgtatacagaaaggcagctctggacagctgcagcaagcaagctttgcttacagaagcagagaggtagcggttagatgatcaggcagttaaccttcagctcagagtcacactgtacaggaatttatggctggaccagagaccagtttactctaagagcttatagccgttcagttcacccaaggttgttatagcacttaaagtattcttaggtatgctttcaggagatgtgtacctagatagagttcagcagccggctacagtttaagaggcagctcctgggtggtagcagtgtggtgcctagggttgccgcttacggatcctgaggcctgcacccttacctcgggagcttgttcgcctccgaaacggaggttgtgataacacatgagccacggactggctgcagctttgctacgtaatgatcagttcgtgcggttcagttaacttggctgaggatctcctaatggtggaataggcaccgccaccgtcgtattgaattctgagaaacatgtgaaacatttaacacaccgtggcgaaagtgaggcctccctggggagtttcgggaacttgtctgcatgtcacagttgagaggttgcaatggtccaaagaggaaaccatccctccacacttctcccaacccctggtctttcagaccgtttcccggcacctgccagtcctgccacgaggtggcgctctaatcccaacttcatctcattcagcggctgcccgctgctttgaagatagttgaatgagattgatccattgagcagattgagcgattgaacctgcaggagtctcccctccactctcctgttaggtcagagggctgccctaggacactgaaatgactggggagcggggggtaccacacacagtagggggccagaagaggctcacattttaggctttgtgtgtgtgtgtgtgtgtgtgtgtgtgaatgtcatggaagatcagtttcagctgtcagagggacccatcagtaaagcatgcgtcaaacagtggccactctgcaaagagcaagcatgagtggacactggcaggcagtatagttctctccgtttttggggggagggaaaaacaagctatcattctgatgttagggtctggggtttaaggtttgctttggtcttctttagggtttggcttgctggtttgcttggttttttgttttttggggggcaggttgtttgttttgtttttgtttgtttgtttgtttgtttttacatagattctttctgtaggcttgtctcttctggaactcagtatgtagatcaggttatccacaaactcagagactgatccggtccctgagcctaagtccagggttgcaggtgtgagcccgcaccaagcctcatccccagccttcgtttttctctctttagtggagacaccaccatgtagccctggcagctcttgactgatattcctgaccaagacgcaggcctgcacctccaggcttgttttgtggttatgtgacactcactgtgtgctgatccgtcagcacggcatagacagcatccactgcctccctgatctgcgcagtggagccagagacggccttgtttcagaatgactgggcacagttgatgttccacctatccttccagcctcgcattctgcacacccacagacctgtcacctcggccgcagttgtcttcagtgaccctagcacaggtttcacaagccttaccccgtcaggaagtgggttgtgaaagagtttaccagagccagacatggtggcataggcctgcaatcccagcacccaggaggcagtgacgaggattacaagttcaaggccagccttggctacaaggccatcctgagctacaagaaaccctgccggggtttggggtgccagaaataaatagaaggcagacagtagagaggagctgtctgcacttggcatcaggaagtgttttcacaccatggtaccctggtcgtttaggtctcgagggagggacacttgtgtgggctcatgtcagatgctcagctggatattcctctactgtgggatacttgtcacagtgtaagttatttcttagagtccaaagttgtcatgagttaccaggggtcagaccctgatgggctgagcctgcttgttagagagaattctctgtagtgctgttgtgagatcgactgcagcctggctcattgagctttgttcttctaatcttaaaatttagttttgtttttctatctgtgtgtagaggtcagaggatacagttgttggtcctcaactctcattgtacttgagacagaattttttttaagatttatttattttatttatgtaagtacactgttgctgtctttagacacaccagaagagggcatcagatctcattacagatggttgtgagccaccatgtggttgctgggatttgaactcaggacctctggaagagcagtcagtgctcttacccgctgagccatctctccagaccatcttgtttgttttccaaccatgtcctccaggctagctggcccatgagtctctatggactcccaactccaccgcttatcttgcagtgggagtattgggattgcagatgtgggctgctgtggctgggattgcagatgtgtgctggtatgtgggatttcaggtgtgattgctggggatgcgaacctgagtcctcaaatttccgtggcaagcgctttaccaatattgtgttcttccagaccccaaattaactctttctggtcttgctcaaagacagtagcagtcttgcttgatcccagccctgggcaaccagccatcacagaacatcacccgcacacccctacacatgaggctcacagaagatggaggccatcatctggagttgcatcagggctgagtgcggcccttgcccacagtgctgatacgtcagagtcatgagaccacaggacatcaactttgttggaaagaggaggtggagttactgttgaaggggaccagaggtcagaggtcaggctgtgacaccagagcaggggctcctgggcggtgggaggcagcatcagtgtttacgtagtggctgctgttcctgaggcagcaccatctggaactgagagacctgaaatcagggagacattgatttaccataaggttgagtaagcaagggccaaagacacacagcagacttaaaacagaggttcctgagagctgagggagtccagacgcctaaaagagctgctaggagctgccccacggaggctggtgaaacccccgagttagacaaagcaacagctgctttgtttctcactggaataaagagatgagaaacatctgaacaccagggaggcagcacagactacgatcatgcagttctgagacttgcaaatatttgtaagttagaacaggaaagctgtgaacatggaagagctgtccctggacaggaccgtgtgtcaccttgtgtgtcatagccatgtggccttctcgggaggctctgagagtctcagacccaaccttaagacaatagaatacaagcaaaataatggtgagtgtcccctcgtccaaggccagcatcacactgggcctgtggggaaatggagggcattagggtgtgtctgtgtgtgtgtgtgtgtgtgttcatgtgcgcgccgcaccagccattgggatggaaaagaaccctctctctgtctagggagcctgaaatgttggggtaaaggtgggactacccagatagtttaagaggtctccttagggaaagccagaaagaatcccttgaaatgagcccctcggtgcctggagggggtaggaagacagagcttgaattggacagcgggcttcccagtgcagcactgtcgctctggcagaagacccaggttcagttcccagcacccaggggatctggcccctctcctgacctctgtaagcatcaggtacccacgtggtgtgtatacataaacgttaggaaaatgctcagacacataaaatctaaaaacacattttttttttaaaatgagtttcaaaaattctatcattagagctcagaaaggaagagaaattacctcagctgctcactaggatctggatgtgtttaaggatggctttcacctggtgctccccaaaagaagagagggctctccaagcagtgtgcaggagtaggctgctaggctttgactagaacaaccctacctccagacacagaacagaggccttacagcatggctgcagtctgagaagaaaggagctgacaggcctgcccgtccacttaactctgaaggcttttgtcctgagagagggttggtttcaggttgtttgtttatatggctgtttggttggtttttgagacagggtctctctgtgtagccatagctgtcctgaaactcactctgtagaccaggctggccttgaactcaaagatctgcctgcctctgcctcctgagtgctgggattaaaggcaggaggaaggatttttatggtaaatccagttcccaggttgtgtgaatgtgaagtgctcccagtcagactcggagccgtactcaccctggcacccagtggcatagcgcacagggacagcacaaccatgaagggcttggaagggccgagtttggagtgcagcctggtgaggtcccttccttgttagatttgtccccaccccctttctagaagatggagggcacagcagcaaggaggtggcactggatcctgaaggccttgcttgttctgagtgacactgggaatgaggaccgggtccctgacagactgaagggagcagggagtcagatccagggctcatatcccgagacagtggaaccctgggatgttgtttgtttttaccacccaggatctcctagacttggtgagcagggtgcgtgtgcgttaacatctgcttctaagttctccctgccgtggtcctacgctgcagactctagaagggaggggccctgagacccaggaggaaggaattgagggatgtgtatcaaaggcagggcacagagcaggcggtgcaggctgagcgggctgagcccaaggatgagtatggcagcccagctatgctgagacagcgtcttggggacatttttatggcagctttgggaaggttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagaagaggaagatgggacttcccccgggaggaggtggctgattttgttttatgctaatatttatcatcatcttcttctccttcatcatcatcatctcttatttttgttgctgtcttctgagacaaggtctctacatagtctcggctgttctggaactcattatgcagtccagactatcctggaataaacagatcctctcacctctgcctctccaatgctgggattaaagatttgtgctcccacacatgacttgaaaacaaatgagcaaaatcctagttttgttaaaactcagtttcaaagtaaccaaaagcccgacaaacttggcagaaaacaatcttcatggccaagacaaaatttctgtcacttgaaggagcttttggtcaatgctccaggcagcatctcccagacgctagtgtgaggcagaggttggccttcagcgtgggtgcgcatgctgcactgcaccgggtttcaccgggtttcggtgccccaaccagctcaccctcacctccaagctgcagaccttgtggctgacgctctcacgtgtcagttttactctcgtcttagcttttccgttttggaaaagtccagtcatttcaccttaggagaatcttaatttacacatacagaccttcttcttaactaaaaatacccttttcctttccaccttcctcaccaagagcgcctctccacactccatgcctctgcgtctcctgtacactgtctcattttactctttacttcctgaccagagccttgtctgttcagctgcatccgggacaaaaggtctcctggcatcactgcagacatgatagctgactagggggcgcttgtctgtccagagtctttataactgcttggattttttaaaaaagctctttttatgcttaaaaaaaaaatgttgagatagagaattacagagtattccattcctgtagaagctgacaaggataacaattgaccttgggcggtaattgtctcagtttaagccccagactggagacatggcccacggtgttgcaacaatgttgtgtgttaaccttgtagttgcaagttttagattctagatgcagttgttcctgcccctcatcccctcacccccccccaaaaaaaaacaaaacagaaagaaatagcaagttgttgggtttccttggaggaccagggggagaggagaaaaagagagcgggatggagcagaaggggtggggtgaaggctgttcagtgggggctggagattctgttgggtccagtgatggcagactccgtctagagcagttgtgtttggggcaggtccatcagcgggaggagacatagaccagatagtgtttcggcctatgtcagctgccttgtccagggcacagatgtcagggtgtgatagttgttctctggatttcctacctgaagtctttgaatgtgtgtggatgagagggagtgccgttggagggaagagtcagaggggaaggtggggtgcagtcgccaggtggagggataggtgctggtctcggagaagctggtggttgagtgggacctggcgtggccatcaagtctgtcgcctaaggctgagttcaagggaggccggtatgggaggcacctgttcttgtcccgtgctgaggccataaaggggggatttttttttttaattaaaataacaccaaagagatccaagtgtaggacaggagtgaaatggtgtgttgtgctgtggccagcctagtctggccagatttcattacaaaggaaaataaggttttgttggctgtgtcttttgagaggttgaacatagagtttaaagaatgtgagtcagaggtcatgaaacccatcataccagagatgcgcgctcacccagaaggcctcggagggcagcaggcctctttccagtactgacttgactgaggtgcccagaaccagggcatcctctgagaacagagacctcctggtccatggggtgaaatccagttggtcaggccagactgacctcaaagagagacacacaaatagctggccagaaaagggggttcactgcccctgagagagtgaaatttgggctacccacgggtctctttattcagaaagtctggctgggaggagggaggtgagcagagtttcttatatggttgtctatggtgctgaggttccagcccccaaacctgtccctttttccgtgtggtccctcctccctctgagtggaagtgctgtgctgttaaaggtgaggagagacttacacttttgtcatcaaggaaagagtatttcttctacagaactttgcatattcgcttccctgtgtgaaagggtgctccggcaaacatgatggcacaaacctcgcgggaaggtgggcaggaagagaagatgttagtgaacattaaacgcattgatttaggggctggagaggcagctcaggggtcaagagaccacaatgctcctgcagaggacccaggttcagttcccagcacccaggttgggcagttcgcaacagcctgtacctgctccccgtgagagagtaccaggacagacgggtatgtagagacccttgtatttttctggctactagttatatttttctggtacttgttatattcaagtacactatagctgttttcagacaccccagaagagggcgtcagatctcattacagatggttgtattattttgtgagtaacctgttcatgtcttcatttatttcctttggaaattttttcatatttgtacatatatgaaaatactttttaaaaagtatttaatccttagggctggagagagggctcaacagttatgagcacttgactgctcttccagagctcctgagttcaatttccagcaaccacatggtggctcacaaccatctgtaatgggatctgatgccctcttctggtgtgtctgaagagagtgacagtgtgctcacatacataaagtaaataaatacatctttgggggggtactttaaaatttatttcgtaacttcactccagctttaggaaggtaggtgctggcagaggccaggcgaggaaatgagactcccaaagcggctctattacccacacatctctctgttcagaaaagtctggctgggacagggagatgggactggaactctctgtagatcagactgtcctgaaacttagagagatccgcctgcctctgcctctctgcctcttcctaccaattactggaattaaaggcctgtgccactatgtccgccctaataaaaccatttttaaagatatatttatttatgtatcatttattttatgcatacgagtacacagtagctgtacagatggttgtaagccatcatgtggttgctgggaattgaactcaggacctctgttcactctggcccaaagatttatttattgttatattcaagtacactatagctgttttcagacaccccagaagagggcgtcagatctcattacagatggttgtgagccaccaggtggttgctgggatttgaactcaagatctctggaagagcagtcagtgctcttaaccactgagccatctctccatgaagggttgtcatgcatgcatgcacagtaaagcccagcaggcttgcacatgttccgacttagaacacccaccctcggcagatatgtgtccatgtccacactcgtgcaagtttaaggctaaaggctttggagacacagtctgacagacagggtaaagagaggtctgtgtctcagctcacagtggaacactcattacagtcatcaaagagtgaaacaaacggcaggttcctgggggaaaataaaagataaaaagccatgaggagggagagctgttagttcaccccagcctgactccacagtgaaacctgtctcataaaaacaccaagatgaacagctagctgctgctgtcagcctgtgtgggatgtgtatgccccaaggattctgttagcttcagttggattgtggtgacccataacaaggtaggagagtcacgaggttgagacctagtctgcagttacaaaatgagctctaggacaccctgggctgtgagaccctctcacaacacacacacactcacacatacacacacacacacacacacataccatagccaataaaataaatcgggtatttcaaaagaaaacaaaaacaaaatgaagccagttgccaagataggcaaatacctctgagtaaatgggcatagtgtggccacagctccaataacttgccgtgtgcacaattgtatggagcaaggtaggactcgaggttgcagcagactgttagcagttatgatgttaagctggatatgttggtatacacacatacacacacaaaataaaaagacagagttaaatcttccatatgagcctgggcctactcagaacatataaacacacacataagcacacactatgcactcacacactcaaacacactctgtactctcacataaatacactgcattctcacacataaactcactgcctcacactcccataaatacacactatgtattgacacactcataaacacacactgcactattgcacttgcataaacatacattgtgcactctcacacacaaactctgcactatcacacataaacatacactgtgcacacataaacactgcactcacataaacacatacacttgttaacataaacatactgcatgcttatacacacataaacactcagcactcacacacacataaacaccacactcacatacacacataaacactatgcatgctcacactcacataaacacacagtgtgctctcacacgctccatacacagtcacaccctgcagtgagccctagtgggaagaagttgaaggacggaagccagaagcaggtctgctaagtgggacagctcgggagggtttgtggcagatcacagcaggaagcctgccttgccctgatgtggtttcagagtggattggcaccttggcctgctgtgtaggcccttccatcctgctggcagttacaggtcagccctgcctctgtgccagcctcctggtaagtgagctaacttcctggaaccagcaaggcctgtgtcccatttccttctactctaggagaggaagtagggccccggcccaaatgctgccccagccgctcgcctccctctggctcctgatggaggcaggtggtggtcccagctgctgggcttccttcggtagggtgaagcgatggcatctggctcccctcagtttacctggtgctcaggctcaggagcaggcacccaaggtgcttggtccttccctgcccttgaccaccatcatttaggagggactcactctgcgctggcagcacctgtacgtcactgccacccttccctcccctggggaaggctggaacattctcctgaaaacttttattttactcagatttattgggtagaaacagtaaatgtactactatgtttgtgtgtagtggtgcagaacacagtgttttgatattctttattattattaatttaccatatttggactttttgagacaggattaatcctgtagccctggctgacctgcaactcactctgtagaccagactggccttgaactctctacctcctgagcactggaattaaagtgccaccatgcctaatgtgataatcttaatatgtaattttagatgagaacaatagtttgtaatatgtatatagtgataatagcttcaaaataaaaaataaaaataatcaaaagagggctgaagagatggctcagtggttaagagcacagattgcccttcctgaggttctgagttcaattctcaccaaccacatggttgctcacaaccatcagtaacaggatctgatgccctcttctggtgtgcatgaagacagcgacagtgtactcacatacataaaataaataaaatctttttttaaaatagtcaaaggaatttgaagtcgtcctaggtgccaagggcaagaaaacgcggttgtaacacttagagcaaactgagattgtctgtggggagcaagtcagagcgttcaaaactccacactcgtgccttatgtgattgttagtggctgtcgagttaagaaaatccaagatggcagcctcgcggagccccagctgactgctcacggtctctgcccctagcttacacggacttcttcctgccgctgctgagtcgttgcccatctgccatggggataaaaaataaggatggagagactcctgggcagattctgggctggggacccccctgggattctgccgaagaggaagaagatgaggaggtttccaaggagcgggaatggcggcagaagctacaaggcgagctggaggatgagtggcaggaggtcatcgggaggtttgaaggtgaggagcccattgccacccccagccgccctccctcccgcccctgccctgtgtcctctactccaggcccaatgcatgtggcctcttgattttactctttgtcttgtaagtccgctaatcatagcctctctccgacaacctcatcccacctcctgaacagatgatgcctcccgggacacgcaggagcccgagtccttctcagcctggtcagagcgcctggctcgggagcatgcccagaagcagcggcagcagctggaggcagagggatcctgccgacctccaagggctgagggctccagtcacagctggcgacagcacgaggaggaacagcggcttttccgagagcgagcccgggccaaggagaaggaactgtgtgagagccgagccaggagggctcaagaggctcaacgggacaaagggccagagcctcccagggctgggcccagggcagaacacccacgaggggcagagaggggcagcctctggcgctttggcgatgtgccctggccctgccctggtggaggggacccagaggccatggctgcagccttggtggccaggggcccccctctggaggaacagggggctctgaagaggtacttgagagtccaacaggtccggtggcatcctgaccgcttcctgcagcgattccgaagccagattgagacctgggagctgggccgagtgatgggagctgtgacagccctttctcaggccctgaaccgccacgcagaagccctcaagtgaccctagggaataagcaagaacctgtggggatgtagcctcaagaatagacggaaggaagcaaggtcgtggatggggatggacaagaaggggcagctgcggcacagagaggagaggatatgggacggctaacgtaatggttgtgggggtggggtgggggaggctctaccactgctctggactgccatttcctaataagacttggttccacacctcactccagagtctcctctgttttttccattgctatggttttcatcacccacgacatctcctttcccgcccaattgttgaaacccacagctcccacacacctgcggtacagtcacagtgcgctctcaatggagaccagaagcccctgcccgccctccttcagaaggcctggttcatcgtccagaccctgtcagctccccaccccacccccgccggggtcctgacaaggttgcagttgaagaaaaatgtgaacaagagacagaaaaaggaacaacccctccctccatctccaaccacatcctcacccctgctcagctcagggctttccctctgctgagtcactgaatgagctgggttgggggcagcagggctaggggaccacgaggacctgggaggatagaggatagaaccagaggggatggaggaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaaggaaggaaggaaggaaggactgggcggggagaaactgtgttgttggccaccaagcctgaaaacctgagttctacccacatagtgggggaagggaactgattcctacaaactgtcctctgacctccatagtgccctgtggcactcatgcacaccacaaataaaagtgtaattaaacttttttagccagaaagtggtggcacacacctttaatcccagcactctgaagcaaaggcaggcggatctctgagttcgaggccagcctggtctacagatcaagttccaggacaaccagggctacacagagaaaccctgtctcatgggtggggagttggaggaatagtggatggttcctgagaaagaaccaagattggattctagcttctacacacacatgcacacggacaggtgtacgcctgcacagatgaacatacatacatttacacacctgcatatacacacccgcatatacacacctaccaagatgacaactacaatatcctataaacttcgtacaaagggacatgaagatgtgccacatggttattggtagaactggggaagttcttggatcagcacccgtttcagctgcctaaagggttggatgtggcctagagcaggaaggttcatggctgaggagaaagacaggggttccgtttcagagagtttcatgaattcagaaaagacactgctgcacagtgagtaaacatgaggccactgtcagaaccctaggaaagaggcaaaaaaaaaaaaaaaatatccaagctaaatctacagagaacttggaagcagcctgcccaaggtactacagtgcttggctcagaacagccatgaccctcaggggaaacgtcctgcaatcgggtgtggaacctaagagcttgggcatctccttctcctcagaggtaaagcagccagagaagtaggagaatgcagaggcctgggtgggggtgaggtcagccagagaaggagcctcaagtcaagtcgtgatggggcagctacgacttaggcctcaaagagatctgctgggcgagaattgaaaggacctcgtaggttcacaaactagacgattacgaattttaagagagacaattttgttttattagaagggagagttgcttttcacactgaggagtgagtgggcggtgagctgagtgaggggcggtgggtacaaaggatggtggagacaagacaggcatcatctctacccacgagtcttgatgatggggaaaatcttaccagttcctgttagtcaaggggccttgtactgtgaaacaccgcacagagggaaggcgagagggagacagattccagggagggaatttaaaacttatcttcaagaaatgacaccaaatacgtccgtgcgttaaacaacatacgatggaaaagacactaaggacggggatgaggcggagggggaaggattatagattgaaggatcaattttgaaaagaaaaggtttttccaagaaagctgtaaaggggaagctttagttaacagaagggcaaagacggaggcagggagggaagccatcttcaggggccttaagctcagtggagggtgggggaggtcgagggttgtggagaacattggagaatccctcggagactgaaacccgggcgagcagcctgggggcccaccagcagcccctcgtgaccgattctgcagctcaggaggaaaacccaggaaatgcctttcatttcctcaaaccgagatcttcaaggtcttcttggttaaacatcgggtgggaacatttttcaaaactgagagtgtaactgaaattgttgagcctgtttgtttgtggtaaacaaaaaccagcaagaattgctgggggctggctgggctgagaaatggctgggctgggggatgggactggggctgaggctgggatgagggagctggggaggggctgagatggctgggatggggatggtgcattttccacataagcatgggcacttgggcagcaagcccagcaatcctaccttgagatagaacatgaggagggaaggagaatccccaggcacttgtgggctagcctgggctgtgcagccacaaaacctgaacctgcctcaaacaagggagaaggtaacacaagcctcccgaggctgcccactgacctccagacacacgtgtgaaagcgcacacaagaatttttaaaatcagaagtagcccggtgtggtggattatgcctgcagtccagcctttagacgtgaaggcaaaagcaccgggggttcaaagtcaacttcagctatatatcaaaaccaagaccaacctatgctattggacagtctcaagtcccacatccccaaaaataaacaccaagaaagaattcagggggttggaaagatggctcagtcattaagagtgctgactcttcttccaaggattctaagttcaaatcccagcaaccacatggtggctcacaaccatcttctggtgtgtctgaagacagtgacagtgtagtcatatatgtaaaataaataaatatttaaaggaaggaaggaaggaaggaaggaaggaaggaaggaaggaaggaaggaaggaagagggagggagctggagagctggctcagaggttaagagcactgatgctcttccagaggtcctgagttcaattcccagcaaccacatggtggttgacaactatctgtaatgggatctgatgctctcttctggcatgtaggcatacctacaggtagaacactcatatacataaaaagtaaaataaaaccaaagaaagaaagaaaggaaggaaggaagggagggagggagggagggagggaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaccctatcttgaatagaaaaaaacattgagataggtcttactctgtagccttgtctatgtctagtctgagcttcctatgtaggccaggtttctctcaaactcatagagatccacctgtctctgcctccccaggtctgggattaatggcgtacaccaccacacctggcaccagtgatgtgaaactgacctttgaaccccacaaggtagaaagagaaactgaactgattcccgtaagttgttctctaacctgcacacatgaaccggggcacgtattcacccctgcatacacaaaataatttttaaaatgtaattttttttaatgaaagagaggctagagatctgagtcaaagtgaaggattaactcagtggagaagagaggatagaagaaacaggttattattcctagggaaaattcagagatcaaagtcttaaaaaaaaaaaagaatcattttatcattaatctgtgtgtgtgtgtgtgagttgtgtgttgtgtggttgtccccacagagaccaaaaaaaaaggatcagagcccttggggctggagttgtgcggcacctgacatgagtattggaaactgaattcctcctgtcctctgcagaggcagtacatgctcctaaccagtgagcagtctctccagctcccagggttgaagctcttgaaaggcagccttgcttccaggggaagctgaggtgggaagtgtggcctttcccagagagaagctgaagctggccaccttaaggctggagagctgagcccagagccgaggacagacatgtgcactctgtgtgggtttgaagatggtgccaggtgatgaaagatgaagagaaactgaaccagatgtccaagttgttaggcatacagtacagatgttgatggagatacaactgtgaagacaggacgagtacggttcgtgcagagtcaggagcctctaaagaagagaatcctgttggtagcatggccacactcctccgtcacttctccctaatgctggtgtcaaaggaagagctaccttctccagagagggcacaggcgttgtctggtgcctaaagaaaacatcttcaaagatgaaacaggggatgtgcgtagatattccacagcaagaggacactgtgaaccagattcacagaagagtccttgctgggtagtgaaccacagaggggaccaaggagaaggacatcctgacaggctcgcttttagaatccataacaaacaggctcgcttttggaatccatgacaaactatgcattctatcaacacctggcatttattgtggggaggcgtgggacactaacaggccccgtggtccagggcttttacatcccaggccaccattatgctggcagctccttgtttccctctaaccccatcttgcctgtgaacctgaatggcttcagacttaacaactctctctctctctctctctctctctctctctctttctctctctctctcttaataagatttatttatttattttatgtatatgagtacactgtagctgtacagatggttgtgagccatcatgtggttgctgggaattgaactcaggacttctgctcactttggccccactcactcaggcccgcttgctctggcccaaagatttatttaatattatatgtaagtacagtgtagctgtctttagacacaccagaagagggcgtcagatctcattacgaatggttgtgagccaccatgtgggtgctgggatttgaactctggaccttcggaagagcagtcagtgctctttcctgctgagccatctctccagccccagacttaacaactcttgagagtggatttagatctcatgtacccaaagcagcacatttggcttttcctgcccacctacctaaggaccctaccttagctcccatccagctccatcacccagacccctgtttctcctcttgttcttctgcaaggcagcatagaccagggagccaccttgtagaccaggctggcttcagactcacaaagatccacctgcctcccaatcaccaccatccctcctccaccctgttctatcacacacactcacaccttccaaaaggtcccacttgaaccggaaagatcacagttgaataaaatgtcgatactttgtgtcttccaaaagatcacagttgaataaaatggagatactttgtgtcttctcacatggtctggccctgccttcctctcccactgcatctgacctcttcaagtgtctctgatgtggtcaagttcagtttcttgctgtccatcagcatccctggcttcctccctcctccctacctatctgtcacctgggccttttcttcagtgctacccttgctgagagtcacattactgagtgctgtatccaagagtattctcttccactccccacgccaccctgccttgttatccctgtaggactgttttacagattcattttattttatggcgatgctggggatggtccctgggtctcactcacgctaggcaagtgctctatctctaagacacatccctgctctttgatgtgtcttttccatctggcctggctggaacatgatccctaagagtaaaggatttactcttaggattctttggctcaactttgtgccacagtatacttcctgccttgaacaaacttcctggttggtactcagtaaacatgtattaaaagctgttggagggtgcggtgaggtaggacaatgtccagctctaatttctggctcaggtagaagttccatctagtatcatgctttgtttggggtcagtagctggataacaccagagacagggtaagctgtttcacaggaaggagtttatttgagagtcctttgaggggtatgtgcttagatttgaggttacgtttgaattgtgatttgggtgaaggttaaacttgggtaaaatctgaggctaaaaaaacagagactcacagtagtctttgactactgtcagttcagcctggtttgcaggctccggagctttctgtggcccttcctgagagtggttatagacgatgcacaagactcctagtcatcagccctcccccccggggaaagtcccagacagctgttggcctccccaagagagaaactgaatttcacacaacctctaaaactgagattgaaaccaaaattggcccatggcaaggcatatccgccagcgtgctgccagctcccgtgacacagcttagccaaggcttacccttccttcgtctgtctccatcatccccttatgcaccctctcctttcctctgcccctccaggtcccagccttctgctctgactcaaatctaatcctctctctgtctctctttctgtctctctctgtctctgtctctgtctttctctgtctccgtctctctgtctctctctgcctctctctctgccaattttcattttaatacagcttagccagcgtctcggctaccatcagttaagagacaaaagcaacaggaagcataaagactcccagagaaagaggaacaaagaaaaggagccaaagatgacacaatgacagaattaaattctgtctgagagaactcagtgaagagagcctgcttagcctgctcaggctgtgggtcccatggccagttctgccaaa

SEQ ID NO: 1140 - DNA, 1497 bp, Mus musculus
ccgggtgcatcctggcgcgcctcctccctccccacctcccttctccgagcgtcttaagcccaggcctccggcctccgtctctgagggtccttggggggggcggggagcaggtctgatgagtaacccctccccccaggccccagaggaagaagcctctacgtctgtctgtcggccccagagttgttccatggcctccgcttcccgccggcaccgccgagagcgacgcttccggcggtacttgtctgcaggacggctggtgcgagcccaggctctcctccagcgacatcccgggcttgatgtggacgctgggcagcccccgcctctccacagggcctgcgcccgccacgatgcccctgccctgtgcctgctgctgcgtctcggcgctgaccctgcccaccaggaccgccatggcgacacggcgctgcacgctgctgcccgccagggccctgatgcttacacggacttcttcctgccgctgctgagtcgttgcccatctgccatggggataaaaaataaggatggagagactcctgggcagattctgggctggggacccccctgggattctgccgaagaggaagaagatgaggaggtttccaaggagcgggaatggcggcagaagctacaaggcgagctggaggatgagtggcaggaggtcatcgggaggtttgaagatgatgcctcccgggacacgcaggagcccgagtccttctcagcctggtcagagcgcctggctcgggagcatgcccagaagcagcggcagcagctggaggcagagggatcctgccgacctccaagggctgagggctccagtcacagctggcgacagcacgaggaggaacagcggcttttccgagagcgagcccgggccaaggagaaggaactgtgtgagagccgagccaggagggctcaagaggctcaacgggacaaagggccagagcctcccagggctgggcccagggcagaacacccacgaggggcagagaggggcagcctctggcgctttggcgatgtgccctggccctgccctggtggaggggacccagaggccatggctgcagccttggtggccaggggcccccctctggaggaacagggggctctgaagaggtacttgagagtccaacaggtccggtggcatcctgaccgcttcctgcagcgattccgaagccagattgagacctgggagctgggccgagtgatgggagctgtgacagccctttctcaggccctgaaccgccacgcagaagccctcaagtgaccctagggaataagcaagaacctgtggggatgtagcctcaagaatagacggaaggaagcaaggtcgtggatggggatggacaagaaggggcagctgcggcacagagaggagaggatatgggacggctaacgtaatggttgtgggggtggggtgggggaggctctaccactgctctggactgccatttcctaataagacttggttccacacctcaaaaaaaaaaaaaaaaaaaaaaa

SEQ ID NO: 1141 - DNA, 1146 bp, Mus musculus
atgagtaacccctccccccaggccccagaggaagaagcctctacgtctgtctgtcggccccagagttgttccatggcctccgcttcccgccggcaccgccgagagcgacgcttccggcggtacttgtctgcaggacggctggtgcgagcccaggctctcctccagcgacatcccgggcttgatgtggacgctgggcagcccccgcctctccacagggcctgcgcccgccacgatgcccctgccctgtgcctgctgctgcgtctcggcgctgaccctgcccaccaggaccgccatggcgacacggcgctgcacgctgctgcccgccagggccctgatgcttacacggacttcttcctgccgctgctgagtcgttgcccatctgccatggggataaaaaataaggatggagagactcctgggcagattctgggctggggacccccctgggattctgccgaagaggaagaagatgaggaggtttccaaggagcgggaatggcggcagaagctacaaggcgagctggaggatgagtggcaggaggtcatcgggaggtttgaagatgatgcctcccgggacacgcaggagcccgagtccttctcagcctggtcagagcgcctggctcgggagcatgcccagaagcagcggcagcagctggaggcagagggatcctgccgacctccaagggctgagggctccagtcacagctggcgacagcacgaggaggaacagcggcttttccgagagcgagcccgggccaaggagaaggaactgtgtgagagccgagccaggagggctcaagaggctcaacgggacaaagggccagagcctcccagggctgggcccagggcagaacacccacgaggggcagagaggggcagcctctggcgctttggcgatgtgccctggccctgccctggtggaggggacccagaggccatggctgcagccttggtggccaggggcccccctctggaggaacagggggctctgaagaggtacttgagagtccaacaggtccggtggcatcctgaccgcttcctgcagcgattccgaagccagattgagacctgggagctgggccgagtgatgggagctgtgacagccctttctcaggccctgaaccgccacgcagaagccctcaagtga

SEQ ID NO: 1142 - DNA, 24888 bp, Homo sapiens
tagttgtttggggatctgggccttggtacagtatcaaataacaccagaaactactttctggtttcaagggggaaaagaacaactgtggaatcagactgtcacgacgctaatcctatggtaaatctaaaatcattaatgaggccaggtgcagtggctcactcctgtaatcccagcactttgggaggccgaggtgggtggatcacttgaggtcaggagttcgagaccagcctggccaacatggcgaaaccctgtcactactaaaaaaaaacaaaaattagccaggcatgatggcacactgtagtcccagctactcggggggttgaggcgggagaatcgcttgaacgtgggaggcgcaggttgcagtgagctgagatcgcgccactacactcacagcctgaaggacacagcgagactccatctcaaaacaaataaataaaaataaaataaaataactaacataagtcgaccagatttgtggcataacaggagatacagcatcacctatgaaggattcttgccaaaaatgcttaacttcaatcagattttttctttttttttgagatgggagtctcactctgccacccaggctggagtgtaatggcacaatctcagctcactacaacctctgcttcctgggttcaagcgattcccctgcctcagcctcccaagcaggtgggactataggtgtgtgccaccatgcacggctaatttttgcatttttagtagagagagggtttcatcctgttggccacattggtcttaaactcctgacctcaaataatccacacgccttggcctcccaaactgctgagattacaggtgtaagccattgtgcacttggccagaatcctcaatattcacacaccactggagctgttttaaagtttccggctttctctgccacataccccaaaattattaaactgatatgattcaaagtcagtataaagtagtaagaaaagggtggtcttgtgttaagcatcatccatagcccaattacgaatcctcctgttacataggaactcaacactctgttacaccacagcaaactaaagcttctccaaaattaaagagactattggcctacaagtttcttatccctccaacttgccacaccctcactctcaggtctctttaccttggcttaccttgacattgggcatgtatttagagaagcgctcatattccttgctgatctgaaaagccaactcccgagtgtgacacatcaccagcacagacaccttaggcaggaagtatacggagacatatggtaaatgtagctcttcattatcccctctagggaagtgactgtcacaaaaacacacctgggccgataataaatgacttcaattctgtgatctaaatcatgaaccccacgcttgcgacagaacatcccccacagctgtcaggttgtcaagggtaacagaggtcatgtgctcatggctctgcaagcatcatgtagttaggacaaaaacacccttcccttatagtcctaaccaaaatcccctccccagcactctccccaaatatacctgcccagtaactggctccagctgttgcagtgtggccaagacaaacactgctgtctttcccatgcccgacttggcctggcacaggacatccattcccagaatggcctgagggatgcactcatgctggactaaaagttggggggggaggaagataaattagacttcagtctccagataactctacctttttcaccatgccaagcccatttcttaccactcaattctcaaagtctagtatttacctggttcttgccaacttccagacccattttacctctctctgctcaattacattcacctcaaaatcagactctcctaattcctcctagctttagcctcctccagatctaggccttcccagtcctagtaacaaaccccttgcatctaccaaccgctcaccttcaatgatcctagctctgtccttatttttcttaatctgtaacaattcatgacatttgaatacctgccacagaccacttctcctgcttaggttgctatacttcgggtcacgtaactactacaaccctggacaaaatgaaggacttggtacctgacccagaagccagtcatctctaaaccagtcatagaggtttccagagaccacagttggcctggcccaacagagggagactacaggtccaagcaggacctttctggaaatttaaaattagaagtcaagtgacaaaattaaaaataagcagacaagaaaagccagtcacaagaatgaatggcagacctggaagtcacttttggatcattagcactttggtgctatcacgaaagaaagaataagcctgtataagcctcctctatccaaaattgtttttgatacttatcccgattttttcttcctcactgtcgccccggctggtgcacagtggtgcaatcacggctcactgaagcctcaaccttcacctgcttaatttctgaacgttttgtagagacaggagtctcgctatgttgcccaggcttctcttgcacttttgagctcaagtggccaccctcctgcctcggcctcccaaagtgctgggattacaggcgtgagccactgcacctggccctgatctagccttaagtataaacccttaccaccacctgagcaacgacaaacacatctttgtattgtacccttaaagagcccaatgagcactacatgcccaagagaaaatttaccttctgacggatgctcaaagccacagtcgacaatggcccggagcaactctggcttgagcaggaagtcacgaaagccagagctgtggatggagacataggagcccttgacatccttcttggcaggggcctcagccccatctcccccagctgctgtctccacctcatcatcttcatagtccaagagctcattgtccacatcgttctctgccataactgggccggcaggggaagaagggaagggggatctggatgggttctcgcaaaataggtgaaaacaaggggtgaagagtaggggattgaggaacagcaaaggaaaacaaagatactatttctaacagaagagctggaggggggaaaaaaaaagcaagacttaatcacgagcacagccttcaccatttttccatccccagttcccactttccctaaaccaggaaacttttacctggaaagaaaaacagatacaaaacataaaaacgaaaagcaaatataacagaacagaaaaagcagtaccagggaaagtggttaggacagaggttcccaacaagattagcaatcacagtagcggaaaccagaaaagttggaaggggaagaccaacttataaattcttgatctgaaagtaacagtgaggaaatagaatagataataaaaggtaaaatatgactaataacttagtaaagtggaaaatggagatgacaagtagagtcctgaaaagtcctcaaaggaagactccgctttccctattataatcccaccgttatggatgcctaactcagcagccatcagtcaagggtgatagatgagggtcatcactgcgcaaagcgctcacctttcgaaaagaaaacatcatatggccgccgtccacctcccatagctctcagcctcccacttctcagtatcctcccttccgctgtttaagcaagccttgtgtaattagcatgggggggaggggcggtgcaagacaaatggctcggccacaaaaaaacaaaattcatgtctccaccctacaataagaaagctaataggtgacagagaaaggcaatccccgcccaggctttaacaggatctttaccaagtggtctcacatcactgttacgctacgaaggtgagactccttttggagaaacatacaatgacaccaatcgtatcgtaaacacttggaaggcactccaaattaagttgggcaagtcaaggtgagaaaaatccaactgggcccagaaaccagctcctcctcccagtcccaccgagggccgaaaaagagctcaagaaagaacaaggaaggtgagaagagccccgccctccgcaaataccaagaccaagggacgccgagcaccgcctctcattgatgctgaggcctccaatatgagaagaacccattggaagaagggagcaaaacgaacacaatggcgccgaggacaccatcttggattgggtccccccttagcttcccttccttcccccaggagctctttgctctcgaaagggatgcaagctaaggaaatagcgaaccaactaggccccagcgaccagaccatcgcctgtgaaaagggtatcaggaacccatgtgacgggatgggtgcggagaagcgcagatggaaacggattgtagcgaaggccaaagcttacctaaacagggagagcgcgtatggcggcagcaacagcgacgaaggagggaaatctgccttcacttccggttgcaggcttccctctactccagcctcccgccttcttggctgcaagagcgcaggcgcaagggaccggaaacagggccttccgcggttatacagatccgtgcgctccaggcttgcctttggaaaatgcctgtctgaaatttgttttaaaaccgtttctaacttcactgctacctccagtaacaaaagatataaaggaaactaacgtctcccccccactgttatctttattctcttatcctactcctctccatgcccctcatctcttcgtttaggtttttgccacgcaggtcttctctgtaggcacccctccgtggatgcgcgaggaacgagtgtggcgaaggctgcgagttcccacggggtccttggcccggtagtgaaggtgacctgaggactgctgggcacgcactaggaaccggcaggccctagctgaggggagggaggagggaagtctcagggaactggattgctcgggggtgtttcccgactctttcccagtcgtggggctggtgggcggtattttcccaaaaggatgctgtccgaggtagctgatgccctagggccagtgagtcaggaaggtgttctgaatccgagcgggaagacggggtctggattcggccccaagtgttaatagtagggcttgagggttatactacattccattaatactgtttttgtttttgttttgagacagagtctcgccctgtcgcccaggcgggagtgcaatgtcctgatctcggctcactgcaaccgctgcttcccgggttcaagcgattctcctgcctcagcctcccgagtagctaggattacaggcgcccgccaccacgcccagcaaatttttgtttttttagtagagacggggcttcacccatgtatgacctcaggtgatccacccacttcggcctcccagagtgctgggattacaggcgtgagccaccgcgcccggcccattaatactgttaattcgagcagaatgttcttggccccgccccaacagccccattgttcaacctggatttttttcctgaatgaaacatttgctatccccgtctttgagatggggagccacaaaagtaagacctgatgtcctgctgtgtaataaaacaacaaacgtttggccctctccctgttaacatacttaatcatttaatactaaggagtaggtaccgttattctcatcttattgacagaagcgaagcaaagcaacatatctcaagcagtacggctggtgaggttacagccaggatgcaaacatctctcattctctattgtattctgcctccctgctcaaagaatctggttagtaaatacactgcaggttaccttattggttcaaattcttggtgaagtaagcttgtcttcagtgacaaatgaagtaactaattcaagaatggtgtcatagaaggtattttcccaagtatcatttaatttattcaaaagtatttatcaactgcctcccttgtgccacatgttgtcctaggatctggggacacaacggtgaacagccctgttctcacagtgtttacattacaggaaagaaaacacataaacacaaatataatgtcaagtatcgataagtggtcagggtgcagtggctcaggcctgtaacccaacccttgaggaagccgagcccgaaggattgcttgagcccaggagtttcagaccagcctgggcaagtgagaccccatctctacaaaaaattttaaaattagcaaggcatagtggcactcgcccgtaatcccagctactcaggaggctgaagtgggaggatcatttgagtccagggggtcaaggctgccgtgagctggaactccagcctgggcaacacagcaggaccttgtctcaaaaaaccagtagcagtaagtgctatgaagaaaatgcaaggtaaaggggcaaagagcacttgctcctacactccagcttttctctacagttgcgatctatagtcctcagattcccaaatgaggaaccatgtttctcactttagagaaataataaagtactacttgttcttgtttctccaagaagtttcaaaggatagccatttgggctgtttagggaatatgtaaacaaaaaacaagaaagtgactgaaggccaggcacagtggctcacacctctaatctcagcactttgggaggccaaggcaggtggatcacttgaggtcaggagtttgagaccagcctgaccaacatggcgaaaccccatctctactaaaaatacaaaaaatagccaggcgtggtggcacacacccataattccagcaacttgggaggctgaggcaggagaatcgcttgaacctgggaggcagaggttgcaatgagctgagatcacgccattgtattccagcctgggcaacaagagcaaaactccatctcaaaaaaaaaaaaaacaaagtgactgaaaatgagaaatgatgaggcaaaaggaggctgcttcaactcaccaatttatttgccaataattattttattgatactttttttattgttacaatgggaaagtaaggtgtcaaggatatagaaaggaagggcatgcatatgagggaacacagtatcattttagatcttagaaagcaatgagcatctgataagtctttggggaaataggaaaggaggaaaatctaataaagacaaagatcagcaaaagaaaaacaaagagaggctacaaaatgcagttatctacctggaattataagagaggggctaaatgtagtcatctcctctttttggagatcagaaggtctctgggaaaagagaagaaccaatttttcagaaaataactagggtcacagaatgaacaagtggaattagagagccagtgatggacgtgaggaaacagctgtgtaggttttgaccagtgagcaggtggtggtaatagtatcacagggttgctacttactgaatcactgctacaacatgcaaggaactgtgctagactttacagaatgattcctaatcattgaagcaaccctcacaaggtaggcattattatcatcccagtttcacagaggaggacatcgaggctaccaagttaagtagcttgtcctggtttcacagccagcaagtgacagggtcaagagagggacccacatcggccagacactgaagtcaggatgttttccacattcctacttccccatattacaaatttcacagagggtttaggtgagaatgacttggaagtttacaaagtcccagtgagggttaaagaacaacaaggagattcagatgtgagcaggatatttataagtgtcacaggaaaattattggatcctgcctcccaggatttctaggggatggaaagaagacagggattatggtgggaggtgattttgattggaggatttctttgagggagggaactggcagaaggagtcaggccctacggtggccctaggcagaaatccggtagttggggtggacctggggcctgacgtcgcagaccatgccaagaagctgggccaggacacgctctcggtttctctgctgggagctctgcatgccctgcacctggcgccttgtagcctgctccacctcagcagacaggttcccctgggagcccatggcctggggggtagggagaggggtggaagagagaaagggaaaagcagaaacagacaagggtccaggcatatgaggggaaagatcctgaaacaaagcctagaagaaaggccctctcagaaaccacccccatcccacagaaatatcccaacaccaaagagatcaacacagtcccctttccccttagacctaacatgcaacttcatcctaaaacagaccgtaatatccccaccacctcaccatccatgaccataaaactctaccctccaccacaaatgttaatcatactccacatagatgttatactttacacagactgtggcattccgcccacaagctctatgtggccttcaaaactcccagactctcctacatatcatcacaaagtttcaccaatgttgtggtccctgccagggtcccctcagcctcagccctctgccaccatattttcttgttgagtcacccttacacacctcactagatgcacccaccaacttgcagtggggtctcatcccgactctgcctcaactcaccgcctgctgcttgctctggaattcgtgctctcgctctctgcggtattgctccacctccatctgtgcctcctcctttgcctgcttcagtcgccgggccttccctggaggcagaagaaaggacagtgagtggggatggacccacacacacacaatgtaatagcaggagtcagtcccttccagaaagttatacagccttctctcagccaaccaggtgccagattctaatatccatccatttcttccctcctaaccagcctccagaccctagctgtcttcccgccagccttgggttttcccaaaatgtttgctgtcccccacccccaattttctttccaaactcctaagggaggaaagaggagactcactctttctggcatctgccaccttctcagctgcccgcttctcagcttgcagaagctgctggataccttgggactgactggccatttctgttgttatggccgatgctgttttgaatgctgtcaaagtaccagatggctcccaccccccaccgcttacttctcctcctccagctcgttgctgcagtcctccactacccctgggtcttagtgctcccctgctcactcagcctcctgcaccgagtgtctctcccaatctcatcctcctattgatgactggtcctcctctccagcacttcttgctcaggcagtacccaaaggggccgcctgggagcagcagagaccaggcccaaagctgcgggcttacaacaggttagccatcccagtcggaaaggtctagggatgaggcaggggcggagacgggggagtactgaggtgagagaaggagaacttgattggtggtaacagaggaagcataaagggttgtgaatgcggtgaaaaggtaaggatgtcatcatgcaacctgtgttgggaaaagagcattctgggcttaattctaaactaactctctacctttctctctctctccaccatcccgccccctcccctgcctcccgttgttaacatctccatctttttctacatatttctcaagtccaaatttttgcatctcacttgccccatcctacgatagtcttcttccgtcttttgtctgtattttttcttttttttgatctgtccctgttgttgtcccactgtggtttttgtttttgttttccatgtttaatgtgatttttatcctgtctttatctcctctattttctctgtcttctcatcttttcgtccatcactgaaccatctcctctctctgccaagttagaggaggcggggaaaaacctccaaataactctcttttctccctcccctcccctcgcctccttttcctcgcctccagtccagtcttctggtttcagacggcccctttaatttaagttccctagtttcccctgggagatctggccaagaactacccggtcggggcggaacgacatccggtaacgcccctcacagttcacttccgtcctccacctgcgtctctgcttgcgccatttcctccagcctggagtgtctccgcccttcccgcctcccgtctccgagcttcttaaacacaggccttgggcctacggctctgggggtacttgggggggcgggggcaggtctgatgagtaacccctccccccaggttccagaggaagaagcctccacatctgtctgccgggtacatgatattcaatttctagatcattattggagattatctgtgactttttaaaactcagatttctgctgataaaaattttccccatccggccctgttgggtttttttaaagttctttgttaaaaattaaaaatttacctgggctcctgagccttaaaccaattatttacccttttctcgaattttacattaaaaaaattaaacctctgatcctatcacccccctcaaaaaaaattttttttcaaatctatcatctgataaaggatcagggttaggttaggcctcatctcttgctgaagatattaaaaaaagacggaaccaaagggagaaacaacaggggatgtcagagatggagggagaaggaccagccaaggctgaagtcctgactgctgccttttttccttccccagcccaagagttccatggcctccacttcccgccgccaacgccgagaacgtcgctttcgtcgttacttgtctgcaggacggctggtccgggcccaggccctcctccagcgacacccaggcctcgatgtagatgctgggcagcccccaccactgcaccgggcctgtgcccgccacgatgcccctgccctgtgcctgctgcttcggctcggggctgaccctgcccaccaggaccgccatggggacacggcactgcatgctgctgcccgccagggcccagatggtgagtctgctcagtggggaacaaggtcataagcagctgaccagacctgaaatgaaagccaaccaatagttgagaaataagctggttatttggtcatcaggacctagggaaggagttaaccaagttggcatgtggctgtcatttgtccctttacattactgagctaccattgtctgaagaacccaacattccccaaagatcaactggtcttcaaatttcacatctgtttagattagtagctactttgtttcttgacagattgtttgctcgtagccaaaaagtagcatagaaggtaggctctggagttagattgcctggattcaaaccccagctccaaatcccagctccacacttcatagctacgtattcttggacaggttacttgaggcttagtttgcccatgtgtaaaaattaaaataataacaacctttgctatgtgccagacatttcttataaagtaacacatttaatcctcacaacaatcttaggaggtgagtactgatattatcccccatttcccagctgaggaaacagggcatagagaagtcatttgccagagttacagttattcactggtagagcagagattataacccagatggactagatagagtgtccatgcttttaacagctacattgtcctgtgttatacattatagcattgtacattgattgtgcccatgttcagagtacccatgttgtgccatatatgttttgagaatcaactgacatagtacataattagagtacctggcacacacgataagcacttggtatatgctggcgattgttgttcctgtttctctgttttttgtttttgtttttgttttttatgaagtttcactcttcttgcccaggctggaatgcaatggtgcgatcctggctcactgcaacctctacctcccaggttcaagtgattctcatgcgtcagcctcccaagtagctaggattacaggcgcatgccaccacgcccagctaatttttatatttttagaagagatgggttttcgccatgttggacaagctgatctcgaatgcctgacctcaggtgatccaccaacctcagcctctcaaagtgctgggattacaggtgtgagccaccacacctggccttgttcctgtttttgttatcaacaggtccatactcccttaaccacaattctaaactcaaaaacactctgagaaccaacatttttcatcaggctgccaccaaaattcatttggtgacagaaacctaatctgaactaaagtaagactattatttattttcatcctactgatgtcaatattcatacatttccctgcagaaacactcatgtgtttggttcttgggctgcctaggccctcctgggctacctaatatagagtgagtgtacttttaggtcagccctatcaagtcccaaaaacatttgaattctgcaaaacctttggcactgaaggattcaaatggggaacctggtgatattataatagtggtggaggccaggtgcggtgggtcatgcctgtaatcccagcactttgggaggccaaggcagtcagatcacgaggtcaggagttcgagaccagcctgaccaacatagtgaaacccccatctgtactaaaaatacaaaaattagccaggcatggtggcacacacctgtagtctcagctacttgggaggctgaggcaggagaatcacttgaacccggaagacagaggttgtggtgagccgagattgcactactgcattccaacctgggcaacacagcaagactccgtctcaaaaaaaaaaaaaagagtggtggaagcagctctttataggtagagccctgcttactagaataaaagctgaaaccttctttccccatctagagatttccttctggagtaagaacattacaggaaaacctctagatccagatgaacaaccctaacatcccccagctcaagtatagacagaaggcccctcccccaaaactcccccaaatggtcaaaaaaccccctatttaaaaatttcctttaacgtacctgagataggctagcatattcagatttgtttcttgttgtttttacttaaaacagagtaggtttactgagtgcaggcatctaacttgacagctcatattgtaagaggcaggaccctggaaggcaaaagagcagattaccccgaagcagacctgcatccagaccccagctctgccatcaacagggacatgcagcttacctctgtgagcccaatttgcctcgcaaaaatgggagttttgttttttgttttgttttgtttttttgagatggagtttccctgttgttgcccaggctagagtgcaatggcgcgatttcagcccacctcaacctctgcctcctgggttcaagagattctcctgcctcagcctcccaagtagctgggattacaggcatgcaccatcacgcccggctaattttgtatttttggtagagacggtttctccgtgttggtcaggctggtctcaaactcccgacctcaggtgacctgccagcctagcctcccaaagtgctgggattacaggcgtgagccaccgcgctcagccaaaatgcccctgatagtgtggtagggatttcctttattgtttgtttgcttgtttgttttgagacagggtctcattctgtctcccagcctggagtgcagtggtgcaatcatggctcactgcagcctctacctcgtgggctcaagcagtcctcccacctcagcctccctagtagctgggactacaagcacacaccaccatgcccagctaattgtttgtatttttggtagagactgttttgctatgttatccaggctgttctgcatctcctgagttcaaacagtctgcccacctcggcttcccaaagtgccgggactagaggcgtgagccaccacacccaactccattgtattgaattttaagaagctggtgagactgatattatcccatttacagatgaggaaagcagggcccaaaaggttcgggaacttgtctgaaatctcacagctctcaggtcattgtcttccaaagggggacccaagctcagtgccttcactcccagaccctggtgtcctctctggccttatttactcctggtcctctgccagccctgccaccagatggccttctaactccttggttgaaaggcccatctcattcagcttccagcttcctttttcttttccttttgagacggagtcttgctttgtcgcccaggctggagtgcagtggcatgatctcggctcactataacttctgcttcctgggttcaagcgattctcctgcttcagcctcccaagtagctgagattacaggcacacaccaccatgcccagctaatttttttatttttatttattaatttttaaatttttatttgtttatttatttttgagacggagtctccctctgttccccaggctggagtgcagtggcagtatcttgactcactgcaacctccgcctcctgggttcaagtgattctccttcctcagcctcctgagtagccgggactacaggagcctgccaccatgcccgactaacttttgtatttttaatagagatggggtttcaccatgttggccagactgctctcgaactcctgaccttagatgatccacctgcctcggcctcccaaagtgctgggattacaggcatgagccaccatgcccgacctaatttttgtgtttttagtagagatggggtttcaacatgttggccaggctggtctcaaactcctgacctcaagtgatccacccacctcagcctcccaaaatgttgggattataggcatgagccaccgtgcccatcccacagaatgtcttttggttttgtttttgttttctgttttgttttgttttgtttgaaaaggagtctcattctgtcgcccaggctggagtgcagtggcacaatctcggctcactgcaacctccacctcccaggttcaagagattctcctgcctcagcctcccaagtagctgggactataggcgtagggactgtaggcgtatgccaccacgcctggctaattttttgtatttttagtagacacggggtttcaccatgttagccaggatggtctcgatctcttgaccttgtgatctgctcacctcagcctcccaaagtgttgggattacaggcgtgagccacagcgcctggccaaaatgtttttatgtttatttttcttagtatgaaactccagcgtattaaagagcattgagaacggttgatctggtaaatcgctataaaggcggcatttcttttttttttttttttttttttttttggcgaagtgggggatggagtctcattctgtcgcccaagctggagtgcagtagtgtgatctcggctcactgcaagctccgcttcccaggttcaagccattctcctgcctcagcctcccaagtagctgggattacaggcgcccgccaccacgcccagctaattttttgtatttttagtagagacagggtttcactgtgttggccaggctggtctcgaactcctgacctcatgatccgcccgccttggcctcccaaaatgctgggattagaggcgtgagccaccgcgccaggcctaaagggggcatttctaatactggagaaaggtgaactttttttttttttttttccgagacagagtctcgctgtgtcacccaggctggagtgcaatggcgcaatctcagcttgctacaacctccgcctcccgggttcaagcaattctcctgcctcagcctcctgagtagctgggcacctgccatcatgcccagctaatttttgtatttttgtagagatgggggtttcaccgtgttggccaggctggtcttaaactcctgtcctgacctgaggtgatccacccacctcagcttcccaaagtgctgggattacaggcatgagccactgtgcctgaccaggtgaactattttataaataatattggaacatttggctcatctagggaaaaacaagagtcccacctcacacctaatcaaaaagtaaattccagcagattaaatacctgaatatgacaggaaggtacacaccaaattcatgggacagatggcctggggaggaatgaaacttggaaggcggtatcacggtaaactacctttatctgtgatgattttatttccttaaaataaattatactacaaacatgacagtacattaacaaaccctgtggtaggaatggggttgtgtattgtattatactttgtatttttgagagttttttaatttcttttttgttgttgttgagacagagtctcactctgtcacccaggctggagtccagtcgcgcaatcttggctcactgcaacctctgcctcccgggttcaagcagttctctgcctcagcctcccaagtagctgggattacaggcatccgccaccacgtcaggctaatttttgtatttttagtggagacggggtttcaccatcttggccagactggtcttgaactcctgacctcatgatccacccaccttgggctcccagagtgctgggattacaggcatgagccaccgcgcctggccgagttttttaatttctaaaaataaaaatgagtatacatctaaagtagtagaagaaaatgcagagaatgttttataatcttaaaatagagccttcctaagagtgaagtgaaataaaaagtcagaaaataatatattgatatagatttaactacatgaaaattttaggccgggtgcggtagctcacacctgtaatcccacactttgggatgccaaggtaggcagatcacttgagccaggagttcaagaccagcctgaacaacacagtgagacctggtctgtacaaaaaatacaaaattagccaggcgtggtggtacgtggctgtcgtcctgtagtcccagttactcaggaggctgaggtgggaggatcgcttgagcccaggtggggcagagtttgcagtgagcaagatcatgccaccgcactgcagcctgggcaacagggtgagaccttgtctcaaaaagaaaaaaaaagcttttttaaagatagatagaagaaaatgtttgcaatatgtataacacatacagtatatagaaccctcatatcaatatatataatttccaaagaaaaagtggataaagaatatgagcaattcattcacaaaaaatacaaatagccaaaagacatgaaaaagaaaaaaacattgttaataaaataattttttaatctatccaactggcaaaattaaaagggttgatgatattcaattttggtaaaggaagacataggcacacttgtatattggcacaaacttattgagagcagtttgaccaaattgcgcatgtcctttgactcagaaattccacttatgaaaatctacccccacagaaagactgtaagatactcatgaggctgaacattttttgaaacaaagtctatcgatattggggtaaggagatttgttttgtacacacagtggaacactaattataaagtcgtcaaaaagtatgaggtagactgtatatattcctgtggaaaaatataaatgagatgttaaatgaaagaagcaagttgccaagcaatatttgtagtatggttacatatctccaaataaatgtgtcatatgtatgcttttaggtacaccaaggtgggactggaagggatcacagtacactgttaatagttatcaaatttgttcgtccttctttaaaaagaaaatttcaacttaattatatccctttcacattaaaatgtcaaataaaattgggggaaaagccacctacagccccaccacccataggctagaatttttacatattttttgccagtctattttttttctttttttttttttttttttgagatgggagtctccctctgttgcccaggctggagtgcactggcatgatctcagctcactgcaacctctgccttccaggttcaagtgattctcctgactcagcctcccaagtagctgggattacaggcacatgctaccacgcctggctaatttttgtatttttagtagagacagggtttcaccatgttggccaggctggtctcgaactcctgacctcaggtgatccacccgcctcagcctcccaaagtgctgggattacaggccatgagccaccacgcccggcctctttttttccaaccataggatttggtctcttgttttagacagttattatctgatcctctctctctctctcttttttttttttttttttttttttgagatagagtctcaccctgtcacccaggctggaatgcagaggcgcgatctcggctcactgcaacctccgcctcccaggttcaagcagttctctgcctcaacctcccaagtagctgggattacaggcgtcagccaccacgcctggctaattttatatataatataaaatataattatatatatattttgtttgtttgttttagtaaagacgggttttcaccatcttggccaggctggtattgaactcctgaccttgtgatccattgtccccccccccagcctcccaaagtgctgggattacaggcgtgagccaccgtgcctggccacatctgatcctctctacagttttgtagccagcttttttcaaacacatgcctcagttgtagtggctgtttaatattatgtttttatagttggaggccctactccttaaaacctatgaatgtaaacctcccatgcaagcctgagcactcaccatgctcaccacctgagctcaggtggggaacaagcgaatgagagacaggaccaggtactttctgggtgggacaagttgagagggtctgtgacaggtcacagcagcactagggagaagtgccccccccaccaaccctgatgtgatttgggtagggatggtgggccttcgccagccacacctgggccattctgtcttcttgccttcctggccttgccttcccctattccagctttctgccaggtaaacagtactttccagcactaccaaataaagatttaaggactgctagcccatttcctcttaccccggggaaagaaagtaggtccacaggaaggaaggctgcctccctccccttcttctatcccccaagtgaaagaggtggttggtggccacagcaggtgggcctggccaggatgcctgggttggcagtgaaggaagtagcatggcactcagctaaccttgggccagatgcagcaaggttgggactgaagaaaaggggagttcaggaacgtcggttcctctcctgttttctctcagcccatgggtgagaccctctgtcacactccactccctttcccctgccctaggtcagcagtcatttggaaagagcttgctctgccgccggccatagttgttgccggttcacctccccacccctctcccatcatcccctggtaaggctggctgagagaaattcccctgaaaacatttattttactcagtttattgataagtgataataaaagataagtattacatatttgtgtatttattaatggcccagagtagagcattcagatattttcccagtctgatatatggtttcaggtgagaaaataagggatttatatagtgacaatatttttaagtgaaaagtggaatacatagtcaaagaatttgggcactgccttggtggctggaggcaggtcagaaaatgtcagttggcatggtagaacttctaggatgctgaaatagtttgtggagacacaagtaagaattttttttttttttttttgagacggagtcttgctctgtcacctaggctggagtgcagtggcacgatctcggcttactacaagctccacctcccgggttcacatcattctcctgcctcagcctgccgagtagctgggactgcaggcgcccgccaccaggcctggctaattttttgtattttttagtagagatgggatttcaccatgttagccaggatggtcttgatctcctgacctcgtgatccgcccgcctcggactcccaaagtgctgggattacaggcgtgagccaccgcgcctggccgagaatattttaaactaccacacttaccatgcatgtggtaaactatcagtctgtatttatcagtgatggttatttcctaatacccaggaggcatccatgtgagccacccttccattgctttaagaccaagggagcgagtgaccagcaggattcaagatggcagctctgccgaggagtgggagtcccagctaacttctgctccctgctctcccaccaacagcctacaccgatttcttcctcccgctgctaagccgctgtccctccgccatgggaataaagaataaggatggggagacccctggccaaattttgggctggggacccccctgggattctgctgaagaggaggaagaagatgatgcctccaaggagcgggaatggagacagaagctccagggtgagctggaggacgagtggcaggaagtcatggggaggtttgaaggtgagaagtccactgctatccacagctgcccttccccactggctgctttccatctgcatgaatgcgtcacactaggctcctctgccccctcctctgtgcttccctgcttcttggggcccatcaccttctcacagcctctctccaactacccccatcccaccctcccaaacaggtgatgcctcccatgaaacccaggaacctgagtccttctcagcctggtcagatcgcctggcccgggaacatgcccagaagtgccagcagcagcagcgagaagcagagggatcctgtcgacccccacgtgctgagggctccagccagagctggcgacagcaggaggaggagcagcggctcttcagggagcgagcccgggccaaggaggaagagctgcgtgagagccgagccaggagggcgcaggaggctctaggggaccgagaacccaagccaaccagggccgggcccagggaagagcaccccagaggagcggggaggggcagcctctggcgatttggtgatgtgccctggccctgccctgggggaggggacccagaggccatggctgcagccctggtggccaggggcccccctttggaggaacagggggctctgaggaggtacttgagggtccagcaggtccgctggcaccctgaccgcttcctgcagcgattccgaagccagattgagacctgggagctgggccgtgtgatgggagcagtgacagccctttctcaggccctgaatcgccatgcagaggccctcaagtgaccctagggaagaagcaagaaacttcggggctgcagcctcaggatgaggcagaaggaagggtaagggaaaggatggggaccacaaggaagagccaggtgctgctcagcagaggatatgggtgggagcgaaagttgtaacaagtgggggtggggggtgcgggccgccaccactgctccttgactctgccgtttcctaataagacctggttccacatctcactcccagtgtctcctctgtctttttccattgctgtggttttcatcacccatgacatctcctttcccgccccgcctgctgaaacccacagctcccacacacctgcaacacacacgcacacgctaacacgggctctgagctggaggcaagaagcctctgcatgccccctcagttcagccctaagaaggcccagtttgccatccagtctcactccactccctacactggggtcttgtccaccctgcaatctgtggctggagaaatagatgcgaacagaggcaaaaaggggaacaaaaccagtttccctcccctccctggctccccaagctgaaccacatcctcctccccacttaacacccccttcccccaacacagggctttccctttgctgagtcactgaatgagcgagttgggggtagccggcgctggggggccatgaggaggctgggggaggatggggaatacaagcagaatggctggaggaagagccctgtgggggagtggaatttcagttgctaaaattaggagcaggggaaggaggtggaaagagcaaaattatgtaacatgggttgtctgttcttgggcaactggagctccacacccaaagccagccaggctgctggctccatccatctctgccctctagcttgtcagttgtatctctcttcctccagggccccaatcctcatctccgccattcagctgctgccccatcctaaacctgagttcatctctgggcagcccaggcatggccttccctataaacatttccttttccaagaaccagtagttgaagtcctgagaggtggagggagagtctgggattcccacggaggagagaggggggctccctggaaactaagataggtagaccccactaccatcgcccaggacacaactgggaacttggcaaaaagaaaggacagggctgcaaggagagtacagacatgtgctggtgagtgcactgtctgcatagttacaccagagcatcttatcaatcagaaacttatctttcaggttttgagcccagttctctacaggagaatcccaggagtggaagtggaaggcagtagaagacagggagggcacgcctctgggaacacgggaacatgggtgggcatgagatccttgaataagacagcctgaagttcggaagagaccaaggcctctgaaggaccaggcagatgttcagggtgcaggagggggaagggctggtgagaaagatcctgtgagaggaagctgctgtgattcagagaagagacttcaagctgtgtgtgaccctggcgtccggttcctctcacaggctggagcttttcggaagtggcatgcaaagagtccaggtttggccttggggggagttggggttaggatccctaagctggaggttgagaagtaaattacagaaaactctggtgaccaaatttgctcctccacccaggagatttctcactggtttttaagcacatcatttccccttctgcaagagttacataaaaccaaagcaaaataagccctgaaacctgggcccaccggaccacagtcttttcaacgtcccttcctggtgtctggcccccagccctggtgggggttcccctgagataagggctgttcactttctctgaccacatggtttccgcttctgtgtctcttgtttcctaggctgataaaaatactgagccctagaggccctggcttcctctgaccccttggggcaggcagcaggcatcctgtccagcatggtgggggcagggacaggggccagggattcccaaggggtgactcagtgcctgccatgaaacagtgggtaggtggaagtgtatctctgctctctagagctggcaccaggagttgagtctcagtggaggatgcattgggattcaattggaggaacaggcctggaaaagaataatgagattgaagagggtcagtttgaggactcaggttggggcaggtttggattaagttaggaaaaggatctgggagggactctgttcagtgtaggtcaactgagcattatgtagcccaaagataaatttaaaccctgcttcaagcttacaatctagtggggaggcagacccatacctaattaactgattcaaggcatgatgagtaaactttaagatgattacagaaagaggggagattaagtccatttgaaagcatccagggagcctctgaggagacagcatttgaacttgctctaatgaatgggttcactaggtggaggtggatggaaaggttccataggcgaataacacgtcttgagcgagcctgacaagtcagaaaatgcagtatgttctgggaaaggagcgtcctgagggagaagaagcacaggtgtgagggaacatgtgatgaagaaaggaccacagaaagtcaaggtcagagattggactgcatcctgtgggcagtggtccaggtgacgatgaaaaagagggagaacaggtgagtgctgcagtacagacaaggagtaagaaaacggccatcatcttgtgaattaatacctactgtgtgttaaccagcccttttcctaacaccacaaatcctctcaacgtctgtccaaaaggtgggtggtggtggccaggcacctcactcctgtaatcacagcactttgggaggccaaggtgggagcactttgggaggatcacttgaggccaggagttcgagaccagcctggccaacatggtgaaaccccgtctctactaaaaatataaaaactagctgggtgtggtgttgggcacctgtaatcccagctactcaggtgtctgaggcacaagaatcacttgaacccgggaggcagaggttgcagtgagctgagatcatgcctctgctctccagtctgggtgacagagcaagactctgtatccaaaaaaaaaaaaaattattaagcacctattaggagcagggcactgcttgacaataggtataaataataaagtcactgccttcatagaacttgcagtctaatgagacagtatacaaataataactatacattatagttataatgtataggtatgcctgcttagggtaataaagtgctcaatgaaggtttgaggtaccagcatgactctcaggtggagatttccagaaagcaggtctggagctcaagagaagttgggtctggaggaacagatttgggcatcattcccttcccagtagaggttgagcctttgagtggacaggatcttcaagggagggggcggagtgaccagaagagccctgagcatgatcaaaggaagagaaccaataaaggagaggttggggagcagtcagagaagcagggcacggggggcgggggatgccaagcagagacagggcagccatgtttgaggcttcaaagaggtctagtaaatgagggttgaaaagattgttgggttcaggaactagacgattacaaattttgagaaaaccgtttccatttaatagaggggcagaaatcactttacataggttgaggaatgagtgggaggtgaggaaaaggaggtggtgggcatgaggtcagaatggtgaacacagaataactgagaatcatctcttagttctacccacagattttacagttgagggaaattttaccagttcctgaaaaagtggttcgttaagggggctagtcttttgagacatcacacgaaaacggaaggtgagatagactggacatttgagggagaaatattaccaaggaaggatcactacttc

SEQ ID NO: 1143 - DNA, 1459 bp, Homo sapiens
ccgagcttcttaaacacaggccttgggctacggctctgggggtacttgggggggcgggggcaggtctgatgagtaacccctccccccaggttccagaggaagaagcctccacatctgtctgccggcccaagagttccatggcctccacttcccgccgccaacgccgagaacgtcgctttcgtcgttacttgtctgcaggacggctggtccgggcccaggccctcctccagcgacacccaggcctcgatgtagatgctgggcagcccccaccactgcaccgggcctgtgcccgccacgatgcccctgccctgtgcctgctgcttcggctcggggctgaccctgcccaccaggaccgccatggggacacggcactgcatgctgctgcccgccagggcccagatgcctacaccgatttcttcctcccgctgctaagccgctgtccctctgccatgggaataaagaataaggatggggagacccctggccaaattttgggctggggacccccctgggattctgctgaagaggaggaagaagatgatgcctccaaggagcgggaatggagacagaagctccagggtgagctggaggacgagtggcaggaagtcatggggaggtttgaaggtgatgcctcccatgaaacccaggaacctgagtccttctcagcctggtcagatcgcctggcccgggaacatgcccagaagtgccagcagcagcagcgagaagcagagggatcctgtcgacccccacgtgctgagggctccagccagagctggcgacacgaggaggaggagcagcggctcttcagggagcgagcccgggccaaggaggaagagctgcgtgagagccgagccaggagggcgcaggaggctctaggggaccgagaacccaagccaaccagggccgggcccagggaagagcaccccagaggagcggggaggggcagcctctggcgatttggtgatgtgccctggccctgccctgggggaggggacccagaggccatggctgcagccctggtggccaggggcccccctttggaggaacagggggctctgaggaggtacttgagggtccagcaggtccgctggcaccctgaccgcttcctgcagcgattccgaagccagattgagacctgggagctgggccgtgtgatgggagcagtgacagccctttctcaggccctgaatcgccatgcagaggccctcaagtgaccctagggaagaagcaagaaacttcggggctgcagcctcaggatgaggcagaaggaagggtaagggaaaggatggggaccacaaggaagagccaggtgctgctcagcagaggatatgggtgggagcgaaagttgtaacaagtgggggtggggggtgcgggccgccaccactgctccttgactctgccgtttcctaataagacctggttccacatctcaaaaaaaaaaaaaaaaaaaaaaaaaaaa

SEQ ID NO: 1144 - DNA, 1146 bp, Homo sapiens
atgagtaacccctccccccaggttccagaggaagaagcctccacatctgtctgccggcccaagagttccatggcctccacttcccgccgccaacgccgagaacgtcgctttcgtcgttacttgtctgcaggacggctggtccgggcccaggccctcctccagcgacacccaggcctcgatgtagatgctgggcagcccccaccactgcaccgggcctgtgcccgccacgatgcccctgccctgtgcctgctgcttcggctcggggctgaccctgcccaccaggaccgccatggggacacggcactgcatgctgctgcccgccagggcccagatgcctacaccgatttcttcctcccgctgctaagccgctgtccctctgccatgggaataaagaataaggatggggagacccctggccaaattttgggctggggacccccctgggattctgctgaagaggaggaagaagatgatgcctccaaggagcgggaatggagacagaagctccagggtgagctggaggacgagtggcaggaagtcatggggaggtttgaaggtgatgcctcccatgaaacccaggaacctgagtccttctcagcctggtcagatcgcctggcccgggaacatgcccagaagtgccagcagcagcagcgagaagcagagggatcctgtcgacccccacgtgctgagggctccagccagagctggcgacacgaggaggaggagcagcggctcttcagggagcgagcccgggccaaggaggaagagctgcgtgagagccgagccaggagggcgcaggaggctctaggggaccgagaacccaagccaaccagggccgggcccagggaagagcaccccagaggagcggggaggggcagcctctggcgatttggtgatgtgccctggccctgccctgggggaggggacccagaggccatggctgcagccctggtggccaggggcccccctttggaggaacagggggctctgaggaggtacttgagggtccagcaggtccgctggcaccctgaccgcttcctgcagcgattccgaagccagattgagacctgggagctgggccgtgtgatgggagcagtgacagccctttctcaggccctgaatcgccatgcagaggccctcaagtga

SEQ ID NO: 1145 - DNA, 47115 bp, Mus musculus
  misc_feature (1171)..(1270): "n" at positions 1171 thru 1270 can be any base
  misc_feature (28066)..(28402): "n" at positions 28066 thru 28402 can be any base
  misc_feature (34855)..(34891): "n" at positions 34855 thru 34891 can be any base
  misc_feature (37116)..(37389): "n" at positions 37116 thru 37389 can be any base
  misc_feature (43130)..(44280): "n" at positions 43130 thru 44280 can be any base
gctctgtacaaggtcattttccagacaaggccagccacctgtgttcagggacactctccagacagagacagggaagccccactaagaaagggagaccccattttgctctatctggtcttggtggactgctaccatcatagcgaggttctccaacagctttcctgctcagtcacatatactcagatgtcaccggcttttctcagaccacattgcaagggaacccatctgtgtatctgacttcgttcttcatggactgtagctgcctatggatggggcagtcctgacgtctatccttggagtcccagaacctggtactagacacgtgcctaatgaatccttgttctgggaatgtccttagtgagtcatgacagtgggcactgtactcatgctgggtgcctagggattgggatgcccgtgagggcttcagcgtaacagccacacataggtgatgccacatagtgtgcaggctttcgtcacgtgagcaagccgaggaagcagagcagtatagaggctcacggggaggccttgctcatgtatatcactcaccacatggctcttttacttgtacctggaggagattatcttacagagagcctgtccctgggtcctcagcaagaggagtatgtcctctcagtttctgagtcatctctctagctctaagatctcatccctaatgcaaatcctgtctacaaaagatgatgggctctgtctgagttcttcttctgtttcttttttggactagcccaaaccacagctcaactttgtctatgctttctttcattaaactgacaaatttttaaaaaaatcatgtatggtaggtctctatgttgatcagcctggtctacaaaggaggttctaagttagatggggctagaaccatatatatatgtatatatatgtgtgtgtgtgtgtgtgtgtgtgtgtatgtatatatgtatgtatcacatatatatcataacatgatatatgtgatatatgtatatatgatatatgtgtgtatatatgatatatataatccttatacaaatatcaatatctaatttgtaaatttcctttttacagaaaaagggtttataaacgctaccagctcgcaagaagagtatgaaattgacccgtacgaaaagttctgcttctcagtcaggtttaaagcgtacccacgaatccgatgcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaattccccggcccccatccccggtatcgagcacctctgtccccgagctatagacttagccccctcagtctgtgagttgatttattgttgagtcagaaaactgaagactgaaagcaaaccgcacctgtgaggagagccacttttccttctcttccgggactaaagcctgctgcatgaaaacagaatcctggcagttttctgtcaagagactgtggtttcctgtctaagtgctgcgctctgacagtaccgggcggctaagtgcggttgtgagtgatgggggagtcggacctccttgccaactgaaaacatctgccctaggtgtactgatttatgttctcaaacacaaatgcagaaatagcccgagcataagtcacaaaagaggatctccttctcctgggggtttgttcaactctggtctagagtgttctggaggcgaacgtctcattccttctttgaaaagcaaaagcctgctttccccggtttcttctgttaactatggtgcctcttctgtctttctctcctttacagattttagttttagccatgtgtatgtgggtgacagtctgtgtgtgtgtgactgcggtgtccctggaggccagaggcttgggattcccctggagttggagtcacagtggctgtgagctgtcccacgtgggtactgggaacccagctcaagtcctctgcaacggcactgtgggtttgctcttattcgctgcaccaaatctgcagcacagctcatggagaaacactgtctcaacaacaacaacaacagacagacaaaaaaccaaacacacaaaacaggaatgtagaacatctcattaataattttcacactgaggctatgcttcaatgattgtttgaggtatgagagttacagagatcaacgaatgcactcagctttcccctctctttacttcatatacatatctgcaggggacttaaaaggaaaacgaggcagctgtctgttgctctggtcactgtgacaagagctgacctctttctaccctctacgctgctcctagtgtttctttcatgatagtatgcttttttttaaaaaattcccataagtgatttataattggtctttgagaaagtgtgtgtgtgtgtgtgtgtgcacatctatctgtatctctctctctgtatgtctgtgtttattctctctctctctctctctctctctctctctgtgtgtgtgtgtgtgtgtgtgtgtgtgtgtgtgtgtgtgtgtgtgtgtaggatggattccctggatggaactggacttataggcagttgtgaaccacctcatgtaggtgctaggaatcgaactcaggtcttctggaagagcaatgcttgctttaaacccctgagttctctctctacctctaaatttgcctaggggggtaggggtgtcttgtggggtgtatatgtgtgtgtgtgtgtgtgtgtgtgtgtgtgtgtgtgtgtgtgcgcgcgcgcgcgcacccatgtgcagaggccagatcaacatcctctgttgtgctccactgttttttaaaacaatacttcatgtaatgcttatgagtgttttgcctgcatgtctatctatgcacgtgtgtctgctggggcatcaggtcacttggaaatggagttatgggtggttgtaagccaccatgtggatcctacgaatcatgcttttaacctctgactcatctttctaaccctctcaactatttttttttttttgagacagactctctcattgaacttggatcttaccattttggctagactggctgacctccataccccagcactaaggctacagagcacgcactaaggctactgcactcaacttttacatggtggggatctgaattcagattctccggctatactacaagctttatatacagagccaccctctctgcttcctatttgtattatttatttatttatttatttatttatttatttatttatttatttattggtggggagaaggggacagtttgagaaagggtttctttctctctgtatccctggctgtcctggaacttattatgtagacccgactggaccttacactcactgagatcttcctgcctctgcttcctgagtgcatcaagctatgcaccaccaccacaccaggctcgcataagctcttatccagaacttgaattccagaaggagaagacagggaggaacggatgaccatggagcctgttttcaggatagctggcttgctggcccctctgtggtcgtgtgagagctaacacagccttagggactcctgctgcattccaggatggttgtgaacctgactcaggtgaaggaggggataaacctggtttaaccaatggtaaggtcgcgatgcagcaacacatttaatcctagcagtccaggggcagaggtggctcatctttgagttctaggccagcctaggctacacagtgagttctaggccagcctggactatacagcaaagggccatgtgaatgggtaagaagctgccattttccttctctcccagaggatgcatattgtcactgtgtaacctggtgacacacagcagaccctcttggggtatcacggagctgtgtctgccatgcatgcatcaggagctgggctaggtagccgcatttcatcctgaggctccaacctacaagcctgaactccagacacgtcccatcccagctagagccgtcctgtgtccctttcatttccagtcacctgagagcagcttcccagatgtgacatctcagctctgagtttagaacctccataaagatggccaggctgtcatctctctagctccgtcccgtgcctcatacaggaaatgtgtgtgtgaaccaggaaacggactcactgccactcctggacatgacttcttggagaaagctgtgcctgtgttgtcttgcgtacagcacacatggcgcccagtgcttggcgtgagattctctgaaggttcccagagaataaaaaacatggcagcaaggaagcctgaggtaaagcagtcagcgctgaacaatgtttttccgtgttctatgatccttctctctgctgtgtaggctctggttgaggtgagaggtaactcaagctctattcaactttaatggtggaaagtttcaaatttgctaatacaccaaaggaactggcatccactcactctcactccagtccaaagatttacttattactatatgtaagtacactatacctgtcttcagacacaccagaagagggcatcagatctcattagggatggttttgaaccaccatgtggttgctgggatttgaactcaggactttcggaagagccatcagtgctcttaaccgcggagccacctctccagcccaggagctggcatccttagctccccactagattctgcagttctgttgccctgagttgggatggtagaggatcgagatcatgttttgagagctgacctgagtggcgggagagttgctggtttgttggttttttgtttttttttaatctgtgtagtagctgaactactgcagaagccccgatgcggtcgtggcacacgccagaagtctctcggcttcccgaccatcaaagcttcatttctgcaatttacttcctcaaatcacaccctgaggctccctggggcttgcctttccgtgtttgtgtctggtttccagctgcctggagcccttttacttctgaaaaagagactgaaggagattcaccccttactttgggggcgaattctgtagactcaccgataaatactgaatccgcattagtgtcgtggtagaaaaagtatgagcatggcataacttttccctggagctatttcatcctgtcttccacgtatctcagtccattctgtcccctctgagctcccactgggtgtttccaaagtgaaacaggggctctttcctgtgttcgcagtctggaggacctgctaggggcctgctcaggacaagagtggccacatagaagctcctgaacaggacctgtggcagagctgacatttttgtttttaatggaatggggcttgagggtaggagagctgtgagcctgagtatatacaaaaaggaaggggaagatgtttgtctctagagcaacaccaagaacccaactaaatctgttttccctttattcatgctgcctgtaaccgtgctgcctgtaaccgtgctgcctgtaaccgtgctgcctgtaacggtggccccggcccttcctttctggggccacacagcgagaccctgtcttaaacatatgtagtaaagtgtatttactgtatggttatattgttatatcttagttaccattttttaaagatttatgtattttatttatatgagtacactgtagctatcatcagagggtttcagagcccactgcagatggttgtgagccaccatggggttgctgggaattgaactcaggacctctggaagagcagtccatgctcttttttttttttttttttttttaacatctgccactcttttttttttttttttttagatttatttatttattatatgtaagtacactgtagctgtcttcagacactccagaagagggcgtcagatcttgttacagatggttgtgagccaccatgtggttgctgggatttgaactctggaccttcggaagagcagtcgggtgctcttacccactgagccatctcaccagcccccagtccatgctcttaaccactgagccatctctccagccccttagttataattttggtagctatatagtgttaaaggttttaaaagttgaaacagggtctcactgtacaagcactgggtagcctggaactggagacatagatcagactggcctcaaactcacagaaatgaccacctacctggccctccatctgacactctttatgaatcataagctgattccagagcccttagccaaggttggccttttttaactcctccccctgggagctaaatacaaggaaggagaaagtgacctgatggtagagaggccctcttcctaattgtaatgacactgcattgtctcggtctccaaagatatgtcactggcaactcaaatttcctgatgccaagtgggaaaggggaggtgggggaacctgaaagaaaggaggctctgagctgcctggtacctgacggtccctctccttgctgctggggtcatattcatgggagaaagcgaggtgtggtggcacagacctgtcactctagaacactggaggctgaaggcagggcaaatgcaggtctgaggcctgccaaggtcagacagacaaaagaaagtggtaaatctgtctggacatttggttctgtgtcccgccaagttatgtgatcgatatcctgacctcagggggctctgtctgtctgaggcgaggcacaccctgtggagacgacagcgccatggacagaaaagacaaatcatcatgcagtcctgggctttgttccacacaacacacacacacacacacacacacacacacacacacacacacacacacacacacctattgtgtggtcattagtttctctcccaagttgagtggaactctgagcatggtccttggccaactatgtcagtcacccagtccctctcccctcccggtctccatcactgtctctgactccttctctccctctgtttgacataggcgaggctcattaggtgagccacattggccttgcactctctttttaaaggatttatctatttttatttgctgtgtattagtgtttgcctgaatgtatgggttctgtgtccatgtgcacacccggtgcccatggaggccagaagagggcattggatgccctgacggagtaggtgcgagccacccaccatgtgggtgctgggaactgaacctggatcctctagaagagcagctagcactcttaactgctgatcttgaccttgaactctctcttaaccctcccatttctgcctgcagagcactgaggttagaggcataggcatgtgcctgtgccctcagctgcctaccaagcccccccagtccctggttggcctttggggttctcccacaatctttccaccatttcatccctgccccccaacccccgccacatttcttccttgtctagaaggccaggatagaaaatggggaatagggctggagaaatggctcagtggttaagagcactgactgttctttcaaaggtcctgagttcaattcccagcaaccacatgatggctcacaaccatctgtaatgggatctgatgccctcttctggtgtgtctgaagacagcgacaatgtattcatatatgtgtgtgtgtatatatatgtatgtatatatatatatatatatatatatatatatatatatatatatatatctttaaaaaagaataatttatgatattgagccgggcatggtggcgcatgtctttaatcccagcacttgggaggcagaggcaggcggatttctgagttcgagaccagcctggtctacaaagtgagttccaggacagccagggctatacagagaaaccctgtctcgaaaacaaaaacaaaaaaaaaaagaaagaaagaaaatggggagtagtgatgtaggtcagatggtaaggtgcttgcctcactcctacagagccctggttcaccctgcttccacaaaaccagatcactcagaaggcagaagcaggagttcaaagccatcttgtagcaagttcaaggccagtctgagatgccagagactctctcttttacaaaagatactgggcatagtggcacattgagtccagcctggtttacagagtgagtttcaggacagccagagctacattgagaaactctgtctcgaaaaactcttccttctcctaattctaggccactcagggctacaagagaccctgtctcctcccctagccgcaccccctgcagaaaaagaaagaaaagaaaaggggtaagaactggaaaaaaaaatgtatgcaattctcagcctttaattgccgaaagcactttattttcctttgggtgttcctggggattgaattcagggcagtggacatggcaggcaagcattctagtgcacgcttcacctgcagaccaatggctggagggctccctcctgggaggctcaaagagtgacttccttctcattagccgaccaggagcatctgactaagagatgggccgcttagagcgctggtgcccaggcacccctggctcagagctccatctgtccaggtgtatcttggggccaacagggagcctgcagctgccttattgcatatgcacaccagcacctgcaagtctgtttagctcagggcctcttctgtgtgtcctttcctgcctttccctctgtaggaacattctctgaaacctcaaattccaactttaattctttagggatggcacttcccacaccctagcatatctgctctgtttcccgtccctttacgtgctttagagacggtagctactcgtgtaccccagcccagcctcgaacctatgatcttcccgcctcaacctcgcaagcgctgagacgcaggcgtacatcaccatgcccacttcccataactgtgtctgcttctaacatcacgctgtgaattttaggatcaagaaaacactctgtcttcagatctgctgcaggagatttgattcttcccgcggtcaggtctccggtggctgaatgaactcatgggctcctagactgtcactaccatctctagacttccggccaataacgtctcccactaggatcaggtcgatctaaatgttgtacatgctatggattttgttttcaaacgtccagtgaaaatgtcgttttcacctctgaatattctaggccatttttcaagggtcctaaccaatggaccccatcctacctcttagccctctttgcccagacaccccagcgcctcctcctgtttcagtcaggaggcccaatttctcttccatgccctgtgaccttcccgtcctcaggattctggtggcatctccttagcgctctcctttttgcactcgtagcaaatgggactcccgccttgcctctgagaaatccacagaactttctacgccgcctctgcctctctttggcagctgaacgccttcgacttgaagctttaactgcttcttttgtggggttccacagctcacttgggctgtggtctttttgaagccgaggagaatagctaggccctcacacactgacacctcgttgctgcgtggagccaggagtgactgcaagcctgtctggcaaggccttgtgggaagtcagtggatggatgaatgtgccaggggattctgggatgccccacttcctgtctttcgcttccctgctacatcttgtagtctggccatgtcgtaccccctcaccagccccagagcaacagggacaaccaacagtgggttgaagttgtgtgctccaatcagatttctctctctctgagttgacttatttcagccctctgttatggtgacagaaggcatcaggggagggggacaaattagaacaaagataatgatgatgtatgaaaatgctgtaactaagcccattaatttgtacttttaaaaataagatttatttatttcatatatgtgaatacactgttgctgtcttcagacacaccagaagaggttgtcaatcccattacagatggtcgtgagccaccatgtggttgttgggaattgaactcaggacctctggaagagcagtcagtgctcttaacctctgagtcctaatttgtactttttttaaatttttatatcctgttcttcacagtagcctctcctggaagcaccaagctgagttcttctttaattctttctcaaacagcatatctaaattttgcgatcataagaacaagccaggagagtacatattctatgcagaaaatgatgacgcccagttcaccaaaatgttcacgctgaatataagaagtaagttgaatctcatcttgtctattttattcctccattaatttttaattaagaagagccaaacacagcttaggagggacgatatcaaactaatttaaaaaaaaaaaaaaaggattatttgcatgtatatgagtgttttgtaagtggtatgtatgtctctggcccacatgcatgcagtgcccacaaaggccacaagagggcgtctgatccccttggaacttgagttacagatggttgtgagccatgatgtgggtgttgggaacccagttcctctgcaatcacaaccagtgatcctaacctctgagccatctctccagcctctgaaactgctcttgtaagcgccatgcttcttgtgtgttggctgtagttatatatgtccctttctatacttgttctctgagctagtacatgttccatctccgatgtgctgtgactttactgccttggcgctatgaaaggaacactaaggaaaggctatacagtcacctgctacttatttcttttaatgattttcgtcttggtctatgcaaaataagaaaaagacactatatttcattaaggtttttgcagattttttttacctgcattttttttttttacttgcatgtatgtctgtgtgaaggtgccagatattggagttacagacagctataagctgccatgtcgatgctgggaattgaacccaggtcctctgggtggtatttttaaagctaagtgttacattgaggtttgcagatagatggaggttctacacttcagctccctctaggaggtgagtcatagagaggtgttgcctccaccagtcaagaaagttttgtgacagaggaggaagggaccaaacaaactttgaggcatcctaaataaggggttgttccaggggtacatagcacctgggctaaagaagcagcctaagttgaagctagctctgaactgattctagaaaaaaaaaaaaaaatctatcttccatgagcttactgcgcgctactttctacagagaaacctcaagtgctagcaaatgcctcagccagccaggcgtcctgttcctctgatggctacccgctaccctcttggacctggaagaagtgttcggacaaatctcccaagtaatgagaaccctgacgtctcttgaagtggatgagccaagccgggcagtggtggcgcatgcctgtgatcccagcactcgggaggctgaggcaggaggatcttagagtttgaggccagccttggggaacacagtgaggccctttctcaaaaaacaagaaggaaaaaaaggaaagaagggaaggaaggagggagggagggagggcaagaggggcaagggaaaggagaaagaaaaagaaaggaagaagaaaagtgagaataaggcataagattctatcacctgttgccatggatacagcttaagaatgacattgaaaatgcttaccctacagccacagcttgttttctttgggaaccatctgtagaaaccctgccttcctgtcctaccatgaccccacccatctaacttcctgtcctaccatgaccccgcccatctaacaatccctttccaccattttttttttcttttcagttgcacggaggaaatcccagaaggagtttggaataaaaaggctaacagaaaagtgtttggccagtgggtgtcgagcagtactctaaatatgagtgaggccgggaaagggcttctggtcaaatgctgtgcgtacaattctatgggcacgtcttgcgaaaccatctttttaaactcaccaggtgtgcagccatttgctgttgtgataaacacaccctgtccccagaaattcccccacctgaagttgggcattgtggctggcctttgctggggaattcttatgagattgcccagttctgagtgagcataaggtctttttgagtcaagcaagaatccccagcagactgtaatttgacgtttcaggacccagttatccttaggctgtgtgactcacaggtcacggagctgtggagtctgggaaatccatggtgtgaagattagcctccagaggtgcaggaaagcagacttagtgatctggaatttctgtccttttccattctgtcagttcccttatttactttgagccggctagtctagattttggagttgtgtttagagtctttctaaaatgacactaacagtttagggtcaccagatagtattgattaactccagggacaaaagcaagaggctcctaagttcacgttcagcctgggctccatagtaagacgctgtctcagaaaaatgccaaacaaagcaagcacgtaagtcaaaattgtggctttggtctcagtagttaagaacacaggctgctcttgcagaggacctgggtttaattcccagtacccacatggtggctcatagccatctgtagctttagctccagctctggggggtgggggggaccttaacgccctcttctggcctctgagggctccaggcatgtacatggtacacaaacacacatgcaggctagcagtcatacacataacttctctacatgtgtgtgacgaaccttgataacaaatacacagacttctttttacctgacacgggctctgtaaaaggtttatatgggctttattcacgtgacatcatggtccagtttttaagatgggttcagaatcgtttctgatttttctggggactcattgtttacagaaacaaaccaactttctgtggggcacccagacagaacacacagattgctcataaggcctgaagatggtggttacttgaacaggatgtgagagactctaacaagagacttaaacaggcctgcctgttttatctcgcccccgcctagtgattgcttctcttgcaggccccttccctttcatccaagacaacatctccttctatgcgaccattgggctctgtctccccttcattgttgttctcattgtgttgatctgccacaaatacaaaaaggtaaaaaccggttggcgaaggctcatccctgtcgtgactctgcagcgctgctgacccgctgttcatctctcaagcaatttaggtacgagagtcagctgcagatgatccaggtgactggccccctggataacgagtacttctacgttgacttcagggactatgaatatgaccttaagtgggagttcccgagagagaacttagagtttggtaaggattgactgttcagagcttcggtggcattgcctctgccttgcaaacatttttttaacccgcacttactccatctttacagggaaggtcctggggtctggcgctttcgggagggtgatgaacgccacggcctatggcattagtaaaacgggagtctcaattcaggtggcggtgaagatgctaaaaggtaccaaaaggtggggttatctcagcaaagtccctcagagaacgagtccagctgcctcccctccccttcttctgccctctgcattattctgtctgctaagcactgagggttaacgagaagcaggcaggggcagtcgtgagcaaagactgcaagcagggaaggcaagcccccaccccttcctctttctcattgttcagttggtatcagcttctgtgttacagtttgacacagattctgggtagaaaacacaccggggacttctcacttcccactctgtcccatcctctcccatctggcatccaccctcgagcagggccaccctcagccgattcttaacccagcgcagaggattgaatccaggattttgtgaacgctaggcaagtcctctacctcagaaatacatccccagcctgtcattctataacacgatgtcttgctatataggtcaggcaggccttgaactcacaacttcaagaatgctgagatgtatcatcccctcgggactgatggcccattcttttgctgaggtgttccctgtaaggataaagggagcccctctctccaaacacacacacacacacacacacacacacacacacacacacacacacacacacactacagagagagtgacagagacagagagagagagacagagacagagagagaggcagagagagacagagacagagagtcactgaagtgcattgcagtacgcagaccaaaaggagaaatggcacacaggacatcatggacagaaatctcacagtcacctcctagccaggtgactgatgatgctatacatcctgggttacagaaagaaacggaagctggaactgttagaggatagctttaggatacatacatttgccgggcggtggtggtgcacacctttaatcccagcacttgggaggcagaggcaggtggatttctgagttcgaggccagcctggtctacagagtgagttccaggacagccaggactatactgagaaaccctgtctcaaaaaaacaaaacaaaacaaaacaaaacaggatacatacattttctgtagatcaaattcaggatgtgaaaagggatagactttcccctctgatatctgcaaggtacaaaaccttgaagcaatgtcagaacacgatcacttgttacatccggggaacagatatgaaggtttctttttacactgtttttcttcacccgtacatcctagttccacagaataaggagtgtcgtcgctgtggtattcccatatgtatactttggtccagttcactagcaccgttccccctcccctcgtcaattctcttcctgtcggtccatttcttcttctcaaatagctcccccctctacttccgtgccttttccttttaatctcgatcctacatatgagagatgatgcactgcttgtcttcctgagtttggcttttttacttaacatcccagtgtctggttccatccatcttcctgcaggtggcccatcccgttcttcgcagccaaatacaccacttcctatggatcgtatttccaacatccatccatccatctgtggcaggcccctaggctggttagatagcatgttgattgtaatagtgccaacatcgacttcctgtgtggagttccttatgcctccactcgctccacgcactcaccaaggacccccctctataacccagcttcatctcctgtaccaatagctctcataactggttccctaagccttggctttgtgtgcccaaatacttgtatctcagcactgttcatccaggctgaagtcctccaaccctggcctccatctctactccagcctggtaattactggaacgtttcagtgagactacacattccacacaaccatagaaacaaggaagcgggttccatagctggctctctctcagccttccccaacaggtttcctgcacagtgtctgctgggcccatcctcatctctccgtggtctctgtggtggtccagttctgtctctcctagagactcttaatggtagcttttaaaaagcatcccaccgattctgctaggggctatgtgctgaggtggggcatggccacgatgcagaacaccttcttgcttggcactgccctaagcattgacaatggctttctactgctctgaaaatggttcccacaggggctggagagatggctcagtcagtggttaagagcactgactgctcttctgaaggtcctgagttcaaatcccagcaaccacatggtggctcacaaccatctataatgagatctgaatccctctcctggtgcgtctgaagacagctacagtgtactcacatataataaataaataaatcttaaaagaagaaagaaaaaagaaagaaaagaaaatggttcccacaactttgagcagtgcagccgtggctcagcctttccgcctcattcttaaccttctttcggttccccagagtgcctcgtttccctgcccacaggctttgcgcaggtgaatccttccacctgctcttccccttttgctgtaggaagccacttacctctcaaatgtcagctttgagatcacttcctcagggacacctcctttcacgccatggacaagatcaagtccctggggaccgtgggtgttctaagtggtacaagacatactcagcatgcttgaggccctgagacgaattctaacattaaaaatatagtacgtcctaagaacactatgtagacttctcccagaatcggagactctaacacagttgcgtttagggattcagttaggttctaagccctctgaaagcggcatgtggcttttcccgtgctgttgttacttaatactgtgtattctgctgcctccgcctgcggtggtcttgtgtgactcctttcggttccccactgagggagaactacagggtcctgctttttcgggctgtctggtgtcccccctagagttcccccacaggactttcactgtctctctctcatcttgtgtggtcatccctcagtttctgcaggaagttggttgcacagtcccctttgcagacgccagggtcccagacgatcaggtcccttctataacacaacagtatgtgcatagaaccaggagtccctggaacagagaccccaaagaaaggtgttacccttgtccccgaggccccaaaacccacggatgcaagggtgccccaggcagctatgctagcctcagtgaccagagccctgggagtaacaacccatgcttgcatcctagcaagatcgtggacacagtttgctccactggagagattgcattggttcatgtgttgtcttctttaactttcccccattgagcacacttaccaatggaagtttctagacctgaggagcaacttcatgttggagacatctgtgcttgctgaccctcctccttctggtcttcctatcagctgaataatctgatttttttttaactaggaaaatcacgttctgtttatcgtgttgtctacctgctttgagagctgggtggaaggacttttatttttctcagggaaagtcaagtagaaatgtatattcttgctgggcatggtggtgcataatttgatcccagctctcaggaagtagacgtaggcaggactcagtgaattcgaggccagcctaatctgcagggtgagttccaggccagccagcgctatatagtgagaccccgtctcgaggaaggaagagattatacattcatatagttaatatctataactcacgttttaaaacgctgtcttaaaacacagaacattattgtctaaatttatgtgttatttttgtgtcagtttttctcttccagttttgaatgtgtgtaagttgtgatctgaaccaaggagagccttggtttctaaaacagcatacagttccctgaggtcaatcctgtttctgctcctccaccaacagagaaagctgacagctgtgaaaaagaagctctcatgtcggagctcaaaatgatgacccacctgggacaccatgacaacatcgtgaatctgctgggggcatgcacactgtcaggtaatgtctacacatctgcatatcgaagccctgttccacactactgcagcccaagggagcgaggcctgcgctctttcctcagccccagtttgtagacgatgggtctgtttcttccttccagccccatgctcccagaaataagactcagactcaaaatatatttacaaataccttgaccatagagctaggctctcctttgactagataaaaacttaatataacccatttattctaatctacattctgccacctgtgctcgggtgccatgagcctgtctcgtctcgttttgtcacgtcttcctgggtgaatctcccaagcctggctctatcccagaatcctttctgtctcccagatgtcctacctcttatttcattcctaaaccataggccatcagacttatatgggcataagctattctcttcacaccagttcaagtggaattagacggtgtcccctctgcagagcacatgaccccgtctttcccctactctatctgtcacagagtcctaaccgcctgagagaaagcggccaccctgcacattcatgttgtggggtctgagctcctccctagactgtgaagctggcctaaatgcagtagtgacatcagcttcagaactcagcacacacatactgatatgttgatgatggtgaggtcagacgtttagaactggagagaaaggctagaagacagattcttgtatacagtgctgagatcgagtgtagtctaatgtacgagctcatttaaagcaccttctgagggcaaggagagcaggaaaggcccaggtcctgttgcgctacagtgtgattttggaggaaagacctgacctgtgtctaaacctgtaactacaattgtaactgtttcagggccagtgtctgcagtctgtctaaccttgtaactacaattgtaactgtttcagggccagtgtacttgatttttgaatattgttgctatggtgacctcctcaactacctaagaagtaaaagagagaagtttcacaggacatggacagagatttttaaggaacataatttcagtttttaccctactttccaggcacattcaaattccaggtaagagctccatcagaggtttatggctgtaaaccccgggacagacagaatgaccactgcacacacctacctgcaaccccacccgggcaacattcggagttgctgtgtgtggcctgagacctaaggcagctatttgtttatgctgggaatttctgtcccattatttcttattttacttaataaagtttcaattacccaccagaagacatggttcaaagatcctaaatagaaaagtccagaaataaacaatccttaagttttaagtacctttacaaacagcttattaattaacattatactatcttatcattggttattattgttcgtgtgttactatgcccaatttatttgtactttacttactattatatttcatttattatttattattgtgtgagtttgtagtgctagggggcaaacccagggctttatgaatgcttgacgcatcctccctctctgagctacatccctagtctgccatgcatgctctagaggaactatcctaacacagacgtgcgtagccaataattagatcctttggttcatttttggtcactgggctattaaataaactaaaagcattaagccttttttcaaagggaaggggagttgaaaactgggataaactcttatggtgggaaatactgagtcctgacctatttgtagtggtgcgggcctctctttgatgcgcttgaaaaggtaatctggccagacagtggtggtggtggcatggtgcacgcctttagtcctagcactcgggaggcagagacagatctctgtgagttcaaggccagcctggtctactgagagttccagagcagccagggatagacagagaaaccctgtctctaaaaaccagaccaaaacaaaacaaaaacaaacaaacgaaagaatgaaagaaagaaagaaagaaagaaagaaagaaagaaagaaagaacaagcaaaaggaaagacagaatctgttgcagctatttgcttatccctcagaggaggggaacgtggttcacagacgctggcttgaaaagatggcgctggaaatgtacaccttcccacgaggcagaaacctacacatcaaacacattgatgaaaagaatatcaaaactctaaatttgtaagctctgtgttgcatgaactctgaaaggtgaaatggcctgtgtctggagcagcaggatgccctgtaaattggttcctctctttataaacttgaggacatagtaatcatttactgccccagtttctgttttatgtacccagcttacagcgtgacagtgactgaatggcagctcttatccaggttggctcggcaaattccaacacacagatgtttttaatgtacacggggtaccgttgacaagccagcatcgtgctttctgtttaaaagcccatttgtaactgaaatctgttcctctgatgaattgtcctttttgtaataaagtgtctgctcagaggaacaatgtaaataacaaaggaacaaatttatttttaatagcatgcctggttcacgagaagttcagttacacccgcccttggatcagctctcagggttcaatgggaattcaattcattctgaaggtaatgttttacttttcattggtattttacactcactgaaatgaatccaagagtcccatgccagctatttttaaactttttaaaaaaattatgagtgtatgtgtgtatgtgcatacacgtgtgcatgcatggtgtgtatatgtgtgtgctgtgtgtatgtgtgtgttttatgtgtatatgtttatgtgtgctgtgtgtgtatgtgtgcatgctatatatacatatacatacatgtatatatatgtatatatatgtattgtatgcatgtatgtgtgctgtgaatgtttgtatttgtgtacatgtgtgtgtggtatgtgtgtgtatgtgtgtcgagtgtgtgtatatatatatgatgaatgtgtatgtaaggtttgtgtttatgtgtatatgtgtttttgtgtagggtgtgtgtttatatgtatgtatgtgtgtatatgtttgtatgtgtgtatatgtgtggaggatatgtgtatgtaagtatgtgtgtgtgtttgtgtatagagtatgtgtttatgtgtatgcgtgtgttgtatgtgtgtatgtgtgtgtttatgtgtatgtgtgtatatatgtgtggaatatgtgtatgtatgtgtgtgtttgtgtgtagggtatgtatgtatgtatgtttatgtgtatgtgtgtggtatgtatatatgtatatgtgtatgtttgtaggtgtatatatgtatgtgtgatatgtgtatgtatgtgtgtgtttgtatgtgtgatatatatatacacacatatacatatatatgtatatgtgggtttgtatgtgtgtatatgtgtgtgatatgtatatgatgtgtgtgtatttgtatgtgtgtggtgtatatatatatgtatatatgttttgtgatatgtgtatgtatgtgtgtgtttgtatattgtgatgtttaaagatatatatgtatatatgtatacgtgtgtgtctgtgtgtgtggtgtctatatatatatatttatttatatgtatatgtgtgtgtttgtatgtgtgtgatatgtgtacatatgtatgaatgtgtgtggtatatatatgtatgtgtgtatatatatatatgtgtgtgtgtgtgtgtgtgtgtgtttgtatgtgtgtggggtataagtatatatgtgtgtatgtgtttgtatgtgtatgaagtatatatatgtacatgtgtgtatttgtatatgtatggtatatgtgtgtgtatatatatgtgtgtgtgtgtgtgtgtgtgtgtgtgtgtgtgtgtgtttgtatgtgtatatgtgtgtgtgcttgtgtgtgggcatgatcgtgccgtggcacccatgaaggtcaactagtaagagctagtaccagggctcagtaccagggtgtcagcctgatggtagcttttctccagtgagccatggcagcagagtggaagcagtgtgtctttgctctggtcaaaggcagactctgtcagtgcacactttctcggaaagtcaaaagctgatagttgtgaactctgtgtccatggtcaacaacaggcacctgaactgttttgtttgttcggaatattctttataaagtcataagctaattggagccagcttgtacctggtaagactgtgagctctagaatcagagtttggttatgttccaactcttttcctttcgaaacagttggctccagacgagagtccccacttctcacttataaaattggtccaattctactttcctcataggactgttaggaggcatacacagaaggttgtgaagtataaagtacagtccatgaaatgtggtagacagttggtcagtctttgcttttttctactgacagatttacctagcatgaagggaaggagggataatgtttgggagttttgcttaccctctctgtctgtgcaccacctgggtgcagtgcccttggagacccagaagagggcactcgatgctctgagactggaattgtgagccaccatatgagttcagggaacagaacccaggtcctctgggagagcagccagtgctcttgaatcactgagtcccaagaaggattcataattagtattccttgtcttagctcagatggctttaacagattattaaagactgggtatcataagctacagtatttctcacagtttcagaggctactgctttcaaaactgaggtgcaggagacacttgcttctcacatgcacatggtgatctttctgggtcctcaggcctcacacagaggcaagagtacacgctttcttctctttaaaaaactttaaaaaaaaagtatttagtgtgtgtcttgtgggggagcaacttacaggaatccattctctccttccaccatgtgggttccagggattaaactcaggtctttcgcctctgtagaaacacctttacctgacaagccatcttgcccattctcctcttcctattttatagagttcatggtcccatttttataacctggccacttcacaaacaccctactcctgataccattgcttgagagttcgtttgcctgtatgtgtgtatgcatgtatgtatacacgtatgtatgtatgtatgtatgtatgtatgtatgtatgtatgtatgtacgcacgcatatatgtatgcatgcatgcatgcatgtatgtatgtatatgtgtatacatgcatgtatgtacatatgtatgtgcactgtatgtgcctggtacctttggaggccaaaagatagagtcacattctctggagctagcattgttacagacagttgtgagccatcatatgggtgctgggaaccaagcctgggttctctgtaagatcatccagtgttcttagctatggagccgtctctccagcccctggggatttgaacagggcttcattccagaaaacagaatgagtgttcaagtagactaagaggagacaggtttatagagacaaaaaaatgactaagggcaggaaaaaaagggaggcagagatcaggacaggaatgactgtgcacaactttaacccaagcatccaggcggcagagtgttagtctgtgagttcaaggtcagctaagtctacatagtacatttcgggacagccagggccacatgttgcttatgaggacaggctgatcattccaatcatttccccgggtttggagtcaggaaatggacaaggtggctagtagcttagccccaggctccccaggagaagctcttctgtaaggtttgaagcagaggccattccatcttcatgcccaggaacctggcctgcgcagaaggtttgatggttgcttcggatttctccgaaggtcaaataatcctttctctttgtatggcggaccttttgtctgggtgacgccattcgatttggtctattgagtctagagcaggagatcagatcaaacgcctcttataaatatctccacactgaggtcgccttagctgcctctcacagaggtctgatagggtactgcctagtgtctggggaaagtgacaagtggacgtctttttacagatgagattgaatatgaaaaccagaagaggctggcagaagaagaggaggaagatttgaacgtgctgacgtttgaagacctcctttgctttgcgtaccaagtggccaaaggcatggaattcctggagttcaagtcggtaagtaccttttaaagagaaaaccgacagaaggcgcaaacacagagccgcagaaaggaatgcatgcgtgcagctttgaatgagccgtgtgtctacgtttgttccatggtcattttaacatgcctcccttgctgtctgccctgcttcccctaattcttttcatacctgcagcacgaaggcccagagtcactggttagagccaacgtcccgtgggatgtctagggaagtcccagaaaagccatactgaaagaagcacagtatcacagtatcgtcatccctgccaatacagggattcattcgggttgttccctgcagtcgggggcatgagcagaggcccaaagttcaccagctctgccaccccagccagccagcctgaacagattcagcctaggctagccacagcgctgtggaacctgtctcttctcagtggctggccctgtattcacaagtgctgcagcaggaagactgcgggacccaccccaaaccatgacctccccgtgctgcgctaggcaatgctgcttctccacccgctgtcccctgtcattccacactataagccaccaaagcctcaaatctttatgtctgctgaagtaacatggtagtaaacagattagcgggggtggggtggggggggggagacaacatctttagctgtgtacgcacctacacaaactattgaaacacaaggaagggctaggttggtgtatcttactaagtttctccataggaaaagatgtctgtgtttcagaggggtagtatgttaattagggctccctaaagaaacagaactgatagaattaaaaataatacatatatatgtattatttttaattataaagttatatatagggctggagagatggctcagtagttaagagcactgactgctcttccagaggtcctgagttcaattctcagcaaccacacggtgggtcacaaccatctgtaatgggatctgatgaccacttctgctgtttcaagagagcaacagagtactcatataaaataaataaataagtaaaaatttaaaaagttatatatatataagtatatatacatataaaattatatattattttactctctatgtaaaaatattttatgcacagacatacacacatacacacacgcatatatgggggatttgttagagcggcttacaggcagcagttcatgtaatccaacaaggtgcacgagactggatgtctcagaaatccccatctggagtcccggggaagtcttagaaagcaggtggtcctgggtctacattgggatcctgaagaagtcagtgagaaagcaaccacagcagcagagcagatggacttgccagtaagagtgaaggcaagcaggcaaaatgcaaacgcttcctccttcataccctctatggctgccaccagaaggcgtggcccaggtgttaggcaggtcttctgacctcagaatccagaaattctctgtcccccgtgctgcagagccgcaatgaccagtttagataatccagcacagtttgttcatgttctctaattacagcaggcctttttatttttactcttaggtgtgttatgacatggacttttgaagagcatccagttttttttttttaaagatttatttattattatatctaagtacactgtaactgtcttcagacgcaccagaagagggcatcagatctcatggatgagatgtgagccaccatgtggttgttgggatttgaactcaggatctttggaagagcagtcagtgctcttaaccactgaaccatctctccagccccgggcatccagtttttagacggtttgtcttcactgcagccttccgctccaatcatgccaagcactgtgctcttccccactctgtgactgtgtcacacatttgtgtggctccatgcgacactgtgctggggcagaaaaccaatgaggatgtgacttcagggcccacaggttttatgtttctaggagaaagacaagcagacctatacatcagatcagtgtcttgtgattgatactgtcactaaagttagcatggctaccccaagaaaaaaggggtgaggaacaggcaagagagcaagagagcctcccttggatggaatccagagggagagggactagtcaaagccagtccaggctgggcaggcttcttgctggtcagaaggagccttcccagagcagctgggaagaatacgggcagggcaggtagtcaggaggacatgatggggatggggacagacatctaggagatgccacatgaagaaagccagacttggagaaggagggcaggagtcacggcacagacattcctgtttttataggctttgttcttttaaaggctgaggagagcgtagtggacccccatgggacaccatgtgctctcttacagagttcattcccttcagagactctgggctctactctcatgtactcctcgaaactcatcgttatcttctgtctgtctgtctgccccctgtaccctgtatgtgcatgtgaaagcaagtgtgtgtgtgtgtgtgtgtgtgtgtgtgtgtgtgtgtgtgtgtgtgtatgagaatgtggggcccatgtaccgtagtgtgtgtgcagaagtcagaggacaaactgtgggagttaattcttccactgtgggacccaggaatcgaactcaggacatcagggttacatggttaatgcgttttctcactgagctgtcatctctttggtccccccaaactcacttcttctgaatgctttcttcgatcttaatctatttattcatttagagacacgacctctatgtgtagtccaggctggcctcaaacttagaaatcctcctgcctcagcctctccagtgctgcgattatggatctgcaccactaggcctgtcagatatgatgcacttttattctgaaagccagttctttatccaaaagggattctgttctcgcacgcacacacgcacgcacaggaagctggctgttagaagcgtctctggagctaggcgaaggccccctttggcacttctttggctcatagctccagggatgcctcagatgactgcagctgagttaacttaggactcagccagtgttctcgggatgtatgacagtcatgggtctctgtcctctgtaactgttgtgagtctctctctgaaggtgtaagtcacagaccatgtcattccagcctctctcttccagtgtgtccacagagacctggcagccaggaatgtgttggtcacccacgggaaggtggtgaagatctgtgactttggactggcccgagacatcctgagcgactccagctacgtcgtcaggggcaacgtgagccgtttgctttttgtcacgagtacaggaaacacctgcactctctgtgatgcgtttttgatttatggtgacaccaaggggagaaaaaaaaaactcccagtgcttcacttctttaggctgaaaagattgttttgtgctcactaagagctaagcaaaatagccacgcatctctggggggctggccactcagaacagatccattaggggttggcatgagatcttcacctgaaaaaaaaaatgcccttactcagacctgtttcggtttccttagctataaagtggctttatatgtgttttatgtttccgatcatgagacaagctagcatgtataaaaagctttttgttttttttttttctgaacaggcagcacacaggtattcactataaagtttaaaggtgctgtagttaactggtagcgtttgttaccctgttactatatgaagagttcaggaagactccaaatacaacataactgacatgtgttcgttcaaagagaatgtgagggggccagagagatggctcagtggttaagagcatagagtgcttttccaggggacccaagtttgatacccagcacccacggcaggatgctcgcaagcatctataactccagctccaaggaatctagtgcctctggcctctttggacatgtgtgctcatgtgcacatacttacacataagtgaaaatcaattcaaagtatgatgaggcaaaaaatgaatgtttaagaagggaagaaagagagagagaaagaaagatagacagaaaatgatagatagataaacagacaaatgattgatagataaacagacagaagacatatagacaatgatagacagacagatagacagtgagatgtctcagcaggtaaaggtagttgctaccaagcctgagggctggagttgccccccaaaaacacatggtggaaaaactggaatggtataagttgacctctgaccttcacctgtgtgccgagcatgcaccctcccccagcgcccacacacatgcacaggaataaaaacataattattcttcttttcatttttcaagacagggtttctctgtgtagccctggctgtcctggaactcactctgtagaccaggctggcctcggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggagtctcagtaccatcatccctgcttatgaaatgacagcagcccaggctgccccagttcctcctctctgctcgacactctcagtactcacttcggtctgaaaatacccactctgtgaagaggaaattgagacaaagaaaagcaacttgcccgcggttgctaacttgccccgtgtggatgcgagcgtgcagagcctgcatccctgtcgttcacggtggtgtcctcctgactaacttcctacaggattctgattttacttcctaggttctcagaaaccaaccaatacaatcaatgacatagccctttaacccaaaatgagaactccaatgaatgctcatctcaggtggcttagagccggttcccagggatggtcgctggctgtggttacagtacactgacctctctgtgtgcttatggggttttcaccccaccagtgggctctcctgtgggaaggtgaattccgttcagaaccttctgttaatgaatcaggtaacccagcctggaccacagattgggccagtgactccatttgcataggatttaaaagaggatttccttctggggctcttctttagcctggccaattaaacacatgaggttcctactggaaccaaatcagaacaaaactccgtgccccaggagctaaccagccactgtgtcctgatgcaaatcaaagcctgtgcaaacagaggccaaccccctgtcccgcctctggaagttattcaagccccggagggcagctatggttactctaggcatgatcacgtaagtccttgagggcgatgcttctcagttctgaggaaagctcccgtaaatgattctccccgcggccttgaacttgtcgacctctgagcaaatacagagctcttccttaacgaacgaacggcatcgctacggcacttgccaatcccaagcacaagcctgtgtccaagatgacttttaaagaagtgtattttgccaggagtggtgccctacgcctttaaacccagctctcaggaggcaaaggcaggttgatttgtgtgtttgaggccctattctgcttatgtcaccagagctacatagtgagaccttgtctcaaaatagaaaaacagatgagctggacggtggtggcgcacgtctttaatcccagcacttgggaggcagaggcaggtggatttctgagttcgaggccagcctggtctacagagtgagttccaggacagccagggctacacagagaaaccctgtctcaaaaaagaaaagaaaaaaaaaaggaaaacaaatgatagatagatagatagatagatagatagatagatagatagatagatagatagagagagagagagagagatcgctataggtaggtaggtagataggtaggtatagacaggtagatagataaacagatacttagatagatgttaaatatagataatagatgataatgggtggatagatggatagatagataagaaacgtatttctaaaaagcttctactttttctttttttctagaacatgattttaatattttcaacttaatattcaacagacagaataattattttaagatatattttgttgttatgtctccttttcatttctgatgttattaatttgaatactgtctctgtgccctctggttagtcaggctaagggtctatctatcttgttttttctcaaagaaccagctcctggttttgttgattctttatagagttctttttgtttctatttggctgatttcagccctgagtttgactatttcctgccgtctactcctcttgggtgtatttgctttgttttgttctagagctttcatgtgtgctgtcaagctgctagtgtgtgctctctccagtttctttttggaagcactcagagctatgagttttcctcttagcactgctttcattgtgtcccataagctttgatatgatgtgccttcattttcattaaattctaaaaagatagactttactttctttttttatttcttccttgaccaagttatcattgagcagagcattgttcagcttctgtgtgtatgtgtgctttctgttgtttttgttggtatttaagaccagccttagtctgtggtgatctgatagggtatatgggattatttcagtcttcttgtatctgttgaggcctgttttgtgaccaattatatggtcagttttgaagaaggtactgtgaggtgctgagaagaaggtatattcttttgctttaggatgaaatgttctataaatacctgttagatccatttggttcataatttctgttagtttcactgtgtctcgatttagtttctgtttccatgatctgtccattgctgagagtggggtgttgaagtctcccgctattattgtgtggggtgcaatgtgtgctttgagctttagtaaagtctcttttatgactgtggatgcccttgcatttggagcatagatgttcagaactgagaattcatcttcttagatttttcctttgaccagtataaagtgtccttccttatcttttttgataacttttggttgaaagttgattttattcgatattagaatggatactccagcttgtttcctgaaacaatttgcttggaaaattgttttccagacttttactctgaggtcgtgtcagtctttgtcactgaggtgcatttcctgtgtgcagcaaaatgctgggtcctgtttatgtatccagtctgttagtctatgtctttttattggggaattgagtccattgatgttaatagatattaaggaaaagtgattgttacttcctgttatttttgttgttagaggtggaattatgtttgtgtggctatcttcttctgggtttgttgaaagattactttcttgttttttctaggatgtagtttctcttcttgtgaagtgttttccatctattatcctttgtagggctggatttatggaaagatactgtgtaaatttggttttgtcatggaatatcttggtttctctgtctatggcaatttagagttttgctgggtataatagtctgggctggcatttgtgttctcttagggtctgtatgacatctgcccaggatcttctggctttcatagtctctggtgagaagtctggtgtaattctgataggtctgtctttatatgttacttgacctttttcccttactgcttttaatattattcctttgtttagtgcatttggtgttttgattattatgtgatgggaggaatttcttctctggtcgagtctatttggagttctgtaggcttcttgtatgttcatgggcatctctttctttaggttagggaaattttcttctataattttgttaaagatatttactggccctttaagttgggaatcttcactctcttctataactactatccttaggtttggtcttctcattgtatcctggatttcctggatgttttgggttaggagcttttttgctttttgcgttttctttaactgcagtgccaatgttttctatggtattttctatacctaagattctctcttgtattctgttggtgatgcttgcatctatgactcctgatctcttccctaggttttctatctccgggtttgtctccctttgtgatttctttattgtttctatttccattttagatcttggatagttttgttcatttccttcgcctgtttgattgtgttttcctgtaattctttaagggagatatttatgtccttcttaaagtcctctatcatcatcatcaggagaagtcattttagagcccaatccggtgtgatgtgtatccaggacttgctatggtggaagaattgggttctgatgatgccaagtaacctcggtttctgttgcgtgtgttcttacacttacctcctgccatctgattatctctagcgctacctgccctggctatgtctgactggagcctgtccttcctgtgatcctagttgtatcagagctcctcggagttcagctgtctctgggatcctgtggttctgggattctgagatcctggggtgttcctgggtgcctgggtccctcctgctggtcccagttacttctggtggtggaacaggtgttgctctcctcctccacctgatcatatcctccttttccatatcaagcattaaaagtgttcttaggtttaaattttatcatctaatgctgggcaatggtggcatacacctttaatcccagcactcaggaggcagaggcaggtggatctctgtgagtttgaggccagcctggtctacagagccaattcctggacagccacgggtgtatgaagaaaccctcccttgaaaaacaaaaataagttgagtaaataaataaataagtagatattgtcatccaatggaaaacaaaaactaaaacttggaaaggctggagagacagctcagtggttaagagcactggctgttcttccagccgatccgggttcaattcccagcaccttcatgtcagctcacacttgtttgtaactctagttccaggaaacacagcacttttacagacagacatgaaggcaaaacaccaaataaatcttttttttttttaagtggcctcaagttttaaattttatcatctaacaacaacaaagaggggctggagagattgctcagtggttagagcactggctgctcttgctgaagacccaggttcagttctcagcacccatatagtggctcacatccatctagaatgtcagtttcaagggatccgacacccactcctggcagcctctggcactgtatgcataaggtgcacttacatacatgcaggcaaaacacccatgcacataaaattaaaaacaaaacaaaacaaaacaaaaaaaaactttaaaaaaatctccaagtctgcatgtgggggaacttcaccagcctctcttgaatcgtacacaggcacggctgccggtgaagtggatggcacccgagagcttatttgaagggatctacacaatcaagagtgacgtctggtcctacggcatccttctctgggagatattttcactgggtatgtgtggcactctgcaggcctccttgggctctggctttgtgtcccccacccctctgtacccttcctttaccctgcatgccaagggcggttaacacaccactcaagaccctagcttctagtcttgcctctgttgccagagttatttgctgacatctgagatctttctttcccacactctgtaattgattaagaggcttggggccctctggatccacttgcagccctcagtacagggtgggtctggcactggggaattctctttgcttgttttcagacagaatgtataccaaatagacaaataggaagaacagtgtttgtgaggccccactgagcgcgtgtttttctcaggtgtgaacccttaccctggcattcctgtcgacgctaacttctataaactgattcagagtggatttaaaatggagcagccattctatgccacagaagggatgtgagtacagccagaccggggttgggtatcaaacatttaccgtgtgctctaagtcctccagatgcattgcaaaaacaaaagcttgatggctttgttggtttgtttgtttcttctttctgttttgttttctttttgagccaaggttcccctgtgtagccctggctgtcctggaattgactctgtaaaccaggctggcctcaaactcagagatccagctgtctctgcctcctgagagctgttattaaaaatgggcaccgctgggctggtgagatggctcagtggttaagagcgcagactgctcttctgaaagcccctagttcaaatcccagcaactacatggtggctcacaaccaaacgtaatgaaaactgatgccctcttctggagtatctgaggacagctacagtgtacttacatataataaataaatacatttttaaaaatgtgcactgccaccacacctggttaaaacacactttcctacgacattgctgagatcttatttatttatatttatttattcatctatctatctatctatctatctatctatctatctatctatctaatgtatgtgagtatactgtcactatcttcagagataccagaaaagggcattggatcccactacagatggttgtgaaccaccatgtggttgctgggaattgaactcaggacctctggaagagcagtcttaaccacttaaccgctgagccatctctccagcccttgtttgctgtttaaaagcagagacatcttggtacagtggcacccacctttaattcccacagcgaggaagcagagaggcagccagatctctgtgatttgaggccagcctggtcgacagccaaagctgtgtagtgagatcctgtcttgaaaaaaacaatcgccaatcaatcaataaattggggggggggggcaggaagggcaaggagacacttgcctataatcccagtactccagaggtaaggtatgaggctgtaggctaatctgtgctaatagcaagacaagaaaggaaggaaggaannnnnnnnnnnnnnnnnnnnnnnnnnnnnnnnnnnnngagggagggagggagggaggaagggagagagagagagagagagagagaaagagagagagagagaaaggaaggaaggaaggaaggaaggaaggaaggaaggaaggaaggaaggaaggaaggaaggaaaagaaagaaagaaagcttcaggtagcttgcgccctcttgggcagcctccaaggcttcattcttctgcttgtggtacctgaggatttgacttcacctcactctctggtgtggtaccaattctagtcttcccacaaagccagcagcgcacagtgcacagcccccaccccccacccccatgctgccctgggtgtgaactgtgggtggagccttgccaagttcattcacaccccctcagctctgctctgttttgctctctcacagatactttgtaatgcaatcctgctgggcttttgactcaaggaagcggccatccttccccaacctgacttcatttttaggatgtcagctggcagaggcagaagaagcggtacgtggaggcttggcttaatcataacggtccccagggagatgtgtgggtgtcacaccgggcactaatggcctcagatccggtttaggccgaccatctttctcacctcactttgcctagattacccttccacagtcctgtgcagaagatgtactatctggtgtgggcttgggggcggggctttcctgtgatttcatccaagtgattaataggttaaaagctcttaagggtccagtgcaaagggctagacaactaaataaaccttaactcctccaggagccactggccttttctaagtcaacatggtgtgagggtgggtatggatgggaagggctttagcccaaagccctgaggacccattcagtctctgctgctcattccccactgatctgaacgatggcaagtttcttctttggcctcggtgttcccatctgtaaaatgggttgcaaaggtaaatgatcctcaagcagcaggatcttggtattacgtcattagcccctcctccttagcactcttagcacaggagaggtctgctccagataagggtggagccttgaacactcagagcccaggttcagatcctgcctccgtcactagtgtctcacatagtgactcacataatgtctcacattagtgactttaatgtcactaatgtctcacgtagcatttgcaactttagactttaatgtggacatcttgtgggatgatagttctgtaaaggacaaatcacctgccatctgcccttttcctactttttattaaaaatgagtggcgggctggtgagatggctcagtgggtaagaacacccgactgctcttccgaaggtccagagttcaaatcccagcaaccacatggtggctcacaaccatccgtaacgagatctgactccctcttctggagtgtctgaagacagctacagtgtacttacatataattaataaataaataaacaaataaataaatataaataaataaataaatagatttagtcttttaaaaaaaatgagtggctgctgtttcagaaaaaaacaaaacccatggaggggactggacagatggctcagtagttagagcactggctgctcttgcagaggatcagggttcacttcccagtaaacagggtagctcacagtcacctatacctcctattccaggagctccagcgccctcttctggccattgcaggcactgcattcaaatactgacacaggtgcacacttgcacacataaagtaaataaaacttcaaaacaagcctggaaactacccaaattcatagttttatatttttaagattattttacttttcaattacatgtagtagtgtttacagggaccctcagaaatcagaagagggtgtcgaatcccctggggctggagttacaagcaatcgtgagccacctcacatgggctcttagaaccaaactcaggtcctcttcaagagcagcaggtgttctaaccactgagccatctctccagcccctaaactcatacttcatgatctgtataaaagtaaggtgtatttaagtactgtgctttctaggcacacaggcgagtcctgctcagccggtcattcttctccctttccagatgtatcagaacatgggtggcaacgtcccagaacatccatccatctaccaaaacaggcggcccctcagcagagaggcgggctcagagccgccatcgccacaggcccaggtgaagattcacagagaaagaagttagcgaggaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccatgtatctgaaatatagtatattcttgtaaatacgtgaaacaaaccaaacccgttttttgctaagggaaagctaaatatgatttttaaaaatctatgttttaaaatactatgtaactttttcatctatttagtgatatattttatggatggaaataaactttctactgtagaaatgttggttcttgttcctttgcgtgaactataagctcatggcctcatctgtatgtgagatttcctgtttttctgtttgtttgtttgtttgttttttgtttctcttgagcaggtgcattcttgggggatgcttggtgttgtttggttttgagacaggatctagttatattgctcaggctagcctcaaacccgagatcttcctgcctctgcctcaagtcttggggttaacgtcatcacacccgacgaaggtcagctcttcaccaaagtgttaaagcatcctgagccgaccaggctgaggaccgcgggcaccacatctgatcggttctcccattccctcctcattcacttctgatcttttgaaactgagcaagctccagcccacaggtttataaactcgccttgctttgtccctttgtacgctggacaccactgagttctgtcctttatttctttgttttgtcctatgacagggtctcatgtgtcccaggttggcctcaggttgactgtgtagcagaggatgacctggaccttctggtcctcgtgtccccacctcccgagtgctgggatcccggtgtgtgccaccatgcccggcttcgcctgattctttagctagcctctttgccatctaagtcagaggttctcaaccttcctaatgctgctaccctttaatacagttcctcatgctgtggtgacccccaaccacgaaattatttcattgctacttcataactgtaagtttgctactgttatgaatcgcaatgtaaataacctgatgtgcaatggctagagggtcacgatccacaggttgagaatgctgccctactgtgtctcttagctgctgcaagttccgtctccctaagcattgacttggtgtgtggtatggtatggtgtcttgtaagcaccaggtctctccattgatccagcttccacccctctgcctctttgcttctttcaccccctagatactagctgcataatgttttctctctagccaaaaccgcctggatggtcctggatgtgtctgggcgtttcccagccccctcttctgcctcagtctctgtttccatgcccatcaagaatagctgcctccgtggcaacctgtgagatcttcttgtctatatcattaggttgtctctgcacagacagcctacctatgtgatgctgtaattagcttttgtgataatgtcctctctcttctctctttatttatttatttatttacttacttacttacttaatgtatttgagtacagtcattgtcttcagacacaccagaagagggcgtcagatctcattacagatggttgtgagtcaccatgtggatgctgggaactgaactcaggacctctggaagagcagtcagtgctcttaacccctaagccatctctccagcccatgtcctctcctttaagctggagtttgagccgtttgaaggcggatgtgatttaagtgaatccaaacactcagctccacggaggtaataggtataaacagacatttggttactttttagcctactcatgtaaaagcataagatatgcttgatggcaaacattcagctaatattgttttttatttaggtgagtggtggttagccatgtaacaagcgttggaacacctctccagctgagctccggttcaggtgtatctctcctaccttcctgtctgaatgtattcctaccacacacacatgagcatgcgcagacgcacacacatgagcatgcgcagacgcacatacatgagcatacgcagacgcacacacatgagcatgcgcgcgcgcacacacacacacacacacacacacacacacacacacacgagtggcaaggcgggggtgcaggatgcaaatgggaaagaagtctttgtattagttaccttactgttgctatgataaaacagaccttggcttgctgcaggctcttgtttactgttaatattgctgctgagaacatggtatggaaattggaaatacccccccatctctctctgtctctgtctgtctgtctgtctgtctgtccgtctctctctctctctctcacacacacacactttttaaaatattttattttattctgagacaaaggtttttttgttttgttttgtttttgagacagagtttctctgtatagccctggctgtcctggaactcactctgtagatcccctgcctctgcctcccgagtgctgagattaaaggtgtgccccaccaccacaagggttttttatgcaccccaagctggccttgaactcgaaatcctcctccttggcctgctgaggtcctgcactgcttcttcacattggccttcacagctgtctctgtcgcttacccctgagaacctaatgtggaacccgaggccaactctcagcctcccaggcacagcctagtggtttgccgacgttccttctctctctgttagctaccaatggtctttctcgctttctctgtcttctctgtcttgatggaattggaggaggcagaagagatacaggaatttgcaaagccccttgagctacttgtcgtgagatgtgtgttgatagagcaaggcagaatagtgatgtgagctacccaagcctcttccttctttcaaagtgattttgcccagggcatgtgcacattgtgtctgtgacatccctctggatggagccaaacacacagtcacatctggagtcatgtccttgtgtgcagcgttaaaaccctcaaaggacttcatttccacggaaatggatattctcttgtgggtttcgtaaaagtggttttatagccttaatactaccaaatgcttcttttaatagcataatattggggctggaaagacagttaatagtccatactgctattgtggaggacctgagttcaattcctagcactcacaactggaacatcacagcctctggcaactccagttctgagggatctgacgccctctactggcctccatgggcactgcatgcacatagtgcatacacacactcaggcacatacacatagacataaaatacataaatccttcttttaaaaagcgtaatattgacttgttcttcaaagatgtattcatgttatgcagtgatcatccctaatctgaaatactaaaacccagaatctgagcttgatgaacatccgcataatacgtcacacacacacacacacacacggaaaagagagagagagagaactcgatgcctggcctccaatgaacagacgttagaatgaagtgagttaaaattatcacatcaagttaccaccaggctgtgtacataaggcacacatgaaatgttaactgatcctttgaattatatgtgcaaaattattccagtcatagcaagtttagtctggttcctgtcactccagccaaggggtactctacctgccttaccccaagctgacattgtccatattgctgatgtcctatgaaaacacactccttgaccaccatcttcaaactaaggacatttgaatatgcttctgggctgtgtcgggtagaggtttggagcatctccttcatagaaagtgaagtcagcagaggtggaaacttaagggctcgttggaaagtcagtggtgcgggaaggtgtttgctaaggcagacacgtgaaggaatatttagctgaagcagacacaggagaaaaggatgttctgctaaggcaagcatgtgatgaaggactctttgctaacaacacgcatgcgttagtccatcttacgttgtgtagctctatttgtccggaatctatagagagaaatgcaccaaaacaaaacaaaacaaaaaacaacttctggtggtgtattgtggcttcttgctgctcccaaggactccgattggcagagtaatgtcagctgagacagtcgcacaggatgaggcaagacctgtggaggacacgtgatgattggatggagtataagtagaactcaacagacagtcatggagactgagcttggcttgtttatagagctagctgtgcaatgcttgttgatctcttgtcttcaccagtcttcgattccccgagagaggcacagctaagaacttctcctgtgtccctctgggtccttcctgctgactctgctaggtaggttgtgccaccgctgctgattctgtttgctgtcccggctcttccaaactggactgctgatgtttctgtgaagtgtttgtgcgtggatcgagctgctgacctgtgaactgaactgctaatttccagacagcacagaccggagttgctctaaagaacctttctaaacaggtccactttccccgtatcctccccccccccccacttcctctggtgggtggtggactaaaagggaggttaaagcatttaaaagccatcattaaaaataaggattggcagagccgcactcaggcactgcagcgcagctcaggtctgcaccaggcgcgcgaaggtgagccagagccaagatggctgtcctttctaaggaatatggatttgtgcttctcactggtgctgccagctttgatatggtgctccacctagccatcaacgtgggcaaagcctgcaagaaggacaaggtagagtaccctgtcacctacagcatggatcctgaaagtgggcatatgttcagctgcattcagcgcgcccaccagaacgtgttggaggtacaccctccctccctgtttttcctaacggtgggaggtgttaactacccccgtatagcttctggcctgggcttggccttgatttcttggacgagttctttacacatatggagaccctagcaagcggtatcgaggagccacggggctctcttgccctctttactctgatgggcaccgccatgtgctctgcttcccagcatcctctgcttcccagcatcttggctggatcagaccgggcttaagctgcgggtccagatcctgccactgaggaaaggggggccgggggggggcttcctattctcatttgcctcctacgactcatcctgatttccagttccactgtttagtttttgttgttgttttaaatataataaaaacttacctgacatcagcctcatacctaaaaatgaagaaataaaaataaaaataaggattgaaaaagttaaggttacagttaggatcacaaagcatgcccctgttcactttagtgtgggccaagctgtgtcccctgaggggagggtacccctctttttctttccctttcttccttcctttctgtctcttttcttccttccttcctttctcttttaaaaatgtatttattttatttgtatgggtgctctatcagtacctgcgtgacagaagagggcatcagatgccattacagatagttgtgaaccaccatgtggttgctgggaattgaactcggggcctctggaagagcagtgtactggctggttttgtgtcaacttgatacagctggagttatcacagagaaaggagcttcagttgaggaaatgcctccatgagatccagctgtaaggcattttctcaattagtgatcaaggtggggagggccctttgtgggtggtgccatccctgggctggtggtcttgggttctataagagagcaggctgaaagccgggcgtggtggcgcacgcctttaatcccagcacttgggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgggcccactagggtgtgtgtgtgtgtgtgtgtgtgtgtgtgtgtgtgtgtgtaaaacagtaattatggaagatgttagtcatgaacttgataagcagttgtgggaagcatagggggagttagaagggaaagaaaggggggtagatttcaaatttctgaaaaaaaatttttttaaagggaagacatggcaagtagtaccctagttatggcccagcaggatgcctctccatcccccaccccacccctaccccgtgaagaacaccaccagtaacagccttagataaactgctgctgtgataaaacacttaccaaaaacaatctagggaaggcaaaggtttgtttcagtttatagtttataggctgttgttgaaagaatccaagccaagaactcaaggtgagaacctggaaggcagattcaaccctctcttcttgggcacaaacacacacacacacacacacacacacacacacacacacgcttgtacacatacaaaatacacctaattaaaaaaatatttttttaaacgagagaagatagcacactccaccagaggcaccttaccctgttctgtttacactaattaagtctatgtggtgttaagcatttagagttcaaagaaagattaaaacgcagtgcctgtgctctagagcaacagcaaggacagatgaggtgcttgtgagttaccgtgtgggtgctggggacagaaccagggttgtccctgaggacactgtcctggtaatccaggcaggtcacagggccacctgtttggtctgcatgtggtacacagattacatgcaggtaaaagcatacgtgcacacagacaagatggtaatggcaccaagtgtctgtctcattacatacggccaccgccgccacctcttgttatggcaatgcctcgggtggaatcattctttctgcagaagtctctgctctcctgatcatagccttaagcggaggtggcggatagctcagtattcgggtgctcctcgagcatgcgtgagaccctgggttctgtctccagcacacatattacccctaccaccaacaaaacagttaaacctgtgtttctcatcgcaggaccgttctggataagctcctcccagagatatttaaaccagggtcagctgcccttgcacagggccagcatgtgtgttcagcaaacacaacccatgaggaggaattagctcactcgctcgatgagagcggaccacaggcagggcagaacactgcctccagtccaggatcagccatggacatggtgaaggtcaattccatggacttcggagaatttgtggatgtgtttgggaacattgttgagaaatgccctctgattgccgctgctgtctggtcccagcgtccattctctggcttggaagacttagaaaatcacttttttgcctttattgatgctctcccgagatcaggtaagacttcaggaccgtgtgcgcgaagtcattttcaatattgtatataaaaatattttagattactttagcctccttactcagttatttagccgggattattagaaggatcagtagacatcctttcaaacgctagtctcttgaaggtggacacaagaacatgggggcgggatgggcaaggtagcatggatggccgaggacagcggaggcagagggaggacaatctctgaggtcgagaccagcctgatctagagcgagttccaggacggccagggctattggaggtcaagaatgggaacagggcaaaggccttggtgactcagaagctgaaggcccactttggcaatgccctggatgaaagagaggatagcgaggacctcccagggaccccagagaggaacgggaagcgctgagcgattttcaaaaaaaaagggccggtttggaccagacaaggatgcattcatttagatcccaagactctttgcagagagaagtaaaatgggagcaaagcaatgttttctggggagagtgggccacagggtggggagaagagggggtagaggtttattcaggatggcacagcggccgaaggtccaaaggtacatagtccctgttcataggctactatgggttctgagaataaacccgacatgcccttggggaacaaagtcagagggtaggagtcacctgcccttgagactgttcttagtcttcggtcaggagggtggtctcaggacagagcaggcactcgcagctgcgttcagtatggctgtgacactctgtggattctcagactcctctgtatggctgcctatgagaacttacagaggaagagcacaggtccaggttataaaatcaagctgaggactggagagatggctcagcagttaggagcactggctgctcttccagtggactggagatcaattttaagcacacattccccaccccccaaagatgctcgcaaaggcgtctaactccaggatctggtgtcctgctctggcctccgtaaacaccaaggacacatgtgatgtgcagacatacatgcaaacaaaacactcaaatatgtgaaatttaagtgtgtgtgtgtgtgtgtgtgtgtgtgtgtgtgtgtctatctgtctgtctatctgtatgtatgtttgcaaatcaactaatcaactcagggtctttcttgcttatcctgggcactctaccactaagatgtactcaatctttttcacaatgtttctagaacagagagagagagaagaggagaggagaggagaggagaggagaggagaggagaggagaggagaggagaggagaggagaggagaggagaggagaggagaggagaggagaggagaggagagtctcaatgtatttgaagggtcatttaaaaatccttaatgggaagtggtggtgaac

SEQ ID NO: 1146 - DNA, 3426 bp, Mus musculus
gcggcctggctaccgcgcgctccggaggccatgcgggcgttggcgcagcgcagcgaccggcggctgctgctgcttgttgttttgtcagtaatgattcttgagaccgttacaaaccaagacctgcctgtgatcaagtgtgttttaatcagtcatgagaacaatggctcatcagcgggaaagccatcatcgtaccgaatggtgcgaggatccccagaagacctccagtgtaccccgaggcgccagagtgaagggacggtatatgaagcggccaccgtggaggtggccgagtctgggtccatcaccctgcaagtgcagctcgccaccccaggggacctttcctgcctctgggtctttaagcacagctccctgggctgccagccgcactttgatttacaaaacagaggaatcgtttccatggccatcttgaacgtgacagagacccaggcaggagaatacctactccatattcagagcgaacgcgccaactacacagtactgttcacagtgaatgtaagagatacacagctgtatgtgctaaggagaccttactttaggaagatggaaaaccaggatgcactgctctgcatctccgagggtgttccggagcccactgtggagtgggtgctctgcagctcccacagggaaagctgtaaagaagaaggccctgctgttgtcagaaaggaggaaaaggtacttcatgagttgttcggaacagacatcagatgctgtgctagaaatgcactgggccgcgaatgcaccaagctgttcaccatagatctaaaccaggctcctcagagcacactgccccagttattcctgaaagtgggggaacccttgtggatcaggtgtaaggccatccatgtgaaccatggattcgggctcacctgggagctggaagacaaagccctggaggagggcagctactttgagatgagtacctactccacaaacaggaccatgattcggattctcttggcctttgtgtcttccgtgggaaggaacgacaccggatattacacctgctcttcctcaaagcaccccagccagtcagcgttggtgaccatcctagaaaaagggtttataaacgctaccagctcgcaagaagagtatgaaattgacccgtacgaaaagttctgcttctcagtcaggtttaaagcgtacccacgaatccgatgcacgtggatcttctctcaagcctcatttccttgtgaacagagaggcctggaggatgggtacagcatatctaaattttgcgatcataagaacaagccaggagagtacatattctatgcagaaaatgatgacgcccagttcaccaaaatgttcacgctgaatataagaaagaaacctcaagtgctagcaaatgcctcagccagccaggcgtcctgttcctctgatggctacccgctaccctcttggacctggaagaagtgttcggacaaatctcccaattgcacggaggaaatcccagaaggagtttggaataaaaaggctaacagaaaagtgtttggccagtgggtgtcgagcagtactctaaatatgagtgaggccgggaaagggcttctggtcaaatgctgtgcgtacaattctatgggcacgtcttgcgaaaccatctttttaaactcaccaggccccttccctttcatccaagacaacatctccttctatgcgaccattgggctctgtctccccttcattgttgttctcattgtgttgatctgccacaaatacaaaaagcaatttaggtacgagagtcagctgcagatgatccaggtgactggccccctggataacgagtacttctacgttgacttcagggactatgaatatgaccttaagtgggagttcccgagagagaacttagagtttgggaaggtcctggggtctggcgctttcgggagggtgatgaacgccacggcctatggcattagtaaaacgggagtctcaattcaggtggcggtgaagatgctaaaagagaaagctgacagctgtgaaaaagaagctctcatgtcggagctcaaaatgatgacccacctgggacaccatgacaacatcgtgaatctgctgggggcatgcacactgtcagggccagtgtacttgatttttgaatattgttgctatggtgacctcctcaactacctaagaagtaaaagagagaagtttcacaggacatggacagagatttttaaggaacataatttcagttcttaccctactttccaggcacattcaaattccagcatgcctggttcacgagaagttcagttacacccgcccttggatcagctctcagggttcaatgggaattcaattcattctgaagatgagattgaatatgaaaaccagaagaggctggcagaagaagaggaggaagatttgaacgtgctgacgtttgaagacctcctttgctttgcgtaccaagtggccaaaggcatggaattcctggagttcaagtcgtgtgtccacagagacctggcagccaggaatgtgttggtcacccacgggaaggtggtgaagatctgtgactttggactggcccgagacatcctgagcgactccagctacgtcgtcaggggcaacgcacggctgccggtgaagtggatggcacccgagagcttatttgaagggatctacacaatcaagagtgacgtctggtcctacggcatccttctctgggagatattttcactgggtgtgaacccttaccctggcattcctgtcgacgctaacttctataaactgattcagagtggatttaaaatggagcagccattctatgccacagaagggatatactttgtaatgcaatcctgctgggcttttgactcaaggaagcggccatccttccccaacctgacttcatttttaggatgtcagctggcagaggcagaagaagcatgtatcagaacatccatccatctaccaaaacaggcggcccctcagcagagaggcgggctcagagcccagtcgccacagcgccaggtgaagattcacagagaaagaagttagcgaggaggccttggaccccgccaccctagcaggctgtagaccgcagagccaagattagcctcgcctctgaggaagcgccctacagcgcgttgcttcgctggacttttctctagatgctgtctgccattactccaaagtgacttctataaaatcaaacctctcctcgcacaggcgggagagccaataatgagacttgttggtgagcccgcctaccctgggggcctttccacgagcttgaggggaaagccatgtatctgaaatatagtatattcttgtaaatacgtgaaacaaaccaaacccgttttttgctaagggaaagctaaatatgatttttaaaaatctatgttttaaaatactatgtaactttttcatctatttagtgatatattttatggatggaaataaactttctactgt

SEQ ID NO: 1147 - DNA, 2979 bp, Mus musculus
atgcgggcgttggcgcagcgcagcgaccggcggctgctgctgcttgttgttttgtcagtaatgattcttgagaccgttacaaaccaagacctgcctgtgatcaagtgtgttttaatcagtcatgagaacaatggctcatcagcgggaaagccatcatcgtaccgaatggtgcgaggatccccagaagacctccagtgtaccccgaggcgccagagtgaagggacggtatatgaagcggccaccgtggaggtggccgagtctgggtccatcaccctgcaagtgcagctcgccaccccaggggacctttcctgcctctgggtctttaagcacagctccctgggctgccagccgcactttgatttacaaaacagaggaatcgtttccatggccatcttgaacgtgacagagacccaggcaggagaatacctactccatattcagagcgaacgcgccaactacacagtactgttcacagtgaatgtaagagatacacagctgtatgtgctaaggagaccttactttaggaagatggaaaaccaggatgcactgctctgcatctccgagggtgttccggagcccactgtggagtgggtgctctgcagctcccacagggaaagctgtaaagaagaaggccctgctgttgtcagaaaggaggaaaaggtacttcatgagttgttcggaacagacatcagatgctgtgctagaaatgcactgggccgcgaatgcaccaagctgttcaccatagatctaaaccaggctcctcagagcacactgccccagttattcctgaaagtgggggaacccttgtggatcaggtgtaaggccatccatgtgaaccatggattcgggctcacctgggagctggaagacaaagccctggaggagggcagctactttgagatgagtacctactccacaaacaggaccatgattcggattctcttggcctttgtgtcttccgtgggaaggaacgacaccggatattacacctgctcttcctcaaagcaccccagccagtcagcgttggtgaccatcctagaaaaagggtttataaacgctaccagctcgcaagaagagtatgaaattgacccgtacgaaaagttctgcttctcagtcaggtttaaagcgtacccacgaatccgatgcacgtggatcttctctcaagcctcatttccttgtgaacagagaggcctggaggatgggtacagcatatctaaattttgcgatcataagaacaagccaggagagtacatattctatgcagaaaatgatgacgcccagttcaccaaaatgttcacgctgaatataagaaagaaacctcaagtgctagcaaatgcctcagccagccaggcgtcctgttcctctgatggctacccgctaccctcttggacctggaagaagtgttcggacaaatctcccaattgcacggaggaaatcccagaaggagtttggaataaaaaggctaacagaaaagtgtttggccagtgggtgtcgagcagtactctaaatatgagtgaggccgggaaagggcttctggtcaaatgctgtgcgtacaattctatgggcacgtcttgcgaaaccatctttttaaactcaccaggccccttccctttcatccaagacaacatctccttctatgcgaccattgggctctgtctccccttcattgttgttctcattgtgttgatctgccacaaatacaaaaagcaatttaggtacgagagtcagctgcagatgatccaggtgactggccccctggataacgagtacttctacgttgacttcagggactatgaatatgaccttaagtgggagttcccgagagagaacttagagtttgggaaggtcctggggtctggcgctttcgggagggtgatgaacgccacggcctatggcattagtaaaacgggagtctcaattcaggtggcggtgaagatgctaaaagagaaagctgacagctgtgaaaaagaagctctcatgtcggagctcaaaatgatgacccacctgggacaccatgacaacatcgtgaatctgctgggggcatgcacactgtcagggccagtgtacttgatttttgaatattgttgctatggtgacctcctcaactacctaagaagtaaaagagagaagtttcacaggacatggacagagatttttaaggaacataatttcagttcttaccctactttccaggcacattcaaattccagcatgcctggttcacgagaagttcagttacacccgcccttggatcagctctcagggttcaatgggaattcaattcattctgaagatgagattgaatatgaaaaccagaagaggctggcagaagaagaggaggaagatttgaacgtgctgacgtttgaagacctcctttgctttgcgtaccaagtggccaaaggcatggaattcctggagttcaagtcgtgtgtccacagagacctggcagccaggaatgtgttggtcacccacgggaaggtggtgaagatctgtgactttggactggcccgagacatcctgagcgactccagctacgtcgtcaggggcaacgcacggctgccggtgaagtggatggcacccgagagcttatttgaagggatctacacaatcaagagtgacgtctggtcctacggcatccttctctgggagatattttcactgggtgtgaacccttaccctggcattcctgtcgacgctaacttctataaactgattcagagtggatttaaaatggagcagccattctatgccacagaagggatatactttgtaatgcaatcctgctgggcttttgactcaaggaagcggccatccttccccaacctgacttcatttttaggatgtcagctggcagaggcagaagaagcatgtatcagaacatccatccatctaccaaaacaggcggcccctcagcagagaggcgggctcagagcccagtcgccacagcgccaggtgaagattcacagagaaagaagttag

SEQ ID NO: 1148 - DNA, 32433 bp, Homo sapiens
cactgagacgcacatgttatctttcaaacaagtcaatggactagaataaatcatcctttctcagcatgtggtctgttgaacaactgtgtaagaatcatctgagcaaatgtttaaaatgtggattcctggctcccattccagacatgctgactcaaaactggggcaaaacgctcagactctgcttttttaatgagaacctttggtgattcctatcacaggtctagatctgtgctgtccggtacggtagccaccagccacatgtggctattgagagcttgaagtgtgtctggtccaaattgagatgtactctaattgtaaaatacacactagattttgaagacttagtatgaaaaaaagaatgtaaaatatattattaataatttttatattggccgggctcggtgggtcacacctgtcatcccagcactttatgaagccaaggcgggtggatcgcttgatcctaggagtttgagaccagcctggataacatggcaaaatcccatctctacagaaaatacaaaaatgagttgagtgtggtggtgtacacctttagtcccagctacttgggaggctgaggttggaggattgattgagcccaggtggtcgaggctgcagtagccatgatcacgtcaccgcactccagcctggatgcagagcaagaacctgcctcaaaaagaaaaaataataataaaattaaaacaatttttacattgattatatattaaaatgatagtattttggatatatcgcattcagcgaaatatgttattaaacttaatttcacctgcttccttttactttatacagccaacagaatttgtaaatgatgtacaaggcttgaagttgtgactcacattctgtttcattggctagccctgttctagatgaagagtaggagttcttttcaccttgattccgctaagtgtttgtttcatgattattgttactctttatacctaaaagggatttgtactaaaagtcccttgttgggacttttagaatctcagtgcagggtttgcatggagttgtctactgtctcttactgaaaccccccaatgttcagagcattcatttttaaagtaattaagaatgcagactggtctgggagctgactgaaacacactcccccaaactcagggtttgtcaacagtggcgctgctggcatgttgagctggataattctttgttgtgaaggactgtcccgtgcactgtaggatacttttcagcatcccgggtctcctcccactggatgccaggagcacattcccttttcccagtgtgaccaaaaatatctccagacactgccaaattgagaaaaataacccctggcattttttttttttttttttttttgagaaccattgccttagaggcatcaacccacagtcatcgtaagctgttattcagaaatatcaagctttttttttttttttgagacagagtcttattctgttgcccagactgaagtgcagtggcacgatcttggctcactgcaagctcctgggttcaagcaattctcctgcctcagcctcctaagtagctgggattataggtgcatgccaccatgcccagctaattttttgtatttttaatagagacggggtttcttcatgttggccaggctgttctcgaactcctgacctcaagtgatccaaccgcctcagcctcccaaagtgctgggattacaggcgtgagccaccgcgcctggcccatcaagcttttaaatgtagaaggttggagagtcagcccctctttaccctagttgacttgattaccacttggcctgtgttcagaaggaaatcagcatatcactgtcccctctctcctttgtatcctatccccatgttagataagctcttagcattatgggaatctcttctgaacctgattcaaagagagaaggggtcgattcaatttagttcaacaaatattactttaatatcctcttgatgggtgtgatgctgtgatgggctgcaagagtgaataaggtaatgttgctttccctctcccgcaagaatgtacacagattgctactgtgctggtgatatctggtataaccttttgagattttacagaatcgccagttggggaccatgtcactgacatatgggtcatgggccaatgtagtgggctgcttcatgtagtttcattccatggctacaatccatacccatgaccccagattgttatcctatagaggtagccaaatgaatgaattaggtgagctcctgactcctatagcgttttgtacctcactcattcctacttatctggcaacagataagtatgtatgtcacatctcaccagggagtttataaactctaagaataggtatgctgccatatttctctatctttgtacaatgccttgttcagtaagtgtgtttaataaatgaatgaattcatcatcatatctggaatgcaactcacagtgcagtctgggccaaagatgagtcgacagcatcctcttcactgcaaggaccacgcacatggttcttagcacaacacccagtactcagtgtttattgttatttgaaagttcttgaagagctacagtgtttgtgctaatgatgtgcattgttggtactgataatgtaccaggtgttatgggccactgacgacacacagcaaaggaaagatgggccctccttcttcatgagaaaacatgctcaaagtactgaacaagaaacgaacaacacaaaatttgaacacgcctctgagtgctctaaatgtctttttctctccacatgaggctctatgttgagatggggatggaggactagattatagtcaggggtaatttccacttttctttgtttttgccttttttttttttttgagacagagtctcactctgtcgcccaggctggagtgcagtggcatgatcttggctcactgcaacctccgtctcctgggttcaagtgattctcctgcctcagcctccctagtagctgagattacaagcatgtgccaccctgcccagctatttttttgtatttttagtagagacggggttttgccatgttggccaggctggtctcgaactcctgacctcaaatgatacgcccacctcggcctgccaaagtgctgggattacaggtatgaaccaccgcgcctggcccttctttttgcttttttttttgagacggagtctcgctctgtcacccaggctagagtgcagtggcgcaatcttggcttactgcaacctcctcctcctggcggaggtgattaagtgattctcctctcggtggaggtgagtaagtgattctcctgcctcagcctctcgagtagctgggattacaggcatgcaccaccacactcggctaatttttgtatttttagtagagacggggtttcaccatgttggccaggctggtctcaaactcctgacctcgtgatctgcccgccttgccctcccaaagtgctgggattacagccgtgaaccacctttcctggcttctttttgctttttagagtcagggtcttgctatattgcccaggttggattctaactcctgggctcaagtgatcctcccgcctcagcctcctgagtagctgcaacttggcgtgtgccactgcacccgtctttccttttgactttttattatagaaagtttcaaatttactaataagttgaaataatagtgcatgagcattctttacctaccacctagattcaacaatttaattgaaccgaatttggtttgtgaagtacaatattttagtcatgtatcaagattttataggcaaagtgatacaattttttaaaaatctgttactgaaaggcccctgtaataacactacccctgaaaaaactttggtgtggtcatggtatgtgcaccagaaatctctcggcttccccactttcatggcttcatttctccaatttacttcctcaaatattacgccaaagtttactagggcttgcctttatgttttattaaattataactttctagccgtcctggtgtcctggtcctgataaaggtttccaggatatttcacccattagtttgtataatttcctatctctacagacttaattacaaattccaaatctaccttagctttttccacttttatgggaaaaaaaaaaggaataggactgttgtaattacttagtaacctcttctgaaaccttctccttagccttgcctaagcctgatgttttcctttttcctgaaatatttaattttccaactctgtgaatctaagttttgcccacagtaggcactaaccgagtgcttacggggtaaacagctgtgtggtggtcgtttgggttctgggtggtgagccagggtcctgctcagaagaaccacaaactgaaaagcaggctgtcacatacaatgagtgacacacaattgcagaagattatggagcctgggagaggagttgtttttttttttttcctattttctgaaggagttgagccttgagcacagacagaaaggagggaaaatgagggaaaagtttgagtctagagaaataccagcagctcctacctaaatgccgttcccattcacttctgcagtttgagacaacattcctggctgcaggtcttcccaagaccccactcagttgtaagttattaaccacatcttaagaagccattctgtgagaataaaagatccttctttgagctcttaccatgtgcaaaatcctataggtgtattacctcatttaactctcataatcccattttatgaaatgtggaaattgaggctaaattacttgcccaatcacagaaggcaaagccaacaccctttattccttctttttttctgaaattgccttataaaaacacataattccacctccagagataacattgcagactttttctatgtaagcaccatgatagaaacatacaatatggatctttgtataaacatgaaataaggtaccatttgtaatctgatttttcacttaaaatatatcatgagtatctttctatattaataagtatgttgttatatctaccttattgctgtaatggctgcatagtattccacttttcagaaatttttattttaactaactcctgttgatgggcatcaactttacttttttttctttctctttctttgacatttttatttattattattattattattattattattattattattattattatttcggatggaggcttgccctctcacccatgctggagtgcaatggtgcgatctcggctcactgcatcctccacctcaagcgattctcctgcctcagcctcccgaatagctgggattacaggcgtgtgccaccgtgcccagctaattttttgtatctttagtagagacggagtttcaccatgttggccaggctgatctcgaactccttacctcaagtgatcctcctcctttggcctcccaaagtgttgggattgcaggcgtgagccatcgttcccagccaagaaaccccttttcttagttttaatgagaacgcatcttcttagacaccgaggtattgttttactgtaaactcaaatgtcctgacctccgtctcctgccggctggccatttgtagaaaacccctaggcgaaagaggaagctttgcatctcccaatcagcctaattagttagtccccttggaattcccatggggtcaggacacggttgtcattgcagttgtcattgtttccagggttaactgtcataagcatgaggaaaggcagtttaaagccattggatattcagttttgtgttcctgctatttatgtgaccaatttcatacttggagtttgttcagaagagtgaaaaatgtttcaagtgctatctcttctaaaccatggcaaaccacactctattaagacagcacaaaagactgaggaagaaaaatgtttacgaaacattttgctttggtctgcctcatgataagtaattgtactggtcatttctttttccactgaattgactggtgtctctgacatgctctctggtgagccacactggcttcattacctcctctcttctcctttttcagggtctttggccattgtccagagagaattacactttctctcttagaagctcacgtctttcttctcttgggccacttccacgccagcctcttccacactgccttcctgaggtcgggcactggcatggagctctgtttcctcttctcctccctagggttgtaatctggctttcccccaatctttctattgtttccacttcaccagtgatttcctccttgttgtccagaaataggtcaggataagaaattcccctttttgacttcttcagccttcttgttaacaaagcaaaagaaggttaaacacctcattcaatgctcagcatttttttttttttttttgagtccgggtcttgctctgctgcctaggctggagtatagtggctccagcaattcccctacctcggcctcccaagtagctgggaccacaggtgtgtgccatcgcacccagctaattaaaaaaaaaaaattctgtagagacaaggtcttgccatgttgcccaggccgatctcaaactcctgggctcaagtattgcaccctcctcggcctctcagagtgctgggattacagatgtgaacccctgcacgcacccaaaggtcaacttttaactgcctgaaacttttgataggtcagagagatgaattctcttgttcacaatacacagtcagaattaccttggcttacgagttcagggcacagaacactggtgtcacacaaacgtgggctcaaaagctgcaattacgcagtggcgttttgtggattttttttgtagagatgggatctcagtagattgccaaggctggtctcaaacttctggcctcaagcagtccacccatctcagcctcccaaagtgttgggattacaggtgtgttttgagtcttggggaccaactgggattctcttctcccctttatcttctgtatccaatctagcccctgccatttctttttttctggtgcctctagggtttgctcttttctctcctttcccattctcctccattaaacaacgctccccttgtcatgctccgaaacctcaaatctgaacttttacttctcctatcacagaaacttcccacactccaactgcttattacccctctaccttcaccaccaaattgtaaattctgtgagaacagaaacccaattttttgaatttgctgttgtgtcctcaatttccgtcacaaacaggttctaacattgacagttgaatgaaggaatgaatgaacgagttcttggattgctacaactgcctttaaacttccagtaaacttttgctgccatcagcaggtgcatataaaacactcttcataggccaagccaccctgactcatacctgttatcccagcactttgggaggccgaggtggggaggatggcttgagggcaggagtttgagaccagcctgggcaacatagtgagaccccatctgtacagaaaaattacataaaataaaattaaggctaggtgcagtggctcatgcctgtaatcccagcacttttggaggccaaggagagaggatcacatgaggtcaggaattcaagacgagtctggccaacatggtgaaccctgtctctatgaaaaatataaaaattagctggctgtggtggcgtgtgcctgtaatcccagctacttgggaggctgaggcaggagaattgcttgaacccaggaggcagaggttgcagtgagccaagatcacgccactgaactccagcctgggcgacagagtgagactccatctcaaaaaaaaaaaaaaaagttttattgcaatgctcagggcagtaagcattgttgtagaaaataagtaatttgtatttttaaaatgcgtaattcatcccggcactttgggaggctgaggtgggtggatcactaggtcaagagatcaagatcatcctggccaacatggtgaaaccccgtctctactaaaaatacaaaaaattagccaggcgtggtggcgggcacctgtaatctcagctactcaggaggctgaggcaggagaatcgcttgaacccgggaggcagaggttgcaataagccgagatagtgccactgcactccaacctgggtgacagagtgagactccatatcaataaataaataaagtaagtaaataaaatactgttcatgatattctgctcccatgagaagcttgccgttcctcctcattgcagccctatgacttcccgtctggcgccttcagtcgctgctttgtctcctccttggatgccttttcttttgtcctctcatcaaaaccaactcatccgtgaggctccagcttgagctctacctcctctatgaagcccccgaacctttcccaccgacacagacctctgccttctttgatcatctgctggacttcagtttaatgctttaatgattccacttgtatgggtcctgtctatccacccggtttaggtatctttgaagataggagctacctactttttaggtcttttgcatcctccacactcctcatctaaagctgcgtccactctgactcaccttcctaacctgccaggcagggtctttttgttttttaaactttaagtaggctaggccgggcgcagtggctcatgtatgtaatcccagcgctttgggagtctgaggcaggcagatcacaaggtcaggagatcgagaccatcctggctaacacggtgaacccctgtctctactaaaaaatataaaaaattagccgggcgtggtggcaggagcctgtagtcccagctactccggaggctgaggcaggagagtggcgggcacccgggaggcggagcttgcagtgagccgagatagtgccactgcactccagcctgggagacagagcgagactctgtctcaagaaaaaaaaaaaaaaactttcagtaggctatgtggaggtcgagttagatatcttcggtacaagccttagatttctttttctgttttaagggaatttttttctttttctccaattttgttactgtgagttcacgaaggcatattcaacagctcattgctgccctgcctctcctgcaccatccaacatctcactgcagtatccagcaacccacaggcctgctgggcgtggtggacagtccccaagatcaggttatccgtgtcaaaatattgagtggttgatgagtgctccaagtaggcactagagcctgctgagagcactcagaggtttctgcacaagctcagtggatttgagccctcatcattgttcattgctatgtaagtcaagggttggtcataggtcctgccttggactgtcatttcaggaagcagggcagctacagcagcagtccccaacgtttttggcaccaaggatccattttgtggaagacaatttttccatagattgggggtagggggatggtttcgggatgaaactgttctatctcagatcatcggggattagattctcttaaggaacgcacaacctagatccctggcgtgtgcaattcacagtggggtttccgctcctgtgggaatctaatccctctgctgatctgacaggaagcggtaaagctctcttgcctgctgctcacttcctgctgtgtggcccctttcctaataggccatggacagttaccagtctagaggctggggggctggggacctctgaactacaggcttctccacctgcacaagttctgagaagttagactatccagagcaagaggggcaggaacttcctggtctcactgagaatcttcggccaatctcaactcccaatgggcatatgactcacacggtgatcatcttaaaatgcagattctgagtcagtgatttgaaagggacctgaaatcttgcaattgtaacaagctcccagatgataccaatggcgatgttgatgctgcctgtctgtggaccacactttgagtagcaagggtctacaatatggacatttccttttccagtgaactttagcaagtgaggagcatttcaaggaagacacctcccatgcacactgtcattagttgcagcatctcctgtagcaattgggctaaatctgtctttaattctttttcaaacagcatatccaagttttgcaatcataagcaccagccaggagaatatatattccatgcagaaaatgatgatgcccaatttaccaaaatgttcacgctgaatataagaagtaagttaaattgccgagaatttgatttttattttttaattccttaattttttattagtcttaactaggaaaagttaagtaatggcttagaagggctactacaaaactgtttttgtacgctgaagtgttttgaaactttactctcatatctactggcattgatcatatatctctttattttttatgttattttgttctgtttcatttttaagaccaggtctcactctaccacgcaggctggggtgccatggcacaatcatagatccctgtagcttcaaactcctgggctcaagtgatcctcctaagcctcccgagtagctgggactacaggcacgcgccaccatgctcagctaattttaaaaccatttttgtagagagggggcctccctttgttgccgaggttggtctcaaactcctggccttaagggatcctcataccttggcctcccaaagtgctaggattacaggcgagagccactgcacctggccatatatctctttctgtgtgtatcatcagaagctgaaagacttatttcacattgtctctgaatatgaattagtgttatgactttattgattttagtattttgaaaggtcatgttaaggaaaggctgaaagtcattttatctctcatttatttgtttttaataattttcatttctttggcttataaaacaatgagaagtccaacttctcctgaagctaagaatcattttaaggcatgcaaacaggtggaggtctgtacctcagctctctccagggagaggctggcaatggaaaaatggtgtgtagcagagaggttgcatggcaaggaggttgcatggcaaggaggaaagaagaaattaccagaggtctggaggcatcctaaatgagaaatcctcccagaagcacaaactgccctggagtaaatgggtagcctgtactgtaggcaactttgaaactatttccagaaagtaccatactccatgagcttattttattttattattttcagagacagggtcttgctgtgttgcccaggctggtcttgaactccttggcccaagtgatcctcccaccttggcttcacaaagtattggtattataggagtgaaccactatgcccagccagtgagcttatttcacacgttcttttctacagggaaacctcaagtgctcgcagaagcatcggcaagtcaggcgtcctgtttctcggatggatacccattaccatcttggacctggaagaagtgttcagacaagtctcccaagtaataaggacattgatgcctcttataatggaagaacataaaactctctgacctattgactctttcatgaatacggtttaggaggaaatgatgaaatatttaaaatgctaaccttctcaatcaaccataactctcaatagtcatagactgtttctgataacttatactggatgaatctcttttagaactcgctgcagaaatcctaacttccaatctgatgacagcacacctgtctaaattctttgccattttttttttcagctgcacagaagagatcacagaaggagtctggaatagaaaggctaacagaaaagtgtttggacagtgggtgtcgagcagtactctaaacatgagtgaagccataaaagggttcctggtcaagtgctgtgcatacaattcccttggcacatcttgtgagacgatccttttaaactctccaggtacaacagttgttcttgtgatattccaccatcaggaattccccactagaagttagtccccatcgctgacttttacttggggaattttacaggagagtatagggtcagtgtgtgagaaaaggtttcttgagtcaggcaagaatccccagagagactgtttcacaggttggggcggagtcctccctgtgcccttgtgactcatgtgtcacagtgaccgggagaagcagaaactgccggtgtggtgaatctccatggaaagatctaactctagagaaacagattttgtcacttggagtctctgtcattttcccttttgattagcctccttatttgccctcagcttgctgttttataatttttggtttgctttttagagccctcctaagttaaacagttgtgaaacctggctgcccaccctagtagttaggatcaccaacctcacaaaactgacttctccactttcatgtgcgaccttcataaaagggatatgaacttcttttttctctgacttgtacatcctgtaggtttaaatccatgcatttttttttttttgagatggagtctcgctctgtcacccaggctgcagtgcagtggcgtgatcttggctcacctctgccagggttcaagcgattctcctgcctcagcctcccgagcagctgggattacaggcacctgccaccacgcccagctaatttttgaatttttttagagacgggatttcactgtgttgcctgggctggtgtctaattcttggactcaagtgatcctcccatcttggcctcccaaagtgctgggactacaggcgtgagccatcgtgcctggcccagatgtaattcttgtaaatttaccctagtaaatggttttaaagaatggattgagaataatccgcaattttctagggaggaaatgtatcctttacagggacattgcctgattgtctgtggggagtagagtatatgtagagtggttgttaggactgaaaatgattattactgaaacaggatgtgagagattataatgagttgtccactatttataatgtcacacaggaattctgtttcatcgctgagtgacactcttttgttgcaggccccttccctttcatccaagacaacatctcattctatgcaacaattggtgtttgtctcctcttcattgtcgttttaaccctgctaatttgtcacaagtacaaaaaggtaaaagcaaaggtaaaaattcattattctttcctctatctgcagaactgcctattcctaactgactcatcatttcatctctgaagcaatttaggtatgaaagccagctacagatggtacaggtgaccggctcctcagataatgagtacttctacgttgatttcagagaatatgaatatgatctcaaatgggagtttccaagagaaaatttagagtttggtaagaatggaatgtgccaaatgtttctgcagcatttcttttccattggaaaatctttaaaatgcacgtactcaccatttgtctttgcagggaaggtactaggatcaggtgcttttggaaaagtgatgaacgcaacagcttatggaattagcaaaacaggagtctcaatccaggttgccgtcaaaatgctgaaaggtacagtatagtggaaggacagcaacaaagatgcccaaaaatgggaggcacagtttcccacccatgccttcttctcttttccatccttttaatggttactgtttgccttgtttcaaggctaaaaatggagtggattggggtgtcaacccagtcatgaatacaaaattcaagtcataaatacaaaactccacctcttcttccacttctctctttgtttatttttattttcttttatttttttgagacagggtctcactctgtcacctaggctggagtacagtagtgtgatcatggctcactgcagcctccaccccctgggctcaggctcctcagcagctggggctacaggcgtgcaccaccacgctcagctaagttttttatttttggtagagacggggtttcaccatgttgcctaggctgatctgggactcctgagctcaaactatctgcccgcctcggcctcccaaagtgttgggattacaggcgtgagccactgtgccaggcctatttagtttttataggctttgatatttggggatacagttgccacaggcagaagttctttcttacatttgtgttgttttattttgttttatttttagagacaggatcttgctctgttacccaggctagagtgctgtgatcatagctcactgcagcctcgacctccttggctctagcaatgctctcacctcagcctcacaggagtgtgccaagacaattggctaattttttttttttttggtagatacggtgtctcaccatattgcccaggatggttgcaaactcctggctcaagtgaggctgccttggcctcctaaagtgctgggattacaggtgtgggttgaaacagactctgggtaggagagaaaactggggccctttgtatcctcacttcgttgctccatccattccgatctggcgtccagccccattgctggcctcaccgttaccaccgctgacccagcaaaagcatctccagctggctctcttgctaaggtcaacagtgacttcaaaccaaaccaagcctaatggatatttttcagtcctcattacttgattgttcagcatgaattgatgctgttgattcttctctccatccagaagctttctttctttgggttttgtgtcaccatattctggttttcctcccacccctctgcccttctcagtcctttgtgggctcatcttcttccatccagcttttgttgttgtggctgattttgaaactcagtcctttgtgggctcatcttcttccatccagcttttgttgttgtggctgattttgaaacacagccttgctctgttgcccaggctggagtgcagtggtgtgatctcagctcactgcaacctccacttcccaggctcaagccatcctcccacttcaggcccctgagtaggggggactacaggcatgcgccaccatgcctggctaatttttgtatttttggtagagatggggcttcgccatgttgcccaggctccatccagctttttatggggcatccctgtgggcttgctcctggaccgccttgcgttttcgctccacacactcaacacagtccatccccactacacccgtgatgtcctcccatacaccaagggccctcatgcttgcgtctcctttcggagcttcaggttcatatgttaaatgtttggatgtctcaaaggtccctttaacacagtgtatgcaaggtgaattcccctaaccctggccctgcaccagcagtcctctctgtgactggtaatgaatgccagtgaataaataaccacattctatatagttgggcacactagaaacccgtgacttttccttgacaccttcctctttctaacaccctgtgagctaatcctatcaggtttccgattagtgtctcttgattccatcctcgtccctccatctctatgaccaccactctagttcaaggctctctcctggacaaaagcttccaaagcaggttcctgtatccactcttgcctccctttggcttctccatactgaggtccaagtgacagtggcgaaaggctaagcagatcaaatggctttcctacttcacatttcctccaccacccgcatggctgggccaccgctgcctccccacctcttgctctcggcaccccagagcgctggccttctttcagttcccccagcactgtcctcccacccactgtggggcctttgcacaagtggatccttctgcttccccttcccctttcatgtaagtatctcccactgccccctcagatctcagcttaaacaccacttcctctgtctcacaccacagacaatattgaggcccttgcaatgtgcgacattagctctctgcaggctttcccccgtagaatccatcacctttgtcatgacattttttaacatccaattgttgtcccatctgtccagtagcccctgtgcctcatgagggcagggtctgtgtctgtggtgctgtgctctctcctttctcgacctttgcccactctttcacaaccctcagcactgttctcctccccttccaccatgagtcacctggccagctcccatttttcttcaggactcagtttagacattgaatgctcctttctccacccctccaaggctaaggtagctatcccttttgaccctacagtacccctgcactcctttgccacgttgcattttttcttttttttttgagacggagtctcactctgtcgcccaggctggagtgcagtggcaccatctcagctcactgtaagctccgcctcctgggttcacgccattctcctgcctcagcctccctagcagctgggactacaggcacccaccaccacgcccggctaaatttttttgtatttttagtagagacagagtttcaccgtgttagccaggatggtcttgatctcctgacctcgtgatccgcctgtctcagcctcccaaagtgctgggattacaggcatgagccaccgtgcccagcccaacgttgcattttttctttttctttcttttttctttttttgagatagggtctcactctgtcacccaggctggagtgcagtgaagtcatcatagctcacggcaagcttcaagtcctgggctcaagtgatggtctgcagcctttccagtaactggaactacatgcaggcaccaccaagcccagctaatttttattttattttattttatttatttatgtatttttactttattttatttttaagtagagacaagctcttgctattttgcccgggcctttcttgaacttctgggtaccagcaattctcccgcttgtctcagcctcccaagatgttgggattagacgcgcagggacccacgtcttgcctgccgtattgcatttatggcactgtattgtcatggcttatttacttctctgccttctccaggagactctaagatccaggaagacaagggttgtgtcttgtttttccttcattccccagtgtctaggacattggctcttacagagtaggcactcaataaatacttgttgaatgactgaatgaaagaggtaatggtacatgaaaatgcttagaagaagctaagcatgctaaaaaatgtaagatattattttagccatgaggaataggacatgaacaagtaaagccccgaatccctgtccagcgtgaagctgaagacatgatgtattagggggtcccagtgcccacaggaaatcccacccccaagctaaaatcttggaaacaaggatacccctgagagcttgcccaaaccaaaatagaggatgtcagcaccggagaagccactataaaggttaggatgccttcctggacaaaataatggaacctggcaatcgaaccaaatcttcactgaatgtaaagaagagttactatatctggaagaaaaagtctgttcacagaggggtggtgcctggagcctggagagggaagtccagagaccctgcccttgcccctgtggctgcccgggctgccctgaccaactgcacatgagccgcaatgacgggagcccttggattccatagcgactttcctcacactgtgcttctaagtcagcttataagtacagtttgctgagctatctggaattttccctagagagagaatgcattggccaaccaatatgttctagcctgcttggcagttttatttctcaatgtcaattaatgggtctcttgagcacctgatagtgggaattagtcctctttgaccttctcccattggacttgctggcaaatctaatgttctagacctgagggccacaggctagagtcaaccatgctcacgacactgttatctctctctgactacaacagatccaagagttcaaacaaacaaacaaaaaggacgtttctcccttctgttaacttgtactgaggaggaaaagcatgtgttattattttgtttgtttgttttgagggccaactgtaaggatttttattttggtaggtagaggaaagtcctgttgaaaggtgcattaccagattcaacatttatactatagtctttgttttgttttgttttgttttgtttttgagacagagtctcgctctgtcacccaggctggagtggtgcaggggctcaatctcggctcactgcaacctctgcctccccagttcaagggattcttttgcctcatcctcctgagtagctggaattacaggtacgcaccggcacgcccggctaattttttgtatgtttagtagagacagggtttcaccatgttggccaggttggtcttcaactcctgaccttaagtgatccacccgccttggcctcccaaagtgttgggattacaggtgtgagccactgcgcccagccctatactacagtctgaattctgccttaggctgggcatggtggctcatgcctgtattcccagcactttgggaggcggagttgggaggattgcttgaatctaggagttcaagaccagcctgggcaacatggtgagaccccatctctacaaaaaatataaaaattagctgggcatgatggcctgtgcttgtagtaccagtaacttggagggctgaggtaggaggatcacttgagcccaggaggcagaggctacagtaagctgagatcatgtcactacactccagcctgggtgacagagtgagatactgtgtcaaaaaaaaaagaaagaaagaaaaggaaaaaaaaaaaaagaaaaaggagaaattctgtcttaaaacacaggatattgtttgtttgtttatttatttatttattttaagatggagtttcactcttgttgcccaggctggagtgcaatggtgcaatctcagctaattgcaacctctgcctcccacattcaagcgattctcctgcctcatcctcccaagtagctgggattacaggtgcctgccaccacgcctggctaatttttgtatttttagtagagacgaggtttcaccatattggccaggccagtcttgaacttctgacctcaagtgatccacccacctcggcctcccaaagtgctgggattacaggcatgacccaccatgcctggcttctctcataattttgaatttaaataaataatgcagattgactctgagctgagaaaaattttatttaatgacataaaattcgtattttacttgagttttacatttttaatgctcctttctttgacagaaaaagcagacagctctgaaagagaggcactcatgtcagaactcaagatgatgacccagctgggaagccacgagaatattgtgaacctgctgggggcgtgcacactgtcaggtaacccacttccacgaaaatcacctcatcaaaaagactgtagcttgatgacaaagaggatgtttgctctctctctctctctctctttttaattctttgtcttttctcagtcacagtgtgaactctcaaacccaagtggaattagacactgagcactctataaatcagaggggtcaaaataaagaatgcctcattcatctgctttatcgtgatatattgcataattctcacctgcttaaaaacaacaacaacaacaacattgcaagtacatttggtggtgtctgtgcttctctcccagcttggaagctggtgcacaggcgtggtgagagtggttacagagcctggccactgccccagttgggctgccgtcaaatacggcacagcctagctaggatatcagactttactttcccagaattctctggggcatgccctctgatcttctctcttctgcctagaaatacccaaatgatgtgcccaaggttcattctttctgcagcagcaggcctggggctggtactaaaaggaaaaagaggaaagtgaatctgagagaggactgggaatatatttctccctcctcaagcaaacagcaaatcagcatatagttaccaagtgttcacctataatacacagctagaacattactttcagttgccaactggagaatccaggaggccagtggtattggtgaggccacacatacaaaaaagggccacagagaatgtcaagaagatgctgctttccaaagaaatttgagcaaaagctgaaactgaatttaaagtataagaagagctaggctcagaaaaagttgtactgtccccaagtcagcagagaaccaagccctcctaagagtatgttgtctgctacatagacttctgaaataacagtttgctttgtgtatgcctataattgaaactgtaactatttcaggaccaatttacttgatttttgaatactgttgctatggtgatcttctcaactatctaagaagtaaaagagaaaaatttcacaggacttggacagagattttcaaggaacacaatttcagtttttaccccactttccaatcacatccaaattccaggtaagaggctgggtcagggtttcgtaattacacatcatagaacgtaggcaaagtgtgctgttcaaacacacttcgttgaccagtttctaaaggcaccgtgaagtctgtgggtcctgcaacctagagatttcctgaatctttgctatagtttccctgttgacatggaacgagtcctgtccctttccttcagtacaggtactatagctgagctagtctctctccacccatgcctgcatcacaccatagacgcctatttggtttggggaaaggtgcattattcggtctttcaggacacctggttgcctcacaggtattggtagaaagaatgaagactttttccaaagtccttaacatatgcaaagagagcagctcgggtcctgggactattgcgcaaaagaacgctgaactcaaattggattctaagatattaggatggattgatcgacacgtgatggggacacagtaaagtagcagtaaccttgtctctgctctgtttatcctccgcatccatggggatcctgagagatgcttggtcctgcagggatttattgctttagcgggcataaatgagggctgtaggagtttgctggatctcctcctcatccttgaactttcttgctaattacttgagcatcatggctttgtagcacctttctctgaatggattcccaggcattctgatggaggcattcgttgagccttggagcattctttttttttttttttttttttcagacagagtttcgctctgttgcctaggctggagtggtgcaatggtgtgatctcggctcactgcaacctccacatcccaggttcaagcgattctcttgcctcagcctcccgagtagctgagattacaggcatgtgccaccacgcccagctaattttgtatttttagtggagacagggtttcaccatgttggtcaggctggtgttgaactcctgacctcagttgatccacccacctaggccccgcaaagtgctggaattataggcatgagccaccgcacctggctgagccttggcgcgttcttatttccctccctgtatggaagttctcccttattctgaagggtatttgtttattggagacttttttctttaccaggggctttttagggatacatttgagagtcccggctttgttttcttagaatgtaagttttaagtgcaggcctctggccttccaggtctgagacacagacccagtgtcttaaagccaccaggccccacggagatccccatgcacgtccgtgtgcagctgcccttaacctatgcatgcccgtcacaccgtcctctcctttacattcatttcccagctcatcgtctagaaatgagaactctataaagccactcatattctggaacagaggggctatcctactgagtccgatgtgtgtgaccagtatccactggtcagtacttagcccctttgattcgttctgttcactggaatattaaatacactgaaattattccttttggaatatttgtggtctgaaagcatgaagccatttcctaaagatatgtaaattgtaaattgggttaaactcgtatattagaataaattgaatcgtgatctacttataattcctacagagctcctcagggaagaatttttatataccttaaaagagatttgtattattgctatttattaatttcacagtaaaaagaaatgagctttacaaaggcaaactggaaaaaagaaggatggtgaaacgcttacgggactctcgggaagatctgtattatgtgagggaaagtgggctgagttcagaaaccaaagaatgagatcgatgtgagtcctggttccactcgaatcatatttatctcactgtgcctaatttctcttttataaaatgccacccatctcataggttgtggcaaggattgagtgaggtcctttttgaactgtaagattctatatggaaaacagggattacttttatcttagactggcaagcccagttacacagatgtttttaatgtacacaaaaaatggacaaatggatggtgtgcttttaatttaaaagtcaatttataactggaatccatttatttgatgaattacatttttaaaataaaatgtctgctgagaagaataatgtaaataatgaaaaaacaaaattttttaatagcatgcctggttcaagagaagttcagatacacccggactcggatcaaatctcagggcttcatgggaattcatttcactctgaaggtaatattttattctaagtagtagcactttaaaatggaaatgaatgcaaaagttttatgttagctattttttaaaagtgtgtaaacacaaaagcattttaaaatttgctaattgtcagatgatagctaaaagccagtttgtatactgtagattttatgtcaacattcaactaataaacactgaggactattttatttggtcagattattcatttaaagtcatatattaattacagccatcttattacctgacaagtggaagagataatgagttccgaagttacatagaatttggattaacttctgcttactttgctttctgactggatgactttggacaagttatgtgaccaccagaatcacaattttcttgtttataaaataggcctaacactaccttcctcacaggactgttagaaggagtaaatgaggggctggccgtggtggctcacgcctgtaatcacgccttgggaggccgaggcaggcaggtcacctgaggtcaggagttcaagaccagcctggcccaatatggagaaaccttgtctctactaaaaatacaaaaattagctgggtatggtggtgcacgcctgcaatcccagctacttgggaggctgaggcaggaggattgcttgaacccaagaggcagaggttgcagtgagctgagattgcaccactgcattccaacctgggcaacagagtgagacttcaactcaaaaaaaaaaaagaaagaaagaaaaaaaaaggaaggagtaaatggaagaatataaaatgcacaatatagtttataaaataggatagatgggccgggcacagtggctcacgcctgtaatcccaccactttgggaggctcaggtgggtggatcacgaggtcaggagatcaagaccatcctggctaacacggtgaaacccttctctactaaaaatacaaaaaattagcatgagcctgtagtcccagctactcgggaagctgaggcaggagaatccagttgcagcaggccaagatcgtgtcactgcactccagcctgggcgacagagcgagactccttctcaaaaaaaaaagggatagacaattaatattaattcctttcccactgtgacagccctacctagtgcaaaagagaagtatctaaaactcctgactaatcaatcaggaggtcatcggtcatcaaagcagttccaaagtttatctctaaccaaaacaagtctccagtgacccttcataggcagcataaacaggtcatctctaatgctgccgggaagataatgcgatagcttcatgtcttagcacctcacctaactctggcttgaataaccttcccatagagatttaataaggcaacttcttagagttttggcaaaagtgaagactggctctattttacagatgaaattgaatatgaaaaccaaaaaaggctggaagaagaggaggacttgaatgtgcttacatttgaagatcttctttgctttgcatatcaagttgccaaaggaatggaatttctggaatttaagtcggtatgctccttttaaagaaaaaacaaaccaaaaaaaagatttgaaaagatgtgcttatatatgttttcttgtttattttaacttgtatcccttaaagtctgccttttctcccctgttcactgttggagtcacctagcgtgttaccttggctcttggctaattgtagtagcataaaggcctgggatcccttgtgaggtcacggctagcacagccctcccaggctgcacaaagtcccctgaaacttccaaggctgaaggtcgagataggaagtcctcagaaatccttcctcaaaacaaagcgtagcattgtcagtccctttcagaacggctgttcaggttgtgccctgcatgtgggcattcaacccaggggatgagaggaggctgaaaccgagccagccaccctgagtgtctttgtctaattctcaccctgcgtgctgtgggctggcagcagtcctgcaggctcactgcctcctctgttgctaaccccagatccattcgttggtaaggccctggagcctgccgtgaaccatgtctctaccccaattttgcactctttttgaactgcctttccacccgctgttctctgtgatttcaaatgtctcctgcctataagcagatcatagcccactctctggctaccttccttcctcgtttgcttgcctttcattaccttctctttatttcccaaaattcttccccctcatttttcttgcagtcttctaatctcctcctcctcttctcctccacttccttccccttgcctcttctctcctgttttctctctgaatttggaaagactactttcaattgtatttttttgttttgttttgttttgtttttggagacagtctcgctctgttgcccaggctggagtgcagtggcgtgatcttggctcactacaacctctgcttcctgggttcaagcaattctcatgcctcggccttccgtgtagctgggaccacgggtgcataccagcatgcctggctaattttttgtattttaatagagatgggaattcaccatgttgcccaggctggtcttgaaatcctgagctcaagcaatccacctgcctcagcctcccaaagtgctgggattacaggcgtgagccaccacactcggccttttttctttaaaaaattactgcctcagccagatgttcatggtgtgtgtctgcagttccagctacttgggaggccaaggtgggaggattgcttgagcccaggagttggaaactgcagtgagctaggatcgcaccactgcactccatcctgggtgacagagcaagtctctttctctaaaaaataaaaaataggcagccgggcgtggtagctcacgcctgtaatcccaacactttgggaggccgaggtgggtgaatcacgaggtcaggagatcgagaccatcctggccaacacggtgaaaccccgtctctatacaaaaaaaattagccgagtgtggtggcgggcgcctgtagtcccagctacttgggaggctgaggcaggagaatggcatgaacctgggaggcggagcttgcagtgagccaagatggcgccactgcactccagcctgggcgacagagtgagactctgtctcaaaaaaaaaaaaattaattaaaaataaataaataggctgggcacagtggtgtacgtctgtaatcccagtgcttttggagggaagcccaagagttccaggctgcaatgagctatgactataccactgccctccagtctgtctattcaaaataataatgaaataagcttaaaagcaataataatacaagttttaaaaaattactgtcacagtaatatttccacacctctgaactgcgaggcacatttttctcttcattttccccacctgctgtttggattcttcttgctcacgcatcttgcccacctgagtctttctctatttcacttatacaactacaatcctgctttcacaagcattttgtttttgtttttgagacaatgtcttgctctgttgcccaggctggagtgcaggggtgtgatctcagctcactgcatcctctgcctcccaggttcaagcgatcctcctgccttggcttcccaagtagctggggttacaggtgcacaccaccacacctggctaatttttttgtatttttgtagggataaggttttgctatgttggtcagactggtctcaaactcctgactcaagtgatttgcccgcctcggcttcccaaagtgctgggattacaggcgtgagccactgtacctggcccacgaacatctttatagaggtgggagaacacctacttagattgtctggcctggtttgctgcccatagctaagtaaatactcaaactactcccaactggcagtcaaggggcactgcttccccttcaaccccaggcttgtaataatatgaatttttgaagaacatccagtttcttaggccttctatccttttatcttcacatcaggcctcccctttgaatcatgcgtgtcactgtccccttcttgtctctcaccccctccctgatattcctctgggtgcccctcagtttcctctgtaggcccttgacttcatcaaacatttgttgagccccagctacatgccaagcactgtactagatgctggagatacagagtcagttatgatatgactcctgggctcgaagatcttatgaatgataggggagacagagacaagcagacatgcaagtcgaagatgacactgaggccgggggtgggtggctcaggcctgtagtcccagcactttgggaggttgagacggtggattgcttgaggccaagagttcaagaccagcctggccaacatggcaaaaccccatctctactaagaatagaaaaacagccaggcacggtggtgtacgcctataatcccagctacttaggaggctgaggcatgagaatcgcttgaattgggaggcagaggttgcagtgagcagagattgtaccgctgcactccagcctgggtgacagagtgagactttctcaaaaaataaaaataaaaaattttaaaaagtttaaaaaagacaacactgtagcatgataagtgttgtgactgaagtaagttctgggaacccaggggagggatctgcacagcagacctggttgggggaaggggagatgcagtggaagaggctttctgagggagtgcgtgcttcatgcttggactaatggagatttttgaaggaaaaggaaaaccagcagggaatgtgggataggataggaagcatggaatcaggaggagttttttttggagaaaggtaatgagttggacatactgaatgtgaggtgccttgagcaaccaagtagagcgtggtctagcagacacttggacacttctcctgtctgaagctcaagagaaatgtttgggttggaaatagggatgtgggcaatggtggttgcatccctaggtttggatgaaatggcttgggtgagggtgtgggttgtgaggatgcagccctcaggagtgagagtaggctcgtgcacaaagcccctgagggagacaggagccggcagagcagtggggagaaagcaggagtgaaccatgcgcagggttcccagagggaggaccagaagcgggaggggctggccaacagcagcagacaccacagggaggtcccgtcagatcgagactgtgtgggtgccaagccagtcagtgcaggcctcggccagagcagcttgggcagacaggcaggaggaggaggcaggttgcagacctggggtaaagtgggcaaagtgcaggtagatggcactgaaaaaactgggtatggaggagggagctctagaggggctgtggcacagggctgccagtgttcatggtgctgctttttattttttaaagatgaaagagtgtacattggacctttgctactagtgccctgttccccttcagatcttcctttgtaaagttcattttcttgtcagacccctttgattaacatcacgacatctctcagctcagggactccttctaattccagttcagtaaacctctccaaactcatttttagctttttgtttttccgattatttccctcgatattactccatttattcctaaagctattttccagtcagaaaagagatgctggccaggcgcggtggctcacgcctgcaatcccagcattttgggaggccgaggtgggtggatcacctgaggtcaggagttcgagaccagcctgaccaacatggcgaaaccccgtctctactaaaaacacaaaattagctgggcctggtggcgcgtgcctgtaatcccagcaactcgggaggctgaggcaggagaatcgcttgaacctgggacgcagaggttgcagtgagccgagatcacgccattgcactccagcctggggaacaagagtgaaactccgtctcaaaaaaaaaaaaaaaaagaaaagagatgctatttctcacacccacaataagagtactggaggacagctctgagattccctctgaaggctcaggggagggcccctgttggggagcctctcacttttgctcggaatctgcaaaagatctgctcctctttggcctctggggatgcttcagaagccgcacaaagaactgcagccaccatagctgcagaattaggtctcctatattcactttgtttgttgcacatcatcatggccgctcacggcacagcccagtaaagataagaggccttccatcaccggtacctcctactgaagttgagtctagaagaaagattgcactccaggataatacacatcacagtaaataacactctggtgtcattcttgacagtgtgttcacagagacctggccgccaggaacgtgcttgtcacccacgggaaagtggtgaagatatgtgactttggattggctcgagatatcatgagtgattccaactatgttgtcaggggcaatgtgaggctgctatttcctacttatttttatacggctattttgtgttgtgtcgttatcatggtaaacaactgcactcactgtggtgcatttttgatttatggtaacatcaaaaaaccctcacagcagtctgcttacttatgcttaaaaggtttttctgcagcttcagggaatcttccatctataataaaagctgagcaaaatagcatcacatctgtccttgggctagctagtcagagtagatcagttaggggcctttgagtgcaatcctcactttaaaaaacccaaaatctcaatacttgcacttagttcagttatcctagctataaagtgatgattgagttatgttttcaattatgtgaaaagctaatagtcacaataaagcactttaaaacatatatagcacatacctataaaatgttaaagctaaatacttaaatatgaattaatgaatatttatcatccttttactgttaacacaggaagatctaaaacatgagtgaattggctgggtgcagtggctcatgcctgtaatcccagcactttgggaggccgaggagggcagatcatgaggtcaggagttcgataccagcctgactaatatggtgaaactctgtctctactgaaaatacaaaaaattagctgggcgtggtggcgtgtgcctgtaatcccaactattcgggaggctgaggcaggagaattgcttgaacccaggaggtggaggttgcagtgagctgagatcgcgccactgcactccagcctgggcaacaagagcaaagctctgtctcaaaaaaaaaaaaaaaacaacaacaaaaaaaacagtgtgaattgacttggtaatgaaaaactaaggacagatgtgtttacaaaaagaactattagaagtaatagatgacaaaattgtgtagttgaaaatgtgtgtttttaaagaattacaatacctggctgggtgctggtggctcacgcctttaatccaaggcactttgagaggccaaggtgggagaattgcttgagcccgggttcaagaccagcctatggaacatggtgagacactcaactgtctctataaaaaataaaaaactagctgagtgtggtggcacacgcctgtggtctcagctacttgggaggctgaagtgggaggatcacttgagcccaggaggtcgaggctgcagtgagctgtgatcacgccactgcactccagcctgggcaacagaatgagacccttttttttgagaccctgtctcaaaaaagaattccctacttgtgaaataataataatattaaatgctgacttagtgcttactatgtgctaaacatctaagtgctttatgcatattaattcatttattcctcagagtacccacttggaaactgaggcacagaaaagtaactcgcccatggttacacagcatgtggacttgaacaggaatagtctgagccccgagtctgtgctaaccactatgttgtagtgtttcccatgagggttatgcacttacctcatagcgttgatgtgggaaaaagccaataaaaccaacgtgaaagcaccttgtccagggtgaacatccagtaaatgtgaaaagtcaaattaaactgtattcccactagaaacaaataatcatcttagctgatttacgatctactcctactcatcatagactgctcatatgtagtcattcagtttctaccccaccagctggttgtctcttatgtgggaaagtgaattccatttggaaccacaattaatttctttaattaatcaaattaaccagacttgcctgcatgaatcaatagctcatcagtttgcatacatttaaaagagggtttacttggctgattaagcatgtgctgattaaacatgtgctgtgaaggactcgtcaacccatgtaaaagaaaatcagtacagccaggtgtggtggctcacagctgtaatcccagcactttgggaggctgaggcgggtggatcacgaggtcaggagttcaagaccagcctggccaacatggtgaaatcccgtctctacgaaaaatacaaaaattagctgggcatggtggtgcgtacctgtaatcccagctactcgggaggctgaggcaggagaaccacttaaaccagggagtctgaggttgcagtaagctgagatagcgccattgcactccagcctgggcaacaagagcaaaactccgtctcaaaaaaaaaagagaaagaaaatcagtacaaagctctgccccagtaacctacccatcttgtgtcttgattctagtctgagactatactaagtcaaaactccctttcatgctagtggaaattattaaagccacagaagccagactggtatcatttctggaagtgatggcgtgggctcccctcccgacattattgtggatgacatttccactaaaggtcttcccagaaatgctgtaacagaagatctcactaattcactagtacccacttacccctaggcaactgactggctattccttaatggaaagtacctctttccagtggaaagatggcaagttaaacttacccattccaagcacaagcctttgttcgagaggagttgtaaagaaatatgccttatgttttaggctagtattattagaatgttaatttgaaagtgaaaacctttcacgtgaggaatgtgattttctcaataaggcattaagagtggtcttaggaagatgatgcatttcatcttaatacaaaagaaaagaagtcatgtctgtatgtggaaaattcaccatcttatctcctctgggttttccacaggcccgtctgcctgtaaaatggatggcccccgaaagcctgtttgaaggcatctacaccattaagagtgatgtctggtcatatggaatattactgtgggaaatcttctcacttggtaagttgggcagctgctggcctcccttggctcctggctttgcatcctctgctctctcggtgcccccccacccctccccccaacactgatgggtcttacttgtattgcagcccatgactttatgtttatttgctggtgtcctttagcctgtcttcctcactggtctataacctgcttgagagcgtgaaccgtgacttctttttcccagccgcagcccgtgtgcctgcaacagtgtctggcacatggcagatctcaatacgtgtttaattgaatgaatcaataaacaaatgaagaaatggatgaatggctgcaattgtctaatgttttcctcaggtgtgaatccttaccctggcattccggttgatgctaacttctacaaactgattcaaaatggatttaaaatggatcagccattttatgctacagaagaaatgtaagttcaagtcagactgtaatttggttgaaatcagaaaggtacagtctgtctacttccaaatgcatgaccaaaaaaagtcaaactccttagtgcaaagcgtataggattctttttttaaaaaatagaagtgaggtcttgctgtgttggccaggctggtctcaaactcctggcttcaagcaatcttcctggctcagcctctcaaagtgctgggattacaggtgtgagccaccacacctggctgtctgattccattttaaaaagaaaagaaaactctttgttttgggagtttctga

SEQ ID NO: 1149 - DNA, 3475 bp, Homo sapiens
cgaggcggcatccgagggctgggccggcgccctgggggaccccgggctccggaggccatgccggcgttggcgcgcgacgcgggcaccgtgccgctgctcgttgttttttctgcaatgatatttgggactattacaaatcaagatctgcctgtgatcaagtgtgttttaatcaatcataagaacaatgattcatcagtggggaagtcatcatcatatcccatggtatcagaatccccggaagacctcgggtgtgcgttgagaccccagagctcagggacagtgtacgaagctgccgctgtggaagtggatgtatctgcttccatcacactgcaagtgctggtcgatgccccagggaacatttcctgtctctgggtctttaagcacagctccctgaattgccagccacattttgatttacaaaacagaggagttgtttccatggtcattttgaaaatgacagaaacccaagctggagaatacctactttttattcagagtgaagctaccaattacacaatattgtttacagtgagtataagaaataccctgctttacacattaagaagaccttactttagaaaaatggaaaaccaggacgccctggtctgcatatctgagagcgttccagagccgatcgtggaatgggtgctttgcgattcacagggggaaagctgtaaagaagaaagtccagctgttgttaaaaaggaggaaaaagtgcttcatgaattatttgggacggacataaggtgctgtgccagaaatgaactgggcagggaatgcaccaggctgttcacaatagatctaaatcaaactcctcagaccacattgccacaattatttcttaaagtaggggaacccttatggataaggtgcaaagctgttcatgtgaaccatggattcgggctcacctgggaattagaaaacaaagcactcgaggagggcaactactttgagatgagtacctattcaacaaacagaactatgatacggattctgtttgcttttgtatcatcagtggcaagaaacgacaccggatactacacttgttcctcttcaaagcatcccagtcaatcagctttggttaccatcgtaggaaagggatttataaatgctaccaattcaagtgaagattatgaaattgaccaatatgaagagttttgtttttctgtcaggtttaaagcctacccacaaatcagatgtacgtggaccttctctcgaaaatcatttccttgtgagcaaaagggtcttgataacggatacagcatatccaagttttgcaatcataagcaccagccaggagaatatatattccatgcagaaaatgatgatgcccaatttaccaaaatgttcacgctgaatataagaaggaaacctcaagtgctcgcagaagcatcggcaagtcaggcgtcctgtttctcggatggatacccattaccatcttggacctggaagaagtgttcagacaagtctcccaactgcacagaagagatcacagaaggagtctggaatagaaaggctaacagaaaagtgtttggacagtgggtgtcgagcagtactctaaacatgagtgaagccataaaagggttcctggtcaagtgctgtgcatacaattcccttggcacatcttgtgagacgatccttttaaactctccaggccccttccctttcatccaagacaacatctcattctatgcaacaattggtgtttgtctcctcttcattgtcgttttaaccctgctaatttgtcacaagtacaaaaagcaatttaggtatgaaagccagctacagatggtacaggtgaccggctcctcagataatgagtacttctacgttgatttcagagaatatgaatatgatctcaaatgggagtttccaagagaaaatttagagtttgggaaggtactaggatcaggtgcttttggaaaagtgatgaacgcaacagcttatggaattagcaaaacaggagtctcaatccaggttgccgtcaaaatgctgaaagaaaaagcagacagctctgaaagagaggcactcatgtcagaactcaagatgatgacccagctgggaagccacgagaatattgtgaacctgctgggggcgtgcacactgtcaggaccaatttacttgatttttgaatactgttgctatggtgatcttctcaactatctaagaagtaaaagagaaaaatttcacaggacttggacagagattttcaaggaacacaatttcagtttttaccccactttccaatcacatccaaattccagcatgcctggttcaagagaagttcagatacacccggactcggatcaaatctcagggcttcatgggaattcatttcactctgaagatgaaattgaatatgaaaaccaaaaaaggctggaagaagaggaggacttgaatgtgcttacatttgaagatcttctttgctttgcatatcaagttgccaaaggaatggaatttctggaatttaagtcgtgtgttcacagagacctggccgccaggaacgtgcttgtcacccacgggaaagtggtgaagatatgtgactttggattggctcgagatatcatgagtgattccaactatgttgtcaggggcaatgcccgtctgcctgtaaaatggatggcccccgaaagcctgtttgaaggcatctacaccattaagagtgatgtctggtcatatggaatattactgtgggaaatcttctcacttggtgtgaatccttaccctggcattccggttgatgctaacttctacaaactgattcaaaatggatttaaaatggatcagccattttatgctacagaagaaatatacattataatgcaatcctgctgggcttttgactcaaggaaacggccatccttccctaatttgacttcgtttttaggatgtcagctggcagatgcagaagaagcgatgtatcagaatgtggatggccgtgtttcggaatgtcctcacacctaccaaaacaggcgacctttcagcagagagatggatttggggctactctctccgcaggctcaggtcgaagattcgtagaggaacaatttagttttaaggacttcatccctccacctatccctaacaggctgtagattaccaaaacaagattaatttcatcactaaaagaaaatctattatcaactgctgcttcaccagacttttctctagaagccgtctgcgtttactcttgttttcaaagggacttttgtaaaatcaaatcatcctgtcacaaggcaggaggagctgataatgaactttattggagcattgatctgcatccaaggccttctcaggccggcttgagtgaattgtgtacctgaagtacagtatattcttgtaaatacataaaacaaaagcattttgctaaggagaagctaatatgattttttaagtctatgttttaaaataatatgtaaatttttcagctatttagtgatatattttatgggtgggaataaaatttctactacag

SEQ ID NO: 1150 - DNA, 2982 bp, Homo sapiens
atgccggcgttggcgcgcgacgcgggcaccgtgccgctgctcgttgttttttctgcaatgatatttgggactattacaaatcaagatctgcctgtgatcaagtgtgttttaatcaatcataagaacaatgattcatcagtggggaagtcatcatcatatcccatggtatcagaatccccggaagacctcgggtgtgcgttgagaccccagagctcagggacagtgtacgaagctgccgctgtggaagtggatgtatctgcttccatcacactgcaagtgctggtcgatgccccagggaacatttcctgtctctgggtctttaagcacagctccctgaattgccagccacattttgatttacaaaacagaggagttgtttccatggtcattttgaaaatgacagaaacccaagctggagaatacctactttttattcagagtgaagctaccaattacacaatattgtttacagtgagtataagaaataccctgctttacacattaagaagaccttactttagaaaaatggaaaaccaggacgccctggtctgcatatctgagagcgttccagagccgatcgtggaatgggtgctttgcgattcacagggggaaagctgtaaagaagaaagtccagctgttgttaaaaaggaggaaaaagtgcttcatgaattatttgggacggacataaggtgctgtgccagaaatgaactgggcagggaatgcaccaggctgttcacaatagatctaaatcaaactcctcagaccacattgccacaattatttcttaaagtaggggaacccttatggataaggtgcaaagctgttcatgtgaaccatggattcgggctcacctgggaattagaaaacaaagcactcgaggagggcaactactttgagatgagtacctattcaacaaacagaactatgatacggattctgtttgcttttgtatcatcagtggcaagaaacgacaccggatactacacttgttcctcttcaaagcatcccagtcaatcagctttggttaccatcgtaggaaagggatttataaatgctaccaattcaagtgaagattatgaaattgaccaatatgaagagttttgtttttctgtcaggtttaaagcctacccacaaatcagatgtacgtggaccttctctcgaaaatcatttccttgtgagcaaaagggtcttgataacggatacagcatatccaagttttgcaatcataagcaccagccaggagaatatatattccatgcagaaaatgatgatgcccaatttaccaaaatgttcacgctgaatataagaaggaaacctcaagtgctcgcagaagcatcggcaagtcaggcgtcctgtttctcggatggatacccattaccatcttggacctggaagaagtgttcagacaagtctcccaactgcacagaagagatcacagaaggagtctggaatagaaaggctaacagaaaagtgtttggacagtgggtgtcgagcagtactctaaacatgagtgaagccataaaagggttcctggtcaagtgctgtgcatacaattcccttggcacatcttgtgagacgatccttttaaactctccaggccccttccctttcatccaagacaacatctcattctatgcaacaattggtgtttgtctcctcttcattgtcgttttaaccctgctaatttgtcacaagtacaaaaagcaatttaggtatgaaagccagctacagatggtacaggtgaccggctcctcagataatgagtacttctacgttgatttcagagaatatgaatatgatctcaaatgggagtttccaagagaaaatttagagtttgggaaggtactaggatcaggtgcttttggaaaagtgatgaacgcaacagcttatggaattagcaaaacaggagtctcaatccaggttgccgtcaaaatgctgaaagaaaaagcagacagctctgaaagagaggcactcatgtcagaactcaagatgatgacccagctgggaagccacgagaatattgtgaacctgctgggggcgtgcacactgtcaggaccaatttacttgatttttgaatactgttgctatggtgatcttctcaactatctaagaagtaaaagagaaaaatttcacaggacttggacagagattttcaaggaacacaatttcagtttttaccccactttccaatcacatccaaattccagcatgcctggttcaagagaagttcagatacacccggactcggatcaaatctcagggcttcatgggaattcatttcactctgaagatgaaattgaatatgaaaaccaaaaaaggctggaagaagaggaggacttgaatgtgcttacatttgaagatcttctttgctttgcatatcaagttgccaaaggaatggaatttctggaatttaagtcgtgtgttcacagagacctggccgccaggaacgtgcttgtcacccacgggaaagtggtgaagatatgtgactttggattggctcgagatatcatgagtgattccaactatgttgtcaggggcaatgcccgtctgcctgtaaaatggatggcccccgaaagcctgtttgaaggcatctacaccattaagagtgatgtctggtcatatggaatattactgtgggaaatcttctcacttggtgtgaatccttaccctggcattccggttgatgctaacttctacaaactgattcaaaatggatttaaaatggatcagccattttatgctacagaagaaatatacattataatgcaatcctgctgggcttttgactcaaggaaacggccatccttccctaatttgacttcgtttttaggatgtcagctggcagatgcagaagaagcgatgtatcagaatgtggatggccgtgtttcggaatgtcctcacacctaccaaaacaggcgacctttcagcagagagatggatttggggctactctctccgcaggctcaggtcgaagattcgtag

SEQ ID NO: 1151 - DNA, 49047 bp, Mus musculus
  misc_feature (8143)..(8162): "n" at positions 8143 thru 8162 can be any base
  misc_feature (12041)..(12681): "n" at positions 12041 thru 12681 can be any base
  misc_feature (36979)..(37681): "n" at positions 36979 thru 37681 can be any base
  misc_feature (37986)..(38287): "n" at positions 37986 thru 38287 can be any base
gatgctcagccctccagggcaggagagggctatactctaagtggagagataagctacacttgtccatttatagagtggtaggtaggtatattaacggtgtgttctctgaggaagtctccaggacctgagatgagggatgtgtgtggggtcagcatctctggggcagtgggagaagactggtcaggaggaatcacggtagagtatatcaacacaggcagttgttagagctctgtgatcattcagtgctatcacccatggcaacaacctctcccaaccattgattgggaattggtgtgggtttcccctaagggaagtcctgacagagatgtggaggcattttctctgagccatcagcctcctgtctgaggacctggggaggctttgtcagcatcctctatagaaggtcagtgtcttggtgatcactgtctatgctggagagaagagagagagggtctgaggctaaggggctggacgtgatcaggggatcttgtagtgatatcagtttctgtttactagccgttttacccccacttaagacagcgtaaactcccagagctacagttattcccattgtcttaggtcccccgataaaactcaggaaagaaaaccaaaaccatttaaaagatctcttcaagccacgcaggtcagacgctcaccaagtttagtctaactcgactaacatttttgttgttgttgttttgttttgttttgtttttttgagacagggtttctctgtgcatccctggctgtcctggaactcactctgtagaccaggttggtctcgaactcgaaatctgcctgcctctacctcctaagtgctgggatcaaaggcgtgtgccaccactttcctggcttcaacactttttttctttctttcttttttttttttactgtttttgttaacagttctattcggtctttcaattagttgtctaaagactgcaaaagtcacttttgaaattgcttctttctgacttgactccttagcccagcaagtttgtcctctaatccccactcttatggtttgcatctcagacccctgcttaaattttaccttctacttaattgcactgaaaacaagtaaagccttctcagagcaacttggttaaaatcgggtccagtcccacccacagacacctgcccccttcctccttcccacagcatgtacaccagccacctctagtggattatttaccgtctgttttttatctaataaatggtaagctctgagagggcagggaccagctgtttgagcctggaagaactggcttctggagggcacccgacagaactgtaggttgaactcatggctggactctctgcttccattagctccactctggccattggcaacaatgtctagctggaatcacagctctgagtctccatcctaatcctctgggtagatcctgttaagccagcatgctcacctccagcgatagctgaaggtcaggacaaatgttaaagtgtttcctaatacagaccatctctatagatgtccacgattactaatatctcagcgtattgttgacttctcagtgaaagggtatgtgctctgaaagctgtgaccagaactgagtgagattttccaggttatgggtagtggcacaggctggtcgactccatgtgtagaagccacctgaggacagccacctgaagagcgtgagtggctgagagttcaagagcttgtaatgttcacctgccatatctactgctctctgacccggtactcacggcttatcagcaatccagaaggagagggtatttagcgggttgcctcaagagtttactgagcaaaagagaggctggaaaagatttcagagatagtggggagtggtggtgaataaccctgtcttaggattttggaaatgttactaagtggaattaaatagtcccggaagtgaagacagagatgcagaccaggcattggggctcccacttgtaacttccacactcaagagatagaggcagaaagacagagcgttcaaagtcatcctgagatcaaggcagtgcagcctggctacaggagaccctacttcaagaagaaaagcaaagagcaagaaggggaatgggctagagatacaaatgcaatagaagccaggaatggcagggctggagggctctgcaggctaccaggggccatggatgagaagcctttcttccagccagcgaccaacaagcagttcagcctgtggtctggggctgccatcccacttgagactctgttcccattcccgtctggtcatagttcacatctcacaactatcatcttctcattggttccctctctcttctctgattcacccttgcctagttggttttcaggaggtgccatattgctcagtgggtctccatgcaaactcatatcaacggctcccacgcctgcaaacaaaaccccagctctcctatctacacctttcctgtgggcaactgcctgtccctcctcacacccacaggggatgctcaggatgtagcctgctcattttgtgttcctctggagtttaataaatatggttggatgaaaactagaggccaccagtaccatgatatgtccatcgactcccttgtcctgtcctgtctcacttggtagataacaaaataaagtggaaatacagaatgttcttgtattaggcactcagatgataactattactgtgggtggcttctcaatgacaagaaactttgagaaactctatagttttccccagtggggcagttccagaagacacctgctgtgaagagccaagaacagctgtgcaggcaatagaggaagctggcactcactcagtaaaaaaaccaaaccaaaacaagaccctgcctgcagttggatggcaaagttcccagatgggcagcttgacataaagaggcgctgtgaggtgtttgatataaaagaagataaaaccgccggaaacagacatctcctctcctaaactgactccctcaatgtgtgcaaagaacaacccggctcagggtaaaaatagtgtttgtggatgaagggggatgtgtttgtccacccagggaaagactgcagctggccagcctctttcctgcacagtggagggtttgaaggacagtcagatgggtgaccaaggagaggagagcagggtggagatacagatgtggatccatattaaacccagaggagaagcaaccgctcaggaatggcagaatggtggccagatgtggcctttgtctcctcatccctgtgacatcatatccaggcaggagcaccagtcatgccagctagcaccttggagtggcagggtgggagggcagggagaatggtgagtggtgcccaagcaggccaggcaggcagaggaagttttgtcttaggaggccgtgaaggtcagtactctgttggaagctgaggagtccaccggtgacagaaattgcccaggcagacacacccaaaaagtgtcaagtggctcaggcttgtctagtccggggtcatgatactccttactaagtcaatagattgtctaagtactgtgcaaaacagcaaacagaacagggccgagccgggctccagactcaacaaaccaagcaggattctttattgcagggccccatgaggtgttggacattttaatactcgttgcatagagtttgtctgatccctctgacctaactcattacagaatcatcatcatcatcaactttatcagcagtcatcaacagagtctcactgtataatccaggctggcctcaaactcatgaccctgctgcctcaatttccccgtttctgggatctcaagtgtgctccaccatacccagcactgaagactgtcttgtttggcttggagcatctccctgagaccctgggctccttgcagatctcttcaccagatctctttaccctccctaggatgcagagtctaccttgagtggcactggcagaaatattggtgaagtgcaaagagacacagggacgtgaagggggaacaaagagaagtcacagcctttcagttaacagtattgtcctgagaaagcactgcatgccaatattcctgtatttagtcttcataaacactcacaagacagaaaccactagaacctcactgtgcatattagggaactgaggcacaggaatgtctggcaacacacctgtgggtatgtctgtctgtagctcataatgctgtgtgttatgggcaagacagaaagatggtcggggcaggaagggccaccagaaaaacctgggaaaaccctccatcactttgttcacagggctcccaccagatcaagtttggaagtattagttgatgtggttcagggagaccagacctccttgtgtgttcacatcaacaactgagaactctagcctgagcacagcagtgggtgttgcttccactcaggtggggagagggtggtcctggggcctccctattccctttcctggcatcacgcacattccccatcatccccttgacatcagccagcatataatcctgacatgtcaggaacatgtattctcccacatcccacatgctctcctgtggccctgccatagagaggtagactcttgaggctactctaaccaataggcaatgaacaacagcaatgtgtattacttggcattgagtgtgggtactaggtaatcctgctgtgatctctgtccgactgcagcagtggctgagacggtccagatgtggcaggtacaaacatgtcaagcttccatttggcctggatttagagtagagcagaaccctccaacaagtagcatgaaggaaaaaaatagactttgatttgtttagccaacacaaaggatttggaactaattggccattgactggaccaaggagccacttaacacctgatgcaattagcaccagaaaattatggtatagaaggaagaaattaactcctgccgctatcaggaatgccaatggaaataacaaaacaattgacttttgtatagtgtttcatagtgtgtgtgtgtgtgtgtgtgtgtgtgtgtgtgtgtgtgtgtattcagaggacaacctaggatgccacccacttgttttgagacaatgtctctcactctaattaggcgaggctggctgggcaataaaccctagtaatctgcctgtccctgtcaccctagcactggattacaagttcatgctgtcacaaccagcttttaatacgaataccatgggatcaaactcacatccttcatgcttgggtggctaacactttaccaactgagatagctccccagacccatgtttcacaatgttcaaggtacttgataaacagagtttaattaattccaaaagtgaccaccatgcttccatgattctgagcagttttccacctcctttcattaagccgtgactgtgtagtccattttcagctgttagagcaaaccatctgaaactgggtaatttataagacttattttggctaaccgttctgcaggctgggatgtcactgaacatagataaggttgcattcttcttcccatggtgggaacagaaaggcaagaggggtgtgtgtggcagggatgaataatgaagggtggctttatgtttcaacaaccctgcatccaacctgtgacaaaggcactaatcctttttgatgtctagttgcccctccaggtccacctcccaacaatgctccaatggcaataaagttcccatataggtttcgagggtaaaaactattttcaaatcatagtacaaaggcttcaggctacatgatgctattgtgaaggaccccgagagtcagaaaactgggattggaagccccagacttcatctccagagttggttagggtgagattcctaaacggttctaactccaacccctgctttccccaccatcagggctctggatcagtagagtattgcctgacagtcaggcaggacctcacacaggatgaagcagagacatgtccaccctttattcagctcacttaaaataatctcaccacctttgagtcaccaagatgtaaacacaagagaaaaaaattaaaagtaatttactgttgtggctaaaatacaattcctgtctattgtaggagtctgttaaacaacagccaaacatagtgtgtagtacaagttgctccaagaggtggcgttgggaaaggccttgtaagttgctgggttagatcagcctgggaagcatgcttgactccatctcaaagaaaaataaataaggaaaggagaggaaggaaagaaataagtctgtaaaagaaaaatgcacaaagacaaagctaaaagtcctgcctaaaccccctgagtggcaggattctctgttctgatgtagggctggtcatatgcctccttgctcctctctatgagaattggtcaccacgtattatgagctggttttgtaattattagattgtggacatttacacatgccattaactagtttatggcatgacttacctgttaccctttatccaacagctggctagtagacagctcgtgttgtttctaaactctatgtacagatcaggccatgatgagctgcctggtatgtgcgtcttcctgagtctctcttcagatggagtatgcctctagtggtgtggctaatgccctgcgtgtacctctgctctcattgtattaaagattcagttgggtgtttcatacaagagagaatttaccatagaagacttcttttttatttgtttggtttttttgtttgtttgtttttttgagacagggtttctctgtgtagccctggctgtcctggaactcactttgtagaccaggctggccttgaacttggaaatctgcctgcctctgcctcccgagtgctgggattaaaggcgtgcgccaccacacccggccatagaagacttctttaatgggcactggaaatctaggaatcagaaaaggacactgagtcagctcagactgactgtagaaaacacgtcccactcttgggtgcagcagtagttaacactggtcaatgtgatacttggataacttaacaattttataaactatagatctgattttagattgagctaagttgaccctctgaacaaaataaaagttactattgactcttacttaaggttctcctctgtgtcacgccttctgtacgggggtgaaatgggctatctcagttcttgatttagatgtggggaaaacaggcttaaggaagtgaagcaactacgcaaggtcacagcctcccagctgtgcagatgggagctcgtgcatccctggctgcatcctctgtctgtgtgctattctctgttcctattgctgcttctgtggtctcacattgctgtgcagatagaagcttgtgcatctatggcggcatcctctgtctgtgtgctattctctgtccccgttgctgcttctgtggactcacgttactatggggatgataccaccccggggcctagctagaggactgccttgttcatgctgtcagaccacttggaggctaagactaattctatcatgtagctgtctgaaaccaagcatctaacagggggccaaagtgtgtgtggggggaggcttgtccccactcattggtctctatcaagcaaacattgcaccctagtctcagagagctgcacaaaaggcccctccagatgattaagttccttctgctacatgtccgtgaacaccgtcaaggtctctaccacacagggagcccactctgcacttttgacaggtgtagatacttgcagagagccaaagtctgttcactacagctctctgtcattcttgcatgaaacagccttgtggatgcccgatggcagctgtcatagcaccctcctttggcagtgctgaggtgctcatgcgttcatacgctcttgaaggcagtaaaagtcccaaatgctgtggtggaatacatgagaagggtccatatttattactgggtaaggaggcatgacagaaggaggctgtttggtatgtgtatgtgtgtaaatacatgtgtgtgtgtgtacacatatatatttgtttttgctttttgttttttgttttttttttgttttttttttttttttgttttgttttttgaggcagggtttctctgtgtagccctggctgccctggaactgactctatagaccaggctgaccttgaactcacagagatcttcctacctctgcctcctaagtgctgggattaaaggcattgtactaccagtctggttaagagcatacatttttaattttgattttttagtttatgtnnnnnnnnnnnnnnnnnnnnctccttgtgggtgagcctcaccacccattgaatgttctctcagacaggccctgacacagaagcaccagctcttaggagtaactgaaagtttcctgctagtaacctttgttagacccagttctacccacaatagtttacataaaaatgaagcaacaaaggaacccccgggagaccgtttgctttgaagcacaaatgtaaacggtctggtttcagcaccctcagattgctttctgtgcagaaaagggctaaacaatcactgcctgggtcactggcaaggtgacattcctggaattactccttagactgtaggagacgccaggcacaaccgctgttatttgggagaatgttcttgtaaaccctttcttcctctctgactgcacagccttctctcaagctcatgaccacagctgtgtgggcatctccagatgacacgagggagctggtcctcccatagcacttatctgtgatccactgtggttaactgacattttgtagagttctttccctctccctgtaggtgaaccatcagcccccccccccccgtattatatgggtatctagctggcagtatggtcttataagaattcagtcagcaaaggttttgaggtcttgcctaggtcctgtagtaggtgttccagaagtgagacctactaagtaatattaactaaagatgaaattttcattttgcacagggctgtgaaaatgtccctaactccatgcccatgactcttctccaaaactcatctcgtctcagagacctatgttagttatgtagcgaccactctctggaaacttagtgcactgaaaaaatagaaaccaaaaacaaactaagttgcatcacggttgaagtctgaagaactgcattcatgatctcatttgccccatactctgtgatctgcagtgtctgaaccttagctttctataaaatgtgctcacacactggagcctgtggtcctgtgcccactgcaaaacgatagtaactaaagcagcagagtagacagagccaggaaaatcacagttatgggcttgttgggaaaaaagtgaccatggggccaggagagatagctcagtgattaggagcactaactgctcttccagcaggccagagttcaagtctcagcaaccatgtggcagcttacaactgtctgcaattccagttccagggaatctgacaccttccaacaccaatgcacataaaataaaaaaaaattaaaaaaaaaaaagcaaccagcagagtgagaaattcaggtggcattcacgtgaaatcacaacagctgtatgtaacacatctgtgccaattacagacatccagtgtaccataacgtaggtccgagagaaagaatagaagtgagctagagtaaagcaggaatcaatgaataaagtcagcaggagcagttagatgactaagtggtgatgatagaagcttgctaccaagactgacaacccacgtttgattcctgggacctacaacggtggagggggaaagatgcctctgactgccacactgatgtcatggcatgcacacacatgcccccttgcgcagtaagcaaatgtaatacattttttaaaaaatggcttttaaaatgcaacctaaagggtttgaacatgtctaaagataaataacagtactcaaccagtggcgaggtccccctttcttcataagtttattctgaggtactgccgagatcaagtgtatgaaaacccaagttcactgttctttctgtcaagagctccattttgggagaaaggacctgatcagagtgagacattccttcagcaggaagttgtcaccagggtggtacctatgggtctgctggtgagaggacatcagagccctcattctggagacaccacctgatggcacagacagagctagactgtctgcttccatggatccactgcaagcagtccacctgggtcctcggaagaaaagacccaggcagctgggcaccccagtggcttccacgccttatgacatccgatttcgagacttggtcctcttcattttggaaaagaagatgggaacaactcgaagagccttcctcatggagctggcccgaaggaaagggttcagggtggaaaatgagctcaggtaggacagccctggtcactttgcaagcatgcaagagccctgaggacatccccaagggacccaaggggccagttggctaagggagatgagtggggactaaatgagattatatagaaactaattggtaccaaaaaataatattttttaaaaaaaatatggctttccatgactgactctgagattaagtatccaggagtgataaccagaaaactagtcagagaaccacatagaaaccactcgattccattctgtaccaaactgaaccaacaccattgggttcaattttttacattgctactttggagcagggagggtgttctgattgtctggctctgacttatacacacctgctctgctaagggtctatggtgggctaggctgaggtgagtcaccacgggtaccttaatggccttggtgatggttttccaaagggtggtccaagtgggcttcaggaagagatgctggttaaagatgtttgtctaggggtgacagatggcaccccagtgtgctatgatcagagtctaggcagggaggtgattgaagctaccatctgcactcgttcagtaagcaccaattatcattgttttgctgactattgtgtacgttcactctcttgacccaatgaaaagaatcaaagcgattcagaaagtcccagtaaaaggccctggtgtgcctgacggctgcagacagaagtgttggggttacagtgggagtggggggggcactcagttcactgccttcagccatgcaagttgggaggggtgctgaacataccgtgtcagagatgatctgacttttacacttgggattttggaaagtctttgaatttaaaagaaaattgccaaacgtttcttgctgatgaaatgctggctttggagacattgaggagacacatttccaaggtcagtactcaggaatttcacactccacatgcccagctgaggggatctttttagattttttgctaaaatgtccccaatcaaaaattcctgaggttctgggcttctctcttttctgagtctttgtcacatggtctcctattttttgttttaagtcatcacagccactctcaacttcattccttgatgttcttttcacacaatccattatttcaactcgtttttgagtataactaatctgttagccttatgtacagtgttagctttaaaagaaaaagagattagataggtaaagggggagggataaaacagaaaaaacatcttcaaagagaaagttaaaaacagaaatcaaaagttttagcagctaccaagatgcttttcatggtaaaggaactgaacagggaccagtcaggaaagggagagccatcaggcagggtgccactcactcagaaagctctctgataaaaggtccatacatctgttggaggcccatggactgagtcaccaatggagcaaatgagccgaggcaagtgtcaggggtgatgatgatcacgaagcaagtatctttgctggagaggtgaatcagagtggtgccccagatgccagcagccagagctatgcctgctgctggggagacaggaaatgggtgagcaagccgctgctgtgctcaggatggagcaaagttctcaggcggagagcacagacactttcaacgtgtgtgtgtgtgtgtgtgtgtgtgcgcgcgtgctgtagaggaagatgaatcacaggaagcagaagccccgacgataacagaatttctgtgcccagataaagagtcattaattactgtagggagaacctttaggcttcatctcctggtgctggccctttccagaccagcagttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatttaacccttggaaccccagtaaaggaggaaggaaaccagctctacagaggtgatttctgacctgcacatgtgcaccatgtcatatgctaatgtgcatatacaatcattgtaattactgctagtgatgattaattaaaaggaaaaatgtcaatggtactgattaacagtaatggctacacttctttcttaacttgtaaaattcaaaggcaaagagaatgctaagctctggaacaggctaatgtccacatctcctgtatacttttggctgccaagaggctcagtcttggctcctaccttccctgagatcctctatgtactgagttctctggattgagtctgttctctccaacatgaatgtgtcactttgagtggaatattcagctattctatgtgccaatagaaagctggttcctaaaacatgaaagagaagagatgctaagttccttgagtagttctgaacatcgaagaacaggatattgaatttattctgtcaccagcatcctagactttagagcaggttgctaacttcagctcacctaatacaggctcaacaagggaaccaaaatctcctgttttccatgccctgattgcatcctgagttcccatagagtgagatacttgaaagctctcatctgtcatctccccttctctataaatacttctgctaccttcccctgtgtcttgaagcaaatcactgtagtcaaggcagaagaatatgtagctcggaaggatggcgttccatctttctaaccatccaggcgcttcatgctagcttgctaacaatgctcaggttgttgtaaacacatcagaggacagcattgtcctgcaatggaagatgctgtcttagctgaaagcatcacaaaagcctttgagtgcctgctctgtgcagtatgtgtggagctctggaaaaacagaagaagacatgagccttgcaagcaaagagcttgctatgataaggaaatcatgaattgtatcttgaattgtgctattatcttaattacttttctttcttttaaaaaaatatttacttttatcttcgtgtatcaattaatgatctgcctgcaggtacgtttatatgtatatatgcatgtatgtatgtgcatatgtatgtatgtgtgtacatatgtatgtatgtgtaccacatgggtacagcgccttcagatagcagaagagggtgttggatggtctggaaccgggtttacagatggttgtgagtcatgtcacacaccatctctaggaatcgaacctggatcctctgcaagagcaggatgttctcttaaccacggaaccaactctccagcccctcggattctcttcttgctccaataaagtacactggcaaaagcaaattaaggaagacagggattagagctcacagtttacagtccatcatatcaaggaagtcacagcagcaggagcttgggagagctggtcacctcacacaggtgaccaggtacagagagcagtaaatgcctcgcgtgctgacatgtgactgtagacagactgtgatcaaaaactagctttagcctcctcaacaactcattcctttcggacagcttgtaacaggtgtgtgttggctagtctggctgcctctgccccccaccccccatctgttcactgtttgacctgttcacagtgcgactttcactggaaagtcattatctcagagcatttgccttcaaagcccacgggggaccttgtggtaataaaacccacattttctatttcaaaaattatgagcttcaagttaatgcaaagttttataataccattaaaggttgttaaagaatcaggcaagatcctgaccaaggctggaagagaaagctgtctcttttgaatgctgctgtgtgtagattagaaccaacctcagctgccttgctctcaagggttctaaaacacattggttgctcagagaactgacagagctgtggttggggtgggttgagccagcttctttaagcagctcagtttaagtataaatatggctaatgtcattgttttcaaaatacccaacatgacctctcccaggtgacaagaccatccatgagagagataacactcacactggaaagggtggtgggtaacgatggctgcctctcttattcatagaaggcatctttaattatatgcagtgaggcactgccagccaggaagagaaggcatgaacaggcagagtggtatataagaaagatgagaaaagccaggagtggtggtgcacacctttaatcccagcacttgggaggcagagacaggtgaacttctgagttcgaggccagcctggtctacagagtgagttccaggacagccaaggctatacagagaaaccctgtctcaaaaaaaaaaaatgagaaaaatactcagagctaagatttgtgagttaatcccataatacatagtttccgaacacctggagccctacctgacaatcctagcaatattttgaacattacatgaaattatacttgtcatatatattctacttaacatataataactgcatatacctaggggggatagaataataattgaatatgcatatatagcatgtaaggatcaaagtgactctgtctctttatagctctatcattatagccacctgtcgtagtcagggtttctattttctacaaacatcaggaccaagaagcaagttggggaggaaagggtttattcagcttacccttccacattgctgttcatcaccaaagaaagtcaggactggaactcaagcaggtcaggaagcaggagctgatgcagaggccatggagggatgttacttactggcttgctcagcttgctctcttatagaacccaagaccaccaggccagggatagcaccacccacaaggatcccttcccctcattgatcactaattgataaaatgccttacagctggatctcatggaggcatttcctcaaggaaggctcctttctctgtgataactccagcttgtgtcaagttgacacacaaaaccagcacacacacctccttcctaggtctccatgatataaacaaagggctattgtgacctctgtgtgtgtgtgtttcaggagggtgaacattacaacttatttcttttaaatgtatgttggttgcccacctcatatggctgatgtgaagactaagttttatacacatcccccacacacatatcccacacatggtagtgtgtcatatttgcaagtggtgtagcatctttacagcatgtctttcatgcacccatatttttgttgtttgttgcatcccaggagctcctccatccctgagcatccccagagcctatgtcagagcataggcagggctttacctagaggcagacttagagaaggagatgcagggcaaagccaggcagtgagaatgtgtgggggaggcagcactgcttgcaagatggacctcaggcttctgcactcatcctggaggggggcagcaaaacccagagagcccagagcagttggtggcctccctgcagatcttccgccttggagtgcatctatagcatctatttttagattcaggatagctctaacttcctgcagtcttgtagtccagacattcaacataaaataggaagacaaaaattatacccaagggggcttcctgggcagatatgttacagagagtttcttcattcatatctctgccccttggagggacggtttgcctttaagtatggcgcccgttcagataacccttctgtgaggagggtggaagggagctgactgaacagggaactcctctgctctggaacaagcactgagtcacagattgcaaactcatggctactcaagctcatgggctttgggttagaacagatctgtgatcaaatttccaccatgcagttattagcagggaagggttttaatgtctcccagggctatctcctcattgctatgtgggtctgataatccctgtctcacagcattactaataattaaatgtatgacatgtacatttaatgtatttaatatttaatactagtacctggtataaggcagtgcttccatactcttgatattttcaatactgaagaaacacctggagccgagttcccaaatccacatgtccccggggacagataattgtcactgtgcatcgataaggaactgtcagtggacagcagtggaggaagcaagttgccctgtgatactgtctggtgaggctcaggattgaacatgaagtgtttagtccaagagaatcatctgcaggaggccagtgacagccacaaaccagaagaaacaatgccagctctgattagacaacagggagacaggatcgagtagactcagtacgagagatgagaacagagataggaccaggatggacgtagcctctaaattctcgtcttttaaattatttgtagctaaggaccagtttaacaaaaaataaaatcatatttatcagtgctttaatctaaccatccatgataaagctggtttggcaatgtcaagtggaggagagtgggtctcattttggacactccttttactgataactttgccttccatctctagtgattcggtcacccacattgtggcagagaacaactcagggtcagacgtcctggagtggctccagctgcagaacatcaaagccagctccgagttcgaactcttggacatctcctggctcatcgaatgcatgggagctgggaagccagtggagatgatggggagacatcagcttgttgtaagtgtctcctttgctgggtggccactggcatgggcatcagaatccacagacttgggtcgattacagtcttttctcacggagttcacttagctctggtggacctccatttcatcctctttatataacaataatgcccacctcctgagatgctgtggaaatcgaagtaacatgcatacatggtgcacactgctgacatattaatagatgggactattttctttaaaaaaaaagaatttttagtgtgtgtgtgtgtgtgtgtgtgtgtgtgtgtgtgtgtgtatgtgtgtgcacatgcgtgcaggtgtccacagaggccagaagagagcaatagatctcctggagcaggttgtgagccactcaggtgtttggcaggagtagcactcagtcttcaccactgacccatctctccagccccacaacaagagctatttttatgaacacattcacacaccgatatttcagaatctcagcctggaaactcagaaaagtaaagagtttctttttttttccccattctgataattcatgaaaaaaaaaagaaagaaagaatatgacttcttaaatctaaatcttttaccaataatgctagagtctctgggaaaggggtctggatcatctgtaataaaggaaacaaaggaaataaaatttaatagctggttctttaaaaaaatttttattggttattttatttattgacatttcaaatgttatccccctttccagtttccccttcacaagccccttgttctctccccactaccctacctgcccacccactcctgcctcagtgccttagcattatcccaccctgggtcattgagcctccacaggaccaagaggcttccctcccattgatgcccaataaggccatcctctgctccatttgcagctggaggccatgggttccctccatgtgtactctttggttggtggtttagtccctgggagctttagggggggttggttggttgatattgccgttcttcctatggggtgcaaatcccttcagttccttcagacctttccctaacttccccattggggtccccgtgctcagtccgttgtttggctgcatgcatctgtatctgtattggtcaggctctggcagagcctctcaggggacagttttaacatgcttctgtcagcaagcacttcttgacatcagcaataatgtctgagtttggtgtctgtagatgggatggattcccaggtggggcagtctctggatggcctttccttcagtctcatttttgtgatttcaaaaatatatatcctgcacagacttaagatgtcacaatgaaattcattatctggtgtaattaatatgtactaataagaagaacaatcatacacgcctgtgactatacactagacaggtatgcaacacatttttgagtcctctatgattttgtcctctttcagagacaatcgtcatgaattgtcttaaacgttttctttatatttgagtaaatgtttatagttatatgtacacttactattggctaattaactgtcattcaaaatggatgcttatgctttcgtgtaggtgaatagaaactcctccccgagtcctgtcccaggctcccagaatgttccagcacctgctgtgaagaagatctcccaatatgcttgccagcgaagaaccacattaaacaattacaaccaactattcacggtaacgaggttttctcaaaacccagggcaaaaggggggcttgaggtttctttccctgagtcgacaagttaaattatgattttctggagatctcagaatgcttctccatgcttacccacctaacctgacctctggttcttcgtcaagtgggcctccttgttcatagactcccagctactcaggggtcagggttcatcagagtaaacacactcaggagagtgtcaagcatgggacttctcgtctctaactttcgagctgcatctgtgaggaagagccggaaacggatggcagccactgaacccactgaagcacagctgcgttctctgctaggaaggcaacatgcctcaccttaaataaccccggctctgggtctgagtgatgaacacagccttcatcccacaaacaccagctgtgttttctgaccacactaagagacctgaaagtctcaggagtgtgacagaaccctggctaaagactggtccagaagataggaaagggttatacccaacccagtcatgactgctgggacaccatggatcccaggtcactacttgattaaactgtttctaaatgtctaatgattgaactcagtttcctcataaatgcattagatacatatcttttcagttcagtgacagagtcccacaggggaggatgcaaaggtacaggagcttgatcctgactccaaaggcgctccattagtaaaggggacaggagggacttgcaagtgactcccacgagcagacctgctgacctggttttattgttttaggatgcccttgatatcctggctgaaaatgatgagcttagagagaatgaaggttcttgcctggcattcatgcgagcatcctctgtactgaaatctctgccattccccatcaccagcatgaaagacacagaggggattccttgcctaggggacaaggtgaagagtatcatagaggtaagggagaagtggaatttgctacatctccaaagaggtgaacgggagacagaacagatcgcataagtatgggctctctcctctatttatctataaatggatcaatatagcaagaaacagatatatgggtgtagacatataaaatccatacccaacacgatcccagtaggaagactttctcgggcagtgacttttactagcagcgaaagactcgatcgagccttagatctccagagcagcagaatattctgctttccaccccagtctgggtgggagactcggtctccctcagcgcttcctgtacagcacagggtgatgttcaatgggctgattgtgcatctctctgttctcaggagagactgggcagtagttacatgcttagcaacatttaaggacttcccaacgaggcacgggtgtcatctagtagcaagtttcaatctaaccaaatgcaaggtacatccttctagaaaaatatcggagctccagacaacagagaccagacctcataaggacttgataatggccagcttttcagtgggccaacaattaacccggtggtttaaaaagccctcttatttccacaactcgaatcaactgaaaagaaaatgaccagggtgatttgaacaatgcttgtcagagaatattttgtcttagagtctctaggttcagatctttatctttctgtatcctcgtcagaggttatgaaggtctaggatctatggtaaaccaagattttttttcaagattacaaggaaattcttgctttctccagatcagccagggaaaaaaccctcaagtttcaggagaaaccagtagttgggtcttgcgcgcgctcgactggccaggaagaacgacgctgcaacaggatccttctgcacacgtttattgggagagcttgattgtagaggcgaaaagacttcgagcccagaactggtgctgcttttataggcctaggaggggcgtgtctcacacccggattggttatgcactaagcctcatttgcatgttcctcatctgattggctactctctctcagtaccttacagaacctcattatcatacctcatttgcatgtctcacatctgattggttatactctcagtaccttacagaacctcattatcatgcctgggccaggcagtgtctttgcaaaaaactttactgcatatgtacacattggttgtttgtccaatcttatgcgtggtggccagcagtagtcagtgccactctgcaacggcacatgtggcttcccacagttggggctgggctgtcggtttgagactggcactttgattatgcagagacataactcaaaatcttttgttcaaccctccttgcagggaattattgaagatggagaaagttctgaagctaaagctgtgttaaatgatgagcgatataaatccttcaaagtaagcgactgtacatttggatactggggcgtgttttgttttatttatcctgttgtttgctgtcgatggttatataactcaggctgctataccaaatgccacagagtgaactgattagtcatagaaatttattttctctcagttctggaagcagaaagtttaggttaagtttcagtgtaaagattctgtggaggactttgtggttttcagtggccagccaccctcttgctgctgccctgacatagcagagatagagatggacaaatgctcattctcagctagctttctttattcttacattattgtgtgaagcacgactccttgcttagggaatggcaccttccacagtgggcatcctacattaattaacagacatgcccacaggccaaggtagtatggataattcctcattaagactcctttcccgggagattctaaattgtgttaaaaattaaactaaccagcacatcccacaaagacactacatgccaagacttacctatcacactgagactacctaccaagaatctgtcactcatggttacaaatgtcaaagggacacaggattcaaatagagcaagtgtggtcctgaagcacaaactctgtctgaaaattcctcattgcacctcaatttctgggacttagggttgaccaccctccaatttgtttttgtttttgtttttttaccttaaagtttatggtactatggccagtccattcagttcataagtgatacagggcctaacatacggccagaacaggagctaggctcagagtacagacagaccagggttgaagtttgtactttgctgttatccacttgtagatggggtgaatttgctgaggatctttgagcaagatttacctcatgagtctccttccaccaaaggtgtggttcaggacttcatgtaaaagactgcaaaatctgaagacagacagacagacagatagacagcttctcatacagacacagaacaggcttcttcttacaccgatgcccagccatctttcacctgtttcgttttgtgacactttgattatggaaggatccttcagaaacaaaaagcctctcaacgttaccatccccaggctcaagagagaactccctaaagtgcagagagactgagcaagagtcccagaaccaacaaaaaagctgggtgtggtagcgcaccttttaaacctaagcactgaagagttagagagaagcagagtggccctaaggctcactggccaatcgtcccagcctgaggttgacttctggtttccaaatgcacagttatgcatgtctgtgcaagtacatacatgcgcgcgcacacacacacacacacacacacacacacacacacacacacactcactcactccccatccccttgatgttttcaagagaaactgggccaaaggtttacttatacttcttgttcctggcctgagactttggaaagtgtcgctctgttgtcatagcaacgatttgggtggataacagcctacctttccctccctttcagctctttacctctgtgtttggtgtgggactgaagacagctgagaaatggttcaggatgggtttcagaactctcagcaaaatacaatcagacaaaagcctgaggtttacacaaatgcagaaagcaggtaacggtcttggggaagtcacgggtcattctgggcttgtcagggtccagtgacatggaagccagtttgacttgctccagacttgagactccggtaaatcttggctccagcacttgtcactgagtgatcttgagtaagctagttaaaaccttgagccttcgttgcctcactggtgaacctgagctaaccagggactagatcagcttgcgcaaagccctgagaatatgagaacaaggcctcttcctggggtgctatggttctctttatccagaagttacagcagagtgggcactgtcccgattcctacagacacaccttaggtctggctgtctccctgtgtaagaagcatgcatgaagggtcgaggacagaagggtaagctgacgtgcaagaaggacagaggggagtactgaacaaagtacactctcgacggcttggttcacactgggaatgtgcgctgggggctggaaaacggaagagaaaggggagaaagtctagccacagccttgatctgtccaatcagagccctaagcctaggaagagacaagagtccagagcagagacggaagagctctcattatcatctgaacgtctggcaagccccgcggccaccacgtaggccagttcactgccttccatggacagtgctggtaccttttccagaaatgaggagatgcgattcatagccccttctaaacgtgtgaaaattttttaaagaattatttatttatgtatatgagtacacactgtagctatacagatagttgtgaacctttatctggttgttcggaattgaatttagtacctctgctccctcaggtcatccgggtggtccaccatatggttgctgagatttgaattcaggacctttgaaagcacagccagtcctcttacccactgagccacctcaccaggccaacatgtgaaatttttaaatgtttccttttaatgtacaataaaaatagagtaaaattgtccttcaagagggagtcactgctatagttccctagcttctggggaaatatgtgaagttatcaagtttttttaatatggaagtgatagagtcttctaccagaggattctgggtatgcgcaattattcaacagctatcttctgtttaagtgataatagaaagacagacagacagaatgaacaaaaatgatatcataagaagtggtagatgaggtgaatcatatcttgggggggtcccatcaatgacactatagaaagcccctattaatcttataagcccactaagttctttataaaaacatttttatttatttttagtttatgtatatgggtgttgtctgtatgtttgtgtatgtaccacatttgtccagtgtccaaggaggccagaagagggtataagctcccttggaactgaagttacagatggttgtgtgttgctgttggtgctgggaatcaaacctgggccctctggaagaggagctagtactcctagctactgagtcatttctcaagtttgatgatttctgagtgactattaataagctttatataatgccacacaggaaataaaagagtctaagaaaaaaacatctaatatttctactctggatgccagaaagtgtagtctagtaagggtgttttacaccagctctagagatgctgttaaagagaaatgtatatgactatcaaacctaagggcatggagatggtttggaacaatagtgaggactcctaacacttacagcagaagtggggaacagtggaatattttctcagaaagccttgaacttgtgatgtcctgtttcagcatcttgagtgctaggaatgcaggttgaggtgttggctgacatccacacagtcttaaaaagtcataacctcacattcttgcacatcatctagtgagtgagcggagggatttcctggcaccacccgaggtgaacttaagtgccagtgatgatggcaatgtctatatatattagcacctaaaagaatgttgcttcttagatcaaacacacacacacacacacacacacacacacacacacacacacactcactcacagcagccatgtcccaatcaaaaggcaactgttgacaacagaacaagagaagtttatgtcgtgtcagttatcgatatgaagatggcagatcccccaaggaactggcttggtagtaacaagtgataggtggattagcatcaccatcttttcctggtcctgaaaacacagttctgcaactgtcccgtttagagattacagatgactttgaacttggtaactgtttacagtgtgctcaagccaaatgactttctggtcgtgtctcatcctggggtgagaaacaggagccaatcagcagcctctagagaagtacatccccctcctgtttatcgagtggcatttggatcccttaaatgaaagttcagcgtcttatatggaagcatgactgtcatcaggctctgactctcccagacatgcccagcttcccaccagtactttaccccaatccttggagataagcctccttctcgctctgcctccctcccactgctctgtggtgacagccaaatgctctgctctccctcgtgaccctgcttctgaacggtcattggttcatagtcctcaggccaggaagcagcacgtcagcccctcgaaggcactttacacttggctttggacactgacccacccctcttcctcccactgtcttttctaatgaagccatcactgccaagtcctgaattttcctacccccttttaaatagtatggcatagcttgttggtcaagaaggctggacacagtgctacatacatggaatctcagcacttgggaggtagaggaattaggagttcacagaatctgggcctttcctcaaaggagcagcagcagcagaaagaggaggaggagggggaagaggggaggaggaagaggaggaggaggaggaggcagtgttggattttcattataatatcagataggatcaatttagattccagaaggatctgaatacttcccccttgatatgaatattgtatacttctacatgaggaagtcaaaactcctttgaaaccatgaaaaaaacccaagcaagtgggcaaggcagtgccatagattactgggctctgtacagagtctggccaatgcctaagagcactgtatgagacagcatcctctcctatcaacagctggtcctcttatgtgtgcctttctctccactggctgatcaggattcctctactacgaagacctcgttagctgtgtgaacaggccagaagccgaggctgtcagcatgctagttaaggaggcggttgtgacatttcttccagatgccttggtcaccatgactggggggttccgcaggtaagtgatgtagctgttttagaacccctcttctacctgcctctgaaatggtgcaaaacgccttttctgacaacagaaccaacctcactctgtagctttggctcctgctgcctgtgtttcgtgtcagagtctcagatagcttgacaccccgcacacagagctgtttcttacctctgtgactttgctcaggtgaaactttctctacagttttgtgaatttggtactaatctgacttcacaattccttcagactcaatttagatgctgccacctccaggaagccctcctcgactccttatagctctattctgggctaggaactttcttctgtgcttcccaggtgcctactgcatcatgtgtgctttccccgtggagcttagttcccacggagaccagggtgtgagcctgaccactaagtagatgctcaagaaactggttgagtcaaagaaagctcaatgaacaagccttcagacatgaaatcttcagttggatacaaatgcctccatttcagaaagaggcttgtccctccacctctccttttgagatcttacctggtcacttgcatcaaagaggttttctgggctgggtctgtcacttagcagagtggctacttagtatggaggaaacctggctttgattcccagtatccagtaaatcaggtatggtgatgtagacctataatcccagcacttgggaagtacaggcaggaagataagaggtccagggtcaccctcagcttcaaaacgtgctcaaagccagtctgcatcatataagactccatccttaaaaaaaaaaaaaaaacaaaaaacaatgataaagagcaatctcttaagccataccatagttccaagaaggctaccttgtatggtgttaccaaagctcttggttggctgcctattgtcatacatgtttctctatgtatgtgatgcatatagaagtaatatttattacttgctttccatccatatacaacaacacacattctggatgaagttttttttttttctgtcacaaatttgttttgcaagaagtgagttgaacaaccaggaatagctggttttaaaatgttgtgagtattttgaactacaaacctcacacttgagacacaataacaaagagttttgttttgttgttttgtttttaaatgaaaggctaaaagtccaactgattttccttttgtgcttttttccccccaaactaggggtaagatgactggacatgacgtagactttctaattaccagcccagaagccacagaggatgaagagcagcagctcttgcataaagtgacagacttttggaagcagcaggtaaggaggccagatggcacctgccatttaaggctggcttagattgatttctgcttgtttcttttccgtgtgtgtgtgtgtgtgtgtgtgtgtgcttgtgtgtgtgtgaatgtgtgtgtgagtgtgtgtgtgtggtatgtatgttatgtttgatatgtatgtgtgtgtactgctgtgcgtgtgtatgatgtgtgtatgtgtgtgtgatgtgtttgttatgcatggtgtgtatgtgacacgcacatgtgtgcatatttttgcatatgtgtaggcacatgggtgcggacatgtggagcctgagtttgatgttgaaaatcatcttccgctacttctccaccttattcatggaggcaggctctctcaatcaaatccagagctcatcgatctggctagtcctactagccagtttgttctgggaatccctttgtctccaccttctgaggctggaattgcaggcaggctgtcatgcgtaccaagcatttgtatgggttctggggatctgaaccttggccccctgtgttgtaaagcaggcgctttaaccaccgagccatctccctagccccttgctaatcttaggtgttacatgatcagtgtacagtgactactattctcacttgtttgtaacacctcatcgcagcaccatgtggctggcatgagactgaccagctttgggtcctaggcaacactttacgggcatgcatcttgtttgaagaaggaagataaggagggcaagctgggccctgcagaggtcatggccaatggctcacactggatgaaatcaaacctgccacgtggcagccagtggttaatggtcaaagctgagttaagttaaccccacagccaaaaacctctggctctctagtcaagcaccatttcctagagagaccaagggctctttcctgggatcctacctgtctggctgaatggaggaggctggaccagagttttcctagtacagacagctttccccttcctgggctgagctcactgatgcaccagagagataagaccagataaagtgaaaactagaaggggctggagagatggctcagtggttaagatcactgactgctctaccagaggtcctgagttcaattcccagcaaccacgtggtggctcacaaccatctgtaatgggatctgatgccctcttactggtgtatctgacagctatagtgtactcacataaaataagtaaataaatctttgggctgtggtggcacacgcctttaatcccagcacttgggaggcagaggcaggagaatttctgagttcgaggccagcctgctctacagagtgagttccaggacagccctagctatacagagaaaccctgtcttgaaaaaacaaaaacaaaaaaaaacaaaaacaaactagaaatagccagcccccgagagccatgagatttataaatgaaagctagatttcagatgcagatccaaattcatctgtgagaccattccatgtccccccctgtcacccctcctgagaagtcaggagaaggtgcactggagaaccccttcagtgatagcaagataggcatgacaagagtcagaatacttttccaattctcgattctctgctccaggggttgggagtgggggacgttcggggggttgggtaggggagaataggggaagattaaagactcactgaaagaccaaagaatacctccccacccccaggcctgttgccaaggctggaaactcattgatgtttgtttttgtgccattgtcctatgctaagacatctgctggagttgagaggtgacagaggagccctctttgcatcgctagtttcaaggtagttttcctctggaccctgggtagagatagtcattagaagcccaggccctgcattcggagccaatagtaaaacaggcctaaatgagactttagaagtgctggtacaacctggggtggtgcttaacagttcatggcccattttctgtctgtgctaacccgggattcaatgaaagtctcggggattcaatagaaaatctctggtgtctgacaaatggtggctaagatcagcagcagcaggattgcttattgaattcagtttgagggccaagcactgggctgcaggggacccaggaaccagcaggccagttccttcccttccctcaagtaccgtgattcagtgtccctgctctgaatgacccatccccctgaagccctggacccatccccaataactcaattgtgaaatcagatgagttcttcccatctggctcccacttccacttgactcccttccctgccagcctaaccctgagcttcactttacagatggccgtgagcacagcttagtacagtgcataccggtgtactcacagtacacacacagcatgcccacaagatgcttaaatgtctgcgaagtaggttgaacagcctttagtgctttctcctatctaaatggtgtcctttggagacaacccctgggtcagaggtaggagaaaggaggtgaagagcttagaaatctcatctccagggaggttgtaattcccccaaacatttgttctgcctgaattccaagcagactgctggtagctcacctcaaaggaaggagagagacttcatgactcaggcttgcggtcaggcctggtaaatgggaccggggtacagggaccctaagtgcttcaggtggtctgtcacccctggagttcatggaacttctgggagtcaaaatgttgagtctacagagtaagactgtaagtcagaaccaaccatggtggctcacacttctcacctcagccattcaggaggcagaggcatgagttccattacaggatacctagaaccaaaaggagtttaaactggccatgaccttgggttctgaattcataggtttcactgacctcagataggaaaagatactttaagaagaaagaaagataggaaaaaagaaaggaaggaaggaaggaaggaaggaaggaaggaaggaagaaagaaagaaagaaagaaagaaagaaagaaagaaagaaagaaagaaaggaagaaagacccacacctatactacctatactgagcatccataggcacctcctatcgtcagtctctaaatactacactgtgacaacactgcatgcacttatatagtattaagtaattaatctaagagtgattgaaagtctgtggggatgtgtgtggctcatatataaacattcttaccactttgcaggaagaacgtgatcatctgttgctaccgtgatgactgctagacgactgagggataactatgggacaactgagggacaactgtgggataactgagggatgactgagggatgattgagggatgattgaaggatgactgagggatgactgagggatgactgagggatgactgagggatgattgaagaatgactgagggatgactgagggatgactgagggatgactgagggatgactgagggatgactgagggatgactgagggatgactgagggatgactgagggatggctgtgggatgactgagggatgattgagggatgactgagggatgactgagggatgactgtgggatgactgagggatgattgaaggatgactgagggatgactgagggatgactgtgggatgactgagggatgattgaaggatgactgagggatgacagggatgactgtgggatgactgagggatcactgtgggatgacagagggatgattgagggatgattgagggatgactgagggatgactgtgggatgacagagggatgattagggaatattgagggatgattaagggatgattgcaagatgactgagggatcactgagggatcactgaggaatgactgaaggattactgagggattactaatggatgactatggaatcactgagggatgactgaggaatcactgagggatgactgagagaatcactaaagttgatgactgagagatcactgaggaatgacagagggatcattgaggaatcactgaggaatcattgaggggggaactacaggatcactgagggatgactgactgaagaataattaaggaatattgagagatgattaagggataattgaaagatgactgagggatcactgagggatcactgagggatcaatgagggatcactgaggaataactataggatcactgaggaatgactgaggactctctgagggatgactgagagatgacttcccccacttgagtttgaatactagattggttcctctgaggagaagatgggaaggaactgaaaacaaaggtcaagaatcctggctggaggactcctcatagagtcctgacaacacttcctgctcttacaccattgcttggggtagcctatggctaattggtccactaagttggaagaggtagatcctctttcttgtaagaagcaaagctgaactgccctaaccccaccctgatccctccgacccccataccctgggagcagagagaaggaatggcagggagagctccttcctagcctagccactgatcttctaataggaagacaaccctgggcagccatggccgagcctgagcccaacctcagagcagttccagaggagataaatcacactgagggacgtggggacaggaaaggaaactgcaaacagtaggggaaacccaacagaaagctggcctggaaagctaggaccacgtctgaggtggtaccaggctccactacagacagcacccagaatcagatggaacgccccagtcaaagcctcgccaagttcaggatcaattcacccaagaatgtcccatctgtcaccagccaagtgctaccccccacccccaccccgtgtgcagcacaggaacccctaggggctggtgcttgcctaacattcccttgaattacttattaactttctggatagaaacttgagataaagcaggcttcgtgggccttctttcactgcctccgagatggagagagagttctttcagggctggggtgtactcagtggtagagtgcatagctagcaggttcaaccctgagcattgcaaaaacaacacaacaacagatgtaacaggtcaccatgccccacactgggtctggaatttcagacacaaccttttgacccagtccagacaaccgacatgcagggaacagtgtgaatttctgttcaccgtgtctttgcttttcaaggagcaaagttgtctctcagaagcaaacaaggagagatggaggctctgaggttttcttattggggactttgagctcagcctttctgtggagagaatcatgtattacctcctctcccagatgctggatgaggaagaacaaaaatgcatccccatttgttcagctctgaagaggctctcttgagagcactgtaatatcacatgggtgccccacccccagccccctaggaccctttctaaaccctcccattgcttttcaggggttgcttttgtactgcgacatcttagagtcaacctttgaaaagttcaagcagcccagcaggaaggtggatgctctcgaccatttccagaaatgcttcctgattctgaagctggaccacgggagagtgcacagcgagaagagcggccagcaggaaggaaagggctggaaggccatccgtgtagatctggtcatgtgcccctatgatcgccgggccttcgccctgctcggatggaccggctccagagtaagagctgtctgctactagctttcctggctcaggggaagaaagcttccgctgcggggcagaaggctgagagaactaagggaccatgcccccaagcctctaaactggggcatggtttgggtacatgttcacacgagttagattcatttagattcccaatgtatggttcaccaagccagcagcagtggccttacctggggacaggttagatttataaattcttcactgtatacctaccactacatcagaggctctaggcagttaagctctgacacggatgtttgtaaaacaccctaggtaactgagaggtatctcaggtgagagctactgaaacctaagaagtgtcagggtagtgagtaactcagatggattcgggtcctagacctacagaaggacccaaccctgcctcttggacaccttcctaaagcctataagatagatgggagtggcgccctctgggggcagcagtgcacagctgcagggtggtcgactcaaatgctgctctaagaaactagtgagggttaaaaaaaaaaaaaacaactttctttttcaagtttcaagaggctgaagctgctctgtcccgggttgcgccgctttcaggtaaataacactcctccagccttctctctaacagcggcgctaacctcacagggctctgtggaggactctctgggacagcagtccatccactcctcttagatgtcatgccaggctcctgttaagcgtctgttgccctgtagcctctggggctcaggaaaagactggattccttagttagggttatgatagctgtggcaaaataccacgatcaaagaaacttggagacggaagggtttattttactgacatttctttatcactgttcatcatcaaaggaagtcaggacaggaactcaggtagggcaaggacctggaggcatgagctgatgcagaggccttggaggagtgtggcttactggcttgctctccgtggcttgctcagcctgctttctcatagaaccaccagcccaaagaaggtaccatccacaatagactgggccttctctcattaatcactaattaagaaaagatcctacagatggatcttaccaaggcattttctcaatttaggttttcccctttcagataactcaagcatgtgtcaagttgacacaaagctatcccacacagcacaactctcttggccattctgcagccattttggtttttaatcacctccttcgagccctcgttcagtgatgctcaccatggaagccctgctcagtctggatgcagcactggcttcctatgggcccatagttttcttatttcttgttattataaaccatttgtgtgcccagctagattctgctccggaggaactggcactctgcaggtatttggcaggtgaactgaatttctctctgcaccacagaaacactcttggccttggccgaggagttcaggaatgtttctcactcccaaatcacacagggcagggaaccgggagtagcccatcattgactgcatataaccaacccccattacacctccagcctctccagttgctgggaaccagtgttagctgtgggaagacactgccagtcaagagctggggtgagctaagcaggacccacaacttcccagaccagcgctaagcaaatctgcttcctcagcaattgttacacaaagctggttccacctacagctgcttctgtaaagggcttctggaggcaatgtctcacccagtctcagaaactttccagcagagaggaaatgaattcttactgctagagggtgcgactgtcccaatgttttgcctaatcccagggggaaagacaaagttctggacctgggaagtttccaggtttctctcaggaaaccagcagcagtatttgtgattcactgtccttgtttctagtgtttgctggtcacttgtcctaggcttcagatttgctccctgaaacctcagggtattcttttgatcatgatagatgtcattccggggcaggtgactcttgacagaatctcagattgagtggacatcaaagaagaaaggaccttaacgttcactccctccaccttgggacaaagcaaggttcagagaagctacgtagtaaggacacatagataggcataatatctgggccaagatctccccactcctcaccctctattataataatgatatttgaaacttaaaacgatttaggtcacattttcctctggaccaggtattattctagaaacaacgctcctactgtccatttatccactcaacagatattcacacatcacctgccgcctgttgggcagtgattgacaagggtccaagccaatcagcttcttgttcacattgagtttctgttctagtacagggagcccagagctcagccacccgggagctttgccctgaggaagaaagtcaccccaagaatttatgttagagacagcagtttcaaacacccaagggcttcggatagctctaaacaccatgtaccagaaataatctggactggagggtaatttgttttaattctctttgtagcagtttgagagagacttgcggcgctatgccacacacgagaggaagatgatgctggacaaccacgccctgtatgacaggactaaggtagtgttcccttctggggatgggtgactgacctttacctgtaagccctccctttgaacagattttctaaaacaatattcattacacttatttattttttttacattggggaaaatggttgcatgtagaggtcaggggagccagttctttcctatcacataggttctagggatggaactccgggcctcaggtttggcagcaagtaccttcacctgctggtcccacttatcccatccctacccccaacccaaactgattttagtgtctaggtttgcttctttttgctgcaaatgttctgttctctgtggatcacagttgaaaggagctggaaacattgcttcaacccctactgggcccagggtgcaactccaggcttctacttcagagagtgaagtagcagggctctagaaccagcacataggtgagcagagctgagctggccgtgttcctggtgtttacggtcttttactccaaagaaaatcagggattcctgtaaatcataaatgtcacaggaataaccatccagtgtaggggcaatcaccttctgagggggtcatcaatgggtgtctcccacagtagagcgacacaggtgcccagaggtggatgggaagccatcaagccccagtcactaaccatgggggacttgagtgtcagcagcatctcattaaagccacgcctcagaaaagtggcaagttaccatgtggctggctgatgaagaatgaacaattctatcgtgaaatccatgaacaaaaaggtctcctgttcttcaagtggtcaagggcaccaaattaggcttggagggaaaagaaggtataaaatcaccaaaagcaagaactgatctccttgcctcctaggggtttattatagtttaaaagaaatggatatgcattggatatctaacacttaacctagaactttaaatagactgacagcaaggcctctctgggacttttgacttcatcagactgaagtgtgattcaaatttcaatatattttattgcggggggggggtggggagggagacagagacagaaacacagagagagagacaaagagagattcagagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccaggaaattgtaagtggctcagtgagaaaccctgtctcaaaaaagtgaggagggggaaatgttagaggaaggcatccactgttgacttctaccctccatatgtaacacgctcatgcacatatacccccacacatatgcgtacacatgcataaacatgcactcacatacacacacaaaggagaatagagactcagggaaaaaatatccacgtgtcatttgctaacaggggaagactgtcacgatttcacctttggatgggaaagtgtcaaaactacagaaagccttggtcagttggtggttggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctggctgactggctggctggctgattggctggctggctggctggctggctggctggttggctggctggctgactggctggctagctggctggctggctggttggttggttgaaattaagggctcactctacagcccaagctcttgcctctgcatgccaagtactgggattccaggtcaccacaccttgacttctgaccaaagcagggtgggatgctttagccaccactcattctaacaagacagttcaacaagtctgcactgaggtgccaaaggaaaatgcctgagagtgtgtttctccttgtgcttccagagggtgtttcttgaagcagaaagtgaagaagagatctttgcccatctgggactggactacattgaaccatgggaaagaaatgcctaagacggagttgttgacatttttcttttcggtttagacaagctgtgctctgtgttagtaaaagatggcttgggaaagtctgggattctttgacctcagaggatgctggcagcaagtggatcataagtatactatgcagagagaatattctaaggcaactttgaagtcttgataaaccaggatgcagccatggttcacattcttgggccatctgtcctactgttgcatagaattcatagtcttttgtctgctttgtttgaataaaaatggtcttgtcattgcagcatcatctagagaagcgcatcaatgcccacctgactcctgtgtgtctgaatctctgtgtattgccaataaaaataggaaacagaagcatgaagttttctttgctttgttcagttattttatttctaaacacaaatgggaacgtggaagagtaaaagcttgcggttgattctgaagggatgcatgggtgtaattagtacatcagaggttcccaagaggaccctgggccccctcagaggtcctgggaggcagggtgctgattcctagctgtatccactctgctctgagctggttcctttcgcacccagccctgcaatgtatcagggaagtgttctcattgctctctcttggatgcaaaagcaatttcctaaaccatacaggaaagacttccttttcctcctggagctcttaaagagagcgtaggtttcatctcagggaacccatgggaggaactcagtctctgcaacagccctcacctaatcattcttacttcccatgtcctccagtggggcacaggacagattctatgccttgaagggacctaaaggccacctattgaagcaatatcactgtcttcagcctgctgtagagctggaggcaaactgatgagtgtcagctgttcccaggggatgagggctggaaggaagttgtgccgaggaaggaaagtgatgccccatgagaagcgaggtccctcaccacagggaccctcgtaggattctcctaggaggacaagaggaatccgatgtcactagttactgtgcttttccccatagagggttaaccagcctgacccagctgcctcttctccaagaaacgctttgccatttcttaaggcctggtcaaaaaaccagggtggccttgggttgcaacaggacaatccggtctgccccaaaagattcgattgtgtcatactactgctcctctaggaagagacaatccatctgggactgtcagtcacttggccaagaggccaccccccagtaaggtcctttcacctaaaactaaggttttgggaggaataactaactgtccttctaagaagatggtgtacttcccccgagccccgaaaaaaccaccccttctgtgaagttgcttatagaactgttattgcaaagctttgccaagcccacctgctttgtgaaatttactcaaataagcttaacttttccttttcttaaaaaaaaaatctctttttcatacttttggatataggccagagcctaggctgtctctgatgctctgggctttagtgcttttttctctgaagccatatccttccacttaccaagtgaagtgactgcttgtctgacatctgactgcagccctccatgcttaagcaaaaagccccgttcttctctcttcctatatacttcctcttcttccctctcttccatgcatctggcaaaatttaaacctttttttctttcttccttttcttttctttgcttaaatgctaataaagctatcccaaagctgctatctgagctatttttttttaacctttcattattagggccaagaatttgaagaggataaccccaaattccctagtaacatcaacattgcagcagaacaccccaaggctgggctcgggcaatactgggggagatgaggcttcaatctgtagcacaaaaaagcagcccacgcccttgggaagtgagattggcagcatcagtttgaccagagcccaggtctcacgggcatccaggctcaagcccaaagtctggaagcacatgggaccctgaagtgaacgtgtacatggggctgcttgaatccaagctcctcccaataccttaaggggtctaagaacaaaaccctcagggaacccaagggttgtctagcagggtaataggacattctgccaacccttaaggagacaggccttcccactgctggtgattgacagatgcctctccagccactttagctctatccattacacctttagagtcccatgccacagtcactcaaaggggatcgctcagcacctctccatgcaggtatgtgccccagtcatgggatagtgcatcaaaggttcacacatgacctcagcagcctgtcgagtggttgaatggcaaccaactacatggcattggctaaaccagtgctcccagattctccctcatgtccaaacatgggcatgggaatctaaaggtgataagtcttcgtaccaacagaagtcctgaaccttgcaagtttagtgaaaacaatttgaaatgaagattctaagcaattgattgtaaggagaattaaaatgaagaacacaaaaacaaaaacaaaaaaacaaaatagtcatactttattttataagttgcaaggcttgctgatctgtatatttcagtcaggcctcacagctgtcctcggggatcagttttataagtataaaactgaggctctaggtggccaacattctaggctggagctgaaacccatatatgtcaaagccatagtctcttcaagttctcagggagtctaaggtcattacccatcatgcaagagaaatgaggcttcatccctgggcacagctgattgaagatgttcaaatgtgtttatctaagacctgagcccatgaaataacccaaaattgaatttcagaggggctttgaaaggcagctgttaacatgtgatggtcattgggtttacagaaccattccctatagctcaagaaatccaactatttctaaacaaccagaggccccatgcaagaagagttggttctctgggatatcaaggtggctcaaggagaccatggatgtttctagagatgccctgaggcctcagctctcccactgtgaagcatggtgtatttcaaggcagtggctgtgcactagaaggtcacaaggaaactgtctggggaagtgaaggcaaagatcaggcccgaactggtgaagttgtccctagatgtcccttgcatagcaggtgtagctatcccaacccatccctttgctcctgtgttcatctttggtcctcttgatgcctctccctcacaaacatcttttctttatggtacttcaaagcaaatggctcattacaaagaaaagtcattaaaacatgaatatcagttttatattagcttacttctctcagtgttatgataaagtcaacttaagggtggaggtatttattttggttcagtccaagaaaggtgtggcagcaggagtgtggggtagctggccaaacactttatctgtcgtcaggaaggatagtgatgagttctgcatgctcaacttgaattcccagaaccccaggctatggaatgatgctgggccacattcaggtggatcttcttactcagttaaatctttctggaggtgtgtctccttggtgattctcaatcccattgagttgacagtgaagattaaccatccaggactcgagcatcctaaaggttaatatgtaatgtgtaacacagatctctgtacttgtgatttggaacttggttgacacccaaggggaaaaaaatggtgtgcagagtcgaagtgaggagactgccagtgaccactagagttatttttaaatgtcaaaaattcagattacaggccacagagaaggtttagatttccttgtcgactttgtgactctggatggatgataagtaggatgggaagatgtgggaagaactgggtgaagaggattgatatctctagtgtctactaagtggaaattgcttcctttattcctgctgtaatttttccagtggccaaaggaagcacagaacccaaaacaggctcggggagggtagatgagctcatctgacttctcaaagtgctcagcagcacgtctgactagggagtgcctagctcattctcagctgtatgacacaaatcagccacatacttccttgtgtcggggcatggacggctccatgcgagctttatcctgagatattcaaaaggaagaaatggcttctgtcacatgtctttggttaggttttatgcctgtcctaacttgtgccaagctggccttggtcaatgcaccccccaaaaaagccaactctcaaagctttattattttttaaatgataacatttggagcaggtagaggagaaggcaggacactcgggagccaagccgtttcccaaaggcagacttctctcgattcagaaacaggacatacggggctcatctggacacatagtcgactcacctgggtcgccttgctgattaccctgcaaggtctgagatcgaatgaacctgcctgcaaccatcccctaaaggggcaaggcagccagatgtgtcttggatctataaatgaaattgatgttgagtgagaggcagctgactcctcgcctctccaagcatgaaccctgagcacagattccaggttttcagccctgatccagctctgggtctgctccctgatgcggtgacatcattctaggctcaggctgggtacaagccaccaaagtcctcttctcctttctagttcttcaggaggacggtaggtgtccggcaggggctcctcgcttcccgagacagtcttcacatatatgtgcccttcttggctgccccgtgggttcatttcatgtgtgggtgaccgcctaggattcttgagaacacaacagatttttaaaatgatacagtagagactccagcttcccgctaagatgaactcaaacagccatattgacccttgaatgggaacagcaaaattcagaccaaacatttgaaacaatggttggcaagacagtgggcatcgggagagtaaagacactgaaccttgaggggcaggaaatgagtgacagttgcctgagcttgttgtcatcaaggggttttcaggccatgcaactctccctggctaattattgctggcagaccgtctccagcttttaacttttaatctattcgagactatattcagaaagtgtcgttctatgggttttttttttttataaagttggctattgcttttacagccaaccagattctctctgtcttgtaagtgaagctacttatatctaatatgattgttgatctgggtgggctcaaacccactctcttgcttctctttttcacttgtcctgtgtgttcacttcttagtggtcttctcctgctttgtcccctataagctttagaaccttacaatgtttactgaaaatgtgttgcgatttatatcacagatatatttattttaatttaagattgtctatgtgtatagatgttttgcctaaatgcacacgcctggtatccgaggaggccagaagtctgcagatgacctagaattcgaataatacgctgtagtgagctgttatgagggcctggaaactgaatccagctcttcagacaaagcacttatgactgctgagccgttctctagcgccacaattacacgatgatagggatgctaagagtaccaggaatttgtggcggctgacagcttgatgctgctgagtccaggaccacagatataaccatcataacttagctattgttgaatgtcttctactaagttttattatttccatgataggattagacattcgatcagatttattctttagcattctatgtattttattaccactataaaatagggtttttataaaattcctttttctaactgatagcaattgatattaagaaatacatattgcttttgaattttttttcagtgctggaaatcaaacataggcctttgctcatacaaagtgggtactataccgcaaagctaagtcctgtgtattgtttttatatacaataaacatatttgactattttcctaagtccaataatttacctctagattattaagtttttctatgttgacagtcatatatcatctacaaattatgataattttgcttcttccttttcaatgttatatttaatttacatatacttatatttgtgaatatatatttatatatatgctatatttgtttatatttcctttcaatgttacatttttctgtcccattgtgtatgttaggccctaaagttcagtgctgaatgtaagtgatgaacactcttgattcacttctgatcttcaagtcatattcctttgggtgtcccttttcaggttaccatcctgttctagcttggctttgaaagtccatgtcaagggctggggagaaatggtgcttgctagcaagtataaggatctgagtttgaatccccagcccacatcaaagcccagacaaagtacaggcacctgcagccgcagcccccgcccccgcccccgcccccgcccccgccccagccccagccccagccccgccccagccccgccccagccccgccccagccccagccccgccccagccccagccccagccccagccccagccccgccccagccccagccccagccccagccccagccccagccccagccccagcgctctctcagggagttgggtggcagagtcaggagaatccccggaagctggtgggccagcaccagcagaggaaaacggcaaagagacccttcttaagcaaggtgggtgggaagggctgacactgaagttatcctctgacgtcctctcacatacattccatagtataaatacccacacacaagcatgtgcacacatacattgtgcatacattaaacaaacaagtaaaactgctttatcacaagtgacttatcttttaacaaaaccccatttttttcttattaagatagccacatatctgtttgttttgaccattaaataaactatattaagctgatttcctttttctgctgttgctatattttcaggaccgggcacagaacccgatgacttctacatgttaggtcagcactttaccactaagctacatccaacccccgattttctaatggtcaatcagctttgaattcctgtctggtcagtagacacattgaacacctccattgtgcttccacacatttggttgacctccttgccagaaggtctcacctttgcacaagcgcacacttaacccttaccgtgctacactttcagtcactctcagggatcataatcaaacgtgcttacctcagatattttgggattgtcatagagttctgaaatttcacatggtatctcagtctcctaaaatggttaaaaataaatacataaataaataataaataagtgtatgtatgtatgtatgtatgtatgtatgtatgtatgtgaagggccatagctgtaaccattcaaatccttgtgttttaagccactgtgcagatcagaattgccagaagcctttaaaacaaagcaaacacatatataagagcccaccttgagcaaaatgaacagatagatttaagaagcatcagtcctcggctggcatcgggaagaagtgagcaagagcagacatgaaaccagactggccatgagttgataactgggtcctctgtgctctacttccacagtaatgaatgtgtaggtacagcaacccccccccccccccgtgcacttgcagtggtttcaagtgccagccaccaatggggatcttaagatgttaatggaaatttcagaaaccaaaggttttaaatgcccttttgaacagcgtgacaaagccttgagccaccctacctcatcagagcctggattagaagcctggccttctatctccctatgttaatatctaccaatagaacaggcatggttgttcatcaatagagaatgaaatgagaacccagaaaccatttgatacaggtatgaagccttgtcaggtaggatgccaggagtgtatacacatccttttgtatgtaagtcatgctcacttagatacaggagtggacaaggctatggtcttatcatatccctcccatagacacttcatccctctttgtctcttgtcttccctcatgttcttaccatctgacttgcgcccttttcctccctcagtgtagacgacaccccactgcacagagacatgtttgcatggcatcagtcatctccctccattcctatcttttgccaccctgaatgtcatcttattgccagagatttgctcaagcaaccagggagttatgtgaaaatcagctctgccggaatctactgacaaaggacatcacagaacagaaatatttactgtcttgtcctcagaaacaacagaggttctgagttctgacatgctaacgccagacagaggccagtgcacggaggtaccgactcaagctactcattcacacgcaagaagccagttatcacctctacgggctcatcatcgatggttcttcttcgctggatcaaggtaaacagcaaagccaccagcagggctgtggccagcagggatgggattccggctgccagtccaatagagggaccacagtcctgtcagagagaaaactgagtcagaaaagcccagattcttcaagaatagaggttacagcgggtgttgtagcacacacctttaatcccagcattcaggaggcagaggcaagcaaatctctgtgagtttgaggctagcctggtctacaaagcaagtccaggacaaccagggctggttacactgagaaaccctgtctcaacaaaacaaaacaaaatgtaggacatattcagtgattaaaataaacaaacaaaaaaggtgcatgggctctgactgcattggaaaaatgaaatatttcaaaagatatctgtactgtatatgactggtgacttgctctcctaggacctaactatatagtttaagcccatttggactgctgatcatgtgttaaaacaagggacaactgatttgaatagtagccttactgaacagaagcacaaactacccttcagaagaagaaaagccaaggtacagtttggaggcacagttaaatgccataaatgccatgttcacaatcgccttcagcctgaaaaagtcaaagcttttttaaatgtttatttttaatttttttttttagtactgtggagagtggttaatgtagagatttacaactagccaaagtgcagagaacacatgtcggtggagtgctccgttgtgactgggatttctatattttatctcctcttctgaggctcaaggaatgtttcagaagagtggggagaaaaggtagaagggccagaagttgagagacactagggagaaatcagtgtcttacactcaagactggagcatgccacacatgagctcatggcaactgtgttgtctgcacaagatcaagctacgcaacggcctagcagagctcgggctgggcacatgggctcccacagctggctgccgagatgctgcagttaaaggctttcagcagagggagagccgggttctccagaggtttggtccctggtaggtcagccatactccagtggttgacaccaaaactatgcacataagtcagcacgaattggatttaacagttattaaaaaaatttaaaaggagaagaagtttcgagaggtgtggaggggaatttaaggagagctgaagttgagaatggggtatgaatatattgaaatatgttgtgtacatgcacaaaactctaaaagaacaattaaaaagttatattaaaaagaataacctagatagagaaacaaaaagtccgcgttgttagcacatcctatgccatctgttgttattttgaaaacattcatattgcatgcatgaccctgctttcaagcgcccactctggtctgagtggtaacagacatgcttgatagcaccacaaggtttcagggttgcagcattttctggaaacactaaagacgatgtgcaaattcctctaaacaccctacaaatgcaacactagcggggtgtgatttttacaaaagcgtgaaaacccgtgtcacaaatacatggaatgaggactgtttgcagaatgtcatttcacacataaaaccaaacatttcacacaaacagaccaagacgtagaatgctcttgtagaattctctccatcccttacttgtgaccaccatcccgaagtctatccctgtagatgctccttatttggtttccaacacacagatgcaaacatagccattgactcttctatccctggctgctttcctccatgctctgtgaatttgcctgagtatgtgtgtgtgtgtttgcttgcttgcattttatttatttattcattcatttatttattcaacgtgcatgtatgtgcaccttgtgcatgcaggagccttcagaggtcacaagagagcataagactctcaagagctagg

SEQ ID NO: 1152 - DNA, 2004 bp, Mus musculus
attctggagacaccacctgatggtacagacagagctagactgtctgcttccatggatccactgcaagcagtccacctgggtcctcggaagaaaagacccaggcagctgggcaccccagtggcttccacgccttatgacatccgatttcgagacttggtcctcttcattttggaaaagaagatgggaacaactcgaagagccttcctcatggagctggcccgaaggaaagggttcagggtggaaaatgagctcagtgattcggtcacccacattgtggcagagaacaactcagggtcagacgtcctggagtggctccagctgcagaacatcaaagccagctccgagctcgaactcttggacatctcctggctcatcgaatgcatgggagctgggaagccagtggagatgatggggagacatcagcttgttgtgaatagaaactcctccccgagtcctgtcccaggctcccagaatgttccagcacctgctgtgaagaagatctcccaatatgcttgccagcgaagaaccacattaaacaattacaaccaactattcacggatgcccttgatatcctggctgaaaatgatgagcttagagagaatgaaggttcttgcctggcattcatgggagcgtcctctgtactgaaatctctgccattccccatcaccagcatgaaagacacagaggggattccttgcctaggggacaaggtgaagagtatcatagagggaattattgaagatggagaaagttctgaagctaaagctgtgttaaatgatgagcgatataaatccttcaaactctttacctctgtgtttggtgtgggactgaagacagctgagaaatggttcaggatgggtttcagaactctcagcaaaatacaatcagacaaaagcctgaggttcacaaaaatgcagaaagcaggattcctctactacgaagacctcgttagctgtgtgaacaggccagaagcccaggctgtcagcatgctagttaaggaggcggttgtgacatttcttccagatgccttggtcaccatgactggggggttccgcaggggtaagatgactggacatgatgtagactttctaattaccagcccagaagccacagaggatgaagagcagcagctcttgcataaagtgacacacttttggaagcagcaggggttgcttttgtactgcgacatcttagagtcaacctttgaaaagttcaagcagcccagcaggaaggtggatgctctcgaccatttccagaaatgcttcctgattctaaaactggaccacgggagagtgcacagcgagaagagcggccagcaggaaggaaagggctggaaggccatccgtgtagatctggtcatgtgcccctatgagtgcgcctgtgccctgcttggatggaccggctccagacagtttgagagagaccttcggcgctatgccacacacgagaggaagatgatgctggacaaccacgccctgtatgacaggactaaggggaagactgtcacgatttcacctttggatgggaaagtgtcaaaactacagaaagccttgagggtgtttcttgaagcagaaagtgaagaagagatctttgcccatctgggactggactacattgaaccatgggaaagaaatgcctaagacggagttgttgacatttttcttttcggtttagacaagctgtgctctgtgttagtaaaagatggcttgggaaagtctgggattctttgacctcagaggatgctggcagcaagtggatcataagtatactatgcagagagaatattctaaggcaactttgaagtcttgataaaccaggatgcagccatggttcacaggtcttgggccatctggcctactgttgcatagaattcatagtcttttgtctgctttgtttgaataaaaatggtgttgtcattgcagcatcatctagagaagcgcatcaatgcccacctgactcctgtgtgtctgaatctctgtgtattgccaataaaaataggaaac

SEQ ID NO: 1153 - DNA, 1590 bp, Mus musculus
atggatccactgcaagcagtccacctgggtcctcggaagaaaagacccaggcagctgggcaccccagtggcttccacgccttatgacatccgatttcgagacttggtcctcttcattttggaaaagaagatgggaacaactcgaagagccttcctcatggagctggcccgaaggaaagggttcagggtggaaaatgagctcagtgattcggtcacccacattgtggcagagaacaactcagggtcagacgtcctggagtggctccagctgcagaacatcaaagccagctccgagctcgaactcttggacatctcctggctcatcgaatgcatgggagctgggaagccagtggagatgatggggagacatcagcttgttgtgaatagaaactcctccccgagtcctgtcccaggctcccagaatgttccagcacctgctgtgaagaagatctcccaatatgcttgccagcgaagaaccacattaaacaattacaaccaactattcacggatgcccttgatatcctggctgaaaatgatgagcttagagagaatgaaggttcttgcctggcattcatgggagcgtcctctgtactgaaatctctgccattccccatcaccagcatgaaagacacagaggggattccttgcctaggggacaaggtgaagagtatcatagagggaattattgaagatggagaaagttctgaagctaaagctgtgttaaatgatgagcgatataaatccttcaaactctttacctctgtgtttggtgtgggactgaagacagctgagaaatggttcaggatgggtttcagaactctcagcaaaatacaatcagacaaaagcctgaggttcacaaaaatgcagaaagcaggattcctctactacgaagacctcgttagctgtgtgaacaggccagaagcccaggctgtcagcatgctagttaaggaggcggttgtgacatttcttccagatgccttggtcaccatgactggggggttccgcaggggtaagatgactggacatgatgtagactttctaattaccagcccagaagccacagaggatgaagagcagcagctcttgcataaagtgacacacttttggaagcagcaggggttgcttttgtactgcgacatcttagagtcaacctttgaaaagttcaagcagcccagcaggaaggtggatgctctcgaccatttccagaaatgcttcctgattctaaaactggaccacgggagagtgcacagcgagaagagcggccagcaggaaggaaagggctggaaggccatccgtgtagatctggtcatgtgcccctatgagtgcgcctgtgccctgcttggatggaccggctccagacagtttgagagagaccttcggcgctatgccacacacgagaggaagatgatgctggacaaccacgccctgtatgacaggactaaggggaagactgtcacgatttcacctttggatgggaaagtgtcaaaactacagaaagccttgagggtgtttcttgaagcagaaagtgaagaagagatctttgcccatctgggactggactacattgaaccatgggaaagaaatgcctaa

SEQ ID NO: 1154 - DNA, 53714 bp, Homo sapiens
tttgggattcagattctattagtgtgcaatggagcctgttcactgatattttaaaaactcaggtagtttattgtgtagccagggttgtgaaccaaagttctacacagagaacaaatatttatgtaacaatgtattcatgtaacaggcaaactgggtttttgtttgtttgtttttgctttgtatccattgctctgggctgaatgtttgtttcatccacaaattcacatgtttttgccttaatcccccatttgagattaggtgtatttggagttatacctttgggagtaattaggacatgagtgtggagccctcctgaacgggattagtgcccttaaaggaggaaacacgagagagatgatctcgttccccaccatgtgaggatacagcaagaaggtggccatctgcaaaccagagctagtgccctcaccaggaaacttttcagctggcaccttgatgttggatttcccagactctagaatggagagaaataaacttctctggtaattttgttacagcatcctgaagtgactaagacaccctggtgatctgggagactccaatgtgtggaatttacctagttttcctctaagagctgccagcctcctcttggattttcctggcactcttccccttctctccctgtgccctcctcctaagttatctaaggcaaacctcttcctccagtagaagttctttctgttggacactcttctgccctttctaatagagctgagatttactagtagtacataggtttacttccgctgagaataagtaatctgctctctcagaagctttggaaaggagctaggccctttttcaccaagttaaaacatttcagttaaatataatcacaccatttagcacctaattataaactattacctccacaatttaaaaatattgaatatgagattttgttatttttaaaaagtaaacaattactcacagagctttataaaaaaagattactatgttgaaagtgagtccctacttccccctacccccatcaaattattctctctgagaaacacacgtttaaaataaatctcaaattcgttgcattgagagctgagtttggtaccaaattcacgatgtgacattgtttctgctgggccgttgaacccctttttcctcccaggtggtgatgaaagactttcacttcctggcaaagaataagagagggttttggctgcatccccagcaaaaccagctttagataaatggtttggcacaaacacttgtgggcctgagctctccccttctatgcattaggggtgtgtcactgacagaattctcactggtctctctggatggaagaggaatggtgttcacagcctatactttgggctgtcatctatgtacaaagacatgtgctaagccctctaagacatacaaagaaggttacactctaaatgggaagacgagccatacttgtctacataaaggaaggtggtcaggggcagaaggtaattgaaacagggtaagtatcaacaatgtgttattaaggtgagttcccaggaagccagccctgagatgggaatttgtgtgcagaagtctattggggatgcccttgggatcatcatctatgggagcatgaaggaggagattgggcagagaaagagttgaaccactatttgattgtagtacagatctcagccaatctaataggatgctctagagttaggctggcccttcagagttgtcaccccttgaaatgagatgacctgacctttgtaaccttcccccgatcattgaccaataagtggaggggtctgtccttaggcaagtgtctctctttgtcagtgagccatcagctctgccattgtcagtagcaaaaggaatggtgactccatcctgaaggggtctctgggcagctcaccacagcatccactacagagggagatctgtgaccttgaagataaatgtgtttttggttgttgctgttttgcttttttttctttgagatggagtcttgctctgttgctcaggctggagtacagcagtgtgatctcggctcagtgcaaggtctgcctcccaggttcaagtgattctcctgcctcagcctcctgagtagctgagattacaggtgtgtgccactatgctcagctaatttttgtatttttagtagagacagggtttcaccatgtaggtcaggctggtctcaaactcctgacctcagttgatcctcctgcctcggcctcccaaagtgctgggattacaggtgtgagccactgtgcctgggccaaggataaatgtttatagcacgagggaaaaaggtacattagtaaggcactgggagtaactggggaatctgaagcgtattgttatgatcagtctctacttgctattcatttcactctgataagaccatctcaatcccctagtgttataaacactacaaatactactatagcataaaatgtcctccataagatccagtaaagaatagctgaaatatttagctgactcttttcaaaccataaaggtcaaacacatttcaagtttagtttaattctattttacagttttggttttataacccaaaactattgttttccaattcactgtctaaataattgtgagattctgtctgtctctctctttatttatttatttatgaaatcagatctggctctgttgcccaggctggagtgcaatggcacagtcatggctcattatagcctcaaccttctgggttcaagcaatcctcctgcttcagccttctgagtagctgcgaagacaggcgtgcaccaccacactcaactaatttttttacttttatttttgtagagatggagtcctgttttgttgcccaggctggtctcaaactcctggtctcaaatgatcctcctacctcagcctctcaaaatgctgggattataggcatgagcctggcctcaatttttttttaaggtagtcttttttttttccagtagtttttggggaacaagtggtgtttggttacatggataagttgtttaggtgtgatttctgagactttgatgtacccatcctctctccttttacaatgatttctttatgatgtgcctccttggtctggcacatttatgcctgtttccatcgctaccatcattagtttctttcagatctttgctaaaatgtcacctcctcaataaagcctaattggataatcttagactgccatcccaaccctggcatacgctgtcccctttatttctctctacagcatttatcaccatctggcctgcttgagattcttgaataattttatttattgtctgtttccttctagtaacagacaagtatgtaaatcccatgaggcaggggttgttttattcactctgtattattaatgcctagaagtgcctggcacatagtaggcacacagtcaatatgcattgaatgaatgaatggtcccagctgaggcttccacggttctcttctggccatttgcaatagtgacccagctggagtagcagcttcagctctctgcaccttccaggaatcccgttttggaccacgggatatacacatcactgcagggctgccttctgtggccctgcctcgggcctgccactgtcctgctcagaagctcccatgacttcttagtgccaactcaggctctgggtggtctctgaggtctgctccaaacctaacttctctccttttctcccatctgctcaaatccttccagccctcctggcccccgacaggctccctctcatgtgaatgcccttcctgccaccctttcctgccctcctctgaattcctccagcagatgagtgtaagggggcaagttaaacatcttccagggccttctgaagaatgtgaggataaatggtaaagcatttcacaaagcctaacatctttagagatgactattattgccagtatgtcatgatagtattattgtatcataaacttctcaattcagtaatagatgtctggaaggttgaagctaaagcatcaagccacattctccagtttaccagtaataaagctgatcttgtgactctggtcacagtggtgtgctggagtcagctgctgccagctcacaagaacccatggctaaatgttctggaactctgcgagccgactgctaaacattcacatgcaccccactgccaactgacccatgcttgttttgcagtcagttcataagctgcaggagagaaagatgtgtttaactgcttaccttagagacgttatcagtcaagaaaaagaattaaaaggatctggtgacagaagtgaaggaacagtttggggagtgatgatgagtagttctgtttcaggcattttgaataatatttttcagtggaatgtaaacgggcctggtgctgaagagagagaaatgggctagagataaagatttggaagttatgggatattggcaggactggaggattttacccccggatacccaggagccatggccccaaccactgatccacagcacaacgtctatcatctcactcaggctctgttctcattctctccagtggccccaagtcatatcttattataattgtctcctgattccttcccttctttctccctcctcaattcaccccattcattattgcctgattaatttccctaaggcaccattttgatcaccttctgtgtttgcttaaacaccttcagcagctcctaactctttgcaaataaaatcccaactgtcctattcaaatttgtccttgaggcaaatccctgtactttctcccctccatgcctgatattcatgctgtcacccataattttgtatacagttaagtttaataaacattttggaataaagactagaagtcacaaataagctgctgttgtccatcagttccattgttctaactatcacttctcatgttgtagatgaaggtgaacccctgttataactaaaatatagaaatttcttgtacttgttaggcacccaacatatatagctaccaaatgcttcttaatggcaagaaacaaattttccaaggtttatttttcattcaagacactctacacatgctcctggcaaggcagttctaagctccagaagacacttgctgccaagaaccaaacacagctgttcaggcaacagaggaagctggtgctcggtgaaaaaccaaaccaaaacaaaaccctgcccgcacatttgaggatggcacaggtcccagatctacaccttgaaacgaatagaagatacaagatatttgatataaaagaaaatgaaagtgccggaaacagaagttttctctctcaaactgacttcctccaacgtgcacagagaataacaacaggactcctaaggataaaaatagtgtttgctgatgggaagagggctacttctccactgaaccatggaaaacctaaaatcctccccattgtttcctgccccatacacttgtactcaataaagatctctaagaatgatcatgtggagactaaatattacccaaaatggaaaaaatttaaaaacaatcccgaactaaggggagaagtggctgcctgggagcatcagcatggaaaccagtgagcagctgtgttctttgtttcctcatagccatcatcacctgaacaggcaggagcattggtcacatctgccagcatcatgggagtggcagcatgaaagggaggacagaacagtggcccagctcccatgtggaccaggcaggcagttgtcatgctatcttattcatcacttacaatgtgaagaagttggcactatgactgctattttacatgttggaaactgcgaaccccccatggggtaagggaatggcccaagctcatacatctggtaagtagcaggtggttcaggcttgtgtagctcctgaggcaccaatacttccagttgcattcaaaagggtgctgtaggtgttctacaaaacaaacaaagaaaaggtaagcatgttgagaatacagtgggcgaacacagtttattacaaacctttaatgttctaacacacattgtatagagtttctctggtttccctacacttaattcactgcagaatttttgttttgcctggaacacttcatgggaccagtgttcccataaatcattgcaggacacccctctggtctcattagagtcttaggtctgttttatttttttgtcttgttttgttttcttttttgagacagggtctcactctgttacccaggctggagagcagtggcatggacagggctctttgcagccccgatctactgggctcaagtgatcctcctgtgtcagctcttcctaagcgggctggcaccacttttggaagagtctagggaaagcaaaagaccattgggaaggattgtgacaggattacctacaaagtatatgggaacacagggaagggaagggggaacaaggagaaacctgcactattacaatagcaatggacagttcttggaacttgcatgccagtggtctttgaagtgctttagtcctcatagccacctgtaagatagaaatcattctaacccccattgcagagataagggaaataaagcaaagaaaggttaggttttgaattcaggtagtctggctcctaacacctgtattctatttgttcatattgaagagtcttaaatggagcagaattctccaccaagtagcataaacaaataaacttttgttaagacactgagatttggagattattgaccaatctagtagatcaaggagagtgctcaacatctgatgcaaagagcttcagaaaatcatagtatagtaagaagaaatcaattcctgctattggcagcaatgccaaagagcataagagaactctgtatagtgttttattattttcaaggcacttcatgagcacgatttaatttagttcctgagaaggcgatgagacatctgtgctctcagaccttatttcacacctcccttcaccacaggggattggtttaacagacattaattgctgaaaaagcaaaaagaggacattgaggtaactcagagaaagaaactgcaagaagcacactacaccactgggctggagcaacaaagggatggagctgggattgttgaaaactggaagtttggagcagggctcccatggagctggaacacagatctttaataaggaagtgctgcctgtcgtccctggtgccatagaatttcatagggaaacctctgcagagctggggctcagacttttgaggagatgtcacctaagtggtattgatacctctgaagggtacagtaagactgggtctggttgtgcagaaaagaaaaaaagaaaaagaaaaaagctaaagactagaaccaatcactgctgtctgagtagagaaccattactgcgaagaccctgacctttgtagcagcaagcaaacaaaaaaggtcacctctttcctcttatctagactttcagtctccctctggtatcaccattggcagagcctgacataaagtcagctggcaaatgagaaagagaatttgctcagtcccagcctcaacctcatggaatccatcagaaaaaaggtagatttgcagctgagagatgatagcctgataaccagacaggcatcagtacatttgaaatttttgttggtaatgttttcaataccagtgactcaaagcaaattaaaatgtgacattgtttaatatgatattttgatgatttagtagtttcacaaaacatatatatccgatttcagattgaactggaatgtctctaaaaacaaaacataaattactacgaactgacatttattgaaagtgctacctttgtgtcaagcactctgcccagcaggttatgtgggctatctcagtcctcattttacagatggggtaaagctgaggcttaaagaagttaagcaacttgctttgaagcttcagagcaatagagacagaatttttatgggcagcctgacgaagcctgagctgttagccacatctcagtactacctccccattccctttactgcttaggtggtgcacctttactattaggtggctataccttgggaacgaacacaacaatcccagactcttgctagaatcatttacttaactccctgctgcagcaccatttggtagctaagactgcattctaacatgaagcattcagctcttcagtaaccaaacacataatagtgagggtcaaaatagactctcatcttccagttgatctctagcaaacagtcatagcatccgggaatttcagggctgcattataggcccttaccagatgtctgaattcccttctgttacagctcaataaacagttatccagcatctgtttgaatacttttcatgacttgtaacacacaactgtataaagctgctctctgtatatttttagacagctgagttactaaacaggtcttacttgcggagaactggaatctattactctacaatttccacctgaagatttctgattttgctttcttgagcaacacagagtgctttacccatgccttaaggcagctgtcacatgactcttcccctaatacggttgtgaggtgctcacgtgttttggagatagcaaaagtctcaaataatatggcacagacggccagccatggtggctcacacctgtaatcccagcactctgagaggccgaggtgggccgatcacctgaggtcaggagttcaagaccagcctgaccaacatggtgaaaccccatctctactaaaaatacaaaaattagccaggcgtggtggcgtgcgcctgtaatcccagctattcaggaggctgaggtagcaggatcgcttgaacccaggaggtggaggttgcagtgagctgagattgtgtcactgcactctagcctgggcaataagagcgaaactccatctccaaaaaaaaaaaaaaggacaaagggtgagcagagctcagattggttattggagaagacaatacagaggaaggctccttggtggttaagagtagtcttttaaaatcagacagatctgagtccaaatcctagctcaatcatttctcagttgtgaaaattcagtagctctgtgaccttgggcaaattgtttagccaaatgagaaaggtaggaccacctgacagtggtattgtgaggatcctgtcagctaaggctggtaggtgcttgccttggccgtgtagtagctgctcaggaaatgagatctatagagtgtattggtgaaagacaaatttaattttgcacataaagttatgaaaatgtctccttatggcagtggttatcatctaaaagtcataccatcccactgaagaagacctattttagggtttataacagactactctctggacaaccttaatccacttaaaaaactaatatatgcatacagcatttggaatccaaagaactgaattcaagatatggcttggccccttattctgtgatcttgaataactgagccttggttctcttgcttataaaatgtacctatgtaagtgaacaggtggtaatacccaccatgaaatactatggagcagttagaagcaacagagcaattagaatacggatctggaaaacatagttccaagtgaaataaaaaggtgattggcaaaatgagaaatgtaacaatgccatttatgtaaagtcaaaacaaccacaagcagaatataacacccatgcaaataacagacatccagtacagtgtaatgattgtctacaaaaggaggagaatgcaagtgagttgggaggtttaaaggggatcaataaataaagaccacagaagggcctcagtacatttagaaataaataacatgcaaacaatgatgcttccctaccttcctcacgaggttactctgaggagctaatgagattgtgcgtatgaaaacaaaagttaattgactgtcttcattatgatctccatattggacaaatgaactgaacagagataaaaattccccatcacactttggcaggaagctgttgccagggcagcacctgtgaagccctggcctggcttcagagtctgctggtgagatgacatcaaaacccttcgtgtaggagggtggcagtctccctcccttctggagacaccaccagatgggccagccagaggcagcagcagcctcttcccatggatccaccacgagcgtcccacttgagccctcggaagaagagaccccggcagacgggtgccttgatggcctcctctcctcaagacatcaaatttcaagatttggtcgtcttcattttggagaagaaaatgggaaccacccgcagagcgttcctcatggagctggcccgcaggaaagggttcagggttgaaaatgagctcaggtaggacagcatcgatcttgctttgtaaataagcagaggctttgtgaacagcttcttgggaacccaaggaacctgtgttttcttccacatgtggaagaggtgatcttcccactgggagaacagcagatttgaaatcaaagaacaactagttaaggaaaacgagataagtggggactgaatacaattatattgaaactagttgacaccaaaagatgagataaattttttgttttttgcttttcactcctatgagatgtgttatttagggatgataagcagaacactaattggaaaatttaatgctgaaccactcaattctattcttgaccaatttgaacaaagtatcactgggttcaacaaaaaagttttggctactttgatgcagaaagatgatttggttgcttggttcttacctatacatctgggcgtgctaaggcagctagcatctgtggtgggcgaggatgactagccagcttaccacaggcacccagatgtggccttgaccacatttttccaaagagtggtcctagtggggttcttagaaagagagatgctaggtaaagatgtattcactgttaagacagctctgtccagggatgacagacatcacactgagtgagatgtaatcagagcccaggcaaggaggcgatagaagcatttggaccacctagattggttcactcactaatccactcaccttgaacagcaattattcttgttgtttttctaacttctgtgtaagctcttcactgatctcaaatagatgaagagaaaacaagcaaaatccagaaacaaatggtattagaaccttgacataagtgatggttctggattaaactgttaaggggcttgcaatgaaggagtaatgatttatgcagttgaccgctttgactgtgcaagaaataaattgaccacaaattttcaggcaaaactataaaaattttatgtgaaaggacattttgattgtataaatagtctttgatatttgaaaataaaactgacaagcatgtcatgcagaagaaatgtcagcttccaagtgttgaggagacatatttcaaaagtcagttttcagatatgttaatgttcgcaacaccctgattcatatgacattgacttttcattcattttttgctaaaatgccccattcagaaattcctgaatttcctatggcccttcttccacctgatttctctttgcaaggtctccttttctctcttgctgcctctttgtaacctcctacagccactctgaatctcattttctaacatcctttccaagaaaatcctagatttcatctaactgttaagcctgcctgatattacagacttacatagaaggctagagttggagaagacaggaagattatataggtaaagaagccaaaaaaatagatttttttttttttttttttgagacagagtcttgctctgttgcccgggttggagtgcagtggcacaatctcggctcactgcaacctccgcctcccaggtgcaagtgattctcctgcctcagcctcccaagtagctgggactacggacacgcgccaccacaatcagctaatttttgtgtttttagtagagacggggtttcactatgttgaccaggatggtctctatctcctgactttgtaatccgcctgccttggcctcccaaagtgctgggattacaggcatgagccaccacgtctggccaaaaatagattttttggaaaagaaattaaaagccttagcaaatatggaactgcttttcatggtaaagaaatttgacaagggttaggcaggaaggaaagaaccagaagcaccacttactggaaagctctccattgaaacgtccaagcttccagcaaggacccgctgatttattatagacacagcaatgaatacatacaaggcggctgaggcaggcactcagggagatgatgggaggtaagtttcttctgttggcaggacagctgaagaggcagctacatgccccagatgcctgctgccagggaccaagcccagctgctcaggcggcggaggaagctcactggtgcatggtgagcaaactgccgctgtgcatgtgatgatggcaaagttcccaggctggtagctcagaagacacattaaatacaaatgtgctctatggcgcaaaaataaaccacaggaagtagaagtcctaggtctcaaacggaatttctgtgcatagatatatagactttaattggatagagaaataaaaattattgtaggggacaaatctctagatacgaaatttagaaacctcaaatcctggctctgagcctccccagccatggggtatgggacaaggtcccctctctcccgactgattttaatatcctgataaatggcctatctgatgtgatcaccaaatgagataatgcatgtcaatgtgctttgataaattaaaacagttagacaaatgtaaagtgtaattattttcttgtgaattgctggatccattgacctttacagcaaaaccctaaggaatgggctctccctccacaatatgaacaaggtcaaatgatatcaacaaatagaacaaagacaggaaagaaacccgtcaacatgttataactggttttttgggagtgggggttggtagggagagattatggctgtttttattttctgggttttccagtttttttttttttttttttttttttttttttgagacggagtctcgctctgtcccaggctggagtgcagtggcacgatctcggctcactgcaacctccacctcccaggttcaagcgatactcctgcctaagcctcctgaacagctgggactacaggcacgcgtcagcacgcccagataatcttttttatttttaatagagttggggtttcacgatgttggccaggatggtctcgatctcttgacctcgtgatccgcccgccttggcctcccaaaatgctgggattacaagcgtgagcaccgtgcctggcctccaatatattttttacaataagcatatatatatgtatgtgtgtgtgtgtgtgtatatatatatatatatatatatatataagcatatatatgtgtgtgtgtgtgcatatatatatatatatatattttttttttttgaggcagggtcttgttctgtcacgcaggctggagtgcagtggtgccatctcggctcactgcaacctccgtctcccagactcaacggatcctctcacctcagcctcccaagtagctgggactacagatgcgggccatgcccggctaatttttgtagagatggggttccgccatgttgcccaggctggttttggactcctagctcctgccttcacctcccaaaggattacaggtgtgagccaccgtgcccaggctacaataagcatgtactttaaaaataaaaataacaaagaaagctgttttttcagctgataggcaacagttttcattgttcctaacacattctttggctgtcagaaggattaaattagagaagaaacctgattcctgctttacttgggcctgaacacacaaattagaaatggtgtacctcaaagtgttgcactgtctggagctatttcattctgcaacatgcatgcaacataattgggtggagctttgctaacatttatgctatattgcaaaatacgtgccattcaatgtgccataggaagctggtcttaaaacgtagataagggaaagtattaaaacccttgaggcatttttgcatatttatgaaaagaatactgaattttattccatggctaacttcctaaattttagagcaatttgccacccgggtcaagctggagaaggatcagaacctactgcttgtcactttcttatttcatcctgagttccaatacgtggagctattttaaaatttcattctgttatcaaccctcctccataaacacattagtgtcactcgagtccatgtgaagagaccaccaaacaggcattgtgtgagcaacaaggctgtttatttcacctgggtgcaagcgagctgagtctgaaaagagagtcagcaaagggtggtgggattatcattagttcttacaggttttgggataggcggtggagttaggagcaatgttttgtgggcagggggcggatctcaacaaagtacattcttaaaggtggggagaattacaaagaaccttcttaagggtgggggagattacaaaatacattcgttagggtgaggcagaaacaaatcacaatggtggaatgtcatcagttaaggctattttcacttcttttgtgtatcttcagttgcttcaggccatctggatgtatacgtgcaggtcacaggggatatgatggcctggcctgggctcagaggcctgacaattagttaagcttactctctgtgtcttgacccaaatcattgatgctgaggaagaaaatgcacgaccaggaaggttggctctccacctttgcatctacctagccgtttaacacttgccaagttccattgttcaagcagcttgacacccaccagaggatactgtcatccttcctagacttccatagtttatctacaaggatgccactggaaggcattgtcttcagtgaaagcaagatgcagcatcatgtcatcaccaataaagggctttgttagtacctactctgtgcagtatttgtcaggttgtggagacacaaaatagtggaagacatgagtcctgcaaacaaggagtttacagtcagacaggaaagtcaggaattgtacctttgtcatcacctggaattaaaaaagtagcatagcatatattccaagtttgaacaagttttctttaaaaaaaaaaaaaagttagcatttgcctgctcattttttacttttagtcttctagtattattttggtctagttttatctaaactggctgcttgccctttccattcagtcattatataatgtttgacatgtggattctgtctcactcattatcccaaaaccatcgcctccaaaagtccctggcaatctcatggtagtaaaatgcattatttttttccacctgaatgttggtaaagactctctccttgactaaactgtagcatggcttctagcagttaaggccatgtccctaggatggccccctttaaaatgcctgcctgagaaagttcatcactgccaggagaatgtcctgtttattctagccaaaggcaggcaacagggagctggcccgtgaaccctctcttaaagcagttactttagaaagttgcaatgataaatcctttctctgtccctttgagatgtaaatcttctaaccatccagaactgtcttccaaggatctgaaaaaagcaacccttcaaagaggtaactccgactttcagattctgtgggagggagggcctaacttcagaggaccttcctctaatttacaccacaaaagtttgcttctcctccaggaaagctccaattaacaaacccagatggcctagtcacagggaccaacccccctactacccctcaggggcacacccttcccctagcagcacatcccagttttttaaaagtctcatgccttttgttcccataaacactggggcctctttcctattgccatcattatgactgaatataaccatccttcccactttaactagtgtccagctttgttaatctttggcaatgttctattctacacttcaaatttatggtgtctgaaatcaaaatattcaaagtcattgtttgcaaaataaacagaacatcagtcgaaggaggtcagtttcctgctctagaaaataaaagttgaactggccactctccaggccaggcccagaatccaaacacagattccctggttttctttacagtttttcttgctctttccctaccaccttgagtgccttctccctttacctctctgcttcccagaccttagactcctgaaagcccccagagagaagctttcctccctagaatgctggtgggagtcactgcctagggtgggctcccagcttttccttttgatgagcaaaggctcttaatctcatccaattacccctctctgactccacaagccacgtgtagacctcagctacagacttagacaattttctttcacataggaggcctcaagaaatatttgctcagagaatgatttatctggtgaatataaaaccagcccaaggaacttgtgtttaccaagagtaatttttgtaatgaattttttttctgcaatgcatgagtattaattttgtaatcagcaacataataaatattttatttttataaattcaagagcatgagcatgagatataagcttttttcttgctctgatccaaattactttgtatttcaaaatttgcggctttaaattaacaaaaaatttcttaatcccatttaaggtgggccaaaaaaaatcgaggcaagatcgtctcagtcataagtacagcagggctggagacagaaacctgtccttagtggtgctaggtgctagtaagagtttgcaataaaaccaaacaaaactgcatgatctttctgttccaaggatactgaaacagatcagttgctaagtgaaattggtagaagggtttttaaactgtaaacaggtcagtttaactgtaaatgactatttaagtcactgtttacaaaataagtcctatatcagatgggaagaatcaggaatgacctctccctgggaagaagacagcaggtgaccatccatgaggatccagaaagtcagacagagggtgggaaggagtctatacccaggcaaataaaaatagctgccactttcctcctggagggtttttctaattatacttcatgagaggcaggatcaactaggaaaagaaagacaggaagaacagggaaattattgcctgagggaaaaaatgcagaactgaagtctgtgagttaattccataacccagggcttttcagacatctgagtgccacagtcacgattcttgtaatatcttttaccacatcttttattataatatatacgtaatctgtttattttgtttgtttatttgtttggggggagacagggccttgctctatcacccaggctggagtgcagtggcacgatctcagctcactacaatctccacctcctgggttcaagcgattctcgtgcctcagcctcccgagtggctgggattacaggcacgtgccaccacacccagctaatttttgtatttttagtagagacggggtttcaccatgttagccaggctgatcttgaactcttgacctcaagtgattcgcccacctgggcctcccagagtgctgggattataggcataagccaccacacctggccagtgtgtttcttttaattgtccctaaactgactcatttaaaataaaattagccttgttctaaggaataatatccataaaacctatgatctgagatgcataatttaaaatacagatataaataaacacataagccttttaaatgttcaattgtgtacctcctaaaattatgtcacgtacctgcagagaaacgagtaccatgttggaaaacacagctgtcattgaggccaaaggctcgagtgggagtcaaatctaggctggggcagttcaatagaaaagatctttctctacagtggtgtttctcaaagtggagttcttgggctgtggggtggttttaaaacataggtcctcctgtggagagggaggggcaatttccccgtcctttgcatctgagagtgctggtgactgattcaaccagtaaggtacagtggaaatgagactgtgtgactttccctgggacacaatctctgggaccccagagcctcatgtaagacattggcgcctcctcttagaccacataaagttgcttgggtccccagtccctagttgcactgagcccagctttccagccatcctcaccaaggtggcagaatgtagaaccacggggaacatcagcacctcagcagaagaatacagggcagagagatcacccagccaagcctgcctgaagtgctgacccacgaaattgtgagatataataaaatagttgcctttttaagtcattacattttgggatcactggttatgcaacagtagataacgaaaacagactgactatatcagaatcaccaatggagcttgtcaaaatgcatattcctgggcctcaggtgcaattctccaggaattctgaagtctcataatgggacccagtaatctgaattttaacctagcttcctggatgtctctggtagacactagagtttgagagacattcctttagagctattcattcattcattcatctatccagtctaccgtcatctttttaccattactataaatctggccatgtgctgggctccaggcataacccagagaccatgccactgtccctgctctcagggacaccaaggaccaagctgggcacctgacagtcaagcactagttgaaggaggagaccctgaatcttcttccctgtaggagactgaggtaccaatgccagttctctcagaattgctataatttgttcaagacctcccaaacttagtccaaagcactaacaatcggtcatggccaagaaattaggagaagattgaattcactgatattttggaaatagccatctcagcagaaccttgggatctctgaggttgaggttggctgccggagggtttctgtcaccttttattataagaaggaagccaaggtctctgtgggcaaggcagaaacaacttcagcctcaatcacagattcatttgcccttgaaaatgacattcatgtatattttcccccaagtagaaaagtgaccatagatagttcattacagaaaatgagaaaataaagaaaaacatttcaaacacacaaacaaagctcccctcaggcatctaaccacagtctagcagaacgttaagaggttgcttgagtcaggcacacctgggtttgaacctcggcttcatgtaagctcccccaggcttggttttctcctctgtgattacattgcctactgtgctaggctgttgtgaggattaagtaagaatatgtgcacatgtgtgtatgtcattatcattatctttgctaatagtcacaagtatttctttctagtctgattccctttatatgccagtatttattgttggttacttaatagtgccttgagccccatcccatctgtactccccagcattctaatgtccccatcagaggcagggctgtgtccagaggaatcctaggtggagagatggtggcgatggagcagcagggtaggagtggatggtgacaggccagaatttggacgatgagtccagggctcccccttgacacgtccatctccctcagaggtttagggaaaacccagagcccagagagcctgacagcctccctgtggctgctccgtcttgatgtgtggctatggcaactgttctttcaagttttctggggcagttctacatgtcctgtagtctagtttagtccatataatattgtacataaaatagcaaaacacaaattctatgtggcagcagcaaggcaatacgtttactgctgttatataggaggtgctattccatctgtatttctgcccttgggaggaaatcgattttcttattattatgatacccatccagatgttactccctctgcaacaagaggaagtgagcagctccctccttttccaaagaacacaaagtcatggatggccaagcacatagactttgatgagaacagccataggatcaaatccctgctccacctactaattattcgctgggtgaaatttttaacatttccaaggctatctcttccctttttttttttttttttttttttttttgagatggagtttcgctctgtcgcccaggctggagtgtagtggcacaatctcaactcactgcaacctccgcctcccaggttcaagtgattcttctgcctcagcctcccgagtagctgggactacaggcgcgttccaccacgcccagctaattttttgtatttttagtagagacagggtttcaccgtgttagccaggatggtcttgatctcctgacctcatgatctgcccccctcagcctcccaaagtgctgggattacaggcatgagccaccgcgcccagcctctcttcccatttttagatggggatgatcatatctatctcatggcattattgataattaaatgaagtgatgtataaagtgtgcctaccagagtgtctagcatatagtaatattctaatattgttaacatttccagtattggagtgttcagagcagagagaaaaccactgtaccagcaaatagacaaacagctgccacaagatagtgataagaaagtatcagcagagcacactagaggccatgggtctccttagtaatactgctcggtaagggctcggagctgaaagtgaacaacacacagagactgtgaattgcctgtgaggggctgatggcaaccccgacacgaggaagcacatcacagcccagatctagctggccacatgcagaggatcagccgaactcaggcaacacaagacgatgggaaatacagtctgggccacaacagagattctctcaacaaaatttcttaaattatttgtggcaaaggaccagttttcaaaaaatgtgttgaagaccaatgcttcttttttttttttttaagccacaataaaactattttggtgatgtcaaattacaattaaagtttctaaatgctgacttacaatttctgaacttaccttgttgggaactagtggcaaccaatactgagctctgagtagcattggcttaagaggttttgtttgactttttggtttttgtgtgtgcttaagattattattgctcttttgttttgtttgctagttgcttattgaacaggaagtgggagtttaaatcagagccttccttcatatgacgtacagcctgtcatccacaaatttgtttgtattaattaagaaatgcatatggttctcacccaacaatgtgagcgcagacattctcacactgtctcagagaatcccaggagaagaggcagtagggggagtggtaagagtgtaggtggttaggggtcccagggttcctctttaacatacccttctccctctcagggttaggtaaaactctatttattgtaataatattataataaataataatgtatcataagtataataatataataataatttttccctccaaaaggcagaaatatagatggaaaatatagatggaataacacttcctattaatccttgatccaaagaatccttcaggaattttattataaataaattttgaaataatatggatctacaatagggaagtggttatccatcttcctttaattcttgtagaatgttgctttgccatgacttatttctgtttaggcacatcctgccatccagatggtctcagctctgaccccagcccacacctctctctgagcaccaacctcagatcccaactgtcaaccagatattttaatttggatctcctgctgtccttcaaatgcggcatgcctgaaataaacttcagttccaccgctccaccccttcccccaaagagacgcaacttcctaaatctgatttctaccaaaagtgccattactttactgtgattaatatgctggagtaatatttgactccctccctgaattcatctttcataggtgagctgatgcagatgtctaccatatttctcctctgcttttctgtgccagactgggttaaaatcatctcacacttacacaatcatttcatcttcctaagtagttccgcaaccctccctaccccattacgctcccctccaaatcactgtatgtaccagactcgtcttttaaaataacactgtagtgctatcaatgttctgctcacaaaagccttcactggctccacaaccccagaaaataagatcaaacctcctcaacaggcttctaagaccttctagaatgtagttgtccctacgaattcagccacatctacaattacttcccaatataaactctccactccaacccaggccattctcctccctgtccttctggcccctgacccttttcttccaggagaaccctaagttctgccttttaggtgtgtcattcaggactagacacagtcccagctctgccaccaaccagctgcctctcccagcttacaccatgtttttttccttctctgaacatggcagatcttcatgcctcatgtcttgtcataattcacatcataagccatctgtttcatgtaacatactagtgtctagtaacttcctttttcttctttggtacccaacctcctcctactaccatcaccgccaccactatcacaaggaatctagggttgtgcatataatagcaaatttaaaaatacctcatgaatcagattctatcaaaaaaagaagatggagaaagaggaaatcaaggaaacaaaataggaggagaaagagaaaatattgctatgttttctcttcgatgcttgggtatgctgtgtgctcatgctattgctcagatttatagactatttgaactgaaaggatcttaaaaatcactgggtccaataatataatgctgaatgtgaagacttattaaaaactagaaataacatatctggcccagaaaaaacaataaaagaaagatgagtatcatttaccagctgtgtgacttttagaatgtcacttgacctctctgttcctcagtttcctcatttttgaagtgtgaatgatgtaacacttattgaggagctaaatgagatgatgtaggtaaagcacatggccaatgccttaaacatggtaagtgcttagtacctgttaagaaaaagatccctgtccatgcttcgaaaacatgtaaatcaaaatttcttgaaggctggttataaataattaatttattgttaataataaactgtgagatcatttaatggggtgtttctatggtctgaatatttgtgtcaccccaaaattcataaattgaaacctaatccccaaagcgatgatattagaaggtggggcctttgggaggtgagtaggttatgagggctccacctagtgaatgagaaattaatgtccttaaaaaagaggcccgagagagctgccttccccttctgctatgtgaggacacacagtgggtgccatctatgaagaatgggccttcactggacaccatatctgccgaccccttgatcatgggctttccagcctccagaactgtgagcaataagtttctgttgtttataaattactcagtctaaggtattttgttatagcagcctaaatggattaagacagttgcttaatccatgtaagcatagctacatctgtacctatttctatgtctactttggatcataatataaaacgtatttctaactgtgggtcactgtcaaacaagtttgaaggccattggattattaaagtcctccactagtaaaaatggagcagcatgccaaaacctcatgtggaatgctaggtgctactttaagagcagttttaccttccatcttttctggaccttggttttccatcaacgcctcagtcctgctaatgttgtctttattgttcgtgcatctgacatgtaacccggaccactgttgccatactaattaatgtagagagaattcccttgcatggaggcctaaattctccacacctatggttaggtctagcatgtgtctttctccatcagatggaatgctcagaaaccttgaggaaagaggagagcttctgattttgaaagatgtttcagctggtaactctgtcttgcattttgcagtgattctgtcacccacatcgtagcagagaacaactcgggttcggatgttctggagtggcttcaagcacagaaagtacaagtcagctcacaaccagagctcctcgatgtctcctggctgatcgaatgcataagagcagggaaaccggtggaaatgacaggaaaacaccagcttgttgtaagtgtcatgggtgtgattttcactgttctttgcttgatggttaagaacataggcttaggatcaacggagctggggtaaaccctaaattctctgcttactacctgtgtgaccttgggcaagtcacttagctttactgagcttcagtctcttcctttataatatgacataacgataatgccagcctcacaaaatggtcatgaagattagaacaacacacatgtaaagcgctgaacacaatgtgttgactatagcaggcatctaacgagtggtcgctattttcccgaacacatttatacacaaatctttcaaaatatttaagccttgatattctagcagccagaaaagcaggagattcctttttttctctcactgtgatcattcagaaaacaaaacaaaacaaaacaaacaaaacaaaaagttaagctctcaattccaaatatttgagcaattgtgctaaaatctttgggaagagggcttggaccataactacagaagttcatagaaaacgaagatgatatttaattgataggtcttttcatttttttttctgatttcaaaaataatacgtgttgataatagcaagttcaaatattagagatgtatataacataaattttgagtctcctataattttatcctccaactacagacaactacttccaaattttttccgtacatatctgttattactattaatttttattgaaaatggatgcttatgcatttgtttaggtgagaagagactattcagatagcaccaacccaggccccccgaagactccaccaattgctgtacaaaagatctcccagtatgcgtgtcagagaagaaccactttaaacaactgtaaccagatattcacggtaacgggactttacatcaacacccagggcaaacgaagggcttgcagcttctttctgtggaccgcaaattaaattataaatttttctgaaaacctgggaaagttttcctcccacctacctgcagccctagcctgatctctgatccttctatccttcttctttctatcgagactgggtctccttccttcctggaaatagacaaatacatttaggttatattctttagagacagcggattactatttacagatagttgtcattaatgggcgcaacacttgtcaaaagcaaatattctgaaaaaacaaatactggaattagtccaaaacatagtaagagcaaattacatagaaatggtaacaatacatcaacagcttttgctgggaaaccaaaaaattgagcaaacctagattccagcctttctgatattcactagtttgggcaagtcaatttctctctctgagcctgtctcctcatctattcaaaaagaaattggatggatcatatctaaagctccactcagccctcagattggtaattgtgttttgaatggccctaaaacccacaactgcttgtctgctagcctagagtcagtggttagctggatgaaacatgtagtagtagatcaatacagagcttctcatttctagacttccagctccatgtctgtgttggaaagactaggaaattgtagctactggatatgctgagcatgagatcacacagctacagctgcttcctcccctgctagaaatacaaacgtgccctaccttaaataatcctggctctgggtctgtgtgacctacgactacactcattcattcaacaagcctgtgttaagtgctgtgtttcatggggctgctcagtgatcaaggcagaattctagccacaggctagtgggaagatagtacagaaggagggattatgctgagtcatgactagcaagatgctgtgagcaccaaagcattttttagttaaatcatctgtgaatgtttaatagcagtgtactccaagtttccgcataatgcactctggtacctgtcttttcaattcaactctactccatgacaccagagaggcatacaagggtatgggagaccccatcctgacctagaaggaaacacgcaagtggtattccaatatttaaaggagagcaagaggcgtttgtgagtgaccactggctcaggggcttggaagcaaatctcctgcttatctggttttatcctgcaggatgcctttgatatactggctgaaaactgtgagtttagagaaaatgaagactcctgtgtgacatttatgagagcagcttctgtattgaaatctctgccattcacaatcatcagtatgaaggacacagaaggaattccctgcctggggtccaaggtgaagggtatcatagaggtaagggtgaaatgggatttgtcccacttcccaataggtaggtgggaacgggggagagagggatgtagctaacagattttcctgtcaactatgtagatgtggtgtacatcacaaattttcctttatacatattcctctctctctcctctgtctctctctctctctctctctgtttatttttatacacatacacacacacatacacatatatatatgttaggggttgtgaatatcctagtcacatggcaccaaaatacgttagtggtggcaggtgtcagagttaccgatagtgaatccgttcgggtctgcagcaaccccaattattgcttccgcagaagaaagaattcgactggggggcataaggcagaaaaagagactgaggcaagtttcagagcaggagtggaagtttattaaaaagctttagagcaggaaagaaaggaaagtacacttggaagagacccaagtgggcaacttggaggacaagtgcagcgtttgaccttttgacttggggtatatgttggcatacttctggggtcctgcgtcacttttcccatgattcttcccttagggtgagccacccgcatgcacagtgccctccttgtgcttgggaggggagcatgtgcagtgtgtctactggagttgtatgcatgctcacctgaggcattcttcccttttccggtggaatgctccggaaagtcatactctgccattttgtctcttaatgtgcatgctcatgcccactcgcccaattcctgagattttaatggaagctgctgattaccaatttcaagtgtttttatctattgggaaattgcctctccctggcgccagttgtgactaatcattttatagggtgacaactgccagaccatcacggaattgcctctctctagcactggctgcaaccaattatcattttagagagacagtgtgataactcctggaccatcacctgatggtcgcctgacattcctggtttggaggggggagccctctcctgccctgctcatgcctgactagctacctactctaacatataaatagatacagacgtgttatttataatccataccctaatattatcacagctggagctacatggaaccagctagtagaagcagaactctcccatactgttattaatcacagtgaaagactcaagtggcctaaatcttgacagcagggaaatggtctgatttccctcagttccacctgggggcgccaccttagagcagtggtgcgtttgacatgaagtggaggtggttctacacctctccagggagagcgccagaggttgtgcttatttactgaacggtgtttagggattccccagcaaagcaagttggtcatctggtagtaagtttctgtatagtcaagtgcaaggtatattattcaaggacaattatcccaactctactcagaggaagggggctctgagctagacatcacaagggcttgaatgtagattggctttttggtgggtccaaaattaaccttgtcaatggaaaagtcttcttatttcagtaaggtcatattcattgaagagaaaattatcaccaatatttggacatacatttttcagtgaatattttggtttgggattctgtagatctggatcctaaccatttgtatctttgttcctaaggatcgtaaaggggtccttggatatatgatgagctagcattttcaagattgtagggaaatgtcttgttttctccagatcaattagggaaatacccctgcatgtgatgcatgcacatttcatgagaaaccaaactactaggtccatgaatttgagagtcttagacagtaattgtccaacatcactaatttaaaatatttttcaactgtccattaggagattattgaagatggagaaagttctgaagttaaagctgtgttaaatgatgaacgatatcaatccttcaaagtaagtgattttacatatatttattgaaaatggtttttcagttaatcttattacttattctggctggttgtattagtcagcttgggctgcaataacaaaatacagagatggcgtggcttaaacaacagaaatttattttctcaccattctggatcaagatgtcagcagggtcagtttctggtgagggttctctttctggcttcttcctgtgtcctcacatgctcccctgctcacatggtgagagagagacagagagaacaagcaatctttctggtgtcacaaagacactaatcctgggccgggcaccatagctcatgcctgtaatccaagcactttgggaggccaaggcgggtgcacttgaagccaggaattcgaccagcttggccaacatggtgaaaccccatcattttacaaaaatacaaaaattaggtgtggtgaggcatgcctgtaattccagctacttgggagattgagacatgagaatcacttgagtctgggaggcagaggttgcagtgagctgagatcacgccactgtactccagcctgggtgatagagtgagactgtctcaaaaacaagacaaacaaaaagacactaatcccatcatgagagccccactctcatgacctcaaaggccctgtcttaaatacggtcatactggggattaggacttcaacatacaaatgggttgggagggggaattccgtccatagctttggtctaggaagaaaatgcctaaataaattcaggtgcccagattattgccatgctgtcgtgatgtacaaattgccttaccctccaagagtctgtcactcatgggtacaaacatcatgggacatgaggaccatgggggggttggtggggacaggacggaactgctcttaaagagcagatttgtgtctgaaaatctccttactgcatcttcatttacttggaagcagggtttattacctcccaattttccctaccttagagttgcaagtggaagggacttccaccagttccttcaaagcaaaagtgatgtacaggcctaaaatatggccatgagcaggagcacaggcttggagtgtaaacagaccagggtttaagtttgggctgtgccacttcccacctgtatgatggtggagaaactatataacctacatgagcatctcttttcaaaatgtgagggtacctatgcagagcatgagtgtcggtgagagacccagcaaaagggagagccctatagagctagcgtatcactcatggacagcacaggcaggccgtcaattagactataccttagccctgcacaggtgccagaacctgcttgttacttctgtttcattttgtaatgccacatgtcaagaaaggactcacctgaaataaaaaatgcccttaaaaataaccatcacccacctgctcgttatattcaggagaaactaggtcaaagatttgcttatactttttcttcattgcctgagacctagaaagggtcatgactcggatgttataatgattatcttagagactgatggcatgcctttccctccattttagctctttacttctgtatttggagtggggctgaagacttctgagaagtggttcaggatgggtttcagaactctgagtaaagtaaggtcggacaaaagcctgaaatttacacgaatgcagaaagcaggtaaattgtctctcctaaaagtcattgttgctatgggctggtcgggtcgtggtggagctctaagtcagttacactgcaactccaatctgggagagctgggacacttctttgatgtccattgatgcttggatctaaatcctagctccagcagtttccagctgtgtgatcttgagcaagttggttaaaacctttgaaccttagttacctaatctatgaaagagagataacattgatacttagctgagaagtcaatcagttaatgcaggcaatgcctcagcactgtgtctgacacagagcaaaggcgccctccactgtggctgtttgtggtccttcacccaaatgtcaagccaggttgtgctgctgatctggtccttactgactcttccggacattgggtcctggctgtctccctgggtaagagttgtgggtgaagagtcaaagacagaagggttggctgctaagaatacttgaacagagttgttgcctggcacaaatgtgaagatgccctagaaactgtaaaacaccaggaaaatagaagggaactggtggaaatctaggcacagggttggtatacccaaccaggactctttagcctaagacaagaccgtggtgggacatgagtgctgtcatcacccacctgaaagcctggcagggcctctcagaggttgaaggtagcctggtcacttccatttatgaggctcccagtaagttttttaaaaatgaaggaatggcaatacagtgtgaaaaaaactgtgtgtttaaaaaaatgtttacttttaacaagcaataaaaatacaatacagttgtgattcaaaaaggagtcacagccatagtccctactcattttttgtaaagttgctaatctttgaaagattgctaataatacaatgccacataggaaataaaagagtctaagaaaaaaagatccagtatttatattccaggaccctgaaagcacacgtttaataaggatgatttacaccagttctcaagatgccattcaaaagaaatttaaataagtattaaacataagtagcaagtaaatggtttggaatgatgagtaaagactctcaatgcttagagagaaattgggaggcaatatagtgtttcatttggatgaaacccttatcaaatgacgtccagtgctctcaggatctaagggcttccaattccctagctttgtaaactggatttttgttcttcctgttgagcttttccaaccctttgaatgaaacagctttattcatttagtcaatcagtgatttccatctaactgtttaatgctaccagttctatgcagaaatcaaggaatgccctcccattatacttatacccccacaagtagttataggcaccccttggagcagcactacaatgaatggaattgccaatgggaatagcttagaatactgtgaagggtaagctaattgaacatattgaaaggacagttcatggtcagatggataacctgatccagttttactcatatttgcacttgattgcagttccctgaggcttgagcgtgcacatgccacgtttgccttgaaaagtcagtttatgaactatagcagcacatatttaaccttatactgtgtgataagtttcctgtaataagttagtcgccttgccataccaaaaaggaaagccaattaaattactttcatggatgtcaacaaatcatcatagtcttacatgttcattcctgatagctgcacatcttcttaaagaaatagttgtgaatcctgacttttggatcgtgtatatcactgcataagcacaggtgtttgtggttacccagtgagttgtactttgaatattagtcatgatgacagtttctgtattacagcctaatagagcattgcttcttagatcaaactcctcatgctcacaaaaatggccatgttgcaataatttttagaaatgtggctttttaataaaaataaaaaataagtatcatattgaaataaagaaagtagtgttccacaagtggcgtggtttggtattggacacagtttataggtgtattcatatgaataccattttctcttggtcttgccagcatgtttccgtgactgtccccattagagataacatgggaaatttggcagggtgtgcaagccaaatggccaccctgctgcctcccttccacaatcccagggtgagaaacaaggaccaatagatttactcttgtcatttcagagggccagtggcaggtgaaatcgcaaagaagtagacttaggcttttcaaaagaaagaactggcacaacagagtttacaattaggaaacaggctcctctggaggtatcagagttccccattattagagtcaagcaaagtttgaatggccccctcttggagaccctagataggagagcagcgatgctgaagcatgatttgatgtccctcaggctctatggatctaatcaccaggctcatctcctcaccaatacttcaccccaatccttggagataagcctcccttctcctttcctctttctttccaaatctccctccacactgctctgtgggaaccaccaagttagcttttcatcataacaactctgaactttcattaattcatgctggtcaggcaaagaagcaacaagctaaaccacctaagatatttcctgccttgcttcagacacacatctactctgctcctattcttgactttaattttttaatggatccatcaccttccaactctaaatctcctcatcccaaatctttatgcgttaccttttaaaaaacagtaggacacagcctattgatcaagaaggctggttcttcagtaggaagtcagatctgaacagtttggattccagagggatgtgaaatattgtctccttctcaggaaattgtaagcctctaggttagaaagcaaagaaccactgttaccctgaaaaattcacaaccaggagaaccacatggactattctgtctctgtgggaatggagtttggtgttgatgcctgtagtcatgttagctctatcgtggggacagaatccccttctactgagggctggttgtttcacacacgtgtcactctctccattgacctgtcaaatggcctctcaggatttctgtattatgaagaccttgtcagctgtgtgaccagggcagaagcagaggccgtcagtgtgctggttaaagaggctgtctgggcatttcttccggatgctttcgtcaccatgacaggagggttccggaggtaaataacttgggtggctttgcctcctctgcccgaatacttcagtggctccctgacttggacaggcatctgaaacggcacaaaaggctgtgatctggtgccagcttctttctacagctttatctcctgcctctcacatttcatttcagcaaccccaaatggcttgtcatcccctgcacattcagagctgtttcttgcctgttgctttgcttactcagacttttctgctttgactgccattcctcaaattgtcgcttggctgacttcccctcattctttaacactcaatttagatggcaccttctccagaaagccttccttgactccctctttctccatgctggattagtgcccctcttccatgctccctgagtacctgcaaagcccttgatccacatagttacagtgatttgttcctgtgtgtggtttctccactaagtttgtagagcttagttctcagcaagactagttcatgatgcctagcacaaagtaggtgctcaagaaatcttggttgagtcaataaatgactgactgaatgaattcatgaatgagtgaacgcttcacaaggatgtatgttgttgttggatattgaggcctgcatttcagaaagggatttctttcctcccacagcctcctctacctctttctccagccctctcacctggtggcttttggccatcctaacaaaataggtttggggcaaggaagaaagtaagagaagatcaaatctaagataatgcctttactccatgtcataattccaagagcgctaccttgtattatgtgaatacaattcttagtttgcttgttgtcatgcttgtctccatgtgtgtatgtgtgggtgcatgtaggtttgtgtgagtgtgtagaataaataatttttttgttattttttgccttgatatacataatcagatacatgctatgtatgactttttctgtgtcataaatttattttgtaaggaacagcgatgtgtaaccaaggatattttgtttcttaaaaaaaagtcaagaaccttctatgttgcaaatcttaagcatagggcatagaaacaaaggtgattttttaaaaatgaagactaatatctaattgatttccattttatactgcttttgaaaattaggggtaagaagatggggcatgatgtagattttttaattaccagcccaggatcaacagaggatgaagagcaacttttacagaaagtgatgaacttatgggaaaagaaggtgagaagaaagatgaaaaatacatgcacacgcaaacattatgttaacacttgaattttgcacattacttgccttataattgtgtaatgaccatctaatcaattctcaattatttgtggcagcttatacaaagccatatgacctacaataagactttcctgttttgggtcctagagtacatgttatgaatatgtcctgtatcttgtttattatacttaccctattgccaacagggccaagggtggctatgcatttgtgtttgacatgcagaggcattaaagcacccaatcaaagtgaaaagtatgcactatgaagacctgggaaatgtaagctggaaagctgcaagcttgggtgagggggcaggactgcaaagactgggataaaatcagtctaagaggtgttgatagtgcctcgatagattcgaggcacttcgtgctgagatggaatgaaggaaactaatgagggcaagctgagccctgcagaggtcatggctcagaagcccccatacattgcagagatcagacttgtgacaggcctattgcctggtggaggaaaccaaagtaagctaagctaaccctgcagccagagccacatgcaagccctgactcctgtccaactctagtgagagcctcacttcctagagagaccagagggtcctacccttgggacctgtagataggtctggctgggctggtgtttctcctcacagcttcctccttcctgagtagtttgcatctgtttggtgtggaccaagcttactgatatcccagaaaaggaaaacctcagataaagtgaaaataaaagctagaaacacaaccctagggccaggggcactggaagtgaagactcaactttagaaccagatccaaactgacacgagtttgaatactgggcgtcgagtcttcccagaaggagttggagggaattagaagcgaagggcagggaagggatcctggctagagagcctcacactcagccttgcaaccctcctcagaaggcacctgagactaaatttggacggagccttcctgtgggaggtcaagctgagtgcatctccctcctgccccacagctctcttcctgagaactggccgctctgtaccctggggaggatgggaaggatggagaggtggggaaatgcctcctcctagtcaggagtttctcagtgtccagtaggaaaaataaaagaacatgctgatgtcaatattcagtcaaccagtgggtattgatggggaagccagagcccagagggctgccctgtagatagccggggctggagatctagaggtggcatcaggggttgtgtgcatgtttgacaactgtggcctgctgcagacaaccttctgaatatgcagacaggagcattacgttcaaggatgcattctcaaacaccttgcaaaattcaagacaaaacccaataaagaatggcccatttctctcttacccaccaagtgactgtttactgttaggaatccagctttgtgggctttttttttttttttaagggaaggtgtgttattacaaatttggctttcatgtgagacttgttcatatgttttatatctcctttttcaaatttacataattgaaatttacacaaaaggctgctattctgtactagtttcagcaagtttccttaaaaagtggaattgtattttccggagctggtgattcgaggttaactacggcaacatctaccacctcctccagaggttcttcctaacattagtgcttcccccttcaaatggtgttttttcttcaaggcgttgaagggtgaagagttccctctattgaggtcaacaaaataaaaagtatctttttgaattgagataatgtcttgtgcaggtttgtagaagaaagacaaagcatgattcctaacaataatcaatttaccaatgatgctcaaagtgtggtccctggtccgggaacaccagcattgcctgggaacctgtcagaaatgccctccctgcccctcctgcatcactctggggacagagccctgcaaactgagctttagcaaaccttccaattgcttctgatgatagcgcttttaaacatctaacctaaagagtacatggtaacaaatcacacatcccagtagcttgatgacattatttgagggttacttgctgtttttgttgccagatttagtggttgctagcacgtttctctctcctgtccccacatctgccctgtgccatcaggaactcccaccaagaatggcaactcgattgggcacatcttagaatcacttgtccactttctggataggcaactttaagtgaaacatgtgtcattaactttatcccactttctccaaggcaggtggactaacactctcatgagaaagagtctcccaagtgctacctagaaatagcaagtcatcttgccccaaagttagactcagcctccagccacaacgcttttggctggttaaacctggtcatcagtataatatgaagggacactgtctttgtccatttaccttgctataaaggaacacctgaggctcggtaatttataaagaaaagacgtttacttggcccatggttctgcaggatgtataagaagcacgacaccaagcatctgcttctggtgcggcctcagggggcttacactcatggcagaaggcaaggaagagctggcaggtgccgaggtcacagggtgagagagaaagcaagacagagtggggaggggccaggctctttgtaacccccagctttcacgggagctaacaaagtgagaactcactcattaccatgaggatgaggacggcacaagtcattcatgagagatcttcccctatgacccaaagacctcccattaggccccacctccaacattggggatcaaatttctacgtgagatttagggggacaaacatccaaactatagcagacactaactcaaagctgctccccagaaacaatatgattttttaagttttattatttatttatttctgagacagggtcttgctctgtctcccaggctagtgtgcactggtgtgattacagcttactgaagcctcaacctcccaggctccagggatccttccacctcagcctcctgagtagctgggactatagacacgtgccatcatacctggctaattttaaaattttatgtagaaatgaggtcttattatgtcacccaggctggtctcaaattcctgcagcgtggctttttgtttatggttggtttgtttttaaaggactgaggagagcccagagcactagctgaggttcagaagtggagagggagattttcttgcagttttgccattaagtggctttgcttcagcctctctcatcgctaaattccttttccgtaaagggaagataatgcaaccactttcttagtgttttctcctagtgtttgcaggtgggcctttaatgcaaggccaaacacatgtccatgttctgctcgaatctgaaaagatttcattaagaatccagtgttaaatcatagatcttcttcatcagggccttttcctgatgccattctgtttcttttcagggattacttttatattatgaccttgtggagtcaacatttgaaaagctcaggttgcctagcaggaaggttgatgctttggatcattttcaaaagtgctttctgattttcaaattgcctcgtcaaagagtggacagtgaccagtccagctggcaggaaggaaagacctggaaggccatccgtgtggatttagttctgtgcccctacgagcgtcgtgcctttgccctgttgggatggactggctcccgggtaagtgctacatggacccatgggatgatgttagctttctgaaagacgtaggccgagtctacctgggcccaggggagagatgacggcaacaggggctgggtgacaggggaggggccagtacccagaaacctctaactcaaggcatcctgtccacacatggccaagtatgacagattaatttagaacagttattcccagtgtgtggtccccaacaccagcagcagcaaccttacccaggaacaggttagacatggaaattcttcaccccactccaaacctatggaatcaaatcagcatctctggggatttcagcccagaaatttgtttggaaaaggcttctaggtgtttctgatgcagctcaagtaggagaaccactgaagtacagaaaccagcaaggggattgaaataggaaacaattaataaagtggagaggcaactcacagattgggaaaaaatatctgcacatcatacatcacataagggccattatccagcatatacaaggaaaccaaaagactcaataacaagaaaacaaataatcctatttaaaaatgggcaaaggacttgaatagatatttctcaaaagaagacatataaatggcaagcagatattgccatcttgcttaacatctctaatcatcagagaaatgcaaattaaaaccacaataagatgttatctcacatccgtcagattggctattatcaaaaacatgaaagacagcaggtgttagtgaggctgtggagaaaagggaaccctcttgtattgttggtggtgttgtaaattacacattttggaaaatagtatggaagttcctcaaaaaactaaaaacagggctaccatatgatccagcaatcttacttctgggtatatagccaaaggaaatgaactcagtatgtcaaagagaggtctgcactcccgtgttcattgcagcatgatacaccatagccaagatattatataaaaacaacctaagcatccacagcagatgaatggatttttaaaatgtagtatatgcacagtggagtatgacacagcctttcgaaaacaggacattctgtcatttgagacaacatggttgaacctagaggacattatgttaagtggaataagtcaggcacagagagacaaatactgtatgatctcgtttctgtatatgtagaatctaaaacagtcaaactcgtagaagtacagaatagaatgtagaatggtggttagcagaggctgggggatgaggacagaaaatggacagggaaaagggtcaacaagtacaaagttccagtcagacaggtggaataaactctgttctattgcacagtatggtgactatagttaataaaagtgtatatttcaaagtagctaaaagagaggatttttaatgttcttaccacaaagaaatggtagatgtttgaggtgatggacatgctaattagtctgattttatcattctgcaatgtatatagatgtatcaaaataccatattataacccacaaatgcatacaattattatatgttaattaaaaataaaatcaagctataaaatttttctgaaagagcacaagttgagttcatcccagacctggttgcaagctcctgctctgcttcttgctgttgggtgatcttggacaagttccctatatcctgtaaaactcaattttcccgtcaggaaaatgaggacgatgaccttagctacttccctgagttgcagagacattaggtgacatgatgttctcaaagcctcagcaccaagccagcacgtggccagtactggataagtagtagcttccatatcctgtcactcacaggagaggacacctgtgatttgagtcccattcgcatgtgttccaccctcccaactaaacacctcaccctgtttctcctgttttcccaggtagctggttgttgctttgagtgaaatgggttcgtagagggttttttatacagatgaatgacacaacacaaattaattgttctcagccgtgggttaaatgtcaggtgtctttgctttggactggaattaattcagcacagcatcttagcactgggatttcttactctaatcacaaatgttgactgacaactaaatgcttttttcattcctaaaaaaaggggaagaaaagaaaaaatataccataaatgcaacttgtctgatagacataaatctttgggaacacatagttgattgagaaaggggaacgttccagaaagaagtccttggttatgcaatgtcatgccagttaagcatcactggctgaagtggttgacatttgcccattttatttttaagatggacatgttttcaacacattctagtctgtttcctcagagtactcagaaattgttgctgttggttctgcaaggcactggcagagcactaagctcttttgctttttagctgggtgactttaaacaaataaaggacttctgattgcaaagtccatctcctcaaccatcccgggtgagctttcctaaaatagcaaattgttccttaccactagagggcaccagtatcccaggcttgctccctactcccacatgaagaggacaaaatttctagattgtgtttctctcaggaaaactagtctccatgacaattcgttgccctcctttcccaaggtgttcctgtcctctgtcttaggcttcatgtattgctcccttcagtctcagagcccattcctgactgtgggagatgtcatccaggagcagttgacttagacgatcagtttcatggcatctcagtgtgaaaggatgttaaagccagagggagtcttaatcatgtccttcctccatcctttcattcactcaaccaagactcagggagtctggatgacttgacaggagatgcacagccaggtagggacaaagtccaggctggaacgggttccctgactcctccatcctcttttacaataacaatattccaaatcatgtaacacccaccaaactagtatttatccagcatttactctggaccaggcattatcctggtagaacgctcacgctattcatttattcattcaataaaacatttgctatacatcttctacatgcgaggcactatttgagggaatacagttgtggacagaacaaaccaggttcctgctctcacagagcttacattctagtgtgttcatgggagcacggacttctgtcaccagagaatttggccctgggggaggaaaatcactttgagaatgtttagtggagttacatatttcactagagggatgtagccacctaatactgaagacattctagacgtgttaataatttattttaactatctcctatccagcagtttgagagagacctccggcgctatgccacacatgagcggaagatgattctggataaccatgctttatatgacaagaccaaggtacagttctcttcctaaaaggggctactttgatcctcatccccaaggctggcccccgagctcttttcatggactgattttagtatccaggtatggtttcctttgtcatgcgtgttctatttccagttcatcatagttgagggcagcaagaaagatttccacagactcgcagtttccacccggcccagaatgcaattcgagagattttggctgaaacatgatgagctaattgggcttccagaacaagtccagcagtgaacattaactgggtttggtatatcctcggtgttggcaatgagtaactccaaagtaaaccagggatccccagaaatcacaaatactacttgtgtacccctcaaatgcagggggcagtggcattttgagtggccatgtaggccattaacaacagtctcctgcaagaaagagagcaacagagctgccctgagacataaatgagcatccagctagtctcattgactacccatgtcactcatttggtgtgctagtcttactgtggtcatgatccaattcatccctcagcaaaacgatagatgcctgtagaagttagaagagttaaatatccaactgttaaatccacagttctaagggctactcttcttacagatatcaaggacaccaaaataggctccatggggaagaaaactcaaaataactagaagtaatggtagtggccaggcgcagtggctcacgtctgtaatcccagcactttgggaggccgaggcgggtggatcacttgaggtcaggagttcaagatcagccaacatggtgaaaccccatctctactaaaaatacaaaaaataaccaggtgtggcggctcgcacacacccagctacttgggaggctgaggcaggagaatcacttgaacccgggaggcagaggctgcagtgagccgagatcacaccactgcactccagcctgggcaacagagtgagactctgtgtcaggaaaaaaaaaaaaaaaaaaagtaatgatcatttccctctaggagcttgtagtctaaatgagatgtattcagttagagttgtctcagttacaaatgttagaaatcaaatctaaagtggcataaacaaaaaagggaacttgggttatatactgcaatgtcgaagcgttcaggggcagccgaatatgggtgctcaggcaggcttccctcagtattgcctttattctcaggcaggtttccccataagtcccactcttccagctacttcaacagagaagagcctgtttcctaatagttcccccaagaatcctacctgatgctcattggccaggcctgggtcatgtgcctatccctgaacccattactgtggctctgattggccagacttgggtcatgtgctgcttcttggaattgggagcagctgcacctaaccctcctggactgagagtcaagaggagtggtttcccatagaaaaatccaggtgctgctcacagaagagggggctgtggatgctggcaggaaagcctcggatgctaagcatgtgggtgaaggcagattcacatagtacaatgaaggaacacttacaaattaatacattctaaatagttcaatgtaagcaagtaccttctatgtgcctagcaccgtgctatgtacaagaagggatggaggagaagagctgcttggtcttaaagagatcacagagtgggatcctgctggggttagaggcaagcatggaaagctaaggaaaacccaacacatacaagtatcctataattaccagcagtacaaaattataactgcatgttagaattacccagtgcgttcagatagattgattataagatctctcctgagcttctgatttcactggactggggtatggctcaagcttcaatgtttattttttaaactccatcaggttgttctaataaacagctgtggttcagaactacagcccgtaggaaaaatatccaaatggcttttgctgaatatgttaaagctgttatgattttactttaattcatttagtaccatgttttggaaagtcagttaaaatgactttttatactcagaagcagggaattatgtttgggctgtaattcattctgacaaggcaattttataagtaacactttcactgtgtccacaccatggtgcttatgaaaaatatctgaatgcacatatttcttgttatgttttcagaggatattcctcaaagcagaaagtgaagaagaaatttttgcgcatctgggattggattatattgaaccgtgggaaagaaatgcctaggaaagtgttgtcaacatttttttcctattcttttcaagttaaataaattatgcttcatattagtaaaagatgccataggagagtttggggttatttaggtcttattgaaatgcagattgctactagaaataaataactttggaaacatgggaaggtgccactggtaatgggtaaggttctaataggccatgtttatgactgttgcatagaattcacaatgcatttttcaagagaaatgatgttgtcactggtggctcattcagggaagctcatcaaagcccactttgttcgcagtgtagctgaaatactgtctatctctaataaaaacaggaggaaacaagatgatggaatctgtttttcttcactcaaatattataaactattttaaaacacaagtgtaaccaagtggaagaataaagagcttacagtttgtcttaaggggacaaacaggtttaattagaagatgcagagattccagaggggatttgggtccgttctggagcttgtggaggaggggtgctgcctctggactggctcagctcggctcagtgcctgctccttcccggccatcatacagctggttccctaagcatcccagcacaggaccacataaaggatgtattctccctgccatcgtgctgaaggaaagacaatgtcctaaaccatcaaagaaatatctccctcttttttccatcttggagcttctgtctacaccttatggctcagtctctctcaggaagtcagtctctcttggcttcttatctgagggcacccaagggaagggagggagccctggctgagggaaattttggaactcccaggctccagacccattctttcctcctgcctcctccaggaggcatagaccctttgccttgaagggagttaacaggtcatctgttccagctgcttccgtgtcttcagcctgctaaagagctgggaggcccatgacgaccgttttcccttccttccagtccctctgggaagaggatattgggagatacaataccttttggctattgtgactaatgctgctgtgaacattggcctacaagtatctgtttgagtccctgctttcaatccttttggtagggacctagtaataaaattgctagattcaatggctattctatactatgtttaactctttgtggaaccactgtactgttttccataacaactgcaccgtattacattcttaaccaacagtgcgcaagcgttccaatttctccacatcctcaacacttgttatcttctgcattatctgttttataatagctgtcttaatgggtgtgaagtggcgggtgaaaacttttgcccatcctggaacccaaagacagtccaggctgaaactaacacactgaaagggcctcagatggtgtgtgtgcctgtcacatcttgagttgatggctaaaaaaagctggggacaacaagagggtggacagcagccacccccactggcctcaaatcccaaaatccacaaagtattctagtcttttctgctgcccagtgtttcccagttatgacattcaagattattctaggtagtaagtagatgaatattttcatactgatataatcaataaatatttattgggtgcttaccatgtcagtcatttttctaggcacagggcatagaaaagataacaaaactgtcaaaaatctctgcctgtatgattataagcataaagcttatgttctagaaaggtgtttatttgtgttcgaaaggtgttaagaaaatggttccttattgatggtagtgatataaagcttcctttttggaataggtttatttatataagaaaagcgactcaaggtcagggaaatcatttaggaaatattaccagtgaaatgggggagtggcaagaatgaggagagagggacgcaggtggctgacatttgggaaatgtgcaggtggccttgtcgccttcactgagcaactccccagccctgttctctggaggtccccaccacacaatagccccaggaggtccatgccagaggagtttccccatcagagaacctcacagattctaaatgctactttccttatttgaaaaggcctgttggagattccacaaatgccatgtcttttttttcttttttgctgtaagccagaatttttatcagttctggacatgttttttttttttttttttttttttttttgccgtaggccagaatttttttcaattattgtggtgactagttaccagaactcagccttcgcctgtgcctcctactttggcagcagagcgccctctgatggctgacagaagaatccttggaggcaagcacagtatgatatagcagatcaagtaggaagcagattatctgttaaaaacattggaactatatgtaagaagccatggatcaccgatgctctatttgttcacttttttcccagccttttaaatctgtgttttatttggggtagtttttattgctgtatcttcaagtttactaatcttttcttctgcaatgtctagtttcattaaacctctccagtattttatctcacacattatagttttcatctttagatgtatgatttagtttttaaaaactatcttccatgcttctatttaacatattcaatttttcctctagcttattaaatacatggaatatagtgtaactgtttcaatgtccttgtctactaatgatatcatctgtgtcaattttgagtcagtttctattaactgagtattctcctcattatgggtcacattttcctccctctttgcaagcttggtaattttatattggattctagacattgtgaacattgtgaattttttcctggatatttttgtattcctgttaatattcttaaactttgttccaggatgtggttaatttacttggaaacagtttgatgtgtcctcatcttgcttttgagctttgttaggcaggactcatcttacttttgagctttgttaggcagcactaacgtagtctaatccagggttaatattcttccccactactgaggcaatacttttctcagtgttctgcctgatgcctggtgaattatggtgttttctactctggctgtttgggaacaggcacggtttgtggcctcccactgagaggcctggcccattagagcttagggtattgttccctctaatccctttgtgtggttctttctccagccttgggtagttttctcacatgcatatgctgatcaatggaataatcaagaggtctcctctgtctctgtgcaactctttctccagtactctgccctgcaaattctattcaccttggcctccatggacttccagctctatctcactaacagcatgtgcaaaagccatgtggtgcaaggaccatggtgtcagagaaaaggcccacgtggcaggagggccatggcataaaatgagcagagagaaagctcttgcagctggaggttcccacgtgtctgagttgcagagagaaagcctatgtttgtggacagaccatggcatctgaagggcagagaggaggcctaagtggttggggaatagaaactagaagaggtgggacacaagactaggctttccccagctctcaaaacaaagacccatatccttaccttggctttcataagtgggtaatccctggccaggtgagtcaacagtaatcactgtttgactcttcatgacaaaatcagtcacatttatggtagaattttgtcaacatggtttgttctcgctcacaatcaaatctttcaaatcattttagcctggaaatgaaagtctatgataaactgattctctttcattataaatcagattttaagccccaggttacactcaccctgtcctccagaggcccccttcagttttagaaatagttctacagcctattggacaaactcggccaacttccaaaatgttccccagtctcacctgtccagttttagtatttttcaccccttaacttattggagttcaggtagcctctctataggatggaggagagaggtttttttctgagttttacttggaggtacagcactttaatgtatgccctgacataaccagacatttcagccatttggaattctcagaggattgaagtgctatgcccatttctccttctcctctaacttcaggtaaaggaaaaagaagaagagtatagattcttatcttatttgagcccgagagagatagttttatgtctttgagcttagaggcaaagcacctgtataaaagctttcctgatattatttccttggatggagattcacattcaattgggtagagaaacgtttccacaaacacccagtttagcattttcattatgcccccaacattgtcttaggacctggcagattgtctgacattggaaggaagccagtgcacatttgttaaatcaattcacgcattaagcaataattctcatcaagatggtgggagggcaaaggttatatgacttcacaatctttcaaaaattagttatcactttttggtcttcaattaacatcgcaatgttgcagggaaaaacgccttaagcaaaactaataattgttatttcttggcaaaataaagaagaagtgagtatctgtctccaccagcaaagtcaggaactgagaagaatcatagagggtatagaaggctgtgctgatgggagtgaggaacaggcaggcagaaggagtgctttgcagggtttggggaaaatcaaagtagaatgtttggactggatggatgtaactttatagataaaccaattcaaacaccagatgatacaggaggaaatgagacccacacacatcgtgcaacctgactaaggtcacttaacttaccagcagccctgggttagggaagcagagcttctgactttgggtctcatcattttgcttaccacacagagctgccctccatgaaagactgaatgtcttctagcctggcagagaaagtgccaatatcgggaatatccctgggataatcttggttccagggacagagccaatgttctctaatataggcaaagaaaagccacaaacattttgtaggttcataagaatggccattttacttttcacttcattccaacataagttcttgtgtatcatagcagaagtaaatgacagaaatgctgaacctttctagtttaatagaaacaatgtttaaatattctaagccgtggattataagtagaattaaaataagtgatccaaaacacaagtcatccctcactttatagctacatggcttagtcacatgcatatttcaatccagccttacaaccaccccatgggctaaaaggatggaggatgagaactgctgtctccactttacaagtacagaactgaggctctggatgatcaacaatcggcccaagggctgacacctataagtatcaaagccaaggccacggctgagttctcagtaaatccaaggtccttcatgacatgtaggaggaagtacaagcaccaggatgactgggaatgtctgtttaaaaatggctaaatctgcttgtttaaggtaattagatccagaggacttggcacaaaactgagtttcaaaaggggctttgaagagcaggtattgacatgtggcagagattgggttcatagaacatgttcttggttattcagggaagaggggcatgtttctgagtaatcagaagccctgtgtgagaaaggaatattttctaggatatctgtgtggctcatggagctgctggatgaacttaagatgccctggacccaggccttcccactgggaggcctggcctgctagagggcaatggctatacatgggggaaccaggctgcctggaagcctcctcatgggagtgaaagtgaaagcctgtcccaagctggctgaatggcaggcacgttgctccttggcccattcctgtggtcctgtctccatccccttgggtcctcttgatttttctttctgccaaacagctttcccctagatatccaaggacttggttcttttctccaagtagacttggttctactccacagagtagatacagccctcatttctaataatcttttggaaaaactcttgccttccccgcggccccccatctttactttcaacacacacacagtccgtcgcagaactgccctccttaaatactctctgattacagacacaagtaggagcaatgaatgatgtgtctcctaggccaggtgtgtggtagggtagctgacacatgttagaaggaagtctgcccaaagacacagaggaaatgaaactcatattgaaggcaaaagaagagtacagaagaaaaaaaaaaaatggctggggatggattggaaaatgggaagaggagttactgggataagagaaagctggagggtggcctctcctggagtaatccacccaaaataaggcaacctggttatagtttgcccaataggctcaatgggccaacaccacttgaagtagcctctccttttccatttggcctccttggagacagtcctcagcaagctgaagcggcaatgctatgcgtgggcttaagggctcttgtttaatctgaagcctttaaaaaataaaataaaagaagttgtaactttaacaactatccctaaagcacaaaagttaaagttatttgaggaactgccatcagaggtatcataatgtcttactttaaaaattaagcaaaatgtttcattgtaaagacaaagtgttgttttaatatgaaacatgaatttccatcaacattaacatctttaaggttaaatgtaacaccaccagtctctgtatttggaattcggaacttgtaagaaactgccttttcctgattcatatgaggacacgatcacacctagattggaagattcacatactaccagcaacacctagaatcatctttagataacaatttggatcataggccatggagaaagtttgtcctaaatgttcccttgtgtggccctgtgactatggggaacaaatgctggtgattagctgttttatcaggcaagcaatatgggaagaggtaggaagaaggtggtagagagagagaactaacattttgactggcaactaagtagcagacacttccctttatttcttatttaatcttttcaattatgacatgaggcaaatatttcccctcctttaaaaaagcaaaaactgaggcttgaaaatgttaaacaacttctccaaagtcgtacagctgctcagtggtaggtgtgacttaagagtccgtattctttccactgctgtgtgacatgattgagccaggtgcttccctgtggtcagggaatgtgtggctccacatggttcctaccctgagatattcagaaacaattaactgcttcctctcacacatcctgcataagtttcatttgtatcccaacttgcaccaggctgacctcagcaacacttccatgaaagtcagatctgatggcttttttgagaaaaaggatatgaaaaaaaaagatgagaaggcaagacactcagaaaccaagcccctttcccaaaatgacaaagaaaagcaaattcccactgggagcaggaataggatctaaggaccccatctggtgagtcacatgtactaactaaagcacaagatctgagagttggaattaaccatgttggggatgtcccctaaagagacaaatcagccccaaagtgttccagagctgtaaatgaaatttggattgattaagaagcagcttggcatctttcctctccaagtacaaaaccctgggttttcaaccctgttccagtgccaggtctgctgctccttgactgagctgcatcattccaggctcagtctgggcacaagccaccacaatcccctccttctttccatttctatagtaggacggtaacggtcatgcacaggttcctcgcttcctgctacagtcttcacatatatgtgggcctcttgtgctcccatcgtattcttctcatgtgtgggtgatctcctaggattcttaaggaaacaaataggttttttaaaaactacagcagagaattctttcatacaagatggactaacagcaaccacattgaccctcccacctgaaataaccaaaatcagacacaacatttgaagcaatagttttcaagacactagacaacaggcaaggagggacaatggtcctggagagacagaaaacaaatgaggagagacccacaattacctgatcttactgctttgggagagctttcaggccactcaactatcttttgtttattgttaacaaagtttctcattttttgtcttttaactgttaatctatttgtgtatttatatttaaagtgagttttgtaggcatcatatgattggaccttgtttttatagccaatgtgaaatctcttcctgttaattcgggtatctagaccatttacatttaatgtgatcattgatatggttgggtttaaatctaccatcttgctatttgttttctgtttgttctacctgtttgttgtgtctttttaactctttttctactttatttcatatagattttagaagaacctcattaagttccatgaaaaaaattgattgggatttatattgaaattacatctgttatatagatcaacattgtttgacatcgttatgttattaacactttctatccaggagcatagtatgcaacccccattatttaggtattatttaatgggttttttaaccaaagttttattattttccataaaggtattacatatttttgttagatttattccatagcattctacatattttaataccaattaccatcacaaatggtaatttttaaaatcactttttctaattgttgttgatgttgaaagtataaattacttttatatattgatttttgtatccagtaaacttgttaaaatttcttgttaattcaagtaatttttctgtagatttagcttttcttttctttctttctttcttcctttctttcttttttttttctttttttaagatgaagtctcactcttgtcccccaggctggagtgtgatggtgtgatctcagctcactgcaacctctgcctcccaggttcaagtgattctcctgcttcagccccccacgaagtagctgggattacaggcacctgccaccacacctggctaacttttgtgtttttagtagagatggggttcaccatgttggccaggctggtctagaactcctgacctcaggtgatccacctgccttggcctcccaaagtgctgagattacaggcgtgagccaccgcacccagccagatttagcttttctatgtcgacaatcataccatctgcaaataatgacaattttgtttcttccttttcagtgttacactttctaatttttttttttgagatggagtcttgctcttgtcacccggctggagtgcagtggtgcgatctcagctcactgcaacctccacctaccaggttcaagcgattctcttccctcagcctcccgagtagctgggattacagacgaccgccaccacacccagctaattttttgtatttttagtagacacagggtttcaccatgttggccaggctggtctcaaactcctgacctcagatgattcacccgcctcagcctcccaaaatgctgggattacaggcgtgagccactgcaccggacctatactttctaatttttaaaaatcctacttcattgactaggatctaaagtataatattgaatagaagtggtgttagtgaagatccttgttttatttctgatctaaagagaatgctttcaacattttactgttaggtatgatgttagctgtaattttttgaaaaagacatctttcaagtcaaggaagttcccattctatttttaatttgctgagagttcatatcactgttaagtttttttgaactttcttcccctattgagatggtcacatgagttttccattttagtttgtcagtaaaataaattatattaaattgattgtctaatattaaagggagcttgaatttctgttcagccaataaaaatgcactgagaacctcctttgtgcttgagcttcctcttggtcatctcttttctacatgtgctcatactgtgcttcttttggtga

SEQ ID NO: 1155 - DNA, 1533 bp, Homo sapiens
atggatccaccacgagcgtcccacttgagccctcggaagaagagaccccggcagacgggtgccttgatggcctcctctcctcaagacatcaaatttcaagatttggtcgtcttcattttggagaagaaaatgggaaccacccgcagagcgttcctcatggagctggcccgcaggaaagggttcagggttgaaaatgagctcagtgattctgtcacccacattgtagcagagaacaactcgggttcggatgttctggagtggcttcaagcacagaaagtacaagtcagctcacaaccagagctcctcgatgtctcctggctgatcgaatgcataggagcagggaaaccggtggaaatgacaggaaaacaccagcttgttgtgagaagagactattcagatagcaccaacccaggccccccgaagactccaccaattgctgtacaaaagatctcccagtatgcgtgtcagagaagaaccactttaaacaactgtaaccagatattcacggatgcctttgatatactggctgaaaactgtgagtttagagaaaatgaagactcctgtgtgacatttatgagagcagcttctgtattgaaatctctgccattcacaatcatcagtatgaaggacacagaaggaattccctgcctggggtccaaggtgaagggtatcatagaggagattattgaagatggagaaagttctgaagttaaagctgtgttaaatgatgaacgatatcaatccttcaaactctttacttctgtatttggagtggggctgaagacttctgagaagtggttcaggatgggtttcagaactctgagtaaagtaaggtcggacaaaagcctgaaatttacacgaatgcagaaagcaggatttctgtattatgaagaccttgtcagctgtgtgaccagggcagaagcagaggccgtcagtgtgctggttaaagaggctgtctgggcatttcttccggatgctttcgtcaccatgacaggagggttccggaggggtaagaagatggggcatgatgtagattttttaattaccagcccaggatcaacagaggatgaagagcaacttttacagaaagtgatgaacttatgggaaaagaagggattacttttatattatgaccttgtggagtcaacatttgaaaagctcaggttgcctagcaggaaggttgatgctttggatcattttcaaaagtgctttctgattttcaaattgcctcgtcaaagagtggacagtgaccagtccagctggcaggaaggaaagacctggaaggccatccgtgtggatttagttctgtgcccctacgagcgtcgtgcctttgccctgttgggatggactggctcccctcggcagtttgagagagacctccggcgctatgccacacatgagcggaagatgattctggataaccatgctttatatgacaagaccaagaggatattcctcaaagcagaaagtgaagaagaaatttttgcgcatctgggattggattatattgaaccgtgggaaagaaatgcctag

SEQ ID NO: 1156 - DNA, 1533 bp, Homo sapiens; identical to SEQ ID NO: 1155

SEQ ID NO: 1157 - DNA, 87977 bp, Mus musculus
  misc_feature (2001)..(2048): "n" at positions 2001 thru 2048 can be any base
  misc_feature (6720)..(7498): "n" at positions 6720 thru 7498 can be any base
  misc_feature (8834)..(8882): "n" at positions 8834 thru 8882 can be any base
  misc_feature (16167)..(16186): "n" at positions 16167 thru 16186 can be any base
  misc_feature (24443)..(24580): "n" at positions 24443 thru 24580 can be any base
  misc_feature (28778)..(28871): "n" at positions 28778 thru 28871 can be any base
  misc_feature (45952)..(46750): "n" at positions 45952 thru 46750 can be any base
tttagataattttctgttgtatcacattttccactggtaaatttggagcaaataaaattccacaagatggctccctttgacctaatggggggaaaaatgtttaatttatcatcctttaagagacatggaaatgagtagttgaccttttgtaagcttatgtgagacactctaaaaagtgccccagtgttcttaatggaaactagaggaagccatcgaccccctagtgcgagccccacttttagcctggaaaaaaaaagtggccttttctcccttgtttgtgctgagttttgggtagagtagaaaactaaagtgatagagacctttcataaaaacagataaactgtgtctctcgcttcatcaaatgaaagccagcggctacgtatctcaggtcccggaagccaaggttggcagttaatttgtaaaacatggtttggaaagttcaagttcttctccaaccgagagtgcgccagtgctttatcatgacgttatatgtgaggttatatgtgtttgatagaatttaaacgattttcacttgaattaagaacatccaggacttttgtcaaagtcatgaacttttctgaaaaggacttggagcattgaaaactcattgttgctgtctgttgggagactgcagaacaggcattaaaaccgagcttccctgtgtttggctttctaaagagcagtttctgccctattataaatagacacgccgatttttgtaactgtacaaatgaggaagttgtgaggttccatgaggctcagctgatgacccttgtctcctgggtttgcatgaggaccttgtaggctgaaggtgaaggattataaagccgtccagatagcctgggttgggtgggtacatgttacacattagcctcaatcttgtgcatggtgtgttgtattggcatgactatcatgaggtctgggacaggggaccctgcttcctagccataccatagaataaaactttttagaaatgtagacattccttaggatctaactggaaggccaatgcaggtcgtcaagtggcatttttgtcattgttcagtttattgtctgtagttgttatcatataactgattttccttctgttgacactacagttgtcttgcttatccccgtagaagttgggtgagcaagggtaactttccaaagtactaaagccattaaaagaccatgatgtgacttagggaactcagtttttaaatctaagttatagtactgtaaacatagttttgaaaaaataagagaacatataacaaattaatattttaatagtttttattaaaaagttatttcattttaagtgactatggttgatttttataggtgccgtcaataacaccaacatcagtttcagtactttctggaaaatggccacagagtccatgtggcctaccctaagtgacagcgagtgacaatgagctggcaatcagtaaatcatgctcctctctggagcaaagactagatgctccttaataaggctggggtgtgccaaagtggccttttatatttaaagaagcaaaaggccagtgtatgtcacaacaaactcggtgatggtgctggcctggagcgtgagcagcatcccatctcgttgagacgatgagtaacatgaaaagcatgtatgctgggacctaggaagttcttctcactatcacagtgaacagtcaagtcagagcaccttctcagttccactgggtcagtctgcgtgtaaggacttccaaacaataggatacctctatgaagctctgtgtggcttaacttctttaggtccaaacaaaataaagcctttggcaaacaaactggcccaaacccttttagctaaagtagaatagcgttgtagaaacacccgcatcagagtgcacttgcttaatgttatagatgtacacgtggtttccctccaccacatacagctttaaggttgtattttcaagtatccacttgactgaatttacttgtatgtctacataatttcactgccgaaagtcacaatgagatattgtnnnnnnnnnnnnnnnnnnnnnnnnnnnnnnnnnnnnnnnnnnnnnnnnttacttgggagaaccgaattctaccgtctcttctaacaattacaaactatcagcacttcgggaattatctgtgtggatcagtcttgtggaaaccgttgctgtattttaaagatagaaatctcatttgtgctgcatctcccttccatcacactcctctggactacacgtaatggtcttctacagcaagagggcagaagacaatgcttctcaacttcggttttccgccttaaatgatgaagtgtgaaaagccacttatgtttaagggagctacttaagaagtggccagtgttgatggtccaaatcagaaagcatgctaattgtaactgcgtgcctctcctcagtggctgtgagtgggtggctagtatggaggttagagaggaaacacagccttgttgtgtgatcatggcttacctgggggaggagagagccaaggcaccactgactgtcatgtcagcacacatgtgagcctcttgcctccaattccattgtctttcttatataaaatctaccatctttcttgttttttgattctagcctagggattcactctgatgcccagcctagcctgaaactcataaactcatatgtagcctaggctgctagtcctgggattacaagggtgagagctacagtgcctggttccaccattttctattacgtgtcacagaacaggtactcagtgttgccttctaattgggaagcaatctttattttattctctctctctttctttctccccgccccgtgtgtgtgtgtacctgtgtgtgatggtgtgcatgcatatgtataaaggccagaggtcaaaatggagaatctcccttatagttccaggccagagtctgcccctgactggctcaattggctgtcaatctagcctcactgctcttttgtgcccacctccccagcactggaactacagttgccttactgggctttctctgagggttcctgggattaaactcaggtcctcacatttgcctggcaagcgcttactgactgaggtattcctgtagccccttggctgcatttttaacagacttcctcatttccctttgaccctccttcatatcagtttctgcccacagaggggaaaatgtgaagccagggctgcacatctgagtgatttgccttctgtggcttagctgactgggggaggaggggcgtggggaacactaaattggattcctatgctcctgtttaaatcttgtttttcattgtgagttgtaccagcaaagctctgggagataatcatgaaaatgtgtagattggcagctaatttttgaaaaaatgaaaagaatcagagatgaaataggagcgctcagaagtttttatgttctcccaacctgttttgtcaaattgttacacaaacctagaaggtctctgactagatacaaagacgtcgcatattgctgctctttctcgtggagcatcccttttgaaaactacagagtaattcacagtgatgtgataaatttgcaaaaaaaaaaatggaatcttcagtgtatagatgaaaagacatgtctttcacagaatcatgtgttttattcaagaggtctgtgacctaggcatgtttaataggtgatagtcccgagctcaaccctgtcttccacatgcacatttacttcctgccttccgagaaggactttgagtattaagtggctagtcccaagtctccctgggacagcttcaccagcaagaaagaaaaccaccaggcacatgtaactgtatggccagaatttagttgctgtacaagttctgttatgagaagtttgtcaagtttcaggctattgcaaagaatgagtttatattctagccaaatatgaggggcaccttcctctgtctgacatttggatcttgtctccactgtggtgtgtttatggagttcttagagcaggtaggaaaggcagacactgtcatctgatgactggaagttcagagctcagctctgctatttgttggtggtggccttgggcaggcaacccttgcttcatgactctgctcacagcctcggtcttctcttctgcaaaatggaaatgataaagcagattcctgtgacaaatcaggattggctgccagctcgatgctggactctgaggcaggctgcctgagaaagtgctgggcaaggcaggttgttcacagtctcaggaagctcgttagcagtttagctctcagatgcctcgcatgtaatgggctgcctcagaggtgcctgtactcctccttttcttgctatagaccaggttctcaaggacccttataaacacaaaaagttaatgtacactgtttttaaatctcaggacatttttcaaagcttatggaagtacaatacaggccaggtaacagactaatgtctactgacctccactcctgcctacagcaagctttatatgccatgtgcttagcagttctcctgatagccatattgtctgggtaacttgaaaagaaagatgtttgtggtttctgcctggcctcgagttttttcattttgatttaataaatctaggctcagcttgtgaaaattctgggccaggccctgggttatgacataaagcaccacaggaagaggtgcttgctgaagggagatcggccagcacccctcccttgaggacttgttgaggttctgggctctactaagtcctcctctgggccttgcaagttagacatgggccagcactaaggaagacctggcctggtggcttacctggagacagcaactgcccagggctgttggatgcttctcccaggagccagccaggttccagcctggtggcaatggcctcttcgtggcaagaggaaaggctcctggcctcccaggaagactcccatggtatgtagttttgaatgtgtgcttcctgcccagtccccagagcagtgaggtccttcctgtgcagtcttgaaacctggctcccagcctcctctttcgcgcctcttctctaacgttggtgatgtgttgaatccttctgtctgaatcaagggaatgaaacctgtttgtccctgtttaatcagaagaagagaaaaacagtcaagaaggaagagggtcaggaggggagagagggagacacagaaataaagagatgagaagagaagagagttagatgaagaagacaggagatgcaaagagatcccgagggatggtggggttataaggaaggcctcactgctcactgtcctaaagagccagccttgggcagcctctgtcatgctggcctgcacttatctctgcatctatttccccttgtgcaagattcagaactgcctgctccaaagaaacaataaaagcattcatgtttagaagaactgcccaggtgagagctagtttactgacattgtggcatgctctccggtgggttgcctctatctgagacttgcttgctcttctcatgcaaagtggaccaccacagcatgtttctgtgaccggcttattccatccaatacccctgcccagacctgaagatggtaataatttgctttggtggttaattccctatagtgaatgaaatctccttgttttatttaaggctgagactgtaagataactgagctcaaactatttgtctttttaagtttttaaaatgtattcgatttctctgactctctctctctctctctctctctctctctctttcatacaagcacacatgggggaggcagtgtatgcaagtgtatctatgtatgagtgtgtgtgcatgtggcatgtggaggtcagaggatagcctgtgagaatcagttctcttcttctaccacgtggctcgtagggatcaaactcaggttgccagacttgagggcatcaccattatcttttaagacatctctctggccctttaagtcctacccttccccctcagattccctgtattgctttcacatggcagcagatgtactttgtaggtgttttgtaagcagtgcctggtggtcagcagagtacccaggatggcctagactccttcaggacacttagggatgtcctttgtaaactttgccttaaaagaggccaaatgcatttatcccccactctgcattggtaggttacttctttagtctctaccccaaaagatgcagatctttggttttgggacatttgaggggcttaagaagtctctgcagaattcgtaggacacagtacagactgactccagcccttagcttaaaaattatcaagtacctgaaactgttgttctgaaacaagggaccctgctggcaaccatactagtcacaagtccagagagggtggggttgaaagtgtgcatgcaaatctaagggaggtagactgtgtcacaagggtccatatgccctggctggcagggaagggagtctgtcgctaagtgacccacagagcagccatgtacagaggtgagctactgggatcctgacatgcacctgtgttaccacagtacccactggaacttgctccaagcactgttggtgacctcacttgtctgtccccctgaggcatgacagctggctcctttgtccatgagatgactgtttggagaagggcaggcactcatactcatgggcctgataaaacatttgtttctatttgacttggaagtagcttgggtatattatctgggctatcactgctatcatctagtgaaccaagccttcaatgcatagccattaaaatacaataatggcactgtatagtagttaaattaaacattttagcagtacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccatccacgtataccataaaatatattaatgataaaaaagatatataaagttttaattatatagataacatcacaaaattacttatatagctatatggcatgtgtatgtatacatatataaaataaatactttcatatattaatataaaactacatgtacatataccatggcttacatgtgttccgtgttatataaaactatgtatataggtgcccttgcctacacagtttcccaaacaactggaatcccccatcaatttccaggtttcttttaaacgtaggcctcaacccatagccccataactgaaccaaagagatggagtacctagaaaaaaaaacaaacaaaggaacctgacttagattcagcagataacctgagtctgctgacagcgatagatgtctagcagaccacggtgagcactttcaatgaagccaccagagtattctactggacatagatttcttatcgagctactgagtgttgcatactaataacataacatctaagggtaccctagtgccccgaggtgtggcccagctaagtccactgcattcatttttctccctctctgtctctaggtccctccctgatatttgtggtagtctgtgtacagtttatggagcactcacctggcccactataaggcagccttttcctatgggtgttttcaattcaaaccaagatgaggagccagccacaggcctgcaaagcaggaggtttgagccctctcctggcttgttctgtgatctctgtctgtgagagaacgctggtggagtctgcagctagagctgaagagtgggggacaaggacagagcgtgtattgcccatctgccaggctggaggtgtattcattattgatggaggtagtgcgttgctgttcagatatgcagcctgcctgggtaaatgagacattcttcagcaaattgcttcgttttttgattgctgattgtacgcgtgtcaccaagctgactcaaggttcatcgatgcatgctcagtaaattagaaagaacataactatggatcagccaagagaatgaattctgtgcctacaatgacccagggccatttaattttctgcttaattttgttgcagtcagtttgcattttgggttattatgcagtaggaaattaacaataaataacaaatttggtcctcctgtgcttgtaatgatatttttataaatctttgtaatgctgttttttaaaggatcaaggtctgtgctaggctgataccccagcaagtatgtgaagaggaaaatgcattattcttgctagatagccttgttgttaaatagcataagcgtctctctctctctctctctctctctctctctnnnnnnnnnnnnnnnnnnnnnnnnnnnnnnnnnnnnnnnnnnnnnnnnntccctccccatatttttggtttaaagtaaaatccatttctctcttctcttctcagataacctgaagacaatggatgtcgatgagggtcaagacatgtcccaagtttcaggtgagaccttgggtgatagttgtatgtccagaagttgtgctagctgtccttggggaagctagcaaggctgccataaaagaaaaggctcagagccacgtgtgtctgtgttcagagaacttgaacataaaaacctcccaagtgagattaggtagtgtgaactctaacagcaattcaacccggattaaggaaatgctgtacttttggagacagttgtaatagatttgtctaccaaacatacagaacacatgccaaaggtggcatttaaaaaataagagatgagagaggaagaggaggccacagcagcaatgaaaagaaagcctagccaacgacggagcccagttcagagtcagagcacttgccacgtgagaacagcaaatcctttctcatcttaccagactgagaaagcgaaacactctggctaatagaaaggtggagctgggttccaggctgtccagtgggcagcactgagggtggcccatccagtagatcctgccctgctcctgcacgcatgagtgtatgatgtccggttctgcctggccctgcatctggacagtacctggaagcagacttcctggacttggagattcagtcagtgtttctgtttcacagcctccaggcagttccccagtcccatgagcctgtcctctctatggcactggccagcctgccatctgtgccttgggcaagctgcctcctcaggtttttgaagagttgttgatttgtttgtaagtttgcattttggtccaggtgcccctgacaggacccgcccttaatatgtggtgttgcctggatcactgggtgacctgaccctctggagatgggcttgtggcaagtcctgtgctctgtcagctctttctttccattgtaaggcttcagacttaaacttcccacaatgcaaagaataatgaatggctacttttaaaaggtgttggtcttatgctctcctagctgaaagtaatgaatgtggtctcttctctatgcaaacaaaccttgttcttgttatacaatctacccacttcagtttaaggaattcatcttaaaaataaactcttacaagtagacagagcatgtaagcacatgctcactgtggtgttgtcattagtacttaaaaaactatggtgtgtgcacagacccgaagcctcggctcttaaaaaggaggaggatatgaatatgcaggtatggaaagaaatctgaagtgtatatcaaaatgggaaagatacaaagtatgattccatgtggaaatataaattgcacacacgtgtgcacacattctgcatgcttccatgaacagttacagtgattctagagtgtagattgacctggacttcccccaaagctgaaggttagaagaaatcctggcgtgctgaggggggaggggaagacattgtttttttcttgtactctgtatagttatttaacttcgttttcttttgtgtttcttaagcaaatctgttaaatgaaaagatgctgtttagcttgttgtatttagcttcccttgccatcgcccaaagcccaggaaaatggtgctaaacataattaaaatagggtgatgatcaggctctgcttttgaaagacctcacctacgggctcaccccttacagcaggattgtttggaatatcacagaaacagggatgtggagaaactccaagggcaagaagaatcccatctgcttgtctttgctgctttgacctcagatgagttctgagtttttatgtttcaagatgcactcagtggtccacacccttgggccacatgccgcctactgtctgacgtcctaataccaaaacattaggctggagatgagaccaacccagatgactatcagtgaaaaaatgggaaaagtgtggtatgtgtctataacagaatattatttagttatgaatgttggaattgatcattaaggacaacatggatagactccaagagcattgagttaagtgaaagagcccaggttctaaaaaccaaaggcaggcacacactctgcttcttctgaatttgttcttataaatgaatggtctgggttggtggatttgccacccacacatattcaagggttgcacactatatgtatgaccgaaatctcaaacatcacactgtacctcataaacatgagcaattattggacgtcaataacaaaatttaaaacaataaagatacaacttcccccagcctcgaaaaccacctctaaaatgttaactatgatgggtagtcagtattttcatttttccatttgatcccaagacttccaaaaactttagtttcttgaacttctttttcttgcccttaacattatgctggatggtgtgtattgtaggttgttctgaaggagaggactgttgagggcagggacagcaacacagcctgaaaaaacccttcactttcattttttgtctgaaaatatttggtctgaaattttctctgtatgcccatagcaaaggaatgacacccctcaccatgatacagccgctgcattctgttcagccttgaacatcctgaacgatgattagagcatcatagagtgtgtcacacttaggaaagaattacatattgcttttgcactcctttaaatttgataacctcccaattcaaagcaatgcttcctcctttgtctgctaagactgggaagaaagtaggaagggttcatgtaggaaggttgacttgttattttgttttgttttgtttttctttttttcttgttttgtttctcttgcatccctggggatggaactcaggactttattcatgcaagacaggccactgagctataatcctagcctgggagttagctttcttcataagaaattgagggatatgttactgagtcatttctttttcataagatgttcaaacctagcagtttcataggattcccccttaacatgtgcaataccttagaaacacattccttactagacccctgtcttcaaggcccttggattcttcttccctgggtgtactctaaatatggactgtgctctaattggtgtcacctacagcatcaatcctagaggttgatggtcattgcagatcatgctcactgacttgagtctacgaattgtggaaagctttctgatagaaactcgcagctgtgtccagccttattacactgtcatctatcaagaccacactaaggtgcttcctttggaggtccttaactcactttctgatggaagctcatttcctggtcttcccttcatcagagttttcaggttactcatgcgtttttgtttgccttctaaagaaagaggcagtctatgggaagaaccttctgggagttgaaagaccaactccacacccatttctgattgcagctgtgggacccaagccaatgctcttgcctcctaaaccatggtgtgtctcctatagcagcaggaactctggccagtgaatctctgaggctcctctggctcatatcacctgaactctgtattttatattttcttaatgctgtttgtaatgtgtttgttggaacgtgcacacaaggagtacaccctgtagacatacataatctgtgtagggaagaggagcctcatatatattaaataacaaaagtattctacctagttaatcatagtaaatcacattgattgagcacttggaactacccaaataacatcctaagcattttctcatttttaccttataaaaacccactgaaggaggatgtagttacctccaagttgcagaaagctaagactcagcctataagaaattgacaggaagtcccatagggagccagacagttatgagcctacttcagccctaggctagaagcaacttactctcctcaagtggtggctctgtagtgaatacatctattaccctggtattactctcccttaagcccctctgtatcttacagatgcatgcctttgggagagatttctagagatttgctgggtagctgggcaaatcataatacacttaagaactcatttacttttagtttccgattaagggcacaatttctttaatttgaccacaaacttctcaaagacatacttgacacacaggcaacaggcaagttaagtataaattggtgtgattataatttcaccagaagtgttgttttctaagtaagtgaaattttgcttgcctcttcagagtcattccatttgacttattaagcatttgctgtcttgctttctccaccctattgcttttgctacctggtaaaggtaccacatagcctatgcctctgtggtgtactacaggttaccaagagtttacttaacaagttggtgttcatgcttgtgattaattttcatcatgacctgctgaactatgcccaaatcatggattctagcctcttgttatacctgaggagagaattctaaagtagtggccatcgctccttcccatcagctctccaattgctttaatcagacctataacccaggttaatcattgtattcataattggggtgtgttggctttacctagcacttgggggtttttttgttttgttttgtttttttaagtaatgattcaactggttagtggggcaaaagccaatatgcacaataacttggtctatcagaaaggttttcatgagatggtaaattttctgcaggaagacctcccagcagtaaaagaatgcaaagatccttggtcatcaagcccccctgcccccagagtggtggatgtctctgcaacagaactcacactgggggcttttaggcaaatcagaggacctcttaaaaaccatcagtgagccgtggtgaggcagggttgaattaatgccacgctcttggctgccatgttaatgccatgttccttcaggtctgattttgtactctatacccctatacacatggggactgacctgttgttcctccttctccctgtgtggtttcatctgctctgagagttcctattgatctgtctgacccacagcgttttagaatcacaatccctactgttttcattacaccgtgtccttcatgtaggaaaagtaccaggatataagatgggaatagaggtgagatggccttttaatgtacaacttcagccagctgtgattcttaagaagtccagctgttactatgaacatcatccttaagatagagttgagttttgtcctttcaaagatggatcagccacacttttaaaactgagtaaccaccatgtgtctttttgcatgcaattaactaatcatgaaatggactgagagtgtggcctgcttttattggctaatcctagatctttatcacacatacccctccctcaagctctagtgtggcatggcatgtccacaggcccagaagtatcatggatgataatatcaaagttattatatggaagaccatcacaacaaaacaagtcaaagcagttccatttccccgtctccaattcccactcaatattaatgccagctggtgaatcacgggtccccatggctccactctccgtctcatgtaccagcctcttaggctatggcgttgtggccaggggccccactcccaatctcatggaggttctttttataattatttcttttttttttttttgaggttatagctgtcattttcctctcccctctgctctttgggggttatttactggcctttcaaaaggcaagtggtgtgggtatctgctaaccagcctgccacttccccacttcaatgtctctacattataaagaatatctgtttaaccagatttctgtgtgcttattgtctttgaatacctccctaacatccccaaactttgaaaaccttcattctgggccatgactctgtatgactgaagctgtcaaattgtttgtataccttctgcatgctcctggatagaggctttccttgcttattgcaaagatgagaagcagagccacaagtcctgccactgttactgtaaatgtcttctatttagggtgagggagacagtgctgactactgctccaagattctagcacaatgtgaacacttttaatcagcctcttgggctttttgtttttctttgggaaattattataatcttaccccatctttaactatttatctcgtatcagctatccaaatatacccaataatgctctttctgaaaatatgccagttgctctaatcaagctaacctgggatagtacattgtgatgtctctttcttagcgattgtaacactattccccaaagcatgtctttggtgcagattctattttaaagattccagtaaagcttgtctcatgtacttattttaatgatcttttctggctcctaaaaaatgttggtgcagttcttgtgagttgatccaattttcataccatgtctgttcgtgttctcagaaaattttactcattggcatgttgtttacataatgctcacaaaagtctgggttagtgtttgttgggaggtcatttcgcctattgggccaagttgccaactcaacgggcacacgtctggtagcctaccttcaggatcttgagccagactttcttttgtaagtagctacaatgagtcagtcagcatagatttagggcctcactggctgtttctcctattcagtttgagcctgtcaatccctttaaatcagctccagaaaggtggacactttcagagctccagccttggtgagaagagagcgttttctaccagcgacagcttcactgtgtcgatctcaatttctccatcctggagctagacaaacttcattctaacccagccaatgattgctagggagatgggattaggaggggagtgagggggtaactggaagtgaaagtggccaaaaagctgtctacacgtgtatgagattatcaaataataacacagaagggaaggaggcagagggaaggaccaaaaaaagctgtatatgcatgtgtgaggttttcaaataatagcaaagaaggaagaacgggagaggaagggagaatgggaaccctactttatgatgtgtaacaaacttttatctttgtatgcttttgagtttgtcaaagcacgagaagagcctcagaaatacagccaccattagcccagcagtaacatttccaaagatgtatacaatgatgatctttaaggatatgtccaaaattgactgaaaggaggttcagtgcaaaattgattatatagactcaaaacaatatatagagtcaaaagaagcaaaacaatgaacctaattccttatttcccctataaataaaattgtagaaataggtttgtatcaacaaattgtattgaggannnnnnnnnnnnnnnnnnnntatatcaatatttatgtagtaatttggtatcaggaatagttaaggccacagatgttgttttgctttttgttgttttccttttgtaaatctttgttctgtcctctgatgtctatttagtgcttagcagtgatattcattcctaggaagagaaatatgtatttgtcctaacagggaagcattaattcagagcaggtaccccttcagtctgccctagtgctgtcaaggtgaagcccaggcagtgaggttttcccagcagctgacaacgcctgccagaaactcaagctctgatttgtgtctgcaggaaaggagagccccccagtcagtgacactccagatgaaggggatgagcccatgcctgtccctgaggacctgtccactacctctggagcacagcagaactccaagagtgatcgaggcatgggtaagtggctcaccctgctgtcctgcaggctgtagcatatgcacagttaggaaatggctgctgtgtaggataaggtaggtgggctcattccctcttgtcctctgaggtcagtcacataacagggtttcctcaagttgggatatgggtgatctgctttaattgatgtgtttatttttaaggtggttttctgttgactacaggtgatcttggtgttactatgtgctgaacaacatggaactgtatgaaatacatttgtattaatttaaaggtcactttaaatcaaggagttcggccagtgttggagcatatagatctcctttgcttagtcctgaaaacaccctgtatgctaggggttcttttcaaaacataaacagatggtcacaacctgcctgtggttctcatcaccaagcgagaggctcattctgggaaacaggagaaattgtcctttgaccatgccacacagggagagcccctacttcacagtcaggctaaggacttagttcttgtggagaaagaggtgggcttgcccagaatttccacagctgctgtggaacctctgcagaatcatcatgctgtaggtgtgatttaaggaaccgaaaaccaggctggttcctggagagcgggaaagatgtgtgtatttcacgtgtcatagatgaataggtcacaagtgctgtgggcaccttgtccctttggccgtgtagtgtgagcagggagcaggcttcgctggcactgctggctggctccctcacgggcctttgcatcctaaatcaagtgctcagttccaggtgcccttggtatgcgcactctgtagaacatgtcattcccagggtcttctctccctgactgtcaccatgtacaattttcagttcaatttcctttcaagatgaagtttagaaagtaatcatttcaaacttgaaaaattaaaatgccttggtaaacgttttgcctgatttggcagtagcagttgacttggccctgaagacaggaggaggctatttgatgtgagcctcagaaacaaagagagcaaagtttttggtggacaactagaagccacaacatcacctgctagaaaaactgagagcaaaagcccagagaacagatagtacatgggaaagggatgagaaaacccaccattggaacacccccagccacactacatggtggccgccttgtcctgtgtgattgttgaaggaaatccacccatttccacatgtaggctatatataggctgtaagtttcataatgtgtagaatataacattaaatagaatggggtaatatctaggaggtattcacaaattacaggaaataaagttgaagcaatacttcaccacactgccttatggagtggctcatgagaatcatggattaaaaaggacaggggaccaggaatcaggagagtttggaataggatcaaagggcaacagggtcaagcaagagtcaccatggaaacagggaggcaggagggcaagtctcagaagggacacatccaagattctggtccctgactgtgaccctcagggcagaacttctcatttctctgagcctccattttcctcatgtgagcgagagcactaccgcatgccccagagtggctttgtgggccagatgaataaagcagaagacagaatggcagacagactaaaagagagagaaagtgtgtgggtgcatcgcaggcacaaatgttcctagggactgttcctagagaaaagggatccatgcggcctcagtagtaagatgaggacagacaacagagcataaggaagagatgagtccattaataaaaaacggacccataaaacacgcaaaattgaaaacagccaggagagagagagaaatgtgttagagaaggacagcgacaagaggagactgactgcagattgagagctcaagcctgtggagtgaccagcagtgaggacgcaacaacctgggtcactcagtggagagaaatgggcctgctactgacagctgtgaccatgccaggagactctgtaccagacaagaacagacagagttagaaaacaagtggtgagagactggaaaccagcccctgactggctagtgggtcattcccaggattagaaaagttggggtttcacacactgctgctttctgtaataatgctgaaaggacaccatagatctatgtataaaaattgggacaatggcagtcagaggcagagtaatacaagcaccattattgggcctccattttcttcaaagtctgaataagaagaaaaaaagatttgaagagctgcttgaagaatttaagtcagacccgaagaagaactttctggaaagcagggatttagtcatcggaacggtctacttaatggcactgtggcttgttcttctgaagttatctctttaataatgagaactctcagctctctgaagtggttgtgtctgaaaccatttgaagctgacgaagcactcaattgacctcttctggcaaacctgagtttaccaagtctcagatgtttgctggaagaagggcagagccgattgcactgacacagaactctagggcctcataaaggccttcctgtgggacagtgtccaggttgatgtctagagagcagatgggcaactataaagaaaagtgatggctcaatactctattcctttgctcagtaatacatcttccttctttctggtgagtttccccctggtttgggtttgctcttgtcacttgtggcctagaagagaacagagctgtgctctccttcccagctggcaagctggggattgtggccaaactgtgataaaatccagagcaccactctgtttgaatgtgaccatagggaagctgggacagagagagaagggaacccagaatgaaaggtggaattccaggctaaatgcacaaacacctagaaaaagccaagccagtatgaggcttggcagagtccaagggaaaagccaatagaaggataggcctgctcaaggctgagctgaaaatgggatgttgctaagcaggggaggctaagtccatgactgagcactggacaatctgtgcagaacccagacagaaggaaatgggattgaactctgagaaggtgcattctaggatatgcacccttcagtctccctttgagtgtatctcaatctgatattcatctgccagatctgagagaggctgaccctgtacagcctctcagtgagtgcttgcacctaacttttactcttcttagcttagatgagaagagagaaaacagatacaaaagaaaatctacatttttcattcttctaggaatcctgaaatagtgaagtgtataaaaatattgatcttggtttttattttgtttggttgtctcctcctcctcctcctcctcttcctcttcctcctcctcttcttcctcctccttcccctcctccccctcctcttcctcctccccctcttcctgttcttttttctcctcctcttcctcctctttccttctcctcctgctctttctcctccttcatttcttcttcttcttcctcctcctcctccttcttctgtattcattacattgactcagccatgagggcagggctgaagcaggaactataagcaatcattttaagttctcattgtatataggcaatgtacatgttactgtgtcacatgagaacatttagaaatatattgtcacatattgacaactaattgtcctgtgccagtgtcctctcccatgtgtatgtgtgggggtagcaataagttttggttggcatacaaaatctgggattcactgtatcatttttaaacatactatggcaccaggcttattcgccccatcactaccatcaactttaggcagtcaaggatgggtcctcaggatatagagcagccatgagattctaggcctaggagaaagaagggctggagggaggtttttaggactgaaagagagactgcaagcctggctggcgagtgggaagctggcttcaagtacggatgtgagcccagttatctaatcagcagccaaaggaagttgtttttatcagtgaaatgcatctcttctgaagcgacagccccacttcagcctagaagcagcattatctggcagcatctgagcagctgcagcaagtgcagggactggaggtgcaagtaggcaggatctccagcctcgggagctgccaccagcactgagttcctcttttctggaggtgactgaagtatgtaggttggctccgtgtgtgccttgatttctctttctcccttccttgccccgcttcagagctgaacgtagcagagcacatctgtcaaattcaatactgttcataatgtaacttactatctctgacctgaaatgcttgtaaaagccactggtactccaccataggcatttctaagtcagctgagaagtattcctttttcatggatttctcaaaacatgagacagtaagcagtggtataaaaactattttcccacccgccctctctttccatcagaggaatgagaattgcaggctgccacccaggtctttggccttctgcatgcatctcccttactctgtcaaccagtaggaatcacaaagatcttcacagaccatcctaacagttggttattcctgaacgttgaagggactctgcatatcacctgtcatcatggattgggcttgggtgtacacagggagaccaagcagcaggaatttaaatccattccttggaggaaacagaaactcaaatgtgtcagtcagcacctgtgtgtgcatgcttgcttctgtgtatgtgggcattatgtgttgtgtgtatgatggatgaatgcatttatgtgcatgctagatgtgtatgtgctagtttatgtgttcctgtgggtggcatgtgcatatatgtgtatatttgtgcacatgtatagtatatgtgcatataaatatgtaatattttatgcatgtgtgtttgatatataaatatgtgtagtgtattagggtatgaatgtgtgaggtatgtaaacaatgtatatgcatatgttgtgctgtgtatttatgatgtgtttgtacatgtaatatatacgtatggtatatggtatgtgctatgtgtagtatatatgtatatctgtatgggatgtgtatttgtcatagtatgtgtgtggtatatctatgatattttatgtatcacagagtatatgggtatggcaagtttatagtgtgtatctgtgatgagtatgagtgtttgtatgatgtgtagcagtgtttgagtagtgtgtctggtatatatttggtatgtgtgacttgtgttatatgtatgtttgtaccatgtgtgtggtatgtatatatgtggcatgtatgtgtgtggcttgtatgtggtatgtgtgatttgtgtaatatatatgtaatattatatatgtctgtgtcttgtgtgtagtgcttatgtatggagtatatatgtggtgtatatatgtttggtatgtgttatatgtgtatggtgtgcagggagcttgtatgtgctgtgtatgtatgtggtattcatgtgtgtagttgaacaatttgtgtagtactatgttgtacacactgtgacatgtgtggtgatatgtatatgtgttatgtgttatgagataaacgtgtggttgttgctttttctacacttacagaaattatgttagggtatatgaaagtacacgctgcatgccgtgggagcatgtatagacattaaaatacaactcacaaaagtcagttctctttgtccaccagtgggttccatggactgaagtctggccattaagctttgcagaaagcacctttaccgactaagctatcttactagctcaaatgtgtggatcttgacagtatgccatggctattttcttggagattctggctttcaactagatgctttagaaatagttagaagccctggttctggtgtgtcctaagatcatcagtgctgcggtgactgccatctctgcacctaggagatgaggggttcgccttacctaagcaatacatgcacattatactctgacatggagttcaccccagccaatatccatgatgttgttaatggcataatattaatgtcaataactcgtgttgtgccaatgacaaaaattacatatcatctcagttgggcagccctttgcctgagattccatttgcaagtgacatggggcagaagcctggacactaagcctgacatgaaatcacaccctgggtcccagagaggacaactccaggtctctgaaagaacttcactaccttcctgtctgaaccatcaactagaactcctgggcataagaggcctaagccagctctgccaggccctggcagagagagaatggagacaaataagctaatgtatggttgggaagaacatggctttccactttgggctagcctcttcctgtacataaaggtcactctacaacccacttagtgccttgtatttgtagactgctgaccatgaaatcctgaaatttctttagtatctgacccaaaacagaaccacttacatgcaaagcacaaccctgccccaacccgtgctgaattcattttagtatttgtgtacatgttgtttggtcagctcccagctttgtttaggatgtctggacctcagagatagaaactcatcccagaaacctttagtggataagatggactcccactgccttggaaaccttgacaactaaagaaagctgtagtgcctgtgttacaacgacacaacgataaactcacaagaatatgaggtttttgtagagaatatattcaaagaataaatagtgtgtcctaactgggctgaggattggggttcacgaggggttcagattcatggagtagctggtatgctcaggagtatgagagggagccaggcctattttaactgtagaatgagttgagcaaagagggaagaatgcttaaaagcaaaagagtagaggcacaagaggaccccagcatcttgatctggggtgtgagcagtggtgcaggcaaggggccaggtgatagctccagctgctttacatagtagagtttgttctcacgatagcaactgttaggagtcttggtctcagagaagggtatttgaacctgtgccaagcagtgtgagtaaggagaagtcagggagagatggggtttgtctactgtcttggtataggtccatgggtatagtgaccaactacagtgattgtggcaacaatgatagtaatccagcgctgattagcatagaatcatgataattctgatccagggaattggctggaatgtagggatggaagaggcagatgttccatctatgcatagagtcagctaggtgagacaagagagggaacccttggaggaacactagcctttaactgtagagaagaggggtagaggggaggagacagtcctgcagttcagatgaaatttctcagaagaattataggatggaagccacagaaaacacatgggacaaaagtgagaaaggtcaaagagaacttagtgagtgcccttagtgaggagaatttgggccagttgtgcatttcccaaaagtagctcaacgagttgcaggcagaaaccagactgccacggaaaccagactgatgatcagggaatgggagggtagccatgagggaggatggacaagtcagatggcatgggaacatgagctgagagttgctggctgaaggggagatttccaggctgatactttaggatgagaatagttaagaagtaggaaggaggccaggcgtggtgacacatgcctttaactgcagaagctggaggatctctcagttggaggccagcctggcctacagagggatttccaggacagccggggctacacagagaaaccctgtcaaaaactaaaattacgggaaataggaaggactggagaaaaatagactaagctaagaagaaacctgggaagcaagcagggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccagcagtatggatggaatgatgggtgttgccttattggggatgagaaagggagaggagctatcaagcaagagtttttctaagaggaaacatggcaagatctgatgctcagcacctcaactgttttaggatactgatttcacagtagcacagctgttgttcagggcagggatacagagcctttgtgggaggctgtccctgccacactgaccagtagtgctaccccacccaggtctctgtgatacccacatgtccccatacagctcccaggtgagaagctgactcagatgtcagccacacttccctcagcgttcccacactcgagagctttcgagttcacacaggacatcttcagctgcctaagacttttattgtggtcagtaatgttccagaacccaacatagaaattaaaagtatactatagagaatttggaccaaaaaagatgcccaagccccactctcaaatgtgcagcccttcttccggctttttttctctttgtgtctccaaaaatacaggttaactgtgcaaagcggtttgtttctgtaaataaaacccagcattaatcttatcttcactgtactctgaccactgaaattcaaaaatcgcattgtgctcccttcatttactgagagaaacaaagaggagtccaagattaaaaggccctggaacagatagacaaacgctactttctgtttctgggtttggtcccagtgttattttctgctttgttctctgtgtgttgaaagagtcagtggctcttctgtatgtagagcagtcaactgacattccgttaactttccttctgcatggggtttcagaaagaaatggaaaaaaaaaaaaacaggttttgtgctgtggttgccagttgccacctgtcctcctatctggttaggacatttttctgatttgggaagtataaatataacccagaaaaaaaaaaaaaaaacagcttcccttccttttatgcaaaagtagaaaggtttaagtagagacaccaggctctacccatcacccttcaagtttgcacagaagcagctaagccctgtgcagatgcctgctgggggaggggaagtgagaagcgtccctcctcaggccctgagtggttgagttccagcttctgacctctaccagaggagctcaacagagcacagatctgctcagaatctcaaaccttttgttgggctttatttatttatttatttatttatttatttatctatctatttatttattttgatatgagaaacttagaaataattcaaaatgtatgctcagttggcagggagtcagctgacctcaatagatccattcatgctgccagactgttaatgaacagcttgaagaccaccatggttcgaagtattgacaccacagatacttggccaatgctacaagttagggcttttttcgttttgttttaatttggtttgggatttgagagctggcttgatacaattttcatatcatgacacggaagtgtgggggggtattttttggatagctatttgtgcagtaaaggccaataattggctcccagtggctctctgccattggtatcacaaatgaggcctcctgcagcaactgccctctcccttgtcatgaagagagaggacttgtgttgaatctgtcagctatgttccaccaggatggcaatagacatcatgaggtgactcccctcgctgctccctgaacccatggtgacaatttctcagtaagacttagcaatatgcaaatgtggaagagaatgatcaaaagttcaccttaccatggagggaccccagactcttggaggccctgaagcaccccacttgctggaacgcacttctgtggtaaaaaagccattcatgctacctctgttaggagcaaggtcaaggcaggcatctctggcacaggactggggtgtgtcattggaaggctggctgccaggagagtacttcccctacaggggatgtggctgcaggctgtcgatttccactgaagtcaccaagccaggattccagtgaagcactgaacgtccagcatcttccccatccagcagggtatgaggtgtgatcatgtgatccatggatggcatccaggctgactcctgctgcctggcagggcccaggcaattgtggacattgactttttccaaatgagagaccgttaccctagaagtgaaaccctgctgaaatgagaaaaaggcttttattacagccctgcaggcagccatatgattattgttattattattcttagaacctggcaaatgctgagtgctttcacagtgtctccacactccacttgaacttggtggcaataaaaataagaatcagcagtgaccccggagcatttctcttggcttctgttggcaccccaatgtgtaataatgacaattaagtattgcctggtgtagtgaccacttgtttgagcctagtatgacagttggaactgccttcagtgagatcagggctggggagagaaggctgacttaagtgcaggcaggggtttaaatcctaagtcctaagaagatgatgctggcttgccgtaaagccatgtgtgtttccttacagttttggaagactgttacttctccgtgggtgtttagcctagactttgcacctgttgcgggtttgcgtttctctgtgtgtttcttgtatttcactaactacttttgttattggtgggatgcctcttaagtattcacccttagcttaacccgcactgtgcctacataccacacgcatgcccatactccctgtcatcccctggagagacagacagacagacaggctcacctttagctcaagactttgaagcatgtcaaccaggagcagtccctgtctgggtcaggagtctcagatgagtggtagccattgtttctggaatatagctatgccatgcatgattgcctgttttagtggagcacagtcagcttgaaatgtagtaatctaggtgctagatgcttctgaattccctagagaaaggaattatttttttaaaggaaaaaaatccttcaggtaaaattaatgttaatatattttatttagtcaatatacccaaatagtattacaaatatgtactcactgtagttgttgtcttgttttttgaaaacttgtacttttcccgtggactgagtgtttgagtccagtgtttgatgcttatatcacatctcagtttgggttgaagccagctatttggagggggctgattttttttccagtgctgcactcaaacactgagctgtgggccaagcctttgggcagggatcttgacagttcctgaggaaagcatataattgcattgtagagaatataatgtgaatgcttgctgagttgtatcatctagttcttccatattttcctcagtctcagtcctgtcccgtttgtactgttgagttccacttggcatcagcattttagcaggggccccacatgcatttgcttccaccctaagagcagtaggagcagaaatacaggaacctggaaagcccatcctcttccctgagcccaactgacatgcgtgggacaggggatgcttctggcttttgtttgtatcgcttccgtctattcctatgctctcccgtgtatcactgtgagcctattcattaaatgaaacatcttcaaaacatgacagttgattcataaacaaggcacattacagaagaataccacaggcatctgctcccaccaaacccagcctcagagacacagtatgactgctgtggaaatggtggccactgagtcctgttgctgttccctaaaaaaataacactgctgcaacctgatgaggcagcagggaggaaggggtgttggaaaggacttttaagggagaaatagaggccagcttccctcctgcaagcttaaaatgaagcctgggatttgcctcactacccactgtggttctgaaggcccaggcatagatggctctggcattcccgcctctcccacttcactcccacctgagcccagcttatacccccagccttcgcagacgtctgcacgccactgcccactgcacttcttacagttcaggagacagggtgtgtccctgtgcatgtgactgctgggtttcctgagcacgccaggatccacagagataggatctgtcattgtggctttgaattgttattgtcttatgattctccctccctacctctcccctcacccttcccacccttccaccctagtcttttcattttctctctcagtcttcttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcttctttctcctcctcttcttcctcctcatcttcctcttcctcatcttctttcctccattccttcaaacatttggtcatagatacattgtcatcaaattttggttgcttgcatggatcaaaggaccaatagatgggttgattatattgtactaggccaccctcagcactgctcaagaggcacaggcagctcgtcatggatagcctggctgtcataagtaacctgaagcatctttaggagcctattgtcagtaactagcagagtcaaagccacatttctcaaggcttttgtgttttgtgttttttgtgttttgcttcctgttaaatgagttagttggtcattccctggatcaggatggattgtaatgaactatgtctagctggttgtatcacagaaagcttaccacccagtgtcgatgggtatgcaagcaggacttctgagcgcatgagagtcttgactttgttgactgctccaggctataaaccaagctttactgtagcaaagtttgaagaagtagatttgttttttcctgaattgagaaaaccaaaagaaaatctgcatgattacttgacatagtcctcaaagctgtgtagtcttgacaatactgccattgcgcctacctctaccctggagtgtcatgagcatcacaggtggacatgaacctgttcctttaaagagttacatgtacaccatgtcttgcctctgaatcatcttcagatttggagctaaggggagatgtgttctgagtggctcgagcattctagagctcaagggacaactgaaggtagtattacgaaagacacttgtccaggcaccctgttaggcagaagccaccaagtaagatgagatcacagaatttaccctttgataatatatatacatatatatacagggatagagagtcaagaaaataacaagagaatggtgagcaataaaatatggaagaatatagtttgtggtacaaaccacaaaccattctgttggttttagacacttaaagttcaatatttatgaaatagtcagctaggtgtagtgaagttcatagctgcttttatcaaattctctgatggtagtatgactattctcctgggaaaggcaaaaaattgtcatgggttagaaaatgccatttgagtcaccagtggaccacatgtgtgacagtcccattgatggtatctgctagtctatcatagctgtctgcatctgttcttaacccgctgcatgatcacataggactgagaccacctcagggtgcatttcttcttcaagaatatctatgtttttaagtgatgcattaaagtaagagcttctgtcccaacatggatggaacagacagtgaatatacatcattggctttaatgttaacgcttttctcccatgccccatacccacagaggaaggcaaacacaagcacagcttgtgagcaatatcatgttgctgctgtgtcaaaaggtccctattcccatgaaatacactgtgtaaaaggccacccagacctcatgtggactcagcagtccatttaaaaccatcagcaggcaggtcactcgctgtaggtgctggcagcatggggggccagacatcaagcactgaactaagtctatgcatctgcagaccattgctcctgtctacaacatttcctcagcagccagagctcttccagttggagatgagacaaacactaaatacccttccttctaataattcctttccttggaatataataaagacaaagagtgaaaaactacagtgtatttgccttgcttctcaccattctcactctttagaggtttcttgtccatgtgcatttctcttatatcagtgtggtggcatgtcatagctagccatgaatccagagtgttcacagataatgatctatgggatcatggcttcttaagcacatgctcattgtttataaactcttagagttctgaggacggaaggctgagtaggaaggccacctccctcacagttggtgtactctcagaaatgtgtgaggggtctgcagccacatcccttgttgcctgctgacctgcagctcagaaacagtttgtcagaagtctgaagacactcatagatcttttgcattctggaacctttgacatttggctgaacaatgggatctgctcatcttcttcttgcttggtttaatgtgtctcagctcagtctttggaggtcttttgcaattgccagacacatagacattgtagaataagacaggactcctgcccttaagaggttcttagttacttcttcggaagatggctgaaatatcccttgttgctgttttgataccgtgatactctgtggatagaatgagggaatgatgaagttagcattgctgagctactaagggttctgcattgatccctgatgccctagacaacacagacacctacaagaggaaacagctcattgtccaagcttactggcaaagtcatgttttcaagccattcaaaatccagttctttaaagggatccaaaacaactaatacacttcagttaaaggagtaaaaacatccaactgcccctgcactgttcagttctcttattccagtggaggttattttacaaggagatttctccatcaggtcttgtattgaatttcatttttactttggcaaattaattttctcctgaaatccgtgttttctggagaaaggtttggtaccatgccacataagtgtgtcaaatcactcaagagcagatggtttactatcaatgcacaaagagttcttagaaaggttaagtgaaggggaaccaggtagaaagaaagcttgataataatggtaagtggagaggtggccatggctgttggtacagccctcctggtttgtgttaagtgatgttcccttggtgctgatggagttccttacccattcttcaggctggggaatctctcttgaaagaaataggagctggccagaaaggcagaatgtttcgctataattgagatataaattttagctttgggtttagaaagaatggcataaatcccaagattttccttctgtatgtatgctggggcattaccaaaatgatacccttgcttgatttctcatctgtcactcacacctccacactggtaaatgctggcagaaattgtttgagcttgtcagaaaagttaaggtctgaaactgttgcattcagaggtaccacgcaatctcttcagacccacatgtgtcccaaccaggataggaggtttgctgatcagagatgcccccataattgggctgttagtaataatctcacttcaggaaagaaagcgagaacagggtaggcatgttcagaaagctatctggtacatattctttgaggtaaagcatctttaaaaggtactgcttccccaacactatgcatgaagacttgaagaagagtaaagtgcttttgaagagtatgggtatcaccccacaacaagcagggaccctacttactggaacaataagctggccaccattttgtttcaggaacaaaccaactagaccactataatagatacggatgccgttggcaatgtatctataggtagatatgtaataaaataaatgagataggctggagcagcttcaacgagcggttgtcatgtttaacagccattagtagatgtccagtctctcagtaagatctattcacactctgaaaaatgtgctgccaagtacagggagaggtagcacatgggccatgtgggatagggttgctgtaggaaaccttgcctctgtgctgtagacaggcagattccaagcgcatgcccagggacctggcacaggctgaaagagtggtcactgtatggagttgccagatgccatgcttgcttacctggctagttagcttaagggcttcattttctgatctttggcagaaaatctctcacaggactatggatccaagttttcagattctttaggctgtcactgactttttctttgttgctatccaaagaacaaatacttgttaaatgccattctgaggccaagtagctgccatctagtctaattttgttggggacatacttgccaggcatataatgaggaaaatgggggtgaatgagatgagcttgagtttttctgagggggcaggatattttaaaaaaaaaaacctgcaatgcatacaacaagcaaggagagaaatcagttttgaggagacatatgtaggtctttagatgacatattatgtgtcttcaaatatggtggaaactggcttgccggctttggcttgggagtgactgaaggccattgaaggaaggcttgagtcagggatagtcttcaacaggtatgaacaggcacccaggatatgtaatgttgagagtgacttgggtggctttctcatgatcaagtgatccctagtctaaagcatttgttctgtcacagccttttccaagaaagctgagagcatgactcatccttattaaaaccacttgtggctaggctgaggcaggaggattgtgatttcaaagcagctggggctacacagcaagaccctgtcttgaaaaggagtagagaaactgtcacactgaaattcctgattcttacatgttaacatcttgaatggataaaggtatgactcagtggtagagtacccatctagcttgtgcaaggccctgggttcaatccccactcctgtgaaaacaatgaagagtgggtatgttatggcattgattgaaaataagcaagggacatttgaggaccatccaggtacaatttgagtcaagactctcaaagcaagaaggcctgtgtgtttcagtttataaaggtattcagagagccatagggttggaagaatcaatatgaaataaaaaagccaatttgaaaaggcaaaatgattccccaatgagaaatacttcatcagctacagggagcatgtcatgtagagcatggctgccctggggtggacttggagatggttcctgagtaactgtgctgtggcctcagtctcagaactcagggctgacaccctgggatacttggccaggtggagacatgatgtattctgtactttgtctccttgagcttcaagtctgatccctgctaccggtagtgcaaagacctacgaactttcctcatcaccactggtccagaccctctggctgctgccgtagctttgcaagctatggttagcaccctcctagaaatctagtgtgccaaagcaaaagccgctcccactctctaccctgctctttaaagagtgtgtgctgtgaggggccctgcagctgcactacagaccctcagcaactgaatgctgctcaacgttgccgagaggtgctaaccttgcccacagagagctctgctcactcctgaccgttagaaatgtgtcaccgaagtgtgaaaatacttatgctgttagacttcccatcatttcttttctttcaatccctctcatttgcatgggttactcataaatgtagatcttgggtatgatttgtacaactgccctgctgtcggtctgtaggaaagccttgctggatgggcttgtctctggccttcatctacaagtgctgggtgcaagtgagtcacaggtggtgccacaggcagctggcctggagccgggggtgcaaaacacagagtgatagtcgtttgacacaatttcagctctcaaacctgctttgtaaatgaaaacactgcttttggactaagtcattctctctgattcccaattgttcaattaatctatgtgtgttaacacctctctataacatcatagatagtgcctagtaatgaactctgcgagttcaggctgaggaaccctgaatgatccgccactctgcagctgttcaggagttgtaccctttttgtgatgtggtgaactctttgaggacttcagcactgtattcttaagatactgaaggagtgggttgaactgtagtaacaacaaggattttgctttttaaaaggatgtccctgcatacagcttagcaaccttgattgaactcagcctttcatggttacaccttaaggttgaaacccatttcatttcatcatttcccagaaggggcactcagttcacccatttcctgtttttaatctcaggttgttctgtgcttgttccacatctactctcccagtagcatggctatggaagccagcgtcacactcttgccccacctggcatctatgcattttgcacatagctgccatccgttctaagctatctgtgcacagatctgtggacagggctggctgttcccctggtgtctggtgccatggccactcatggagctcgtcaccccagcactgttgtgccatgtctgacacacaagctctcgtctccctatgtaccacagagtctctttagtatgtcacagaggtggacatggtggttaagaccaaagcttctaaacttgctccatcctatttccagtggacttgaaccactgtgtgtaaagaattttcattgactgtgcttgatacctcctgccccgacagtctttaaagatgtgtgtgtgggggtgggaggtgggggtgtctgtgtgtgtgtgtgtgtgtgtgtgtgtgtgtgtgtacttgcacacgttgttgttggtaatgatgttgagtgagaccagcacatgactggcatgtggtatacaactgagccatgcccacacatctacattcatgtacccaccccttcagcgtgcccttccctggcctcccatgtaaccagagtattgacctgaccctttcaattctgctcaggtttcagatggttaggaccctagggacaggagccatgcttacgtttgttaacccacaggtcctgcggtccaccaaaaataagttgccttgcctgagtaatcctggctctaagctgtcttctctgttctcatactgagtcctgtctcttcctctgttaggctgctggagattagataagaaaccgtctttccccccacccccactacagtctgtaaagcagggtcctcaccctcagagtgggtgtctcagggatttgccaggaaatgcatgagtttcacttcagaactttgcttatctgggttttagctgttgtttctttcccatcctgggacccttttcactgcgaggtgcagttggatgtgaattactgagtgatggggtcgggccagctacagagctactgctcttcttaagagtgtacaagttcttagcatcgttaggccacaagactgtcactttcagcctctggtgtctttggattcttcctagttaagcttctgttgtgtttctgtcgcttaaaagtgacagaagcctccaagttgatgtccaaatatgtttctgtatttgtaaaggatgtgttttacaggggctggagagatggctcagtagttaggacactgactgcttttccagaggtcctgagttcaattcccagcaaccacatggtagctcacaaccatctgtaatgggatctgatgccctcttctggtgtgagtctgaagagagcaatagtgttctcatataacataaaataaataaatcttttaaaaagagagagagagaggaaaggggaaaagaaggatgtgttttacttggaaccctccttggcatcctttggcagcatcagtaatggagacatgaatgtttcatcgctgcagagtgcacctttgcagatttcgtgcagtgcccgtttccgtcaaccgttttaggttgtttaagctttgttgttggagaatgagatggtgtggtgctcactgtgctgtacaacctcgcctcgctttcacggtccgattgcttcataaggttgagagacacaaagaggatgagagtcctggaggctgcagcaggactggcacattgggagagtgtgtgttcctgcaccagcaggtttccattcacgatttcccaggagcttggactggcaggccctaatcttcctgacatcagcccttcccccatcactggcaatgacaagctgtttcagctttgccacctctcccaggccactgtggatgtcaccgcatagcatggctgactatctagtgcagtctctggctgacacaggttaagtggccatgggtcacaagtgatgctatcctggtgatattggttaagctatctatgtgacatggcacacgtaggacagccatatgtcacgtgactacattcagtgatacaagtgcgggcatctacatgaccgttagggtattctggtaacaaatggcacagataagcacaggcaaccagaaccagcacctccacctaagcttgagtgatcagtggggtcccagaggctgtgctggcagagggatggccaagggcatgattgataaggctttgctccaatgttagctgtgttatatcaactgtgtttcttttattatttttgtgtttatttccataaatacctaaattgttagtgagatactaacatttcattgattacagagtttcaatgaccctcttagtcgttctcccccaagacattctgtgttcaaaaatatgatggtttatatatgtgacacatagaaaataccatccagagcgtctggccaagaatgtgcccatcagaagccttgaagacagcatgacaggtgtagggctggccagggtttctagggaaggtggacacaagagtcttgagccctcttctacatagtcctgcccaccagcctccactaggggaatcttccccagcttccattttccagggaaagcctgagccatctgaaattcctttcacaaagaaacacacctggcccatacaggtggacaggtaccttgtgctgtgtatcatctaggacccagtgtaggtaatatctgagtagaaaggtcttgtgtaaagaatgctcagagcacacacgagcacagaagagccttcacccactcagtgcatggccttcccagggctggacataaaaacacacagatgtgtgtacaccacacagtactctaagccaccagtctcacgtcaaagtccctccaaagtttcagatgctagatggcaagacagtaaacaaataggaacagctcttcagagctactagcatagaaagtctccatggacatcagtttgttgtgagagcaacagtggctctgaggtggctgataattctctggagcagtgagacggttgggacagaggcgtgtgacctttaatccctgccttggtgagggtgccttccatttacaccaggccgctctctcgcctcctcagtggggcctgcgggctctgccactagcctgtgacatgttagataaggactttttcttcttggtgtccacactctactagtgggctgcctttgactcaaccctgtgcttgctgattatctccacaaacagagtgccacagactaacacgttagtttggaattttcctcattcttctaggatattctctttcatctgttctcttcattcaaaaaaactgagttgtagaggtttctaaatgtgccctttttaagtattaatatatataaatatattctctgtttcagtagtctacttttgttgcttgtttgcttgattttatctcagtcctaacactagatttttattaaaatgtaaggaaatcttattgtggtttttattctcgctgtttaaatacaagagaaaaagaactgagtggcctaccagaagtatcaagagttcctagattttaggatcaaatagcagatagagtcaaatatgcagggcacagttgagcagcccctctcatcccacaagactaaggtagccgtcatactcttctgtggagagtaggaatacagagctcaaactctcattttatgttcaagaaaagctgtgtaaatacatgtatacatgcctgtgtgtgagaagacacatgtgtgcatgtgtctcttgtatttttgcatctgtataggtctaatggcatgtttgctgttgttccatcttgtgtgtgcatgcctattctgtgacagtatctgtgcatgggcctatatttgtgtgtctgtgtgcatgtgtgtattgtgtgtgacccaagctctctgctaaaccctctgcatcattccctaatcttacttccctttctgtcagttctccataactctttgatttcagttgggctggtgtcttgagcagcttcctcttttcctgcattcctatatttcagtgttcaccctcgttcctcttcacaagctcttaccatacagccaagaggatgtggaaacccagttacaatatgtcacacaacacagtgtcacaatcaccaagcatgtccccacctcctggggatagtgatcaggatgggataggagaggcagggagggacatggacagaatagagaagtttggctctgggaagcccaggacttcctggtgcgtagctgctatgccagatgcatggtgagcaaagtagaccattccatcattttctacaatggcagttggggttcacacatctgccttggggctagggcctccccgtcattgcctcataatcctgcttttcctccaaaatgcctgttctgtttggctcccaacttccctatttctgcctgttgggtgttatggtctcctcccctccttggaagtttctccatcccaaagccagttcctaccacgtgaccagctgaacaagcacctcagacagttcctcttgtctgggaactccagcttccatagggccataggatggctcccagcctattatctcccccagccctgtggatttcagaacactgtctccataactctgagtaggcagaggatcacctacatgcccaatacaggtctcttcccacatacgtgacttctaatgagcccccctaggaacccagggcccatggtccatttctgctggtactccatgatggctcttgggcagtgggtatgtgtgtgctgtatcttatagtactgccaagctaaatgctcctgagccagagacatctttctcctacaatgttctccagtgacaccctgggggttagaagcatatttctagaatggctgcattcctccaatgatgtgtttggcttgttggaaaggccttgtttcaaaatctattagaagcagaaagtttatttaaaacaaaacatgtcaggatttagggaattatctgggaggaactggctatgaggtcccataaacgtggggtgcatccatagcttgctgagtctcactagtaaccctgggcagctctgttgtctgtgagtcttacttctgtctctggtaagattggggagggcagtatttataagggttgctccaggaattaaacaagtaaatgcatggtagatgttcaacacagctccctcacctaacgaaagctcgcaagctactatggggactgtgggggaaccagtagccttgacctagatgctaagtgcttaatacgtctgattttaactgggaagagcacatagcttaaactactcatttctatacatttcccaataaagttctattgaatcatacaatgaaaaaaaacaggaaagaagaaagaaattctctcatttcaaagaaatgctaataaggacaggactttttgcaatggcctggtggtaagaaatggctggtccctactaggaaaaacatggtatttgaaggttcttcccaggagatgtgacattttgatgaaagtgccagtaagctaggggtttctgagtaatgagctgagctcagagaaaggtaatggcacctgcgcaaagggtgccagcatttcctgagtgctgggtgtcttatctggccactcagaccacatggagcccagagacagctatttttctggatttccttgggaggaagctgaaacttggtgatgtcatgtgactcttcagtcccacagaaatgataatgtaggggtaggagggcctgaatagaacttgcttgcctctgtgggcccattttccatggcagtttccaaagcttggaggccagatgttaggaccacagtcatgactaacacctgagagctttgtaatgatggccaaacaatatagaatgtggtcagcatttgtaatgctcagttcctgtaatgggagtctagaacagaaaggaagaagaagaataaaagggagaatgactcttgaagacctctctacaaaaagaaacatccaatgcaaaggctttgttgtgctgaagttagcagtaagttgcccctagacagtgaagggcttggactcccagcatgtcctgccttctcaccatgtgaattagcaacccccaaatctaattctgccaccagctgccattccttggccagaccctcttaacagtggttctcaaccttcctaatgctacaaccgtttaatacagttcctcgtgttgtggtgaccccacccataaaattattttttattgccactgcataactataattgtgctactgttatgaatcacaatgtaaatatctatgttttcaatggtcttaggtggcccacattaaaagggttgctggacacctccacaaaggggtaacaaaacacaggttgagaaccactgctctatagaaatgtgtttctgttcagatatagaggaagctcttgcaggccacatgtaacatcaggttcctgcccccagagccagaattctggagaatgtgtcttagcatggggataagctgatctcatattcagaagagtagcaatgggtccctatctgtactgttctcatcctccatgaaaatgtccctgtaaatatgatctatgtgtgctacacacctgtactgatgcactcttgtcatgactctgtatacacacaaccttgtgctctggtacaccaggccagccaagtacatccatccccatgagcacacacatatcccagccactgacccaagcttgttctcctgtacacatagccagctcttgcagatatcctctctgctcctccccatctgagctggcacctgagaaacaggtgttcctgggaggagcacatggagaaataaccaaagcagagctggggtttcgttgcctcctgtgagtgaagttgtcaaaagcctactgaccactccaatcctgatttctcagcctgagtgtgcgtaagtgcctctccacagacaaaggcacacactgccagccaacacctggacctgtggctgcaaaagctgcaggaaaaccgacatccttcccatcagtcccccttctttgctgagtcactctttgcttggaattctgacaggtgcccgttgggcttctggaagggagggacagcagaggatccaccctctgtgtgtcccaggagagattacattatcttcagccaccctgaagctcggcctaggcttctggaatcggtggggctgacacaaagccagttctggggacagggaatgtacggatagccacaaggagctaagccatctgatgttctcttcacctgagcaccctaggacttagagtgctcagctctgctttgcatgtgttccactcatttcaaggaccagcataccctacacctcacccatgtgagagctgcacgcttctgaactatatttaagaagccaggtcaagtacaatccatgtagtgttttcagccctacattttgccaattgctggttggcattagcaggcagttcaacttgttgctcttggaagtatgttgctgggaaggtcagtctaccagccatgtgtaacctcttcactcagctcacacctagcagtggatggaagctctcattagctggctcataccaatttactctgataacgacgaagcttgtcctgggacccttcccggcttcctcccaagcctctgtacttctctggtgaacacggccacctcttcactttgtggtaggcgcctctgactatgtctcaccagcacttctagggcctgagttttggaagataaacacagaagcctcctggtgtccctcctgacatctgcagttagtgctctggtgcatggcctaattatccagcaagattccagtgtatactctatcctcagtatactggctcatgtgatctagtaaagatgtctctcactgcacagaatttcaaatgaaatgggaaataagtatctcaacttttaactcatacccaagacctcaaatgatgtcaccatactatgagacacaaaacaagcacctttgtaataatgttcccctcctctgcccacaccttgttcaccttactcatcagaatactcccattctctgtttttaaagctttcattattgttttaattttctcatgcttatgtggttcttcttgaatcccaggtcttacaggtgatgtttaggagctttctcatggcaattttgcatactttgtaccacacacatgaagaagtaatgcttttgatgaaaatgtagcacttcttttaaaaaaaaatcaaaaaagcaagaaacttaaaacattcataaaatatctctaagctttttcccccagacaaccagatttaacctcccagctgtgggtctgtaagacccagagcctgacctagttgacatgaactgtgtgtaagagggccaggagagaacagctcagtgtcagaacctgggggaattacaaatggcaccatagtgatgacttgtggcttctcctgtaaatctgaatagaaacattattgttgctctctcctcgtcctctctaaacgaaattctgaacccatctctgtatttctaagtcatacattgctttttctaacctgatttgttctctgtgacaatttagtactgtgtttgtaaaatagagacaaagccaggacagggttggcggtgtgattcagtgggagagcacatgcctcatgtcttcacagccctgggtcctgccctcagcactgaaggtaaaactcaggtgttctacaacaaccagaaaaagggggacattgtgtcctctgcattgtctgacaggtggaactgggagcaagacaaactgatgctgggaacgaccccaacgtccatgtcccccaacagcctaaagcacagggaagatcacctcaaacatactacagatgagatgagtccccaacaaaatcctgaaacagaagaacactgttagggatttcagggctggaacatacaaacatcctctaccctggctccattgtcctgggtgagctgccaagccctcttcctgctgctgttccattttgaggaaggtgacaaacggtagctgggtgtagccaatgtcataggcccataggattctttgtggacaagaagataaagcgttatcttcccagcctgtggctttgtgctgagcacaaagctaactacttgtcctctcaggcccgtggagtattatcatgattcggcacacaaacctgacagaacagatgggattattcccacttggtggataaggaaagtgagctcagatagtcagcgcatgatacagtttccaccaaggaggaaaagcccagcatcagatgcctcccccgacctggacatggtcagctgcttcttccttccatgagatcatagcctctagacttacaaatgtctaagttcaagaacatccagaaccaatggaagccaagggattcatttgattggagagccagtaggcatagactgtagtgatgtatgacactggatgaaattaatgtcaaaaattactttccccactgttgactttgctctaaatatgcttgcgtcctaaaactgcatgtgaacaccaacatgttctgccatgtactctgacacttctcaattactggacatggatttctgaaactatccaactattgtagttattaagtagagagctttctagctgaactgtgtcacagataacctgtacctcctgtgcatgctaccaagtgacactgagtgctagtcagccatggcctctttctgagcatggctatggtcaggtcacatgagcattcagagctgggcatttatctggaataggcttatgtgaagaccaaaggccagaggggggagggtcttctgaagaagcgtctccaggctatgatcatcgggcaggccctgcaactccataatactgtgaggaccaaacacaaagagtccagagagtaggcaatctggttctaggggagagatgatctgggtgtctccatctcagacccagaaagtcacttaagccaggaagacacatgcaaatggtggctgtggggtggagggtggggcattgctctggaacaagaatgtgcatggttaaatggaaaccataacatttgcaaacatgggtaatttgtgagctttggttattgttttagcattttcctaaggtccatccctttatttattgaatagtgtgatttgacaagagatctataatagcagttgccagaagtagaggaattttgacacaagattttcagttctctcacagagcactgtagactgctgggccatatggaagtcagatgtgatcatagagactcaaggaaggtgacagcctcagtctgatagacacgtgtgctgggatgggagcccaaaggccacagcccacagtgcacaaaaaaacctaggcaggtggacaatggtgagcaggaagcacagtcaggaggtaacacagacccagcctgggcttcgcagtggcaggggtatgattggagcacatcagggaaactgaggctccttctcaaagaaactgggatgatcattggactttgtgggtggccatggaggagctctggtggattcattggctagaaccttgtttactgacacacatggagaaataggaaaaaagctaggccttggggagagggtgggtttggagatgggcagctgtctggtgcctgaagggcacaggagtggcaggcaggaggcagcccgggtgcatcctgttctctgggccttggcacagttctgctgcctgctctttctatacttgaatgcctggaggcatgcagagcatcgtagcctacacagaaggacctctgatgtcccaacaggagatggttgaaagagttgggacagcctcacagctcttctgactctgcatctgggtgagtggtggaagtcacttgagtaggtgtaagactgcacaccaatgcacctctccactgtgtccacaggtgggacgtggggcttctttgtatcttagctgtctctttgcaaggctgaaaccacaacgtcttctgtcagtgatgtcatctagctagtgtcctcttcccgtgagaaaaccctgatcagcccaaccaacagggaggtttaagaagaaatgtatctgtctataaaatatactggttctcaaagaggaagtgcttttggcttcaccctacactcctgtagaatatacctatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaggccggcagatggatctctgtgcatccaaggcctgccaagtttacatagcaagttctaagacagccagagcttcatagtgtgatcctgtctcaaaaaattttgttttttaatctgtgctatttcataaaacagtggcttaaagctgcaggtagactgtctgagaaaagaggacaaagccaaaaatcgcacggtgctccctaggtcccattgtggggtgagctgcttctgatgggatagtgtatagacagggtatcacagggcaatgagcttgcacctgaagatggctgcaaaagagcaagcagccaggaactgtgtcctgattcagagcttctataagcaatctgggaacattatccaaggtactctcagtgacccctgagcttcccgcctctgtgtgtacatgaagaacaccaggcttagctgtgaggaccacagagcaggcacaactaggcagttgtatttgcaacaccctgcaagttattagctggccacgtgtttgtcattcgggaaactctgttgtaaatgcagtcacccagtgtgaccatattcaggcaagtaaacacatatgcatgggggtgcacacttaagtgtgtgaatgcagtggcaaaacttacacatttcccagtgccttacaaccacccaaaagaaggctgcttgcaaaactctgtcttttgaattatgagggtcatgtaactagctttgactttaattttcgtatttctgtgctaaacaccaaaaactttacttttcacatttacatgctaaacactatgcttaatgcaaagtatagaccttcctgtgagcccaagatcccttactgccaaaacagtgatggtgtctacctcaaagacccacagtgcagcttagaggctgcctgtggaaagcagtttgtgtgcacctgacagacccactgagttgctgctgtgagagactggattttagcatagatcgggggtttgctgtttgccgtaattcctacccacttagaacaccatagaatgttttttctaagtccagccattgtatctgtatcaattccactttactatgccagacagaacttagcaactggtgctatattttgcttttaagcttttggtagatttttggttaaggatgaaaattagcagattgacttgagttatggtagacaaatgattaattcttttgaaagggactcaacatttcatgacccagcatcatggtctttacattaaatagtaaaaatgtaaactccaggcatggcaatgaacacctgtaatccccacagtagcagagggagcaacaggcggcccacccctgagctttctggctagccagtgcagttggattggcaatgtacaaattcagtgagaagccctatctcaaaagatgatgatgggggctggagagatggatcagcggttgagatcactgactgctcttccaggggtcctgagttcaactcccaacaccataatggtggctcacagccatctctagtgggatctgatgtcttcttctggtgtgcctaaagacagctacagtttactcatatacattggatagatagatagatagatagatagatagatagatagatagatagatagatattttttaaaaaaaaagatttgatggtgatgatggtgatggtgataatgtctagagcaattaaagaaacatcagacgttgatgtctccacatatgtatccacacaactgcacatgtactatccacatacataaagtttttcacggggaaaaagggaaggttctgtggccaaacaaatttgagaaacagtaacttaagcaaagtttgataactatgtctttttcctgaagtccatcagcctttttttcctgctgagtcagtagttgatcccagaagtttaatttagccagctactttgtgtatacaattctggctgacattttgggaaagaagtcatgtgagcgtgcacccggtgtgcatgcatgtacatatacacacacagacacgtgtacagagtataacaggtcttaggaattggaactcactaggaacggcctgcgaaagactacaagcacggggcttggtgccattttcaaaggcaactactaagcaatacggaaatctggtagctccttttggagcagcaattccctatccaacaggcagatgggaaatgttttaattttctctggatacaataaagaaaagacaaaaaaaaaaaagcaaatgaagaacgtttgaggggcagactacccatgaggaagcacactgattgtgcagacgtgtgctttcccgtgtgagactgtgatgtggccaagagcacactcagccagtactactgaatggttgctattggttctaggatgttctaggctgttgaggccgtcggagcttgctcacagttcagaggtcctgctctgaggagtgacttttctgtagcttgtctgaagacaacaataacaaattagcagctaactggtggttttacataataacattgccttttgaaagcagcactgtcttctgcactcttgtgtccgtgatgatttgacaacctggctttctttttgccttctctattgcagttgcatatggggctgatggctttagggattttcatgcaataattcccaaatctttctctcgtaagtatatgctttgcttctagaaaacagatgttcatttcatggtcagttccatcacacagacaccaccacttgcatgttctctcatcaacaccttcctttataacttgaaagtgacatggactaaatgtttgccattctatcattaaacacccagcatccagtgtgtcattgatacaataaagtgcaaagacagagggtgagggtgttgtttggtttttgttttgcttctgaggcagggtttccctattattcctggctggcctagactgctctgggatgcccagactcatcttaaatttgcaatgatattcctgtctctgcctctgcccctgcccctaccccctccctctgtccctgccccctcccctccctctgcctctgcctcaccaataaggatcagatagtgagaggattataggggacttttgggatagcatttgaaatgtaaatgaagaaaatacctaataaaaaattggaaaaaagaaagagagagagaaagagagagagagagagaaagaaagaaagaaagaaagaaagaaagaaagaaagaaagaaagaaagaaagaaagaaagagagaaagaaagaaagaaaggtgaagaaagaactaatgtagccacagtgggtgtctcactgggaggctgctcagcagggtcctgattaaaactgtgatcaacaactttgtggtccatgcttcctgtcagcatcaaacaaaccaacatcttttcagataacttgtgcaattttgtgtgacaggaaaaaaaaaaaaggtgcaccctttttcccttgctctggagtgctaacctcagaacagagaagaaaaactcatgggtttccagcccattcttctgtggtggctcgccacgtaagcatgcaccatgttagcgtgcatgcagcctaccagctctcctcggagctgctgtgccgaaaactatatggtaatttcatctcttaatacattgaaagttgaaaatgataactatatttgagcaaccataaggagtattttcaagaatagagaaggcttttttttaatgcaaataaaatcaatgcaaaagagttacaggttgttagaccccttaggtcttaagccttcagaccttgtatcaataaaatgtttaatcttatgaagcagcagcagaaagcagagtgtattggcatcactttgagaagagctttgtctgtgtgtcttgcttcagatcaaaccaaagcacactctaccaccaaattacaccctaagaccagcttgctgacatcttactactctaatcttaatattgagatgtcagccgcgttaggtttatgatgtcctgttatcagatattacttgggaagtacagtacttagcagtatccatctcaggatgctcctggtcaaaggccagatagacttccctctccagaatattagaagtttgctaagatatttctcctattaattatttcttcagttcaatgtgaaggtaagaatttgagatttccttcttcatgtaagcatgtatgttcacataacatatttttatgtgtgagctgtgagtgtgccagggcaggaagtcatgttaattttgagcctgccaatcacagttttgaaatgttttggtaagtcaagtgcacataaaggtaagacagcacattctaagacacattttcattaagcctgaggaatgggcaaagcccagcattacctactgaccaagcagatgggtgaggttttcaggatgggaaaaaatgacagtgggagatgttctgaaacatgataaatgttttcatgtttttcatgtctatctgcttataaagattagttcatagtaatactatctctttttctttctctcttcccctcagttgtatctttctggaacaaatggttggttgagcctcaagtctccgcccaacaacaaccaaactgttctgggccaatatcgccaccttgtggtcatgcttgagaactgacctacaggcttccttctggaagttaaaacaaacttttggcctcctctgccatctttatcccattttgagtccctagataccccccaaaaattaaatatgccttaaaattcttctttcttaataagttttcattttctgatctatttccatctctgacttcattgtatttgaaggctaaacatcaaataagattatttctaaaataggcttgattaggtagaaaccctattattttaactatttttaaatgatattaagtcatgcaatttgttctaaataatgcttacaatttgttctggatttgagacaaggtgccatgtagttcgggatagcttcaagtttcccagggagttaatggaggatggcctggttcctcctaaccccttgtctctgcctcccaccacactgctggctcctttagaggaaataaaaaacactagtctgcacatacatatgtgtctcaggtcttcacctattaccacaaataaatgaaaatgtacaaatataccttatatattttaataactttgcttattagctacagttattataaagatctttacacttgcatctgcctttttccatttaaaatattgaacatttcctttacctgacataaaaccaggctggaatgacaacttcagaatttttttttccaatgggaaaataacattgtacattctgaaatgctacttttccagtaaatattaagatgcaagggaaataacaatgtagacatcaaatctgtgacccagaggctaccctgcatattacacctctgcattaaaaatgctcagttgctcacaagggcacacttggcagccaagccaggcctcccagttcctgctggcctgagttccttcacttctccagagtctttcattctaaccttttcctagatgctagaggccttgccacactcgggtcaggaggggcattctcttaggacagcagggtgactatgctggtatacctctaaaatacataatgagagggttttttgttttctccattttaagtaacaactgagaagtaaggtagcttttataaggggtttgaaaataccatgttaacataagccatgttttgtaaacactcaaattggcctcgcccattatctgtcagtatctggaagagtaggttgaacccagagctttggggggacagggggaatattcacaagactccattcatgttttatatttaatcagctcagtgaagcacttcatcaagctccctgttgttctcagtagtagactagggacagagcttacacaatatgtgtgagtctattccttatatgtagcatttcactgaaggaataccacagctaaacagttctagaaagagtcccttgttgtcatggacaacctttttggttgaatagaaatctgtcagattccttatttagcaagcacccactttgcatttatccccagagatatgagggcctttcccatgtttgtatagaaacccttcacatagcaggaatcttaagttccccatgctgacagtataacctgttttttgccaaatcatcttctctctggtcactcatctccgttagacatcacagaccttccaagtcaaaacatggctggcagtgtctgcatcacagccataagtcccagctcagcaagatgtgtgcacagcctgctgtgtccccactacttacggtccttggccacacccacaggcatctgcagacacagtatcttctttctgaaaaacataaactttcagtctttaactttctgattactgatcatccttcccgtactatctattgactctctctctctctcactcgctcgctcgctcgctctctcgctcttacacacacacacacacacaatcatatataattaaagctccagtataaatcaggccaagtagcttggacttcatactctatgtccttggcagctatccacctatttttccacatacatttcttacccccattgtatctgattcccacactgaccctgggacaacttgtgagcaaccctcatgcctcccgagttacctttctcctttaatgctatcacagctggtggcagcaccatcttctaaggcagaaatgccaaagccctgccttcaggtgccctagtcaccctagtgataggccctcgggggctttcaggaatccagtagcctagaaagcagcacccatcacctgattcataacctgcttcctcctgactctccactctccctcattttgcaagcagcctgctagaggagagctgctcctggtatgagaagcctgaatgttactgcccatgcaccctgctgtcctggccttctctgcgaaacacccacataggcattagtgacttgtgccaagaaatccccccagaggattgcacatgaactctgctgtttttattcatacagaaaaatgcttacaactggcatgagcttctctgccctgcatgcagtgtgctcaggaaagcaggatcacagcctcctttacctcagtggagtcaggaacatgctaaggggatggatcatcccaacacatgttcttccacaaggtgatttttacccagctgtggatgcttcctgtttatacactttgctgcagttctgtgtcttagctgtcatggctaaaaacttgccacatgagctatgatcctcttcatggaatcttttactacagagagagagagagacagagacagagagagagagagagagacagagacagagagagagagagagagagagagagagagagagagagagagagagagaatattgaaaaataaccagaggttgagatttttgtagttttactgtgctgacgtagtctatgatctgttgctataacaaagattccacagactagttagcatataaacaatgtaagttcgtttagcttgtaattgtggaggataagaagctgagtgtggtgtctacatctggtaagggacttaagtggcgagatgggacattgctctagcacaggcctgtcttcctcttattcagctttgcgttgctaagtgaaaacccaaagcaaggggttcccagaggaacgtgtatctggttaggctctagaggttccaggcaacccagcagggaaggctttggtgagagtggccaatgatagtgatgggagcatgtgtcagagccaatcacacatcaaaagttgggaagtagaaagtgaccaaccgggacaatatagtcccacagtctttttgaggggacatcactagccatctaaggacttcccaccaggtcccacctcagaacagactctcaccctgagtgagcctttgggaagtgtttttccaaaccatagccatgtgagtgcagatactggtgaatttgaatctacccaaagataacctaagaatcgctactccagagtccagtgtcattaatcaccgctctgtgaaccgcagacctttcccctcttgccacatggataggatctggcctctgagggaagtaaggactgctgatttgcaaagtttcggatcagagacttgtagggaaaagcttttagagaattccccattacagaatttctcagtgttgtcctggacatgtgcggaattcagcctcagagttcattctcacttccaggacctcagagcccatgctccggtttgtacgtctcatcccattactaagccagtaagtcttttctgcaaagagctaacaggataatattggcagtaagtaggcactggagacctctgtgtggagacctcccagatctagagctagcaggttgctagctctgtgaccatagcaagttctttgactgaacctctaccactacaaaatataggatggtaatggtgtggcccttttgagttgttgtgaggttaaatggcaagtgccattaaagtaccagagggtctaggacaaggtaagtacagtaagcactgttgggatcaggcagagccttggtggatgtcacttgctgtgccccagtccactgctcctttcctcagtcctctcagctgccccaggctggccatggctatgaaagctcctgtatttacagatgaggaatgaggcacagagaagtcagatgacctgcataaaatcactgcgcctttaaataaaggtgccacccctccaggccagccatttttctcttggtgtcagaacctcaaatgtcccagtcaagagaaatttgggaaataagattctctctcaggctgtgaagcaggtgggctcctttaactcaatattctccattgtaaagtaaccttaggttcccctccagggtcgatttaaacacacagctgaattcaccccaaaatttgggaaccagaaggattggggaaacccagaagagcacacttcagacatcctctatggccatgtcctggctgctgctctggggaccaaactttgagaatccttgaccaaaagtgctcaaattattatgtcaaatagaggctggagatccagatcaatggttaatagtaattgactgtcttgcagaggacccagatttagttctaagcacccacatttggcgcttcacaaaagcctgtagctctagtcccacaaagctgcacacagtgtgcatacatagaagcagacactcccacatacacacaaacgaaaagcaaatgcctgcttcttaattatgtcacagtcacctcactggttattttacttagagcagcatacctccctaactcttatgcacctagaaaaaacactgagaaattatggctacagtttccactgccattgcatgtgggattcaccactgtaccattagtgttttgggagcatgtttatgcaatgtgttgtattttcttttcaaatgagtaggcaaataacaaaactacatgacttgtgctgggactacagcagagtcaatagcggtgtttgtttgttaacctacaagcatcttcttctttgaaagactgttacctgttgcactcataaactattccagctcacctcttagcaaatgaaggagatgtgaggacacctccaccttagggcacaggctggggtatgctgctataagataaaaaagaaagccaattgctaagaaaacggaacttggacaagggagttggaatcagaggtccaaacagcaaagagctgttccaaatttgttgtgcatatgcgtaagaaaatactcacccgttcagacccgcatctgtccctgcatccctaagtgcatcccgtaggtaccatccacactctctggaagcttggtgcatgcaccagtcagactgcccgccctgaggtacaggctcaaaactgcttagaagctccaactgtctatttgatgccttgttgctgctgtgttgctatcttgtgacttatttttgcagtgacactgagtggcctcctgtgttgtctctttcagccagtaatgttaaagtagagactcagagtgatgaagagaatgggcgtgcctgtgaaatgaatggggaagaatgtgcagaggatttacgaatgcttgatgcctcgggagagaaaatgaatggctcccacagggaccaaggcagctcggctttgtcaggagttggaggcattcgacttcctaacggaaaactaaagtgtgatatctgtgggatcgtttgcatcgggcccaatgtgctcatggttcacaaaagaagtcatactggtaaggcctgggagttttcccttgagtgtctcctgaggtcctgtgggggctgaaggagcaaaatgtactgtcaagggctggggatgcaagttagtattgtagagcacctacctagcacacacagtccctaagttcaaagtgcagaaggagggtgggaaaaggaatgtggtcttgaagcatgttccccatagactagcagggcggcacttgcttataaatagctcccaagttgtactgaggcacagctttcttattctagggcagtgtctgaaaggtcttctcagcatgtacctaatcaaccctgtgaacgaaagagaaggctaacagcatgtgtgtgtcagcttctgagactctgatagtatactcgctagaaaaaaagaaaaaaaaaatcccagccacagtgctgactctcatgtccaatccttcacaagacgagatcaaaagctagagacacaccaaaactgacttcacaaatttctcattgagaaactacagagaatacttgttttaatcttgttaacacttgggattctctattctgaggcattagtgaatcattagtgaggcattagcctagcagcaaaatggtcttttcggaaagggtgtaggtcagcataaagtggttcaccctccagtctgagtctctgagtcagctagccatattgccacaagttttcatcacagagcagtaggggactttctgtcaaactcctattacggtagaaggtttgcacaggctttaagagaataagagaatgcaatagtctattcaaaactaagaaaatgttcaagagccatgcctacccctgccactggcactgtgggaagcctaaccagcttcagtcggctcttctactcctgttccacatgtatatgaacagtcaactccttgttcaacctaactgttactccaccaccactaaggacactaaagaggcttcctagaaacatcagtggtgttcaggacaagtgtttgcatggtataaggtttctttgagaaaaaaactaaagagaaacattactcttctttccatagaagtttcttgaaaggtagatattataacctggcaaattcacctaactcttatagccacagaaagctcacatgtaaaacgtatagagcctgggctatcactacccatacactggcttctttggggcctgagaaggctggcatctgctagtgcagtgtccaggagggagaacaacacgcacagatgaatgatagcgagttttactagactatctcaagaagctgaggaagatggcttggaaaggacaaccttgtctgtttcttacacgggactcaacaagcgtgcgttatccaaaaaggaatcaggagctagaacaggtatagagcagtagtgtcatcaccaaggaatgaaggcgtttccaaggttgggttttatatatggacagaagcagtttctaaaattatatattccacgtatagtatatgtacaaatgatttataagatgatacttaaataaatgtttgtcttcaacaaaagtttagctctaaagttaggcaaatttggcttttctgaaaggagcctttagttctcaagtgactcgtagaaatagacctggcatacccagccctgagaaaaccaaatgtgaaggtaaccttgctcttgccttctgtgaggcagtggaaattaacatggagaaccctgtgacagatgctcaaccagtctagggcctgtagcaaaccattgctgatagagagcaaacctctgactgtacagtaaaaatccccttagatatttgacaaatgaatcaaattctcgtgtagtaaattgctaacatatgactgcctgccttgacttaaaaaaaaagaagaaaaattacatgtaatgattaaacctgctatcaacagatctgggagggtacctgatatttgctacatactttcctcaacaaatagtgactaagtatcatacctaccccaatatgctaagttcttcaattatggaacagataacttacagaaagaggaaacaggaagagactacacacacgcacgcgtgcactcatagacaaagtttggtcattgccaactccacagtatatctccgtatatgtgaatatacaaatccccaggtagaagtaaaaaccccatttagccaactaggtttgaatagctagacagagcagatgggctttctcttccaggtctgggtggaatgtgtcagcaaagttttgggctctgcattcctacaataacagcaggttatgagaacactgcccacccctgtgaaaggcgctgggaatcacttggaatcttgagaacatgcagggcctaattcagactctgggagaatctggagagccagcattcctatgaagtcctcggaacgctgggcatggaagctagagcacaataagcccccggggacatgctgctgaggacaggacaataagcagagccatctctgtggcctatgaggagctgatgtaggatgtgctgccccagtggacagctaggatgtgcaccagagcctctctctcttcttcccattgcccatgacccagtcaaccagcctcatgacttgcagcccctttctagtaaacaaagatctcaggggcatagcccagcttctactcctctcactgggtggcattccactgccgccattttctaaatggcttgtgggcaccggtgtgtcacttccccttgggtgctcagttggtttcatgtttgattcaagtgtcacaaccccagcgtagccaccaacagctcagggtgcatctgaggatcaccctggggtggtagggagctgcagaagggcagcggggcccacctgtaacatcattattctgaatagcaaagactaggaagtggcctgagcagaacaaagaggctggcttcctgtggtctcctgcctagcaggtgctgccacaggcgtggtagttacacatctattcttgtatgccaggctttttttaaaatctaccttctgcagacaggccttcggatgttctaccaggtctttttctttttttaaagaagatattctttattacccaagtaacaggtcgcaaacgttgtgacagaataaaaagtgtggagttcctgggatggaaattaaattcaaaatttgcagtatctaatgtctcatcccagttaaatgtaggtggatacaagcttaaaggaccttaacttagctacaggctgttgtcctccaggaaacaggtcatggccactgtcaacagaagcagacatgggcactgtcccatgatcttcgaacacacccccttatgtgtaacacctgcactgagtgaaataccatatgatccattttagaaatgtggtctttaagcctccccaccatgggctgtacattcatggcccacacaatcaattggaaatcagtagatttacagtagctctgccttaccttgctttgtagcaaggcttgagacaccaggcaagcagtccccatggagagattttgactcaagtgagaaggcaggttttagtccccaaagaatgcccaccttcccttcctgtagaagaacaatgtgctttgaattatcaaattcaaagaaattgaaagaaattgataattcaaaggcattattagtcctgtctgcctcccaatggccagaacactagctcgaatcacatcagggagacacctggagcgcctcccagctcagaaaggggtcactcagctgctaagcacgtgacttggcccacttggatcaccaggagtgtcttctgaagctgtcccgtgtgctttcccatgcagcctgagggcccagccctctctgaggagcagctacagtgttaggcacgttccacttccccagccggatcttcctgcatacactgcttacttttcttgtttccgctcctccagttggagctgaacactttgtgaacacagtgtccgctgagtgtgcacttgggtttcccaggcgaggtgatggttagtgaggcttctaaatgctaacacctacagttatcgttctccatcctccttgacgttaaacagtgtcgtcacgttcacctgggtctaatccagacaggaatttggggaaacgttgaatacttactggttagtatcaagagccctctgactggccattaaatatcattgtaaattaattctaacttttgtgtttgcaatgcccagtgaaaaagacctagaggtaattcggaaattcaggcaccagtatgcacattaaagcttaacctggcacagcttttaacagtaccacctgtgataaaaaaaactctctgctgcccctccatttccgtgttggagaaatgttaattgggtatttttaacacattgttcacccttaagagaaatgtgtctcgggacatgggtttcatacataatggtcttttaaatgaagcatctgtccttcaaaggcagcgtttataaggcacataatggacacaccattcctgagagttaaaggctaagttagtgtccacccagcaggacagtcacacactctttactcacaagtagctcctgcaaccatctccaaagccagggtgtaagccaaagctcttgggcacatagtgcaggaaccctgggctgtctcagtcacaaaccaagaaacctccttggaaacgccctcaatggcagcaagatctgtacctggaacatgacttgtctactgtggacacaaaaatgaattcgaaggatctctgagttgtgaggaaagggaaaggcaggaagtctcaggcaactccgagcgcgggagccaggggttccctctggaggacaggtcacggctgtcctgtccctgaacttctcttttattcagtctttctccagtctctccctctcacgctcacactttctctgtctgtctctctcctgatttgcctgcttagggacagacaggtaatggagaagaaattgaaagggaaaatacagggaaaatgtaaatgaaaagaagttattataactgttataatgaagtgcctttcatttaaatataagaatgtaacgctgaaatgaacttgtgatcctgaaatgcatttttaatgagtttcctttttattttgctgcttcagtggcatattttaaagaccctttgaaaaaagccacattaaaaaccccaccaaatgccacaacacgcaaaattggatattggtttattccaaaactgctgatcaggaagagtgactcttcatcacaaaatgttgcagtcactttatttaaatgagtttgaatttgcattgtgatgtgccattctgatttagggaaaaaaaattagattttcagatcaaattgacccagccagtgaagcgttaagcagctggcaggtttagtctgaaagcctcatgttctatcaaacctgcagccggtggaagtcaccaagcccatgggaaacaactttctcgaggccgcgctcctgagcagctctctctcagtgcttaccatgctaccctcttcccttcttgcccaggtgaacggcctttccagtgcaaccagtgtggggcctcctttacccagaaaggcaacctcctgcggcacatcaagctgcactcgggtgagaagcccttcaaatgccatctttgcaactatgcctgccgccggagggacgccctcaccggccacctgaggacgcactccggtatgttcactgagcatggcagggatgccatgtagggaccccgatcatgtgttccatgttcccagccactgcccttccaatccacccagtccacagccctctggggtgttggcctcctatgtggtaatcccttattcctactgaaccagaggaaatggggggggggggtgcacacatggaaaccctgcctccttggtgtgttttagaagagctttccctcccaccatgtcaggtaagtgggtatttttctgaagtatactgctcatgcccttaaccttccatacacatccttttacacctattgctgtgtcactcatatcactggcttatgtggaatatattgactagcagtaataaacgtaattattttcgttgcagagagataggttggtcagaatataaccctgtcagcccagggcacactgccccagccagagagtaacttccaggctggaaaccagcagaggctttgatgggactaatcagtctagagttgtcagcaaactgcagacaggaaaatttccctgtaaggatggtccagatactctagagtctcagaagaccatttatataaatgctggacagttgtcagaatgttcccaacctgtcacacagactcatctttagttatcatacatcttctgcctcctgggtggcatcttatccagtagccctataagcctccaggtctgagatataggaaataaaaactatatgctatgtttgcttgcaatctagtatttgtaacatgcatatgtcgcttccattctgcactgtcgtgtggtgtcacgtgctacactggctttaggagctctaggttgaggggccttgcccctgccctcctagagtgccctgtcataacaagctgtcactctgtccttgctcagtgacagaagaaaggtcctcagctcatcttcccaaacaagatctcaagttatccatctcttcgccccatatttcctaagcccctcaacagcgtcctatgtgtgtgtggcatggtagagtcccgagggtcctgcaggagcagaaagaaaagacagtctgtcctgcctggaggatccatagagattcccacagcaggagggctacagggcggggccagctcaagctaagtttgctttagaggaactctaaaccaatgagagcagaggttattgcagcacacattttaacaggtggtatccagagctgggctttctggttagtggtcacctccaggtgggcagatgtagagaagaaaagaagctaaggctatgtgtcatctcccctgtactctacttccctacctgactggcagtaagcagtcaggagactcctaaaagtgtgcagcagaaagttgtgacttgggcgagtttcttggcactgccaagaaaggtggtgccctccgttgaggagctgtcctctcaggcagcatgtgggtcagaggacgtgtcaggagacagacacctccctgtcttaggtaggacactacctcagatctgggaggcgttttctacaaggaatgaggagagccaaaggcttcctgggatggaggtaactctgtctgtgtgtagctgctccacaaggtgaaggcactgcaaggcagggagtgacatacagacctgggtaggtggcaggtgacttaggagaaagtcacagagacacagtaggcaggtaccatgcactcagattggcagcaagcacgacttcccaagccaatggaaaattccaagacccacttttaggctgataccagtcacagcactatcaccctttaattactggtttacagtataaatctttcctgcatgcccatccttcaacttaagatagcaagataacatcttgtgaaatcagtgctgagttttgcgttttgcctacatgcttgatcattgcatttaaggcatggtggtatcctcctctcggtggggctaatgatttgaataattatttaaaacagacagagggctcctgacagttatttctgccacagagtcaccaatctctggtaaagatgtccaccagagacctggggcattggtgactcgattgtctgaaaatgtacttaacaaacacagctctgggagaaaagaaacactgtgtttccttcttcaaaacaattttaccagaatgacaggacttcagcctttgtctgcaaagtccagggtgttatattttcttaatgaatggccacgcccacattccattagaagctaggggcaaccatagctttccctagcatcctgtggtggtctgacgttctagactctactgtgatgatggaatttgtgctggtatcagggttggtactcttttgaaaactacaaactttgttagagtcagtttggttctcgtgttctagcattaaagtcaatcatatactaagaaaaatcaggtaccataccatttatatagggaggcaatttgattcacgaaatcactaaaattaaatttttttcgggaaagggcatgtattaatttctgtaaccatagaatataaatgtgcaaccatatgtaatattcgttccatatttcatcatttgtggtacatcactgtctctagacaaaaattctatataactggagagacggcccagcagttggagcactggctgctcttccagaggagccacatttgattctagcacccacgtggtgattcataacaatctgtaaagccagttccagggactccaactccctcttacagcctttgtgggcagacaccaggcaagcaagtggtacacagacatacaggcaggaaaaaaacccatacccgtgaaattaagtaaaataaaaatctgttctggagtctatagatgaagctttggtttccttgagagcatcttcatagcatctggtcacttaggaaagagacttaagtcacactgaattaccagttatcaagcattcctgtttggatggctttatatcatacttagcatgagaaatgcaatgtgatgttgaggtgaaactctatattccacataaagtaattggagaccatcttctctaaaaaagggtctttattgaagtctttaaaaaccgatattatatggaccctttcctattcttctaaaatacctctcaaaaaaaccaggaaggactaaactcttgtagaaccacattgccacacataaaagccactggccatacttaagttttagtaaattaaaattaaacaaaattaaaatgttagtcctaacattaatctagccaaacttagaaactccatgtaactggtagctaccatagtaaataatacagtgaatgccaagctgaacagatatgcaaagaacacttagagtgctcaagtcgttagcatgagttctaatggccaaggctgatctgggagtttcatcatctcatattctttggggatagaatagaggcttttcatatgctcttcctatgcaaaacacattgtatatcctccaggtatatgaaaatgaatttggcttatccatatcccttttcattttgtgtttatatattgtatattcttaatattcttaagtgggatagtatgtactatagtgtaaaatatatttgtattatatagaaagatacaatttagaaatactcatttctttaaagccttttcctgccatgatttcttagagacttgcgcaacctcattttgcctcctgaattttcaccttattcattagaggttgtcacagtaaggggtcagcctggggagaggcccaccctgacagtgaatctgtactctcctcatgtttctgtccacactggaacatggagatagtttactttttaccattaaaggagacccttgagtccgtgtcataggttaagatgaaattcatgaattcttggtacactcaatgagtcacctgggcattaacatttttaaaattcattaattttgactaagtccataatagtcatagctcagtagagagtacattatttttttatcttttttttttggttataaatgtattgattgcatccccattacccagaaggccaatatttaattggagtcttaaactcaattgtgttttctgcagttggtaagcctcacaaatgtggatattgtggccggagctataaacagcgaagctctttagaggagcataaagagcgatgccacaactacttggaaagcatgggccttccgggcatgtacccaggtaagcactgaggccctgctgagctgcacccctccccctcccagcgcctgggccaggatggggctctgtggcctgtttcagccacaggaggaactttttgtcttgtagcaatgcatctacactagggacaaaccgtgcttctctacttcccaagttctcagttgaccagtcatacataacctgtcttaagacctccttaacagcagtgacccttttaagagtctgtgttgtggggtattttgtcgttgttgtttgcgttgtttggtgtgttttttttccccagggggtggtgggtgggattcaaaccaagaattggctaaagctatagctaagtgatgaatgagcttgcctggtgtgcaagaggccctgagtttgatctccagcaccacaagtgagaaaataaaataaccaagttagagtagtgtcgttcgtgatttcttctttgtgtttaaatatccaaataaaatgtgagtcttttaaaaaaaacactaattactcatgaaggtcttcaaaaaaagaactgttaagctagaactaaacattgatttagactgagctttgagtatccacagttggagagagcagaacttgttaggagacctggttggcactggttctgagcctgaggaagagtgttgaatgtatattgagtactacattgtggtgagaatcagtttctaatttgtcctgcctggtgtctgttgattcagagcactgcagtgatggcttcatgctccagttctttctcaagaagtgagaaattactcttgcaagaagcagcaatctgacctcagcatgcccaaagaggcatttaattacattgggttcttcctgcctctgcctcagggcacattaagatacactagatgattatagttgcccccaagccagtgctagccagcttccatcactgtaatgggtgtctgagacaaccggtaataataggaaggaaattctgttttggaactttggaggtttcaaaccatggtcaattggctcaattgctttggccaggtcatgctgggagcacaggtacactgaaatctcctgccagagagaccctaataagccagggagaaagagagaaagaaaaggttagggacccatgctccttgttgagagcatgtcccaatgatttaaggacttcccccaagaccccagccctcaaggttcccagcatcttttccttggttcatcctagagccaaggcctcccacatgtgggcctgtgggggaccctgcagttgcaaactgtggttgcctaggtcatgtcttacttcactatttcacccctgaaacccctgccttatacatatacactgagtgctggcttagggaatatggcattgaggctccatcctgccaataaacatgtacattctcatttgtctcctgaccctgaccctccatctccctcaggtcacctcattactcccacggacctagttaggttgggtccattagttgaaaactgcctaactcaagagatgtaagctcaagagatgtaaaagtaaggtttgtttttctgaatatgattttctttagtaaaaaggttaaggatacctgttacatttcacctatatctgcataggataaggaactatctcctgagcctcacatgcaccaaggacagaggaaaaagtactgggctcagaggtgtggtatgatgtcacctgagagatggagcacctgagagaagggaagatatgtaaattagcttgataaatcacatgtatgaatgacttctagaattagattttatgactttctgtatttcctcctattaatcagagtgggctgaatgttgagctatttaacaagacaccctcataattcactgttaacagaatatgccagcagtagtatttgactagaaatgcaggttttaaagtgacgatataaaaaatgcataaggattgtgtgggcatgcagggtacagaatacccaagtggcagaaactaccaggtcatcctgggcaagggggagatgtagaagatgatggagtgaatgaaggctgagccattgtgaatatccatttattgtaaaaaaaaatctatcagaaaaaaatatatttaaatattgacaagactaggattatgtgaagatgtagctatgggtcaaggaactctttgaggagcatgaagataaactagatagaaccagataaacctatggtaaatcaatggcctgagaagggaaacacacaaggcaggaacagtatgggaagagctgtttaaaaagtagaagctgatcactttacactctaagctcctggggaatgaaggaattatatattttagaagtccctgccttgcaaactaggtgtcaggatagaagagactatgcaggagacaaacttgtatcttcttcacttatgggcagggagagttggtatagaaaagcagatggaatgagctaacctgtatgtctgtgtttaccttaatggctgctcggcttcctaccctgtgtgattgctgtgtggtcattagacatgtgctgtgtggttggggactgctccctatagagttgtgactttagaccctttgttcatttctggaccagatgatatttggttctcattgttgttgttaaatttggttaaggcaatcttgacaaagaccctccaaagtaacacagttaattcactgtggtccaaccttgtgtggtagacagcagcttgttattttggtcttagggataatgtgggttgaacaggtggaggatggggtcctagcaggtggctagtcattggcattgctgtagctggttctgccaggggctgcaggatgagaaatcggctcttattggcacttgacaaatgtgcagttaacactgaatacagcaagatcttgaagtgcaagcatttctaaactagcctctctaactgtctttgactttagtcattaaggaagaaactaaccacaacgagatggcagaagacctgtgcaagataggagcagagaggtcccttgtcctggacaggctggcaagcaatgtcgccaaacgtaagagctctatgcctcagaaatttcttggtaagagttaaatgtttgctgtctcttaacctagaattatgtgggtgttctagacaaaaattatttgaaagtagaagaaaacaaaaaaaaaatctcccttttggaaaaaaaaaaagcttattatttcttaaatactgtaaattttttctaataatattattcaaactgatagaccttttaccaggaattagatagggtgtcatagcatttggagcctttggtatgatgtttctgtggccgctctgacatggttacatcaactctttctcccctccaaggacagtgagggctaataagaaccaaacagagatgagccccctcagaagacagcggaagggtacagctagacttgctgttctgatcactgaatccttacctgtccttgatactatgcggaataatgcagagggaatgagttgttcatgaggcactgttgcctgccagctaaggcggacactgtaaggacaaggaagtagctgagacagatgcctgaatggcatcactagcctcaaaggcaagctttaggtcagaacagagatgctcgtaaactctatgggggcaacatgggggaaatgacccaaccttcccaagcctgggttccattctttatgtgtctcataaggcaaccggaagcataaaatgcccccacagatataaaaaaaatttagaagccctcagtaggaagatcagctactatcattgtcaagaaaagaaaccttatgtccaagaaaaaaaaaataaggtgtttgagaagctgaggtggactttgagaaaggggcaggacctcagcagcatgccatacagtgaaggggtcatggagtctaggcagacaaggaaaattactttgctggtgttgggatctagagcaggactagtgggtatttcccagctttgcgcaagtactcactggaaagcagtgagtaaagctgtcccatgatgctctgactataacagtactggtcattgagggccaaactgggcagcatcatctcatttggaatcacagagaaagcaggggtatgctcccaatgggagcagaagctgagcacataaagatgacatgggtcaaaattatctggacatgggagatggcaggagaatggggagtaattgaaagaatgctttggtgtagaaggaatggaggtcacggtagggctggtgaaggaaactgtgacttcccttgcttagtgtgccatttgcagaaaagacaaagccacgtctggaaaataagagttcagggtttgatgtaattgcttttaagaatgctaccctggtaaggctaccccatggaagctgtgctacaaaggatgtgcaaataaaacgttggtgacacacacacacctttacagagcacctacactgaggcagaaagacagaggtcaggttctaggagttgataagaaggaggggaagaaagaccactagaaaacaaaacagaaaccacttattagaaatattgttcatagacttgtctctctgtgtatgagcttttgaaccaaaagaatgaaggagacttcatatcctgatcaaagaaagaggcaatcttggtcaaggagccagctcttggatggctggggctttagaaagtatgaggtgcagggccctatcttctccctgaggagtgcacagaagacagggaccatgatgaactatctgggagactggcagagatgaagcagcaaatgtgttcaagggttgtgaagagtaactgacctcaggaggcagggtgtgacttcctctttccaattaggaacctgaagagtgccacatgccttagtaatgagcatcggcagtgccctgaagcttcaggagacttccagccaaacagagcatctgaaactttgtcatggctctcctgggtgaatgggcattgtcttgattcacacgctctatgtgaaagggatctacaaaactagtgaagcaatgctgagaggggaaagcgatctccaggggagaggttaaacacaagaggaagtggccttgtgggaacaggaggaccaggatagcagaagtgaagtgtgcaaggaagggctcccagcagctgtgctctgttggtgtcccccagaggtggttggcagttcacacactaaccagtgcctcttcctgctctcgtgtctgccttcctctcagtgctacatgacgacattcctgtccacccttcctactgtgtcacagttttctccctaaaatgaagagaattggacctcaaaggctgctccccacatttaggatgatatcgttttgtgtacttgagatgatagataaatagatagtaagagttttgatagaactatttcatgttttttcagaaaaccaaatgcaacatccagaaattaccagtattaaattagaagaacatcattgtaaatatcttcctgccatatatatttcagtggacaggattaataataggtggactacaaatagagatgtggaggaaaggcctttaagttcctgaatgcgccacctcagaaagattgcagctgctcttccctgggctggaggtgttgcctggcttcccctcttcccgtgtattgattgaaaatcagttcacagtggccacagcatattcaacatgtcctaggagataaaggctcctcaatgcacagtcattcccaacaggacttgacttttttaaaaggatgactatcagggaaaaaaaattattctaaaaattactttaaaaacaatcatttttattgcttttatttttacattgtacatttctattcatattctatgcagaaatcattattcttatataatttagatattcatcactatatattttaacaggttacagaatcagaccctggtctcttaggctcattttcgtttattttgatcaatcccttcattgaatacactttacattcaagcacccttgtagacattccatctccatctctgctttgagtttgaggatgtcacctgtcacctctctacagtaaccccaggagtacgtagcctctggccactcttccttctctgacattggcagatttttctttgttgaattatgtgggtgccaagtacaacctgactttcttttctttgatattacttttctcccaaaatatgtagtgttctttccttgggcctaagtcaaccatcatcagtaagaagctctttggtgttttacagtctacatgaaatgtagcctttaagagtgagaggctcctttcttcctccttgtcttttggaaacattcctttacataagtaccaattgttctatctaacatgacttctattcaagagtgctggttttccatagactggataaattgtctcccatgtctgttagcattttgctattttaatttctttatttttttaagtttacttactgttattttatatttttcctgatttaattgagttcctagcaatgtttattctagtgtttgctatttttaactcatgtattgagtatgtattgaattggatttggttttaattcctgagatctaaaatctccctttattctgggttgttttttttttttttttttttttttttttttttttttttttagtattgtctttgaatagcttcaaaatctgactgcttgcatattctaaaaactaaaatagctaaaacttgaaaaaaaaattttaccccatgtcatgaagtaattatgcttcattgctcctcttcctggaattaagtttctttttcccctaggatggactttctggtttgtcttacttcccttcttgccaaaaaaatattttccctgtaaccatggcatttcttttcatcctgctcattctacttggtctaatgaggcttgactgacatttcaacattcttcccattgtacctgagacttttcctatgagaactataagttttttaaatcctgaaagaatgccaaggatggtgttgggggagttcaggtgaggccaagtacatacggcttctgtttaaagtgttcccctttgagagctctctcagagttttcagatttggtgaaagctctaaaccagcagatgatgccttctgtctccacaagggacatctcagggcctacttcccctgaagtacaactcaccaaggcctttgcttgtgtgcaggggagccagcccacatgctaaggtctctggtgtcatgtgctgcctgaaagtggaattttcagctccatcatcaaaatgaggagggcatttgcccattggaactctgtcagtgtgagggtttggaaggaatgctgagagtgttgtgtttctagaagtgacattacccaaagctttgtccagtctcaggcaagaatcttctgtacctttccttggtcatatgtagttgaatgtaaagtagaaataagaagatggatggatggatggatggatggaatagatagagatagatagatagatagatagatagatagatagatagatagataggatggatagatagaagatagataggagggagacagggaaagaaagggatggatgagtagatgggatggatagatagatagatagatagatagatagatagatagatagatagacagacagacagacagacagacagacagacagacagacagatagaataatagatttcactggggcactggaggcttttatagcttttaatttttcacatttgggtagagaaattctacaggtagatttgtcacgccatgctcatctggaatgtatattgctttctttgcaacacccacttcttgaagcagcaggcttcagtggttgcttagaaaaccacagaaccacagctctggggagaaacaggaaagtaccacctctggtgagagaacacagacttttacagctaacagaactgggcaccaggccacaccctcctcctccattgctagggtttggtagtaaatgagatgcaagtacaagaatgagttcctcatgtccacataatgagatgggttctcaccaaaaccacaaaaacaaacaaacaaacaaacaaacaaataaacaaaactcccccttgagtggagagaggaatcccttcatggtttctaccatccactacacgtggcttttgctctgtccagtttctgagagtgtgtagctggacattaacacgttttcttcctgtagcctgaggatcattgtatgtcgttaccagagtatgcgttggttctggcatgagtagatgaaagcaaatgaaatcaagccattgtgtggtgcacacccaggaagatgaagaaaatgcaatcaggaggatactgaatcaggaggaatatattccagggctactatagtcactgattattttttcaaggactatggttagatttatgaattgtggaatacttttcctactgtagataaagagtttgggggaagtgctgacctcagtgctggcatgaaagacactgggatcatcttctaccaccactccatcagctgccttcaggtaccacctgattgagcagcctgtcaccctggtagctcagtctgttgccccactgtggctgggtagttcactttcttcagacccttcaccagtgcccctttttatttgaataaagtcagtctagtctaaggttccagtgtatgatcccagctgtacttggacattccctatgcccccaagagctctgtcccctggacctttagattgtcaccaaagccccaggctctctgtcccctcgggatcttcactgcttctgtttccaacagtaagatacaaaaagccccagctggctcttatgagatgagaaacctatgcaacactctggtagcaagccttcctgagctcgtgggatttcatagatagggatggagtctgctgtcatcatttagtgtgtatctctcctgctagctgtgtatatccaaggatacatatccattctcactggctttccttttagtcccactgttgagccagacatattgaagagaggaaaaaggcattgtgggaggtgaggtataaaagtgcatctgattcggcagactgccaagtgccttcttctcgctgagagggcactcagtgactacctctgccaacaggaatataaactatccatttactgaatgaatatcttctctgggtcatgatttcacatcaatgtatttggaaaataaatgtttaaggaaattcattttgtttcattataaaacattttactccaaaattgtatctgaagccaaatctggtctcatcttcttccattgccagggaagatttgtgttagccagattttccattatgatagggaaatatctgagatgtccaatttgtaaaaaagaagaggtttgacttaagccttggggtatccttcttcatgactgattagccctattgtgctgactccgtggcaggaatgttgtcttgtggctgtgaagcaaaagggaaatatatgggggtcagagttccaggaccccctttaagaataaagtcccccaagtctaaaatcttctcattaggcccttcttccctaaagagttgagaaccttccaacaacagcatgtccctgggtagacactaagcttctgggacattgggttcagccacaatcatagcacaggttggacaatacctgaaaacatgggcctttggggacatcgaaggtccagacagtagcagagttcatgtagtcctacaagctaaccatacgagaccataagtttcttgagtcccaggtctggccactactgaattcttagttctgctcatctttagtattagctgtgtttgtaaacagtaagtgaatggtgcccacctccaagcctactcaagtagatcatctctgtttcctgcttcctgtttctgctgagctaattcactactgctgactaggaagacagggtacatacaattatgtttaagtattccttcaacttcaccatgcattggaacccatccacttttgaaatatttataagaaatatatagtttattataaataatatataatcatgttttgagaacatttttagattattaaaatgataaatgtaatatagtatcttaaatttattaaatatcattaattcatggctgtgtatttttattaaataattttgggataaattaaacagtatacatttagaatactcttttaaaatatttaaattaaatataattgtatgaactttatcatacttaatgaaagatgggatttacccctgtgaaatatgccctctttaatctgacatggataatctttagtttctttttcattaatgggtaaataggacttcctgaagaacctaccatagtaagtccctgggaaagatggcaccttatccctcctgagccctggcagatgtgtcctgtctgctgtgacactagaacaccattcaacccctgggtgtagatttcacttatgaccatctacttcccgcaggagacaagtgcctgtcagacatgccctatgacagtgccaactatgagaaggaggatatgatgacatcccacgtgatggaccaggccatcaacaatgccatcaactacctgggggctgagtccctgcgcccattggtgcagacaccccccggtagctccgaggtggtgccagtcatcagctccatgtaccagctgcacaagcccccctcagatggccccccacggtccaaccattcagcacaggacgccgtggataacttgctgctgctgtccaaggccaagtctgtgtcatcggagcgagaggcctccccgagcaacagctgccaagactccacagatacagagagcaacgcggaggaacagcgcagcggccttatctacctaaccaaccacatcaacccgcatgcacgcaatgggctggctctcaaggaggagcagcgcgcctacgaggtgctgagggcggcctcagagaactcgcaggatgccttccgtgtggtcagcacgagtggcgagcagctgaaggtgtacaagtgcgaacactgccgcgtgctcttcctggatcacgtcatgtataccattcacatgggctgccatggctttcgggatccctttgagtgtaacatgtgtggttatcacagccaggacaggtacgagttctcatcccatatcacgcggggggagcatcgttaccacctgagctaaacccagccaggccccactgaagcacaaagatagctggttatgcctccttcccggcagctggacccacagcggacaatgttgggagtggatttgcaggcagcatttgttcttttatgttggttgtttggcgtttgatttgcgttggaagataagtttttaatgttagtgacaggattgcattgcatcaggaacattcacaacatccatccttctagccagttttgttcactggtagctgaggtttcccggatatgtggcttcctaacactctccccacccaccccaccccccaaaacagagcctgaatcttcatgaagtgaataaaacaattatccaagaaggagtaaggtggatcttgccctaagcagagtttatgccacaaagattctccaaatcccccaagacagcacagccactggggttgagccatctcagggagctctgcaggtgagccagaggaccagatataaggcagctggggaggagcagggacatcagcctgtgcagagaccaaggccaaaggttgaactttgaaagactattaagtcatatattgtatggcaatatggtgtctggacaagttgtgcaatgtgctgaagggaagggattggagagccttgaagactcttcttcatttgcctgatcaacccggcctccagagggttttttgcccagtaagacgagctcagtgctcttgtgatcatttttctcttatcgtttccatgccgttgatggccctgaagctcatcactgcattttagaacccaatcctgaaattgagacctttttttaaacttctgatactgtaaaacttcttggaagccaaagctttcttccaagccccatcctcagttatcctggttcctgttcttccccgagctgatagtaccaggacctgttattccacaaaagcacaggcatccgtcacttcaattcaatccctgttcagattatagatatggactttgctatcttgataaatgtcttctctatgttattttgtctgaaaaacctataaaaccattattaagaatgaccatttttagatggaagaaatgagcccagcatctcagtggctaaaacacaaaatatccatgcttttaaacaaaattgttaaatattccgaagctctctagtataaacaccaagtagcatgtgttttcacataaagaagacaggggccatgcaacctttatcaagtggaggtattagaatgttgtaatgtttggagacacagtgtgaccagtacaggttcccagagaggaatgcccaccatatcacagaaaggtagaggtgggatctggtatagccagaccaagacagggatgtcacgctgaagccaagtcagttagctgaagattctcaacaggaaggcctctcttaagagtcagtaatagggttgttaccatccaccacctcaacaaaacaaaaagcttataattgtaaatgtttacagcactgtcttcgcagaaactttctgaggtgattccaaagaactagaggggagatggtctataacagctcttgaagtaaacgaggttcttagtctcagctctcctgacatatagggcttgattattactggtagggattgttctgtgaattgcttactactacccctggtctctccccagtagatgccaggaacattctagctgatacctaactgtcttcccaggtgttcgagggagcaaaccactgatctaaactctaaacgctgaagtacgcaggttttctaaaaatgacaagcccttgaaacctttcccagtaggcagcctcgagctggacttgtgtctttggaatgctgatgaattctatagatcagcattgcaaatacacttcaaatacgtctgagttcaagtgcagggactgagttcaccaaggtgtgaactgtgctcaaaaagttcaaaagtgtgtgtttctttgtttctaaaacattgtggcatctttttcatttgtttctaaaactttttttttagaaacaaatgaagcacttggaaagtgaaagtaaaattacaaatataaggatttacactgaagagagaaaaattttaggaactatagctgtgaaaagattttgttcaaaaggcaggctagccttacccaaattcatatatggcaggtgtcaacctcccaagcttacagttagcaggcagcttttgctcactcatccttagccatgagagccattaagtgtggtccaagaaagatggctccaaaccctacccccgacccaccagtggtattcagagattaaagcagaattgtaaatagtggcttcaggagctcttttttagaatgctttgccccttcctctcactgccttttttagccaatataaatgtcaatttgcacaccttttgttgtggttttatattgtaacagcatttttttgaaactattgtatttaagataaggtttcatattatgtccacaagtaattaaattatgtttgaaggtggctatatgctgtatcagaagttgatgatgtttttctttagccggtaaaggagggttttgcatgacctcactgtttgttctgtggtttgttctgttgtatgatgtgtgtcttgagttttgctgtgtgatgaagtgcgctgagattccagtgccctcaagttgtgttttaagtagctatcagaggcaagagggttcctaagagcaggttgacctgttggcgacagatggcaatcaccatttctcattccttcttctccctgttaccccagcttcctgtcccaggtcccttctgtgattcttaccttagtgtgcatgtgtgtctgtcctggtgagagtcaggagcatcgatatgttatcattgcattatcaccaagggcacgcacagcctagcacctgttgcttcagataccgtcacactctgtttccaatttagatacaaccacataataaaatgttagagtcttcaatgggaagcagaggtgcttgttataaagatgggggcttatgcttgtgtcacattttgtgttcttttcttcttttgtttggttttaacttaattgtgacccttgtaacatcatcttgccaaaaaaaaaaaaaaaagttgaactggatttatgtagacatgtcaagacgtactatctatttctttgtcagttatagcaataagagtggataaactctaaaatccagatctcccacaatgaacatccgtgttctttctatgatttttctttctttatggtgagccacaattaaacttgagatgtacagccacccaaacccaggaagctcatgtgcatctggtgctatggcactcactgtgaataagtgtgaccagatattaatatgcaatattgtttccaatcctttctaatacattttttcatgatgttgtgtgtggttaaatcttcctgtatcactaccacttcagatcttcacctccttgctgacaggtaaatggaagtgtgagtaagaaaatgaagccatctctgcagccctgactctagcatgatattaactcatttctgtttagctgggaacaagaggtttccactgggagcatagaggagctatccttttgtacacattttgccttagatcactacagacgatcattacagagcaaataaattctacaaatattctgtctgccccatccagtgaagtccaaacacaagcataaaacaagccccagtcattgtgggagtctgctgtagcctctctgaaaccaggaggtgagggaggagcccaggccttgacacaagaagtgtgagcagatacacagaaagaggcacagccagttagctcagctggccagctagggagtcactgctaagcctctggacctcagccacgtggtgaagtggtggcagaagaggagagcattcaagacagaatgacaaacagaatgacagctttcgtgtcctgccttttattcctttccattttaaataagcacaagatctcaggatgattttctgacaccgtggagcaaggctttctcattcatttatctgcttcactctggaagagattgccagagaaaatgatgctaacttcacttctaaggagtatgtcgatgtaaacactgggctctgttttccatgtgagcctggaatgcgcactgagggataggagggaggcccaaggtccctgaccccatttccagtgtttctcagtcatattttgatcagcagaattcagatttctacaagcagaaaatgatgtggaagttctgtgactccttagttaaacttccttgccttccttctttgaacccattccaattctcaagaaacaaagctttgggcactagggatatggctcagccggtagagtgctcatcaatgcccagtgccctggggttagatccccacacactgggtgtggtggcagtacttgtaatccccgtattctgaggaagaggcgggagttgaaggtctttagctccacagggagctcaagggaagccttggattcctgacaccctgtttcataaaaagaaagaaacaaaacgttggctgtttctgaaagttgccttttgtcatggcttcaactaagacacagagctaggagcaaaagagatagaaaattgagcaattagtgaaaggctcagaggaagttctcagatgaccaaagtgggaactccgtgttcctccatcattctggaaacttctggctctttctctgcaccagtacccaaagcagcaaccaactggcacagcccccatatgtagaggtgaggtcaaatgttgctattgccacacagcatccacctcttgtgtcttttcccaggctactctctccacccgtcacatatacaacctcttgggaaacccaaagggattcccatggcccctagaattacactgcttttagcagccccaaaccctttggcttttctattccactattaacctccaccctgagcaaacccactctaggattagcacacaagaagcccagcctccagttcatcaactacaaccctgctgggtatcagttgctctagaactggtatcttagaagcctctcaaactctaccctatcttacccctattgttcagttgcagcttccagaggtcacttactgaatattctggagtggaaagtattcatgggacaacccgcggccccagccctgaggtgtgtgcgtggccagccctccagtacctgaagcaaatcatcagtcagttcactgaggaccagttagatccgggactctcctgagcctgggctcacagttgtctgcatagaggaacagtgtcttcccacaaatggtctgaaacagcttagatgtagacaaaggaatcaggtgagaagctgagatgttcattttgctactctcaaaaggccagcttccacgtgtaaccacccagcaaaaagcaaccacattgaaagatgcacatagtctaaccctcagtacctcagcatttcccccagtgggcagctttgacatccaacctggcttgtgtacactacaaagacagaaggccacatgccaaccatcgtgggtttccctagctactccatcatagatgatgtgattttctgtgactgtccttgcaggcctcctgcctcctgagtcccgctactgtggtccaaccattctgggctttcaaaagtgatttgtggaaatggggacctgatcccacattactgtccctacgcacaggtcatcagtggttgcactgaagtttcagagcagagcagagtttcctcagctgggaacatggacgttgaggttgcattgccttaagcaggtgtccccctgggtgtgctcccaaaagtatggtctggtgcttaagaacagaattctggagaccaccaagtctgtgtttgaatgtctgcattgcagactaaaggaatgcaatggtgggcaggtgacctaccctttccaagacctctttcctcatcattgacagctggagagctggaggctaaagctagtaacatctggcaaaacgtgagcactgggcctgggtcattcaaatattctgttctttctgacttttttatatactatcctctgcctcctatcttatctctgtgacaaccggacaagccagcagttcattcgtattccaaccttggagaccaggtagctgtagtggggaagcagcaagcctctcctcccttgtagcaccagccacactgaaaagtccccagcctttgcaatttccctgggagttgcagggtcatgccccattggacacatgaaagacagcacctgggaggccaagcgtcacaaaaaagatggtgctgtgcagaggtagctatagctgcaggccctggcccaggccccttctccacttggctcccgctccattctggaatgttccttgcaaagaaaagtgaatataatatgatcctcttgagatacagtgtctctctcagaaagggaggaaaatacctacacctataaacttgccttcaaagcagccctcagctgatcatcaccatactggtccacaggttgcatgtcatatcagtttctcacaaagagtcactatccccaagacttgccccagagcaacaaggcaagtggcacagggccagaatccagagccaaataggaaaaaatagtgacatgggtagagccaggcacagggagccagatcttgtttaaatatgacaactgtggacatctctagagcccagtgcatggtagttggacgtgggcagcattgtccacccaagatgtaatggaagctgtgagctgtactgcagctgctctggagggtagaaaacactgctctgggagaggggagaggaacaggaagagctggcaaaggaaatgaaaatgtttgtacatgaaggaaggaaagccagttgagcaggcatccccaattttcatcttcaaaataagagaccaattacaaatccaaaaaaaaagaaaggccaaatgaggacagccactgaggtggcctctgagcccaatatatagtttgctccaaatgaccctgaaggtcaatcatgagtaggaagaggtcatacagcagaggtaggctctgaccccaggcctagctaacaagagaagacttcaaaaacacagtgccaaagttcagctgctctcagtttcttggccagattttacaaaacaaggaagaagaccctcactggtatgtctcttggctctttccacgttttgacaaggctaagagcaggagcaaagtggacatcctttgacctctgactcctccgatgactacagacgcagcatgtctagggagagggctacttattgcaggatgccctaagctccagcccaaagaacagtctggtggctccttgtacagcaatgagcccctgacccgtactccatttacagtaagcacttgacctgcggcagagcagctgagccctggagactcagtgaatcggcaccaagggaagcagatgtgctcgccatggtcctcaggcacaaccaggaaccagccactaggggaggaaatttgcataatagggataatttggtaccaaaactgtcccctgaagtgaactacatggatctcggtatagttcaacaaatttcacttcttctttcccatgttttctcacaccaactagatatgaggtagcatgtgcaactcgtccaaaggttcgggggtgttgtttgatttttattattgtctcccttcataagtcagtcccatgccttttctctcttcaacccaccactcccttgtgcccaaagtgagtttctgagctccctcagagacctctcccaagcacatgcaatgtgggggacacccaaatgctcttaccctgcaacacaagcagattcacaaacagcagtggtggtcatctgcctctctactgatatacttgaccaatgctgcctcactctgccgcttcctagagcctgcatgagcttcctcattgacattatccctgtggctttctgtgggcagagggtggaccagtcccagggtacaaagggtgtgtggtttcagggctccccagtttcattcccctttcaggcctcctcctttcgtggtaccaccctgattcccacccacagaggcacagcccttctctaacccttcgagggactccctattgcccccataaattcccacttctgcaagcatcaggagctatttttaccattagttttataacacctcacaggaaggctgttgtgcatttatatctactgatactgttaccaaattttaggtgacaaatactctaaaataaaccaaaggaaagaatagcctgagaaaaaatccctaagacaccagcaagatggccagattgctgttaaaacacacacacacacacacacacacacacacacacacacacacacacacacacacacacacaccctaagtagccagtgtgttttatatcaaaatttgggagaaaagaattataaacctacactctctacagataacagggacagaacaatgtgaggtaggcatagcctgcgacaggaggttaggcctagggcaggcttcctcttcttcctggttggctggtcccacacgcagagtatgaaatggccttgatggctgatcagcacacacagatgcttagattctaaactgaagcctttcgtttgttgcagctgctgacttgagttgtggattcaaatgagttaaaataggcttcttgtctttcctcactccattttttaaacatttaatttaattcagtatatctcaaaatacaaaagtaaagaggagactttcttatgagttcaacctcacggcctcggggaccataaagtgcaggaatctatgggtaaaaagcattctccccatcgtgacagccctgttcccaacccatctgttcagacatcttccaaatcacatctaattcccacaccatcctactccaagaaccctgcttaccctcaaagtcttcccacactgcactggctgctaaaacagaattctcggcactcggtgtttggtgcttcttcgagaccagatctgttcctagagtaactttgcacttgatcattcctggtcctggctgttaagtggtagtctgtccacatcagactaaaagcttagagggttccaggctccccagagccccccataataatggtatcctgtgagatcagtcctccctgtatcctgggctccctggctctcagacgggtcctgtccaaggtgatgatctggaccctagcccttctttgaggagctccttcccatctttgcactgcttcagctttccccttgggagtggaaaatgcagcagctctcaccttggaatctccaggaggggccactccttgccccagtattcaggacaaagtatcctggcacaggcagtggccttggtgtgaaaaaagcaaagagaggggtcatgaggcagagaaggtgagtgcagccccttgaaaacagggaaactagccattttagccgcaagtacagggcagagggtgtcattcacagattgggacttttctaacttaagtaattgttatttctatcagaatatactggtataagccagtcctataagcatggtcaagttccatcccactgactctaatcaggccagaagttgacctgtcaggtcccaaggccagtaattgaaatatgacaggacaacagttcactgttaaggggacaccaaagttttgccaataactacaaggttgttagatgttcagagtcaagcactgaacagacaggacctagaaaccagtcaggatccacagaccaggggcatctcaaccaactcttgaaaaacagacagcagaaagaatgaatagtggagacatggaagagaattaaaaccagagatgccaagtagaggaggaaacaaaaagaaacaaagaagcagggcgataaatttatttaaaaacagtgacatacgtagtaggtgctaatcaatctttatcagcaatcatgctaagtgccagtgaacaacacacaccaattaaaaggcagacactggcagaatggaccccagctaagacttgtctacaggctgtaggctgctaggtgagaaaggttacttatgatcttacccagctgtgggccctgtgtagtacaaaaccaacctaccgggcaagatgtgcccgctatcataacataatagttatgataataaccaaccactttctgattggattttaagcctgctacactagagggaaatcatacgtagtcaaaagcccatgatgagggccttcacaggccctggtgagagcaagggaagaacttagcttttacttaaggatgtgtttatatccacagactaggtttatagctataaagcaacac

SEQ ID NO: 1158 - DNA, 1550 bp, Mus musculus
ccttggggaggcacaagtctgttgataacctgaagacaatggatgtcgatgagggtcaagacatgtcccaagtttcaggaaaggagagccccccagtcagtgacactccagatgaaggggatgagcccatgcctgtccctgaggacctgtccactacctctggagcacagcagaactccaagagtgatcgaggcatgggtgaacggcctttccagtgcaaccagtgtggggcctcctttacccagaaaggcaacctcctgcggcacatcaagctgcactcgggtgagaagcccttcaaatgccatctttgcaactatgcctgccgccggagggacgccctcaccggccacctgaggacgcactccgttggtaagcctcacaaatgtggatattgtggccggagctataaacagcgaagctctttagaggagcataaagagcgatgccacaactacttggaaagcatgggccttccgggcgtgtgcccagtcattaaggaagaaactaaccacaacgagatggcagaagacctgtgcaagataggagcagagaggtcccttgtcctggacaggctggcaagcaatgtcgccaaacgtaagagctctatgcctcagaaatttcttggagacaagtgcctgtcagacatgccctatgacagtgccaactatgagaaggaggatatgatgacatcccacgtgatggaccaggccatcaacaatgccatcaactacctgggggctgagtccctgcgcccattggtgcagacaccccccggtagctccgaggtggtgccagtcatcagctccatgtaccagctgcacaagcccccctcagatggccccccacggtccaaccattcagcacaggacgccgtggataacttgctgctgctgtccaaggccaagtctgtgtcatcggagcgagaggcctccccgagcaacagctgccaagactccacagatacagagagcaacgcggaggaacagcgcagcggccttatctacctaaccaaccacatcaacccgcatgcacgcaatgggctggctctcaaggaggagcagcgcgcctacgaggtgctgagggcggcctcagagaactcgcaggatgccttccgtgtggtcagcacgagtggcgagcagctgaaggtgtacaagtgcgaacactgccgcgtgctcttcctggatcacgtcatgtataccattcacatgggctgccatggctgccatggctttcgggatccctttgagtgtaacatgtgtggttatcacagccaggacaggtacgagttctcatcccatatcacgcggggggagcatcgttaccacctgagctaaacccagccaggccccactgaagcacaaagatagctggttatgcctccttcccggcagctggacccacagcggacaatgtgggagtggatttgcaggcagcatttgttcttttatgttggttgtttggcgtttgatttgcgttggaagataagtttttaatgttagtgacaggattgcattgcatcaggaacattcacaacatccatccttctagcc

SEQ ID NO: 1159 - DNA, 1296 bp, Mus musculus
atggatgtcgatgagggtcaagacatgtcccaagtttcaggaaaggagagccccccagtcagtgacactccagatgaaggggatgagcccatgcctgtccctgaggacctgtccactacctctggagcacagcagaactccaagagtgatcgaggcatgggtgaacggcctttccagtgcaaccagtgtggggcctcctttacccagaaaggcaacctcctgcggcacatcaagctgcactcgggtgagaagcccttcaaatgccatctttgcaactatgcctgccgccggagggacgccctcaccggccacctgaggacgcactccgttggtaagcctcacaaatgtggatattgtggccggagctataaacagcgaagctctttagaggagcataaagagcgatgccacaactacttggaaagcatgggccttccgggcgtgtgcccagtcattaaggaagaaactaaccacaacgagatggcagaagacctgtgcaagataggagcagagaggtcccttgtcctggacaggctggcaagcaatgtcgccaaacgtaagagctctatgcctcagaaatttcttggagacaagtgcctgtcagacatgccctatgacagtgccaactatgagaaggaggatatgatgacatcccacgtgatggaccaggccatcaacaatgccatcaactacctgggggctgagtccctgcgcccattggtgcagacaccccccggtagctccgaggtggtgccagtcatcagctccatgtaccagctgcacaagcccccctcagatggccccccacggtccaaccattcagcacaggacgccgtggataacttgctgctgctgtccaaggccaagtctgtgtcatcggagcgagaggcctccccgagcaacagctgccaagactccacagatacagagagcaacgcggaggaacagcgcagcggccttatctacctaaccaaccacatcaacccgcatgcacgcaatgggctggctctcaaggaggagcagcgcgcctacgaggtgctgagggcggcctcagagaactcgcaggatgccttccgtgtggtcagcacgagtggcgagcagctgaaggtgtacaagtgcgaacactgccgcgtgctcttcctggatcacgtcatgtataccattcacatgggctgccatggctgccatggctttcgggatccctttgagtgtaacatgtgtggttatcacagccaggacaggtacgagttctcatcccatatcacgcggggggagcatcgttaccacctgagctaa

SEQ ID NO: 1160 - DNA, 96594 bp, Homo sapiens
  misc_feature (4844)..(4863): "n" at positions 4844 thru 4863 can be any base
  misc_feature (8214)..(9596): "n" at positions 8214 thru 9596 can be any base
  misc_feature (29909)..(29928): "n" at positions 29909 thru 29928 can be any base
  misc_feature (34733)..(34834): "n" at positons 34733 thru 34834 can be any base
  misc_feature (38964)..(40859): "n" at positions 38964 thru 40859 can be any base
  misc_feature (45671)..(47707): "n" at positions 45671 thru 47707 can be any base
  misc_feature (54803)..(54822): "n" at positions 54803 thru 54822 can be any base
  misc_feature (59603)..(59640): "n" at positions 59603 thru 59640 can be any base
  misc_feature (67744)..(67831): "n" at positions 67744 thru 67831 can be any base
  misc_feature (77916)..(78082): "n" at positions 77916 thru 78082 can be any base
aaagtagcatacaggttctgaccttcaaaggatcaataaacaaatgcatctcctgctctacactttagccattggagccaaatcccatggttctaccctcagtttagtccctcggcttaatcatcttttgattggccatggaatgtgtacctaactatagtcaacagtcttacaaacatatatacatcctgtatatctatttgtacaaagaattggatcttcatcctgcatattctcttttcaaaattagcctttgtttaccatctataaatcaagacaacattattccttctcccaaaatgcagggttattcaatacaacttgttggaaacaaaccggcttggctgaaaatgtttatgagctataatcatagaaaataaagggatattataatgagaagtcaatctttcagtttaattgcagaacactttttaagctacagaaaattgtgaatttgagctctgaagtggaaataaagttgccagtttcagactgcatatcacagaaaatgaattctttttcttcattagaaaaacatatctgcaagtaataagatattatgagtaaatattacaagaatacattgtactgggctgtgtgtagctacagaatgcattatatctttaaattatttctaaatcacaaatttagagaaagtcctgctcctggcattactaaattataatctgtcttcttatcctacagaaataaagaggtatcaactcacttaggataattgcctgatacaaccagaacaggattagggaaaattcattatggtattgcagtgttgtattttaaaagtattctctgcttcctttttgaaaaatggcttaaaaatgagcagaataatgcacatacaaggaaagtgtgaaataaattgtcaacttttagttgaaggaaggaaatttggaatattctgtgttgaagcctttactgctaagacagcattaaataggtgaagaagcaacacttctagtgcatgatcgcagagccccagacaggacagaagcatagggagggatgggggtctttcagctgtcaggagaggaaaacacagtccctctgcatattggaaaacaaatgtgccaactccttgacatgttacttaaacaaaaatatttttcctgtaagtaagataaacccttcaaaagtagcaccatgaaatggaactatctgctgaatatctgctcactgttctaggaactgtgaggaaacaaaatagaaaaaaaaccaaatctctcctttcaatgagagcaaacaacaaatgttaccaatgaaaaccagagagaaggcaggagaaaagctaacgctcgggtgggtcaaggtcgttccctttcatggagaacagacaatgacaactcaaccacaatgataatggaccaaacacctgaagccagtaaggggggtgggcaggcagaaatccaggggagaaccttctaggagacagcagtaagtgaaaggcagtgagctggtctggagcacttgaggactataaggtagggccaagtggccagagacaggcaagtaagtgggagagtggagtctggcctgcattcaacacagaagcaccccgatctgactctgctcttcatcaagctctctctggcttctgtgaggggcaggggtggaagtagagagacccctgaggaggacactgctatttgcagatgagaggtgaccagcctgtctgcaatggagggagaggaggtccgaccatggacacctgatacctgcagagctagtgggattccccaatggactggatggtaagtgagagagagaggcatcaagaatgactccaaggttttggcctcagcaattgccagctggtattcaatgagatgaaggggtctcagtgaagcaagtaagagaggaagatcagggattcagctgggagacagtaaatataagttgcctattaagcctccaagtaaaggtgttaaggaggtgggagagttcaaaaggaggtctgaagagcagatattaatttttggagtaagggtacagagatgacattgcaaactgcttctggagaggccttcaaggaactgactgcggagggagacatgtctggagagctgcagcattttaggaaagaggggagaaaacagccaatgaatagcacaagagaaaagcatggcgagtggggtgtcctgaagatctacctcactgatatcggggttcaataaaatgttcgtgcattttttggtaaattttaaagtgctagataaatgctgacttactacctttgggaccagatggactttgctccatccattgagatcattctttccagctcttcttagattaaaaaaaaaatccacttttaacttagtcaaggttagtcccaactgagaatctggagacacattcctgggaatcagaagctctgcctacttttgacttgttagatagcactttctgagaaatcttacagccacccataaacaggggaaagggagaagggctaactcacattgattactaggtattacaattgaagacttatgttcatgcttttgtttaatccaaaccacaactccatgaagcaggattcattttccctgttgcagaaatgacagtgtgatcctgagagaggtgacgtaactcagctgagttcacgcagtgccctcgccatgcacctgtggtcccagttacttgggaagctaaggtggaaggatcccttgagcccaggaggtggaggctgcaatgagccaagatcgtgccactgcactccagcctgagtgacggagtgagaccctgtctcaaaaaaataaataaataaaaataaagaaaagaaaagagagttgctatcataattcaaaaataactagactaaatttcagtcctacttgataggctggaaaggctgttcacatatcttactctttcctggacaggtccattccatctgacctctctaccaagactgttgcttctaagactgacaattcggccttaggggaaataaaaaatttaaagagaagtgaaggaaaacgcttcccacaaattggagaaaggtgtcttaaaacagcagtccccaacctttttagtgccaggaactggtttcattgaagataatttttccacagaggtcaggaggggatggtttggggatgagtcaagagcattacatttattgtgcacttgagctctattattactattacattgtaacatataatgaaataacaactcaccataatgtagaatcagtgggagccctgagcttgttttcctgtaactagatggtcccatctgggggtgatgggagacagtgacagatcatcagccattagattctcataaggatcatgcaacctagatccctcacatgtacagttcacagcaggatttgcaatcctaagagaatctaatgccaccattgatctgatgggaggtggggctcaggaggtaatgtgagtgatggggagtggctataaatacagatgacactttgcttgctcaccctccctatactggtcagtggccctgaggttgggaattcccgtcttacagaaatcagttcttggagagatctcatttctgtgttgggaaatgtggcataagcaggaagaaagaggatacgtgtggagccagaggaggagccagcatgattcgcaaggtaatttgaaaagagagggcagacgcatggctgaaatattataactggccaagatttgtatcccagcctggtcacataaaaactgaatgcttcaaagtgccgaacacttacccagtgcttgatatctgccaaggagccatcaaaatgtccttaatgtgcactaactcattgagacctcaaacatttccgaggatgtttgtgctatggcaatgttcccattttacagaagaggaaactgaggcatggagaagtctagtaacttgcagaactaactccaatagtttggccccagagtctgtcatttcacagccaggttctgggctttccatcaacccccagcgagtccccttccctgagcttcagtgtactcatgtgaaatggggaccacagtgctagctttgctgcatcgttagatgggagataatgcctgcatgcctgtcacagagctgggctcagggtggggtgataattacaatattactattaatcttgagttaattctctcttttgagacggatgtttctaagctcccctgccagccaagtgtggagcagaaaagcatttgctcagacctcctgtgtgatctctcctcaccacctccctccttttgtccatgaagcctcccccagttctggcaactctttagtgctatcctttgtgttccataaggctcatgtcagaatttattatgacacattttgcatcagaatgaaactattaattgtccaccgactttactagattgtgagctccttaagggacagatcttcctttctgctttcttgtgactacctgcatctcaagagccacctgcaatggtacactctcaataaatacaggctttctgaataaataaatgaatacatgccaccagagtgtttatgcttccggaaatcctgctccaatcctgttcctattcaaagaatcaactggagtgacacacagctctgttcttctttgttctgatctgttcaggtcagattaatatattattttttattactcatcaaaaacatcttcagaaacttttcatcagaaagattttttgtgtaaacctatctatctcctccaaatcactatatctgactcagtgtgatttttagtctcttataaccaaatgatattgatagaaatttgttgcttttgagaacctaagtgtatttctcttacaaatttcaaagggaataaagtgaaagtattatcaggaagtgggaannnnnnnnnnnnnnnnnnnntgggaagaattcatatgtcagctgcagcccatccctgattcgaaacctacaggcagagatgtgaatggtcagtagtgctaaaggatttctgtggttcctgcagaaccaggagacactgaggtgccaagacagggccttacagatgtttcaggaaaccaagcacccagaggagtatcttgccaggttcaccaggtgcttcctacccaggcactgccagcaggacagtcctagctctgcaccagccccctgcctctcctctgcatcctgctccttcacccccagcagcaggcgggagctagtggactatgcttagaaatagccaaaccaacgagggagcccaagaaaaaggatcgaggacctctcaccaggccagtgatcattacttttcaaaaacagcagaggcagaagctggaagtcatgaaaactgggaaaaagaaaccaaagaaacagtgtctttgttgcaacagtttcatccaagtcctgggtatataaataaaataaaattttattttttagcaaaaaaaaccttttgctgttatttaaaaatattcttgctgttttccaaccatcagaggagacatgcacttttcattgctgttaacagatctttttttattgaagaaaaatacaattatgataacttccatagattatttcattgaatttcacgtaattctatcaagaccattgtgaagtagatgtgctctgcggatgagaaactgaagctcaggctttaaacaacttgccaaacacagttactaagaaacaaaactattaaccatatcgtatcacctcaatcatccttttactttcctttgaaagtaaaaaactcactctcttttgaaaatcccatccaggctctacctggacaaaagtgcctagctgcctctctttccatagtgagctctgaataagtagcctttgattaatcctataggtggtctctattctttcgataatacagcctcataagaagaaaaattggtgatttagcaattattgcctgaataaattaaagtgttttatttaatactttaacattatgaagagggcaatatatgaattaatatgtaaataaaataaaatgactttagacataatatgaaaaaaaacagttttacatgttccaatttctccctatatgttttcccatccattgtgcattttactgttgtccctaagggtttgaacatttgatttatatcacctctctggtccctctgagtctatccacagaccccaggttataataatataagcttgacttccttcaactccacccggttgggggcaagggtaaggcatggtacctgcagcctgactgctgttttgttttgttttgtgacagggtcttgctgtgtcgcccaagctggagtgcagtggtgtcaatcatggctcactgcagcctcaaacttctgggctcaagggatcctcctgcctcagcctcctaagtaggttgttgggactgcaggtgcataccataacacctaatttttaaatttttaatacaaatggggtttgatttttaaagtttaaaatttttttgtacaaacagggtcttgctttgttgcccaggctggtctggaactcttggcttgaagtgatcttcccaccttgggctccaaactcaggtgtgagtcactgcacccagccaaggagcctgactcttcacagtgcactcctcatctcattgggacattggttgggctagcagggaataactgttcttacttggaaagtactcctctctgtcaggcatgtggcaaggtcttccatatgtgatctccttaacccacaaacaaccccaccaggagggttatattatcaccaccaatttacagatggggaaattcaggctttgagagattaaggacctcagtcagattcataagcccaaactatctgggctcttagccccacatgctcctgcctcagtgggctacaccttggtgagatgcctatgtttcggtccactggtccactcctgaagaccaaggcacaggtttagagagacgtaccagcggctaaaggtacttctgcatccaagaactagaggtgtcccgtgtcccctttacaacattgttggcctccctctgggccttgtaccttatgtttattgcctcatttaatccaggtaaggagtctttaggattggtggcatgtattctttttatagacaaggaagatgatgctcaggagtttggataacctgcccaaggtcacgcagtggaggagaggactagaaggtaaatcaatggacctttcactaccttccccttctctgggctgtagcagtgagttaactggctcagacttgcccagcggaatgcccttcaggacacactgagtactgtagtaagagctgcatatgcgctcagggagaatgtggatagacgctgtttgtgattcacgggtaaagggccttctcccagaggcagcagaggcagatcctgtctctggtgtgccctggcccccgacttggaggcctcctgggccaggccaagaccttccccggcagcgatggtctccagccacactcaactgccctgaagggacatttcctgcttattcccttgcccggctgtgtcctccacccggaaggcctgtgccttcttcgcctgcatgtcctaccctgaggaggctcccttggtctttcatcgctctccctatgggtcttcacgccttcccgaaccaccgcgcccaagcaggagcacgttctcggccctcttcacagggcgctcctcctcacaggggtgcccgggatttttattctgtgccttcctggtggctcctacaagtctggaagggcaggaggcgcatctcactcctctgggtcccctcccctagcgcctggcgggagcccaggctgcatttgtggaattcatgactttttctctcctgctcaagctgaacacattgctggctcctgctcgggtggagcccggctaattagagtgaggggctccccgtagggcgaaggggtgcgctgtcagatgtggcattcccgttttacggagacacacggtgtcttacacgccagggagaggtctgagacgcaaagagccgtcgagcgggctgcgggattgcttcgctgtcacctccgcctgcagccacccttccgcacgcacttgtgtgtgcacccaggccaacatggaaggcgccatcctaacttctgccgtgagcaggtgggagggaagagagacgagaggtattccattggttgtctgggaaaatgaattgcaccttcccctcccttgcggaggatcaacttttcccaccccctcgggtgggcactcgcatcctggggccggagactgaacccgggagccaaggggccccagttccagggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncggctgcggggcaggtcgagcagggaccgccagcgtgcgtcaccccaaagtttgcggggtggcagggcgcgcgctctggccacccgccgctctgggcggcagctggtggcaacgcaagggcgcggcgggggcggccggcgcggagggggccaggtacggggcccgcgggcggcgctgtgcgcgcggggcagccggtcggccgggagcgcgaaagcctggtctgagccggctgggggcggggagtgtggcggagaaatggggaacaatgcgagtgagcaacttcaggaagtcattgtgaaagaaagctgggaagagctccgcggccaagttagcaggacactctaacaagtgactgcgcggcccgcgcccggggcggtgactgcggcaagccccctgggtccccgcgcggcgcatcccagcctgggcgggacgctcggccgcggcgaggcgggcaagcctggcagggcagagggagccccggctccgaggttgctcttcgcacccgaggatcagtcttggccccaaagcgcgacgcacaaatccacgtgagtgttttcaaattgaatttcaataggaaaacttggggtaactggtgaatttaaaaaaaaaaaaaacacagtaaagaaaagcggtaaggttggtagaccctggtgtcgctcaggtccgcctctcttttctgaggacagtgagagagttcacttctgtcaagcgtctgttgctctgcactgtgccagcaggtgcaggaccaggccgacatgggacacttctgagcagccccgctgtcaccaggagaggagttctagctcccaaccatatttaaatttatgtagacctacatatacccacggaagtcagcctttataaagtcgtgtgtaaagagttttccttatatttgagccgggagctttctttttatactataaatatgatgagatcgagtctgaacttaatttctgcaagagaggaattatcccggctttgaaaagttagtccttttgctgaccgcaggtttgacgctcaagtcaccaaaccttctcaggaaaacccttagtaatattaaggcatcaggttacttgcggttatatttgaaatgtattttaaatatttgtcaagcatcgctgctgatgcctaaggaacctcgtgagggcttgtttttccttctaatttggaggcatctaatgaccgaaaaccgtagcgattccatagggtctgaccaggcacagctttcaaatgcagcttccctctctctagggactgcagcccacccagactgaatttcaatgcggtgcgctttgcttaggttacccactcacaatttcccactgcgccgcaggcagtatatttcagctttgagataccttgttttaaaattccagacaaaatggtgttgaggaaatgtctccttactagtcccatcaacttctgttaaaagaggaaaatttatggaatttgaaaatactgcgtatgatatttaaactttcatagacattcaaatgcttttaaggccaggttcaatttggttatgagtcgaggggtgggggggacccacatagaaatgtcctgggtcctcttgagtttatttctttgtttgaagatgtttgttcaatgagttttattgtactcatcttttatatggaattttaaaaagtaacaatttcagtattatttatattagaatgtgtcagaattatttccgtgacaaatcagatcatttgggctatggcttaaaatgtacacgaggcaaatattcatgacaagaagattcaccttcttacgctggcatcttgtaaaatgcagaacaagttaaagaaataatgtgtacacatacaaataatgatgtcacattaaaaatactacactattcttgcttgatggaatgtatctgatttccaatttcaccatgaacatatttcatacattttttacatgaaaaaaaacgtgactcttaagtctcacagtcaatcagagctggtgaccagaacattttattgaactaaatggtcatgttttcttccccttttgtttcacggtgagagttgaaggaaggagtttagaaactctccagtacttgtttaattcatcagtgttctaattagagtggtacctcttggaaaactacacacccccctaatgcagaaacatcatagcaataatcacccaccctcagggtctccaggagaccacaagggctgcagataaaagtctggatgtgttaggtttgaccctttcgaagagttttacacaggctcctaaagagaagatcagctgtggccgtttgtagccatttcctttgtcgaaaaactaagatcgcagtgaatgtattagccaagaggtctaaagccctgttgtactgcaggccactgtcttccttgtttgactagagacttggagtttgagaacagtggttctttggtttggatacattttttgttcttgatttggatgtgtgtgtttcatgcgtggttaatatagcatattttcaatataaatgtcaaaaattttgaaataggaaagaactctctatatattaatgtacttatacacacacttcaagattatgcatttattaacagatacatgaaataaattccatgtgcatatgcacatatgcacacagagcgtgcacacacacagcatgcacacagcgtggagtgagaggcatggggcagtgtggaagagttttaacatcaaacagacctgaaatgagtattaaaggccccctttatttttaaacttttactaaaacaagatggatttccctatgttatataatggtgaattttaggcataaataacgttttttgagtgttgcataattgtacgtattaatgtaatgtaactgtggttaacgaagaattcatcaaggatatcactgttttgtggcattttttttttcctcctctaatctttggacttgtgaaataatttcactatgaaataaatgttggttcttgtcatattctaagggagattgatgtaagtggctccactccagcttacagaaggtaaaccacgacctttttgcgttctctgaaaacgcttgtcttccgatgcctctgtttctaagactgacaagcactctgggggcactgtgacgcctgcttctagcggcagagttgctgcagctcctgtcctggctgtgaacattgttctctctctggtgtctctatgttcataactacagagacttcagctctattccatttcatatttgtgctgaataatcattccattttatgggagaaaacacaagatgtaaaagcaacaagtgacccatcctttgaagcttacaagaagagaaacattaatctatttcacgtcttgaaaacagatcagttttattttgctcaaaaagggcacatgtacatttttgatctaggtcttagaaacgtagagtttcagaggatcagcattatacacactgtcacacacacacacacttaaaattcagatgaggaacaagataggaatgaggttttgttagggacgcagagcacctaaaaccaaaggatatcgacagtaacaaagctgtttttactgtagtgctgactgaacactcatgctggtgtcttcatgtggaccatggctttcttgtatttctttgcagtttaataaatgacttcatatctcaggttacctttccacatctcctggaatatatgtttatgtccttaaagtttcagtgtcgtcactttagtagctttagtttgagtttttaaatgtttggtaatattccaacaaatattttttaagacattatgaaaccttatgaagtgccatatattacaagtgagataaaacagcaagcaaaagaaggtttgcagaaggtttttaagtggcgaagtgcgggcctgcccattttggtgtctccttggtggttactcctgagaagggcctggaggaagagcaactgaggcctaatctacaggcaactgccaaattgtttcagttgacgtttttccctctcatgtttgactataataaataggtagttgccagtggagccttcagccaaccacctggtaataaactgttaaaaatggtgcaaaccctaggtcacaggtgtgggggccatttgtcttgcctgttaacaggcctggccttaattcttttctcccatggccatttctgcctttggggaactcacaattcctgttgactaaaagagcacccttttccaccacaagcctgacaaatcagacgtccacataatttctgaactcgttttggttaggacaggaagcacaggctcccttcctgtctgtgttttcctaagagaaaacggtcttccctccttttttgcatatttggcaagtggttccacctttctctgcaccctggtggagtgtgaaggcagcagaggaaccttttggaggaggaagaggacacagaggccctgtagccaggcaccaagatccctcccaggtggctgggtctgaggggaactccgagcagccctaggtcctcaaagtctggatttgtgtggaaaaggcagctctcacttggccttggcgaggcctcggttggttggtgagtgccacacggtttctttgtgtgcttgcatggattggaatagccattgtgttcttccgtcttccctgctggtgtttccacagtgggtggcctgagcccagagcagctccccatatccctgtgcaggccacctgtctcgggtgatggagagcatcattatgctccgtctgaacgctctgctttcggatggccccatgctccacctcctgatagctcgtggcgcggggccacggcttaacgaatggctgaaaatgggtcctaattagtggaaaagtgctttgttcatattttctcactcgagtgtgcagtgattcatttttcttctgcaatcagctcactgctaaagtaaatctgactctcttcccgccattgcacaccaaaagttaactctaatgggtaggaggttaggtttgttgagagagcaatgcagtaaaaagaggggatccaatgtggtcttgtctgtctggtcttcctttcttcgttttttcctcccttgtcttctctgtcattcccttccctccatttgccttgcctttcctgtccttcccttcccttccttcccctctttctttctataattggtggggggtttgcacagactgccaaaacactaagaactgtgtaaagtgtttttgaatggccttacacatattgaagtagatttttatgctccatttttgagatcacacactaaaatctatacctttaaagcattttctgttagtttgaaactatttgaaaatgaacaatgtggtttagattagagtcctgttctgaagctaggagttccactatgaatattgatttatcagtttttgacaaatttttgttgttataccagattttcactggcaaacctagagcaaataaaattccacataagatacttccctagacctaatgggaaaaatgtttaatttagagtctttaggagaaatgagaatgaggaattgaccttttgtaagcttacttctgaggcactctgaagtgtgttccagtgcttttaatggaaactagagagagccagcaaccccctagtgtgagccccacttttaaccggaaaaagtgaccttttcctcctcctttgtgctgagttttgcgtagggcagaaaattaagctgatattcaaagagattcactgcaaaaacatattgataaatcgtatattctatttcattaaattaaaaccatactgctaattatctcaggttgttaaacataaggcaattaattatcattttaaaagttggtaggaagttgtgagtacttttgcagtatgagtgttttcccgctttagtatgaggttgtgtatgtttgcttgaatttacagaattttcactttaagagcagacaatgttttgttaaagaaatgaaatttgctaaaaaggagcatgtaaagtgaaacattaaaaataaataatttcaacttacttaagagctgcagaaaaatctgattgctgtgtttaaaatgaattttcccacatttcgctctcttatggacaggagcattttctgtcaggttataaataaagacatgcccattttttgtacccccacaaatgaggaagttgtaagctctctgaggttttactgatgagccccctccccctgggtttgcatgaagagatcataggccacaaataaaggactacaaaatggggtctaaactatcctggtggggcctgatacccacgtttcgcatggaccttacgatgtgatgaatggttttggcatgagtgtcttaagaatgcttccagattcgggttacaggacagccagcgctgagctccctattgcagaacaaagtaggaatctagaactttcttgctaacaggatccagctaaaacaccaagttagattcttaaatgatgttcttttctgtcattatttgattgttgtcagtagcagtaattgttaccaagccattgatgcttctattcttccctttgcccttctgagacacagctcattttgacttcagtggaacccctcgaaggtggggtgatgagcaaggtgaattttcaaagtaaagctactaagagaccaaactacaatttaaggaacctgatttttgaatcaaattccatatactgtgggtatagttcaacatagattaatttcttatagttattatgaaaaaaatctcatcttgatgatagctgataattttgtgggtgtcgtaaacaaaacagaggtcagaattcagtcccttggggaaaatttccaattagtaggaaaccaagtggcctaccttagtttgaagacacccatcaggatgtctgcaccttttcatcctctctggaggaaagactaaatacccattattgtatataggtcaggccaaagcagccttttatattgcaaggaataagaggtaaatagatatatgtgcaacaatgaatcccctaatgtgtttactctagaacacatgttctttctgtatttatatgtagattttgtagatcttgtcttaccacctgctaatggtagatactgtatctaaataagttgaggaaaatttatagtacctaggaatgtgtcctcagtgggccaatcaatcaatcatgacttcaggttatttttaataaatatacacgtatgggttcataaacaatgggatgttcttgtgaagatctaaataattttacttctttgggactaaataaaatatagcttttgccaaataaactcacacaagcacttattttaatagaagtcaaatggctttgcagaaacttcagttttacaggtgcattgtttgaaatgttacgggtatacaagtggatttctctattatgtacagtgttaagtttgagtttcaaaatgtccacctgaaatgatttacttgtacgttaagataatttaactgctaagaaggcaagataaagcattctttgtgacaccatatggccttgctgagggaaaaacttactgttataagtttgtgtttatctctctttttaaaaaaaaatgaagaaaaaaacgtttaaaataatgggaacacagcagttcctggggtcctctgtctctttatcttattatagtaaattaccaaaaaaataatgacctggggcatgtctgtgtggacccttcttttggaggcagtttctgtgttttgtaaagctgtaggttctattttcattgcacttcatattgctgcacagctcctgaccatgcatgaaggtcctctgaaatcggtaagagggcagaagaaaatgattctaaacttagatttttttaacttaagtgatgaagtgtgaaacgccatttatatttgaggaagctacctaggaagtggctcatgtcgatggcccaaatcagaagagggcctgtaaaagcttctatcaattttgactgtgtatgcttctaccatggcggctcaataaacagcagtattagtttaagagtggatggtacagtagtatagacgggaagcctctcctctccgtgtgaaccgtgcacccctatgagagggtagagacaatacaatatgcctgtaacgtcaggacagacagtcatggccagcttgaactccagccctgggcttcttgcagcaacaaacgtgaacacagaggactgtctccaactccactttctctatttttaaaacaactttttgaatacagtatctgccatcttttcttatacctcactttgaaacaggtggctccactgtggcatttaaaatgttctgtttcttttccctctgtatcaaatacctctttaccaagaaaacattcaaacagcatagtttttaactgtattttgaaaggtttccttagttccctttgacccttcctcttttgcatatcagttcctggccataaaaataaaaaatgctaggacagaattgcacatctgagctgatttgccctcaaaaagtttcacagtggaacaaaccgcaggaggagttttctgtggctcagttaaatgtcgggggagggtggtgtgaaagccaaattggattcctgctttcctgtttaaatcttgtttttcattgttatttgcaccagcaatactctgtggaataatcatgaaaatgtgtagattggcagctaatttttgaaaaatgaaaagaatcagaaatgaaataagagtgctcggaagtttttatgttctctcaacctgttttgtcaaattgttacgaaaacctataaggtctctttgactagatacaaagactttgcacattgccttagctttctcttgaagcatttccttttttaaaatacagtgtaattcacagtgatatgatagatttgcaaaagtaaaatctaccagtctgaagatgaaaggacttgtctcttagcaggaataatgggttttattaaagaggtctgtgacctaaggcattttaaataaattacaggcttggtccctgtctcccccatgtatctactcccttcaatataagcatcattgagtatttaaggaaataaccccaaatgtaactctagtgtagcttcacttgtcagggaggaaaaagtaaatagcatacatttggccaaataaccagaactttactgtagaagttttatgatgaaatttgcctttagtgcagagtattacaaagatcatgtttagtttctagcagtatataagtagcatccatccttatctgtcatgcatttggagtgtgcgacccctgcactgggctgcaacattctgatgggcaagagtgctagggagaaagaggcatcaccatcagactgcacgggttcaagtgtcagctctgtggttgattagctgtgtgacctggggaaagctatttctcttagccttggttctctcatctataaaatggagataatgatgcagatgccttgggtttaattgggagagttaaagacacatttacatatttagcaagtaggtgttgaattctagctctacattggacactatgccaggtgctcaaataaacaagtggacaagacagacaacacccatggtcttatgaggcttaaccatttgcctcttcaatgccagaaacttagtaggttgattagataaagccagtgagtaccagtatccttttctttgcagccttttcctggcacactaaaaatactcagtacatatgaaatatcactggacaaagaatcccccttggagtaccagtggagaaggaaggcatttgcttaaaagcaaaccaacagaaagacattgtaaggcagttgtttaagtctcagagacctataatttttttcttttttcttttttttcatctcgctctgtcgcccaggctggagtgcagtggcacaatctcagctcactgcaagctccaccttccgggttcatgccattcttctgcctcagcctcccaagtagcagagactacaggcgcccgccaccacacctggctaattttttgtatttttagtggagacggggtttcgccgtgttagccaggatggtcttgatctcctgacctcatgatccgcctgcctcggcctcccaaagtgctgggattactggcatgagccaccacgcccggcaactacaattgttcttaaagcttgtagaattactgtgtgctaccaacagacaggctaattttgagtgaccctcagtactttgtacagttaatttggcacgctgtgtacttagtggctttttaacagctataaatttgggctgctagaaaagtagtaaagttgtgattcttgacaggcatctatctgcattttcatttttacttcatttgtctagactcagcttgtcagaattatggaagagactccttgtgtcagggcaagcactgtgaagagaggtattcactgtcagaaaagagaggggagctggaggcagctcagaggcctgagacccgcctccacaggagccccagcaggttcggtggagctctggccacactctcctttgggatgctgaagtcagaatgagttcacttcccagccagtcttgccaaggctcctcacctggaagcagcaactgcccagggctgttggatgtttctccccaggggacagccaggtcccagtcccgcctcggtgtggaaggaggaaaggcagggtccaggaagctgtttcaggacaggcccaaggtcccccagggatgcctttcagggtcagcggaggctgtaaatcagcagggcccacacggcctggaagaggcccctgtgctgtcggcttgcccggcttgcccggctcctagtccggcttctgctcctcctttgtaaagttatggatatgctaatagtttccaactgagactaggaaagtaagtcctacttgacactgtttggtcagaaagagggagagaaaggagaaggacagagagagactgagagagagacagtctcagacaaagggagacggagggagggagggagagacagagaaagagatgggaggtaggtgtgggaggagggagagatgcagaaggcagaggaaagacagacagagatttagacctcccaagtcagtgagcagtccagagttggagtggagggtgcctggtggcttgtgactgcagactccactccccgctcctagaggcacagccatggacagcttctgtcacgttggccctgcacttatctctgcatctatttccccttgtgcaagattcagaactgcatgctccaaaaaaacaataaaagcattcatgttcataagaattgcacaggtaaaaggtagtttgctgatattgttgtattttttactatcgcttcttttagctcttgcctgaaattgtttgggtttcccaggcaaagtagaaaactgcggtacgtttctgtgaaataattattccttctggcatctccctttacagacctactgatcttgatttttcatttaggtgaaagtttgtgaaaacatgccattagcttgctttgtgattaactccttttactgaatgtgagctccttttaaattgaggccatatcaagcttaaattccatattttacccggcactctgcatttcttccatgtgggagaggaggggctcagtaagtgctttgtaaaatacacagccgaagtgatgcacgtgctaacaaaggagtgtgacaggacttaagtgcccttctagacacttcaggctcccctttgtaagctgtcttggaagaggccacatttcctttccctcaaacagtttctcattgtttgattattcttttagcctttctctggaagcaaagccacttttacgagaaagtcactgctttttcatctcaagagatgcaagtttggagtttggggaagttttcaggtgcccgtcaagtcatcctttatgatgtcagacgagtcaggccacagaattcacagggctcagtgcagaccgaaaacttgaggcctcttgttcagaaattattaaaaattttggtgaacatcaccccaagcaaagagatcccctaagcaccagcccccaagcaactgcactcataagcccatgaagccccctgctgtcagaaacaatgtggttgaaattgtgtatgcacttggaagtgagatggattgcaaaacacaggtctccatgctggggcaggagtggtgatagggcatggagtggaaatgtccagcaggcccacgtgcgaaaatgcagagctctctggctcttgcagacttggctgctgacaatagacgcgctccaggaaggtgctcgctgtggtgtgatctgctgcccacccctagctccctccaggagactggtgcggggactgtttgcaaatgactgcaaaagtaagaaggttcccacagagcagagcttgatttggggaccagccgagggcagtttgtcaggattccggcttgaaactgttctcacatctcaccgcctgaaaggacgagtgtgtccagaggacttagcattgatcacctctgtctccatgcagcaaactcagaggctcagcccgcattccactggaagggcgtttgccagtggtgttggttggaagagccttgactttgccttaggaaacatctttttttaagaattgaaaataacttgagtatgcaacagtagggcatttgttatataaattagttgactagtgtgtagccagtaaaatgatgatggtggtgtgtatttgttaaataaaaagatatgtgtggtattaaattaaaaaatattttaaaacaacatatttgtaatctgtttagtgtcctctttttgtaaaaagtacagaaataaatatacagaaaaaatagtagtcctaagtggtagaaattatgagcattttcttgcctttaaaaaaagttgtaaaagattgtatcatttatgtagcaaaaagttttaagtcagcattctaaaaatttcgtgttgttatagttgctgtgacaagatttaacttctgtatgcttcaccaatcaatacagaggtatttaagacccggtgtgtgataggccgcgctaaaatactatacacatcttcagaaaactagagaactaacttctaacttcctatattagtgtggcacggctgttacaaagatttttctcatttgagtctatcttgcttctttatcattgttttgacagtttcagaagaatcgtggcttttccccttttttacagtaaaggtacctgagactcttgacgtattgctttttggaaatgcttgtgctggtcacatgcttgcatctgggctagtgtgtctggcttccgtgtgctggtggatgcttactctgttttctgaaatactttttctgtacagtggccactagctgtactcctaagccacacacctaccttgaaaattcatgtcacttttagaaatagataaaagcccctcccatccagaaaaagtgactatcatgtatatcctcatcatgactaatactgatattcctgaaattgaaaatacatattccatatgtaccataaaaggtattaaagatatatggagtgatagatatattatatataacacttctaccctcacagttttcagcctaattgagagggtaagatccctgaatcatccatcagtttttcaggtctctgctgaaagcaggccacagctcagatccacacatctgaaccagagacagaggtggccaaaaataaaaagggggacagggggacaacctggtttagagtcaacaaatagactgcattttctggttagtgaaggagctctcctgaaagtcatataccagagcataaatgagcagatttccttgaggtcaccttctgctggccatagctttcttatctgtggagctgccagctgtcatccactttggggcacctgagactgccgagcggcaggccaggacccaagtgcgaaacacagaacacctttttgtttctactccactgatgctggggttctctccctggtgtttgtggctcgtagtacactctgtggaacattcactatggtcatcgaagggcagcatcttcccagttgtttctttcttttcttttttttttttaatttaaaccgatctgagaagccagccatctgtcagcaaaacaggaaggctcgggctctctcctgggctcgttttgctgccgtagtgagcgtcacttctccccgtgtaagagtgctggtgaaggctgaggcaagggcccagaaagattgagggacaaagacaggagcgcccgcattgcccatctgccaggctggaggtgtattcattattgatggaggtagtgcagttgctgctcagatatgcagccctgcctgggtaaatgagacattcttcagcaaattgcttcgttttttgattgctgattgtacgcgtgtcaccaagctgactcaaggttcatcgatgcatgctcagtaaattagaaagaacataactatggatcagccaagagaatgaattctgtgcctacaatgacccagggccatttaattttctgcttaattttgttgcagtcagtttgcattttgggttattatgcagtaggaaattaacaataaataacaaatttggtcctcctgtgcttgtaatgatatttttataaatctttgtaatgctgtttttaaaaggatcaaggtctgtgccagtctgatactccagcaagtatgtgaggaggaaaatgcattattcttgctagataaccttgttgttaaatagcataggggttctttatctctctctctttctcatatcttattagtatttttgctttaaactaaaatcccttcctctctttctcagataacctgaggaccatggatgctgatgagggtcaagacatgtcccaagtttcaggtgagaccttatgagatagctgtgtgggaagttcatgagaaaagcttccctggggccggaagtcacagtgcttggtatgctcatgggggaggaataggggctattctgcaaaagaaaagaccatgatggaatttgcctgagtgtttccttcacctgttacaaattatctcactttgagctgaacagaaagcctccaagatgaaattagttttactgttaaacttcaggaaaaaaaaacgggaagagttaaatacatttttgtactgttggaaggaaaaatggctgattggtttaaaacccaaacacatgccaatgatggtacttaaagagagagagagagagaagcttgaaaaacataattgttgggcacagtcatgactgtttgttcattaagcatggacacaacattgctcccctttgccatatatcttttcaagccgtattggatatagctcttctcatccaggagacccaggaagtggagaagtctgtagtaggaaaagcctaagggtaggtcacagactgtgaccatttggcagcactgagggtggacggcgagccagtccaacaaaaccgcacagttccccagtgcatggacataggaagacagctttctatctggccctgtatccagaggcgtcagccccagtagcagctttcatggactttggggttttcggtatttcatatttttgagcctcacagactcacagccagccccagaggctgacttatatttgagaaagttctcagtggcaccttgccttggctgagcgccctcgtgttttgaagtttctatgggattctacaagttggtgctcctgatgaagaccaggacctatgtgtggctgctcccctgcttggtggtttccctggggaaggtgcaggagaggatcttctgagttccatggaactggagatagatctgccaatcacaggcttccttctccaccactcctcagccgctctattcatgtttcagattttggacttaaactctcccaggtgcaaagaacaaacaaaaggctagcttatttttcttttagagtgaggcttcgtatttattacaatataattgccacattctttgtgtaattctcacatttatatcttaaatataattctcatgaatgagaattatataattctctttttgtatatcattgaatattttcacttaatttttaatttttttaatcgtcacaaaataattgtgtacatagacacaaaataattgggtacatagtgatgttgtgatatatacaatgtatagtaatcggatcaggtaaatcagcatattcatcatctcaaacatttatcgtttctttgtattaggaacattcgacatcttccttctagctatttgaaactatatattattgttgactacagtcatcctgcaatggtgtagaacactagaacttattcttcctacctagctgtaattttgtctcctttaacaaatctctccctatcttccactcccccgacctttccagcctctattagcctctgtcctactttctacttataatgatgacagcagcatttgttagtttccacatgtgagtgagaacatgtggctttttaacttttagaatgtggtattcaggcacttcatggtacagttggtaaaagtgaaaatgtgtccaaaagtttgtgattatctatataaacaaaaatggtataaatacaaatatcaattttgcattgaagaacttaccttagaggtatattctcacaagtgcacagagcatttaagcatttgttcactgcagcattgttatcagtattttaaaactatggtacatccatgtacttccacatacagctcttaaaaataaggaggatatgaatgaactagtatgaaaagaagtccaaatacatgtgaaagtgagaatagcatggttctggatggtatgcaaagtatgatctcgttcttttaaaagaaaataaattacatacacatacatattttctatatgcttgcccataacgtttaggaaaattcttgggtgatatttattaacctggacttcctcttggaagactgatggtagaaggaaggggacgagttagggaagaggaggagaaggaaaactttgcttttcatcttctaccttttagcattatttgaatttattttccttaagcgtttactttgtttcgtaaacaaaaaagcacaaaaacaaaaaacgagttaaatgggaaaaaaagcagtttagctctttatagcctctcatttggcttcgccagcctctcactgcagcctcagagagctggtctgggaaacactggtagatgaggactgtaatcctcactcatggaagaggatctcattcactgggtttgctgactgtgactagaagtgattagggtgtcaaaaaacccaagcatgttaaaaatttccagaggccaaaaagatgctttcattgttctgctcttcttttccttgtcgctttcactttgggtagcttctaaattggtattttgcatggtgcatttaaagaaaatgagacccctttggccaatgcaggagtctacactctgatattctagagtcaaagctgaatgctgacacctaggaattcatctctagaatgtttatataaggaatagcccctcagtattccgatctcgtatcttagtaacgaaactaacaaaagcctgattctcctctggtagttttcttgtctttaccataatacaaaataagtaatttgttctgcaccctgactgttcaaaggatagggtagctgggggcggggacaagaatggagaccttattacataagacttcctgaaaaaggaaactctgtttttgtttgaaatgatttggtctgaaatttagtttgtgtacacttaccaaagggattcctatttctaaaacactcatactgcttttgattcctgttaacctttgagcactctacgtaatgatgagagcacttaaagagtcatgtcacttttagtaaagaatcaaaggatactttttctacttcttcgagtttgatctctgcttctccagttaaaaccagtatttgtttttttcatttctaaagttggaagaaatgacagttagttatggcataaggatgtacatttaaccaaataggagttgacattcttggtaagaaatcttaccaagattatgttatagattataagaaatcttaacaagaatatgttcctaaatcatcctcttttcccataaaatattaaagtatcagcaatttcataggattcaacctaatgtatgcgaaatgctagataaacagataaatacttaatatctggctttttttcaaagcactgggttatttgttccttgagatttatcctaaatgtgggctataccctggtttacagtgtctcacagatgtgtagtagtagacactccataagtgtttactgacttgaatccacagggtactgagaaaatgctactgatagacttggaggagagcatatctaaagcaagctaccctttcctttagggcacgtctcactaattctttgggtaaagcgtatttttcttccttttgtgtttttggcagtctttccaaaaatacgtgttatacctatgcattattttttggtttggtttctaaagaaagagtcagccggtgggaaagtgaaggatgtgggaactgagagatctgcatcagcatcccacctctacctcccacgatgggacctgagacagttatttttgcctcctggaccactatagtatcatctgtaacaggagggacttgagccagttgatctctaaggttcctctggcacctgtgaccctaaatagatattggatattggtttaatgctatttgtagtgtgtttttttggggatatggaaaccagaagtttgtttccataaacataaacataaactgtatatatctaaaggatatggaaacctttagatatatataatctgcttacgtaaagaaggtttgtatatattgcagtgtcaatgggaatattttatcaagttaagcatagtaaatcacattgattaaatgctttgtatttaccaaacattacccaaagtgttttctcctttcaacctcacaaggacccacagaagaaaatacagttatcatttccaacctgcagggagctgagacacagagaatttaagcaactgaccggaagtccaacagggagtcagagattgctctggggtgtgatccccacttggaccctagagtggaagcttctccactactttatagagttgagattctatattttgagcttgtatttacccagagaattatatcctcttgggcaattgtatataataaaacctcatgcatttaggagaggcgggatgacagaactttgttgagtgaattataatctacttgagaaattatttgcttacattttataagctaattataccatatctcatccagttttcccagaacacttctcataggtaatgctttatttgaaacataggccataggtaagttaagtgtaaatgtgtatttttataatttaaccagaagtttatttcatttttctaaataagtgaaattgtattgcatcttctaaattattctatttaaacacttgatgtcttgctgtctccgtctctgtgtgtttgcatgtcattgtacatgttcttaggaaaagtgtgggagcttgacgcaatatataccttatgtttctatgtgcatatagtttaccaaataataccataagtttacttagcatattagaatccatgcacattatttttattttatcttcaccgcaaccctgtgggatagaccaaaatcatgcttttcagcctcctttttccacttgaggaaaggagtcttaaaaaagggaccagtctcatgttcccattcgtcttacaactaattggtcaagccagaaagccagaactatgtcctgggtcactaactcctagtcactgtgtgttagtatttgagatgcctgttggcttgatttagtcatttattttttagtgttttataatccttgcatacttttacattttaaatggttaaccaggcaaattggtttaaaatcagtgcataaaaatactgtgcctatcatgatgggtttcatgaagtgataacttttcatcatggagatcctcagctgtcacagaagatgaggggccctgggtacagaggctcacgtgagggatgaaagtctcagcagcccggacttacactttggggcttttaggcaaatcagacaacctcttaagaactatcactgagttcaggcaaggcgagcttgaattaacacagggcccttggtgggcatgtgaatatatctcacttcactaccatccagttctgactctttactagatgcccctgtacataccaagactgattttttattctcccttctccccatgtggtttcttctgcatagagagttcctattgatcagtctgacccatggtattttagaattgcgatccctactgtttcattattcctttttctcccccatgttgaaaaaaataaatgtccctgagatgcaagatcagggacactggagcactgacatttagttcagtgcaggaactgaaggcagatgtaattcttaagaagnnnnnnnnnnnnnnnnnnnntgtagtggatcttgttttctcatagatacagcagttaaattttttaataaaagtaactaagagttatttggatgtattttagcatgcactgagcggaaagtacgacatttcttcattgggtaagtcctgattctttatgatcctcacttggttccagggccccatgcatctaagggtgtctcagagcatcctgcagtgctccagcatgatcgcagggaaaagctataggaggaaaagagtcaataaagtttagtttctcaacctcccacctccaccccataataatgacagctggttaatcatgagacgcgtgcacaccccacacgccctgtacatgtttactcattgggatagcatgtcaggccagaaggctccatggtcatttctatgaaggtactttagcaggtcttcaagaaggcaagtggcctgggtccctgcctcccccaaattgcaagctccctgctttatgtaggagacctatgtgtatattacagttctgtgtaagattattttgttattcttacccccacacccaccccccaaccccccgctgccaccaaaaaaaaaaaaaaaaaattcctctgacaaccttcataaagtacctgggagtttgaacaccattgctctaggaagtcatcttatacaaaaataagagttgtgaggtggttcatataccttcctgcgttctcctatttggagtttttccccatttatgaaagaggtgaaaacgctaagatatttagcaattattactttaaacattttctatttataggccgggcgcagtggctcatgcctgtaatcccagcgcttgggaggccaaggcaggcagatcacgaggtcaggagatcgagaccatcttggctaacacggtgaaaccctgtctctactaaaaaaatacaaaaatttagttgggcatggtgggggatacctgtggtcccagctactcgggaggctgagacaggagaatggcttgaacctgggaggccgagcttgcagtgagccaagatcgcgccactgcactccagcctgggtgacagagcaagactctgtctcgaaaaaaaaaaaaaattctatttacagcagtgaaaatagtagtgacttaatgcacattgccaaggctttagcataacatgaacactttcactcaatgtctctctggccttttgtttttccttgggaaattcttataatcctgctccgtctttaactattcattttgtattggctatccaaatatacccaataatgctctttctgaaaatatgccaattgtggtaattacagctaagctggaatattaaattgtgatgtctgttttccagagaatgaagtagtattccccagagcataggcttggtgcctgtgcaggttctattttaaatattccaggaagggttgttttatatactgaggatgattttactggtcttgccagtcgtctgaaatgctggtattactcttgtggaaggtttattcaaacaaacaaggacatttcacacaatacctagtcatgtttttcagacattttaatgtttggttcatcatttgcacacactctcaaaaatctaggtttgtctatgtgttcatatcattttgcctgttgccagctcagtcagcaggcacactctcccaggctgttgctgttttgttagacttcttcaggaccttcatctaaaatggtcttccacacgtagctatactgcataagttcacatcatctgtttcttgcatgtgggttgtgtctcaactcaagtttaagttagatttggaagggcggaaactataggagttgcagcttcagtggagaaaagagcatttcctactagttatggcttcccaaggaaggttagattcctcagagtaggagtgattccccaatgctagaacctttggtcaaatataattctaatccagtcaaaataaatacaggtattctgtaaaacccgatttcattttgtaaatcctactttgtatagtataagcaatttttgtatttgtgtggattatattttattttcctatttcaaagagaagaatttgtattagcagactccctttgcatgcggagaggggatcattttcccagtaggcatggggttcccttccattccttgtccagtcttcttttccccactaagttaagtcaaactaagcagctggtaagatattccctggttcttgcaaagaaagtgagcagatggcagaatgtatagctctaagcagaatacctggtgtggtatcctcaaacacaaattgacaggagggtgtggtgtggcaagctcattgtgggggtaaattggaataagcttacagggggaagagttgacaaaagataggaagaaccttaaaaatatagatgccttttatgcagtgataaaatgtctagatatttatactgtggtgattattaggaatatgtgcaaagattggctattaggatgttcattacagtgttgtttaataattataaaaggacagaaagcaatgtggactcaaaaataggaaaagaatttaaataaatcctagtgtacccgttatacatgaaattatggaaatatgaccctgagcatggaaatatgtacatgagaatgtctaaaagctagttcattttgaaaaacaaaataatgtcacctcatattatttatagtatataaagatgattttaagagtggcagtgtctgggattataggtgattgtatttcttcccttttgcacatctatgttctctcatttgtattgtgtggggagaagtgactttttttataaaaagaaaaaggtatatgcatcccagcagagaagcactggctccacccagtacctgcctcctcatgccaccctctcaagccaaaagccgggggaagcccaggcaccttgaccatgaccgcccgagactcacacttcttctttctcatcagggaaggaaagcccccctgtaagcgatactccagatgagggcgatgagcccatgccgatccccgaggacctctccaccacctcgggaggacagcaaagctccaagagtgacagagtcgtgggtaagtgggtcaccagcggcctctgtgcctgtgaaacctttatctctttgtatttttccaagacagtgatgaagggatgcaagtcattttatccattgtgttccctcaactggcatattaaagaaatatggcacaaagatcagcaggatgggggtcctctggtgtgtgggaggatggacactcacaggccagcatggccgtgagagccacacaccccgcaaaatgtccaagttgaggagcaatcctgcccagggacgcgtctctgtcactgtcctctgtcctcactgcacttgcaggaatatcaaatgttatggattgtagatcgtgaaaattacacacttacgtgttttggcaacagtgcttttcagtgtttggggttagaacaagccacatctggccattttatgttatccctctaatctctagttcttaaatttcagatttaactgaaaatagaaagtttcataaatggtaatttttaaatgttagaaaaaaatcaaagcacacatttacataccttttccataaaaaagtgtgtgtgaaaccatctgcaactccactggttaacttacacatgcgacagtttgtgtttggaaaacttcacccaccctctttatttcaagaaaccaaagacggagagaagttcagtgaattaaccaaggtgaaatgacagagtcagaattgaactgaatttctgactgaaaaactagttctcgctccattataccatgttctaatgagctaatgagtcaacagttccctggaatacctgttttcttctttaaaaagagaaagagctgtgatactgagagctacctattggcataaaagaatatgaaggacatacaggtaaaatgaggtagactggatcaatgtgggtcagctacataagcccccatagccaaggagggaacatgtatgtaaaattctcaggcttatgagaatcacaactgtatgtctataggacatcctaatgcaataatgggaaaatgtgataactgaattttatctacatgtatagaaaacatattttgggccgggcatggtggctcaagcttgtaatcccagcactttgggaggccgaggctggcggatcacaaggtcaggaaatcgagaccatcctggctaacacggtgaaaccctgtctctactaaaaatacaaaaaattagccgggcgtagtggtgggcgcctgtagtcccagctactcgggaggctgaggcaggagaatggcgtgaacccggcaggcggagcttgcagtgagccgagattgcgccactgcactccagcctggatgacagagccagactccatctcaaaaaaaaaaaaaaaaagaaaaagtaaagaaaacatattttgtatgttttttatgtgtcttagaaaccaagtggactaggtataatggttctttttttttttaactcagcagcacagttaatggcacaaacagataaagatggtggctaaagccatttggtgtagatgaatccagaaaacaagtacatttatgaattattttaccctattggaaaatggctactatatgtggaaagtagaggggaagagaaatgaacttgtgaattatctactctattctaccaaagaaagatacatatatcatttcagggttttccaaagttgggatgcaaaggatcatgtttcattttaatttatgtatttatttttgagattgtcttctatgtattgcaagtgatactggttttaccatgcactgtaccactacgagggttcctttcaaaacacattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttagtccctgaagcacccagcgccaagggtactgttcttcctgcttaacacaggagcaaacagatgctcacaccctgcccaagaacacagaggctcagggactgaaccagaagaaatgatccattaaccatgtaaatgaacagagagcctggatgtcagagtgaggaggccagctcgggtcgctgtggagaaagagatgggctctccctggaatccctgcagctgcccttagaggctgtgagccatcgtggctagggcatctttagagaactgaaagtcaggccgattcctggagagtgaagaatagcacacgtgccttcaaaacagtgtcagtatcctgtcccttacggacgtcatattgttggtgggttttcctgggtgggagatcacccagtatctggttggcattactgatgggttcccagagctgtcttttggttcaaagtcctgccctcggtcccagctgcccccagcacaggtgtcaccttggagtcaggggcgggtttgtcatagcccatgggtcctggccctgccctttatcatgtttgacatgattttcagtctacttttccttcaggatgtaatttagaaaatatgatttcagaattgtgaaatttaaaaaccctagaaaacctctttgctttgcttgtaaatagcagttgatgcagccctgtggacaggcgggaacagccatgtgacgtgggcactgagatgatttgggagattgaatgctcctcagtggggctagaggccacaggagtgataggttactgtaaagaaagcaaaaaagatgcaaaagcctacatgacaaaccaggcacgacacaaaggagaggcttgagaagaggaagtgaaggagggagaggattccacaagaccgaagtgcccaaggagacatggagggaagagagggctcttcacagagctgagtttagagaccaccctccatggttctggaaggaaaccagccagctttcatatgtggtgacaggctgttcattaatttgtagtgtacagcattaaataaatgaagtatgtagagaacattaggaaacaatataaaaaggtaggggaattcgtggataaagggaataacctgggtaccatatttcatcacattattccatgggaataagtcatcagtgcaaaggactgtaaggagtgcacagcaggaaatgaaaagacagaagcagtggggccgagaggaggaaatggagttgctgaaatgcagggtgagcagcaggggcggagagtgccctgtgggtaaggcacacctcagaagggacaggtccaggccctctcctccctggcctggagcttctggcaaggcttttcttctctgagcctcactttcctcttttgaaggtggcaatagtaactgaacctgcatcacagaatggccttgagggttagatggaacatatatagacataatttgttgaagacagagtagcaaagacacaaagtaaaaaggacagaaaaaagaaatgcaacttgtgcaaaatagaactttcaaagatttacaagaagggtaaatgaagctatcgtagcttcacttgggaaaagggagagaacagatgaccagcaccaaggatagaagagggatttcttactttaaaaaaaatggtcccaaagaataaacaaactgaaaacagccaaaagagaaaggaagaatttgttagaatagggcaagactaaaggacagagtaagggtgctggccgccacctgactcaagttcaagtcgagctgccactgttgaaatttcaaggagaaatggtgagaagctaaaagatgcaaaaaaaaaaaaaaagtgggaaattatttgctaataatagattgcaagagtgtctgctttagaaagtgacaaggaacacttttggaaagctgtgagctgttatgaccactggcatccttcagttttagacaaatctaatctcaacaaggataacagaccatattaataaacaaattgatgggaatggtggaaatcagttccctatgaggagggtgcaaagttatactgattggtgagtcactcccagaataaacaaataatggtttcacacctcattgcttcattcagtgtggaaggaacattctaggtttgtgtgtaagtttggggagaaggagacagagccagagggcagagcagccctgcagccctcagttggcctccattttcttcccggtctgaagaaaatgaaacaaaggatttaaagtgttgcttgaagaatttaagttagacttaaaggagagatgtggtctttactctccttttggcaaggagagtttagtcatcagaatggtctatttagtgagactgtagcttgttcttctgaagtggtctttttaaaaactagagaactctcacctctctgaagtggttgtgtatgaaactgtttaaagccgaggatgcactcagtgacctcttcaggcaaccccagatttactcagtcagccatggcacacatgctagagaagtaaaaaaatgaattgagacttgttctgaaaactcttgagcaggggctcttaaaagttttttgtttaggaattatgtcagggttggggtctggagagcagataagtgttttgtgtgagaaaagtaaaaacttagttattttcttcccgtattcagtaatccttgcatttttttcctcctcctttatacatacatttttgccagttactgacttctctcttgtacacatttccgtgtcctaaattaaccaagagtcctcagccactaggattctattgacaagcccacaggtctggaggtgtgagtaagggcattcctcccccatgaaatcaggcagcaggggaggcgtttgggtgggtggaacagaggagcaaaagaccagaggacagagaagaaagattgcaggctagaaaacgggatggccacccctgagaaagaggacaagcaaatttagggcttagagtagaattgaagaaaaaacccagggcagaggcacaggaatgctgtaggactgaactgggaccatgattgatgtaagtggagatgggttggttgaatccgtggaaggccaaaggattgaggcccatatgggcctgggacagggcttactaaatgacttgctacctggcttgataatcgggacaacctcaggcagtagttattcaggcgggaggacacatgagtttgaatatagggagataaggtatatttctatatgccctggtacattccagaatgtgcttctctggctctgtgcactggagcagccaactcctgaagttgggaggggatcgccatggtttcatgagtggtttatttcagcttgcatctcacagtgtggtgttcagaggcataggctctaggctcccctggcagcactgagagatagaaactgaatcagcacaacttaggtccttcatgttgaatagtttgaacagaatttgatttaccctagcctaattgaaaaaaaaaaaagtagaaaagaaatcctaggtattttccctctggactccagaacaaatgattgagtgtgtaaaagcataaattctttttattcattcaattgaagtaaaaatttctttactcagccatgagttctaagactgcagtgggaattgtaagaggattaccatattttaaattggctattctggtgccaaatctccccttcattttacagtttcaggcagaagaccagcacggtagtcgggggaggggggtgggtagacaaatggtggtaacagtcctctacactctgggagggaaggagcggtgctggggacagctttcaccatggaaagaaagcagccgctctggagattgggcagcaggcttttgagcacggatgcggagcctgcttatctaatcagcagctagaggaagttgtttttatctgcgaaatgcatctcttctgaaccgataaaccccattttagctggggagaaatattatctagcagcatctgagcattagctgcagctgaactcaagcatgttcaaatgtgagagaagtctcaagccgagaactgtttgccgaacttcaagtggctggagtactggttttcaagttttcttttctttcttctttgaggaataactgaaagcatattatttggattcttgttcaccttgcttttttagttcctttcccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttaaaagtgctgtcagagtagatagataacattttctgttgccgggtttttggtcccagttttattttctgccttgttccatctgtgttgaaagaatagttagctctgtgtataaaacaaccaactgacatttcgttaactttccttctacatggggtttcagaaagaaatggggaaaaaaaggctggggggttgagctgtggttgccagttgccacctgtccccctatctggttagggcattttctgatttgggaagtgtaaatataacccagaaaaaacagcttcccctccttttatgcaaaagtagaaaggcttaaacagagtacagccttaacattgccccggaaagtttccacagaacccgttagactaaatgaaagctcttgctctgggggagtgggccatgccaggaagctgccctaccaagccctctcttgctggcaaggcagggctgggcctgggctactgtctcccaccagataagcccagctttcttcaaggccctaacaggaacctacatttcacaaattaccgcagacatgctcacaattttaaactctttgcctgttaggatcagtgagataacagaaacttatagggaactcagaaagcatgctccggtgagcagtgagccacctagaatcagccaactggtaatatgcggaaaatctgccaggttgttggtaaacttttggtagcttgaagtctaccgtggttgggagtatttacaccacagaaatcggtgaacgctgcaaatcaaggctttttctttttgagagctggtttatctgtgcaccactagcttaaatacacttttaatgtcctgacagctgaaatttgacagtgaaatttgaaaggaggaattcttttgggtagggttgtgtgtgtgtgtgtgtgtgtgtgtgtgtgtgtgtgtgtgtgtgtgttgtggaggaggagctgggaaagggtgaatctattggggaggactgtggggtacatataatttgtccaacagaagagttggttccaaatgactctttgctgttgaagtcacaaactggaaatgttggagcaactagactctccatattctaaacaaaacacatctttagcatttagtttggttgctgggggagtatgattagaaaaggatttggccaggcatggtggcttacgccgtaatcccagcactttgggaggccgaggcaggcagatcatgaggtcaggagtttgagaccagcctggccaatatggtgaaaccccatctctactaaaatatgaaaaaaaaaattagctgggtgtggtggcgtgtgcctgtagtcccagctactgggaaggctgaggcagaagaatcgcttgaattcgggaggcgggggttgcagtgagccaagattgtggcactgtactccagcctgggtgataactccttctcaaaaaaaaaaaaagaaagaaagaaagaaaaggattctgtgtcttatttatgagctattatgctattgctgttatttggggctgaatgatttttatttggggctgaattatttttaaatgtaaagcaagatgtctaaattacattaatatgttactaaattactatgatttttccagaaaaatattagcccatgcaatattctttaattcctgtgattaagttggtcttctgcaaagaaatttctgttgacttccttagattaaatgcagccctgagataggtgtgcaggtccaggaagtggcctgtgcagttctccctgtgcctgcaggggtggcttcttgaggatactttcgcagtaagggcttagcaatatgcgcatgtctaaggagtctatcagaaaactacctccactgtggaagggctggggattgtatttttgtgctttgaagcacctgacacttgctgtaactccattaactgaagagccgtttggtgccctaatttcaggagtgagttcagctgcagggatctcagagagacaggtctagggtgtgtctccgcaaggcctgctgccaggagagtacttcccccacaggggatgtggctgcaggctgtcgatttccactgaaatcaccaggagatgattctggtgaagccctgaacatccggtgtcactcctcaccaggctgggtgtgatcgatggaaggccttcagcatggccccctgctgcatggcagagcccagtggcagatgtggctgttctctttttcagagtgaaggactgttaccctagaagtgaaatcctgctgaaatgagaaaagtgctgttattatatttctacaggcagctatatgatcatttttattatgattcttggaacctggcagaattttgactgcttttgcaatatctctgtgctctccagttgaacttggtggcaataaaattaagaatctgccagtgccccccaagcatttctactctgtccataatgtttagtgacaattaactattaccaggtgtagccacccttacttaatcttagtgttatggtgcaagtaatccttagtgaaattattgttctgtagagaatgctgtgatctaagtgaagtgactttcatcctgagatgacaatggagttgtttttgtcactgtaaaggctgcatttactcgcagttttaaagcattattgctacttatatatggtctcaacactgatttttatatttgactttgtagctttaagtgtaaaaatttctgttaaggttttatatgtgttagttaatttttcccatttcaataaccatgttttattattgatggagtctcctaaaaatatacccttaaaatctgcttgccctgtgcctgcacacatattttaaatgttgggtatggagtcttttttttttttttttttagacagagtttcactctgcagcccaggctggagtgcagtggtgtgatcttggctcactgcagcctccacctcttgggttcaagtgattctcctgtcccagcctcccaagcagctgggattacacgcccgccaccatgcccagctgattttttgcatttttaatagagatggggtttcaccacgttgaccaggctggtctcgaactcctgacttcaggtaatccacctgcctcagcctcccaaagtgctgggattacagatgtgaggcaccgtatccaggctgtatggagtctttctaatcaggacataggcagacagtcctagcccagctttatgccttatgagacgcaacaacgttgaacagtcattgtttgagggacagaggttttacagatggatgataactagcatctgtggaacattatttgtgaaatatagaaatcagaaattccagcgtagcactgtccaaggggaacataatttgacctgcatatttgctggtccatttttagtagtcacattaaaaaagaaaaatgacacaggtgaaattaatttgaatatattttcttaattcagtatgcttaaatattatttaagtatgtactcaatataagcaattgttaatgaaatattttactctttttgaactatgtgtttgaaaccccggatgtattttttttttatcttcaccacacatttcaatttgggttggtcacatttcaagtgctcaggagtcacatgcagctaggggttacctattggacaggcaggcagatcttgagagctccaaagaactgtgtgtcattatattgtggaaaaaaaaaaaactttttagattaacccttgttgaatgttagccaaagactagtcatttatcaactctctaaaagtagtttttaaatcaatttgcttttcaaaacattttctcagtgttgtcacaaatgtatgtgaacatctgctttttaagtctttcattttttgcccacatttgatgtaaagaaaatctaggtccagtccaattttaacatcaattgggtttattttatgtagctgtgttttaagtacaggtcttgtacttgtaggcattttggttaagtacaaagtaacgagaatacaacaacatgtgaacatgtcaaacaaatcagtttttcaaagctaagtagctgaattaaatgtagaaaaacatgacatttaatttttgtcttcatcccttcattgtattcccatgtactctatggtaacttttttaagttgggaagtcctctttaaatttttgaaatgaggtagctgctttatagacatgaggcaggttcccagagagcgcccttgaggacaggctgtaagtaaactaagctgcaaagacagacaccatcacaactatggaattgttttgcaaaaattgtggagagtgatgccccttgatacttcctaaaagatgcttttgcaacctgataaagcaaccgaggagaggtggtgaaggaaaggcttttttttttttttttcaaagagagaaagagaagcagcaagctgcctgcctgcagcctgagaaagcagttccaccttggcacccatgtcctcatagcccaagcggggccaccctggcatgtgaatctgctccgcagtgtgcagcccaaaccccagccttcctgtgaaagggacacctcctgctgctaaccgctgctcttcctgcagttcaggagacagcgtgtgctcctgtggcggctgcatttcctgagtacaccatgatccaaaaaggcacagattcgtcatggaagctttgattgggccgttactgtcttttgacctttcttgtttgcttgcccttttgtttctttcctcctttttccttccttcctgtctttcttcttccttccttcctttcttcctttttctttttaattttcctcctttctctttctcctttctttccttccttctttcctctttttttctttcctccctccctccctttctttcttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggtgtcagcactccaggaacacatgggatccccgggaggtggaaattgagccgtctttggagaatcagctaatgagacagatgcatgttaaatgtctgttgtggcccaggcactctgctaggcagaggggtgaaccagaagaatgagattcatggggccaaagaatttgccttctggtgtaagaaaagatggaggcagcttggcagaaagaaaaaaaaggtaaaagatagaaatgaaatacagaataatctatctcctcatcccacaagcaattctgcctggtttgtggctcacgcctgtaatcccagcactttgggaggccgaggcaggaggatcacttgaggtcaggagttcgagactagcctggaccacaaggtgaaacctcatctctactaaaaatgcaaaaaaatttagggccgggtgcagtggcagttctgcctggtttgaacatctggttcagttaaaatacttcatgaaaatatttagcttgatgcactgaaatccatcactgcttttgtgggatgcactgactgcagtctgactgttctcctagtggaaaggggagcaatagcttctgtctgcatgtgcatgaaacagatggaaatttagaagagattctagtgcagacaacttcatcccacccccgctgcccacagagctagccatgtgcacggtgtgtttgaacaatgttatgttgctgctgtgcacagagatccccagtctcataaaacatactggatggaaggctgtcgagagatcatcaggccccagtgcataagttcttcctaagcatccttaacaggtgatcacctcgcctattgagaaccctcaggaggcagcccacttacggaagcactgattgttacaaaagccctgaactaaatctgcttgtctctaaagccagccctgcagatgtctgcagtgtaactactttctcttctctcaagcagttcagcccttcaaatcattgacaacagctctacaaagccctctaaatagcccgttctcctggctaaagtgtgttggtttcctcagcatatgatgaaataaacaccatgatgcctttgccttgctttttcttgctggtctcactcttccctggcattcttcaatgtgcccaagtccttcctagaacattgcacccaaagggccttcctggtctttccagggaatgcagaatgaaaaagaaatcccatcccctgcctcgaaaggagctcttctgtgtgtaagtgtaccttccccctcagggcataatgggaaacagtttgccaaagctaactgtgtaatttcacatgactcactgccgttagtctgagaaagcatggcatattaaactcattttccatgcttcccaactttatttactattccatttctgaggggcagagagctgagcaggaataacaccttccttgctcctcctaatggggcacatgtgcacatataaaattgtgttcgatctttgcagccacgacccatgttaactgtcaactgagaactcatgagtcagtttctcaggaacagccctgaagacattatctcctgcatcttgtatttgtgcctttgatatttggagggaagggtaggatctggcaattatcgttatctcatttggttcagtgtatttcatttcagcctgttaagatcttttggaaatactgtatgtgctagttacagggacagtgataaataagacagcattcctgtccttgagatgctatttccacagctccatgagatgcctagttaaaaacagagccttttttggaaacagcctactaatctgttaaaataataatggaaaaagataaagttagcatacctgagctgcaagggctgcctcctggtctgatctctgataaggatcagatcctagagcctctgagatccctgtcctccctgtctgcacaagcactcgcagaaggagaaacagtttacggtggttcatcatgactttgaaccaagcttaaagtcaaagtcatactctttaaaccattggaaaccaagtttttgcgagttgcctaaagtgggcaaaaatcccacaatgcacctgagcacaagcaggaaaacatgccattgtctccccaggagccctccttgacttctactttactttatccattgacactagtcttataagtagctttgtctgtccaatttttaattgaatttcgtttttattttcgtgagtggaaatatcactttgaaagaaatcagtcctctcctgaaatccagaattcctggagctcagtttacatgtttgacgcgtgtcacatgattccacaagtcactcaagggcaggaggattaccatcgatacggaaagatttcttagaaagcttaagtgaaagggaaaccagggagaaagtgtgcttcgtgagaataggtatgcggacggctctttgtgacgctctgtgcaaccctcgtgtttgcattgaaccaagctgtgctgcagatggacacccatcccatttccccgactcataccagggaggcccactttgcaaggtacacagaggggaccacagagcagggggccatgcaggggaccaagggacattttagtgtaaccaaagtgtgaagtatgccctttatttcaaaagaataaagaaaatcacaggttttcccgctgatatgccagggacatttccaagagaattccttttttgagagaaatctcctttgatatcccatcagtcagccatactgcataattgttagatagtgaaagaaattcattttttaagtttgtcagaaaaataaattctttgaagtcttaaattgttgcctccggacatgacatatctggctcttccagaatccatgttagtcctagctgaggaagaaggagaaggagaggggcgtttgttgattattgattttgtaagatgccccacacgttggctattagcagaattctcacttctaaaaggaaaatgagtgtgagctatgttcaatgagaaacagttatttttgggacattctttgaggtaaaacacctccttaagatgctgcttccttattgctatgggaccaagattagagcaagaacatagtggttttcagaccctggacatcatccacagccgcagcagaggccctgcccacttgaacaatgagacaggccaccattttgtttcgagaatgagcaaagtgaaccaccatgccagatattgttaagtcagcaactcttctgaagatggacatagtaaaaaataaacaaacaaggcagcacttgagatggtcatggcagagcaatctcaacaagcgatttgttattttgcacagtgatgtacccactcattgaataaaatgcaccagaaccatgcactacagatgctaaggagagttgtccttcaacaaaggagataggccccactggccgtggggcagtttatgttatttggtccttgtcatgggcaggcatggccctttctatgcttcacagatgaggaaggtccctggcacaggtccagtctccagcatggcctagaggtggcaggtgctacttagcatcgccagcctcctgcttggtcatggggtcagccagtttataacacgaacggaggttaatgaactgatcttcccatcgcacaactggtatgaacccacatcttctgattataaatcttttgctctttaactcttagtcattaccactgtctagtgtaggcctgtgtgttcatggcctttgttgccaccaaaagatcaactattagctgaataacatactgagacatgttggtgttgtgttctaaatagcactagtaaactgttagggaaatctgactatatagctactatccagtctagtttttcttgcgaagtgtttgttgagtgtgtaatgaggagtaaggaaggtgaataagaaatggcctgagtctttataaaataagcaaggagagaaaacagttttgatgagaagcgcatggaatttttagaagataggacgtgtattatgtacctataagaatgggtaggattttagaagagatggatggggaaaaggaacagggagtgggaacaaaacgtggaccaaggaagagcaggtttagccatggaagcctcaccgccggctttggtttatcgtgggccaaggggacagaccctgtggggagggctggcagcagggaggtcttccagaagtctatcctgcaggcagtaacagccacccagtctataagctgagtgggcatgggggtgatggggaatgggtggggagttattggggtaacttaccccaaaatgatagctagctggaaccatttattctattgcattttatcaataaatcttataggaagtaccatcctagtgaaaaccctgtcacattgagggcattcgtgcttatgttttaaaacatgttattgggtctatgaaaaataaggctgaaacctatgagcaccctccatgcaaagtttcagtcaagactttggaaacaagacagtgtcttactcactttataaattcattcagaaagccgtaggtttgaaaattccaaacttagatgtaagaagctctgagaaacacatgaaatcacccccacatcagtagagatgtctcagcagacatgggaagaggggcagcagggtgtagggaggtggggcagccccggggtgggccttgcaggctgggcttgaatcccatggccaccaccgtccgctgggaggcctggagccggctgcccactctctgaccagcacatgttgatgctgtatccttgaagggaccgtggtctgacatcctgtgatgcagacctgaatccagcacccacagggtctgcacattccctctttgaggtggagcccagctccagaggctggtccctgactctgtttctcaagaagcctgtacagatgttcccctcaccactgtttccagtcacctttggctttcacggtgcagatgctaagtttgattttcagagcccatctgggaatttagtgaactgaacaggtagcatttctgaacccacccataacccatgccctccccactgattttgaaagagagtttgctgcaggtgactttgcagctgggtagagaatcttggggcaggattccgaggcaggcagatgagtgaggataaattgggttctgacggcacgttacaccagtggactctaacgacgacctcacctcgtgcacagataattctgccttgtgcttaaccgttagaaatgtgtcactgaagtgtgaacatattatgctgttagatttcccatcatttctgttctttcattccctctcatttgcattggttactcataaatgtagatctttggtatgatttgtacaactgccgggtgtcaatctgtgaaagaaatcgcagagcaagctgggctctggtagcgctttatccctgcgtgctggcttgcccgggttgactcagaggcagtctcacattcagctgcgctggggccaaggacccagggagccaagtgtgcttctgttttctgtatttagcaatttaagacctgcgtttaaatactagctatgcattctagcaaaagaggtttatattttaacacagtaactcttaattgtttaattcagttcgtgtgttacctctcggaataaaatagtggaagccaattaactatagacttcattagtttggatttaagatcaccaaaacatttaccacatctcaattgttcattacatgctctctcttttttaatgcagtttttataatatggggagtgggggtgtggatttaaccattatatttttatgatattgggagtagatttaaccattatgtaaactggattttttaattttaaaaagtcacttatcttgatgtaaaatcatgtcttagtaaccttgataaactaagttttgcatgattacaccttaaggttaaaacatatttcatttcatcatttcccagaaggggcactgaattcacccatttcctgtttttcatctcagaatgttctgtgtttcctccatatctactttcccggcagcaggaccctggaagcagtcacaccaacctcatttaccccacctgagatttgtgtgctttgaacatagttgcaatcaaatcaacaatatctttgctcagaaatggatatgtgaagtaaaatgtgctgccctgttcatgtatgaaatcattcagctagctggccagtgagcccttcattgcaacaaagatttttctagagcccctgcactatctggggctatgtcaggcctcacactcctgctcacacgtttggaggctaccttggccagtattaccttaatccagcatttaggggaaggagcatttcaagactaaattttctaaactgctcaagcctacctcattttatttcttgtgtattttaacacttttggatgaggactcttcctagaacctactaacaattcccccccgcccccatgccaagattctttaaagactttcttgaaaacgcttcagtcttttcttcttagctcaaaagtactatcctaaatactagctctggcattacagggagttaatttgtgggcacacacagtaaattataaaccccttaagcagagaagattgtattatcagtttattagttttcttattcattccttcagcacacatttctgttgcctccaatgcagcagagaaattgacttctacagtttccacaacagtccagatttcaactgtgtagtgctctttcagccagaaagtacacttgtgtttccctggccataggtcctgaacctcacttctgaaaagtcattgtgcatagagagctaatagctgtaccctaaatgatcctggctttgaattctcttatctgcttggatagtattatctgtctcttcctctgcattctaatttgctacttctaatctgctgggaattacaataagaaagaaccatttaatcatttttacaactgtgcctaaagagagtgtgtgtaagtgccgagagagtgtatgagggacttgcccatgagtaaatgcatgaattttaggtcaagggttttttgcttctcttttggttgattacctcagagatcagttttactttctttctcattcttgacctatcatcactagctgatatggatgatgtgtacaactctgagtaagaataatnnnnnnnnnnnnnnnnnnnnctgagtaagaataatgtcaatgggacgggatgggattggctggtgattctgttgatcttaaagtttatatattttaagtttagtgtttcagaatgagaccaaagcggtgacattttcaacctcttcggtctctcttcagttttttcattttaagtttttgttgtgcttctatcacttaaaggaagcctccaagttgaaatcaaatactaatgacatttttatctaatgtataaatgtgtttttattatttattaggaaatttattttacttggccctcagccatgacatatcatggcataatcactatcctaaatttgtatatcttatccttgcataaggtaagactttctatgaattacacatatttgtattttcctctcttacatattttaagaatttttttatactttgttttctgcaaatgaaatattgctcataagccaggtgatggctgtccacgcctcttttcccctgcttacccttgcttagatcttatggtagaatcttttcatagaagacacagaaagacatgaaagaaagagctggagaagcctgaggggctgcccagtggtctgctaggatgctgtgccacagcccaggcacaggaggcagggagagcaatggggcccttcccttccaccaacattcagcagaatttgcagctccatgtttccaaagcttccagggcacttgcatttagagagagagagcaagcaagctgcctttcctcttcctcagttctgccagccacactcttgccatgatgagcagtttcagccaaaagctccttcccctgccctaacacctcctgcaaggcctgaggtctggaagccacctgcgcctgctggcccctcctttcttgtttctgcaatggatgttgtggccctgtgagggagaagagaaaaagaagttgccctcctccctctatcctcacctcctgccatgctgtcacccttataagagagaagggctaaccatccaggctaatcctccagtgatgcaggagaggacatcctggccggaagagtcagagcttccaggtgagctcaggtgggtcagcccccgaggctgtgaagagcccaggggccagtagatgccacttttgctccaggaagaatcttcaactgtgtcctttttattcaaggggctctcttttcagcgaatctctagatgtactagtcacaaacactcgcatttattaaaatgtatccatgatcccacaatccttttacatatttctctccaggagtatcacatttctgagggccctgtgcctgttttctgcaggaagttgctgttgtcccgggtccccctgcccccagcacctctgttacaagaagcagacccttcatgccacactgggacccaggcaggccccaagccaggatgctgggatcttagtaaaggttggaatgatgtcagaacatagaggaggcagaattccccccatagcatcatcctggagggcgctgatttgtgtgctctgccaggttcatctgtgactcaggatttaaaagccccaggtgtggtgtcccttctgtgcctgcaaggtgcgtctttagcagttctccctggtgtggaaggatcagtggttcttgcagcctaggcaccctccacagcaagcccaacacaggtgctgtgagcagctggttcatgaacggtgatcctggggagaagaggaggatgaaaatggaaaaccagtgcaaaggtgtgtcatccagttggttactgctgtgggtgcccgggcttccatcccaccagagcccccactagccagggcagcctggcggaggtgagcatcattctgctttctggctgcacctgtgtggacagagcccgttccaaagcctcccaggcacagggcagacatcaagcaaggggcagagctggggcgagggctctgggtgcccccgttattgaacacaggcctgaagggagcctaagaggtggctggcaggagatactacaaggcagaaagacagggcagcagtctttgtactgtacgtttttgttttttaagagagaacaaaaagtcaaggttgagagatgagaaatactcttgccaaaaagagaacaccaaaatcctggagtcacgggtcttccattaccctctctagcatttctgcttgtcttttccctagtattggtgaagaatttttaaagtaaccaacccataccgttggttacaggccctgtggtcaccaggctgtctccccatgatggggatggagagtggttagtgcagaaacttagacctcccctccagcttgttgaatgccctgaagtttatctagaagggaagatactcaagcgtaggatttcagtgatgcatttggacagcatcagtactatgcttcagcgtcaaaaacgtcactttgggtaggaacaatacataatgcgtggcaatgccttttgtgacacctgttcaggagattcccataggaagcttctgaggcagagtcctcaggtgaggagggggacaggcctgggtcttgggggaaggtggagatgaccagcctcatgcctctctccccagtggcctcagtctccatcaggcaaatcttgagaagcctcctccattctgcaggcaaatgactgagatgtgtgagctctgcttcccaacaggcggaaattcacatggggaagggcacctgtgaatggccttctagaactatcaggaagttctggatttagtaccctgtgagagcagatggtcctgggtgcactcggatgatcctgcctagccagctggattgcagagtggtcatcattatcagtgagctattgaggggttgagagcagtcagtgtcatgtataaggatgggttggggtaccggccaacgcccgccttgaggcctggccgccggatgggaggcgagagcacaagagagtcctggctaggtgtgccccgctctgcagggccacaccatccactggaaaccctgtgcccactgggctgcgtgctaagaggctgtggccaatgctcttgtccaaattttactgaatctgcagtctctcttaattcactccaaagtttaatgtgttagcttgcgaataaataaataaataaataaataaataaataaataaataaatggaaagaaacagtcctcagaaagtcccagtcaaattttaattccaacagatattcagcagtttcctctaagaacaatgagagttctggggctagccagtgtttctcttggaaaataaggaagagggaaagcggtgcattcatttaaaaacctgccctagggaggcagcgttccctgtgaactccgaggccacagtgagcagagcaggctggaggcctcccggctgtcctgcccctcctgccacatgcctgtgaaaatgctagataaggactttttctcagcaacttccacgctccttcagtggggatgtctttgactcagagctctgccactggttatctccacgaacagaaaatgccacagatgggttaattcactgtgttgttctcattttccctcagtttcaggcttttctctccttgcctgttttcctcgcttaaaaaatgatgtgggggtccctaaacgcatctaccccgatagatttatgttttcttttccattagtccactttgcgtctcagccctaaaattaagtttttgattataatgtaaggaagttttaccatattttaactctggctttttaaatacaaaagaaaaataacagaatgggcttctagaactatcaggaacttctggatctagtaccctgtggggacagatggtctggagccagcgcacttggatgatctctctcagccatctggaccgtagagtgaacttgttactgtccctccaaggctgacaactatgagctcatactcttctagcagtttaatttagacccaagaaaggctgtgtgtgtgtgaatttgtgagagtgtgtgagtgtgtctttgtgcctgtgtttctgtgtgtgtctgtgtgtacatgtgtgtctgtggggtgtgtctgtgtgtgcacggctgtgtgtctgcgcgtgtgcatggctttgtctgtgtgtgtgcgcacgcactctgctaagctactcaatgcaattccttactcttacttccctttctgtcacttctccataattctttgtatttcggttgggctggtatctcgcggcggcttcctcttttcctgcattcctatatttcattatttgctcttgttcctcttctagggcttttacaatatagccaggaggatgtggaaacccagttacaagatgacacacaagcacagtgtcacaatcgctgtgcttgggccctacctcctggagaccagggtgggacggtgtctctggatatggagggaagggcggaagatcacggggtggcagaaggcccgactgtccggtcttctggaagctggggtctcgtggtcgctgggctggtggtgctctaaaacctagagtaaccgagagcaggatgactgcacccctgactgccgactcaccgggcttcggagggccatgggtgtgtgattccacttgtgatcctcctacttccccagcccaccctggtggtctcccacttctctctctctgcctgtggagtgttataaccgactccttcttctaggcatctccatcccaaccccagaccagttcccttaaaccacctcccaccacaggacccccacaagcagggacctctcacagttcctgttgcctggggacttcatctcagcttccaaggcctctgaaaccaggccctgcatcctgggcatgactgtccccatgattctctgagccagccannnnnnnnnnnnnnnnnnnnnnnnnnnnnnnnnnnnnnccacccccccaccgccaagtccactgctgaccctgctgtagccccccacctccacttgttgagattccctcttcctgcttctcattttgaatgtcacccttctgtgacttctcacaacccccctgccacccctccctccagttggcatggcttagtcttcctaagaacatgtgctgcttcccagtacccagggctgctgtgcaccgtggcacgtgagtttcggtgcatcttcctcctgctgtttatagattgcaacatccctggacagatcttggattttccctctataatttctctggagactccctcggggtttgcacacacatctgtggaatgcccaagttggagatggtcctccctgatgtgtagtgtgggctattcagagggcctcatttcataaactcattaacagctaggacgcgaagacttggagaagttagctcaggacacacggagtgggagggaggcaacgagttaagaaatgggctttggagtgcctcgaatttggcctccacttttcttttctactgtcttacctggtcttaggcaggtcgggtgaccatctggagtcggagtttctctcatttgtaaagcgggggtgatatttttctcacagggctgcttcaagggttaacaaagttaatgtctaggaaggacatagcatagcaccttcacctggttgcaagcccctggagtcacatggcaacagctgtggaaccaggtaaatgacttgacttacatgttacacgctcttagttgttcgatttgtaaatgggaagagtgtgtgacccaaattagtcgtttccagatatttcctggtaaatggttgttgaatcataaaactagaaagatgggaaagaaagggaggaaccccccttacttcgaagaagtgttgttgatgtgaaggacaggactttttgagacactctcatcctaagaaacagctgatatctactaggaaaaaacatgacatttgaagtttcttcctaagagatgtgaggttttgacagaagtgccaggaagccagaggtgtgtgagtagtgggccaatctcacgtgaaggctgtgggacggggcaggagaggggcagccagcatttcctgagcgccagctaatggcggggacctggcacctttgctctgtgactctccagctgtatggtgacatgaggctggcgttttctttggtttcatacgtgaggaagctgaggcttggtgatgtcctgtgcatggctcggactccagagctactcagaggcagaggccgtctgtaaacaccttcaggtggttggaggcagggtgctgcagccaatgctgatcactcacaagccaaggctttattgtaagggctaaataaaataacatatgcctagcatttatacagcacggggctttttaggaaatagtgagacgaccatggagaggtggaggaagagagaagggaaagaagaaaaagaaaaaaaaagccttaaagagtttcttaagagaactatatattacaaagtccttggagtttttttttccctggttagacataagtttacatgaaacgttaaacggcttaaagtagccacatctccttccttatgtcttctcacagccacttgtgagtttcttatcaagatacagaattatggccaagtgcggtagctcacacgtgtaatcccagcactttgagagactgaggtggaaggatcatgtgtgctcaggagtttcagaccaacctaggcaatatggtaaaaccctgtctctacaaaaaaatacaaaaattagctgggcatggtggcatattccaatagttccaggcactcgggaggctgagacaggaggattgcttgagcccaagaggtcaagactgcagtgagctgtgatcgagccactgcactacagcctgggccacagagcaagatcctgtctcaaaaaataaaataaaataaaataaattctgcaacaagtcacaattccttgctcagaaatctctacaggtgtgcttctttgttaagaaatggaggaaacatgaatttcatcctgacttctgagtcttgtagagaccagatctgactcctgcagccttctgcccacagagctggcaggcgggggaatgtgcgcagagtgaggaggagctgatctgacattccgaacagtggagactgctgcctatttggccgcaccactgtccttctgcatggaaaagtcacagtaaataatggactctctacctgtgagtcgattttactgagctgcctttttaaatatatgtgtagaaagggcgatctctgtgtgtcatttgcacatgtacatacacatgtacacacgtgcacacgtggtcactcatgtacacatgtgtgtgcaccagtgcaccagaccagatgcacccacccaattccacgctcctcagccccttgctttcctctgcagacagccagttcagctacagttatgccagattgcctgcactctgatctttaccatcaccagactctcagcttgagctcatgcctgagaaatccactttctgggaggaaggcagaagaaactgccaaggcaggactgaagacttgacctccacctgtagtggggtcaggtcaccagaggctggctgactccccaggatttctcagcagagtattacacaaataccccttccttaaagattagcaaccacttaaagacacaaagtgtgcaggactgtacccatggccgagagcggcgggattaagagggcaactgagttgttcttcccatccctcctcctctgtgctgagtcaccttctgcttggaattctgacagggacccgttgggcttctggaagggagggacagcagaggatccaccctctgtgtgtcctgggggagattacttatctctggcctccctgaagcagggcctgggcttctggaatctttgaggctgacaccctgccagccctggggatgagagagaatggccgtgtctgtctgcagagcctgaggaggagctgagcacagcctccggagttctcttcagttgatcgcttaggtggacaaaggccacagaaatggatttaaactcctcagccctttctttgcatgtttgttctcatttgaagtcagaagtgatatgtcctacacctcaagaacgtgtgaaatgcacatacaataaccccatttcaggaagccaagtccagcttaacagtcaaaacatttccttcagtctttagtccttcactttgccgaactcccttttacaccggcagcaacagtttaacctgttgcttctgtaagagtgtgctactgggaaaaccacatctaaaacacgtgtgcagttacatcagctagagcacatgctaaacagttgatcaaaggctcttgccttgtggcccacgctgcagacactctgacgactgcagagctccgcagccccacgtcgtcccttccgcactgcctgctgtgcctctcctctccatgtggcagggaacacagccagtcatcaccatgtggctctgcccggcgctgccccagcatgtcctgacagggcctagatatggaaaggtggctctccatgcacacaccccaagcccctcctgcccgccgtgtgacccacactcttatgggcagcccagttattttgtagcatttcccttccttatcattttggcccagtgatccagcacaaatctcccttattagaataaaatttggaatgacaaaattaaatttcatttttcacttatattgaggacctcacactcttcacccctgccacgatccctgacaagagccttcctatctaatcattgttcctccagccctcttagttttcttcagcctttcttgattgcctgaatgtccctttcccttctccttttaaagcatgaaccaagctttcttaccccgttctcattatcatttttgcattttcttctttgcatatgattctccttaaattataaaacttgggggtaatttctagaggtgccatcatagtgcttctgtctactcagtgtctttagaatcagcaaatatcatttttacaaaaaagtagtatttcttccaaaaaagagtaagcaagaaggttacaacactgggaaaatatccctaagcctgttcttcaacctgttgaatgttttcccctaaattgttatatggagatcctggacccggaagttggctgacatgaaacaggcctagcagggcagctgaggaaatgctccaacctcaggatccaggaagattgcacatggcaccaaaacaatcatttaaaagctaatcctggccaggcacagtggctcacgcctgtaatcccagcactttgggaggccgaggtgggctgatcacaaggtcaagagatcgagaccatcctgaccaacatggtgaaaccccatctctaccaaaagtacaaatattagctgggcatggtggcgcgcgcctgtagtcccagctacccgggaggctgaggcaggagaatcacttgaacccgggaggaggaggttgcagtgagccaagatcatgccactgcactccagcctggtgacagagcaagactccatctcaaaaaagaaaaaaaaagctaatcccataaaagaaccatcattttgaacctgctgtttcctttcttgtactctttagaagtacccatttctccctttctaagccataggtgtattaattggagctttttctatcttaattagttcactgtgaacaattaaaattgtgttaataaaacaaaaacaaaaataggactggtgcctagttgtactacatgaagagagaaagggccagacattggtttttcctaatcttctgtcaagttctccaaatcatctgctctggaaggtagctccaacagctgggatttgaagtaaagcatagtgactttggccatcactgacatgtcccatttgaagcaaccaaaactgtccctcgacctgacactcatccctgaaacaccatgagggtaagtgaggcgcttcggaaggtccactcaaccccattgccagatagagtaagtgtctgccaggggcatttggagctgaagggaagactgtacagactcacggtttgcaggcactgaaggcgttttcctgccttctttttcaccttcagtggacttgcaaagcactagccctattgtttttcccatctgggaaacatggtgaatgttggttggttgtagctaatcctatgggtcttgaggtctttgttgacaagaaggtagatgttatctttatctgcgtgtggctttctactaaaacatgagctacagggctctcttttttgttttaaagcatttttccataaggttcacccttactattgcttatctgaataatattacctgctgagaagtttattcattgctcaccagttgtagggagattttgacacaggactggaggatttttttctcatcgtaacagtgcagacccatggaaagcttggaagcagttgtgaccggataagagcaggttgaggatgataatcttagggcaatgagcaggttgattgagaggggtgcctgaaagcaaggtccccatgatgcaagcaaacaaactcacatgccagacggtggacaggaaacacaggcaggatgtggtgcaggctgggctgccttggctgggcaaaggcaggggcttcatggccatgctgggatgtgacgtggttggaaaacaataagaatggagacctctccaaagacctcagacataatttggccatgagaggcaagggtagaggcgagccccctgtgggttggaatgtatggaatccagatgaagcaccatcaacatgcatgggctacataggagagctgggtctgggggaaaagatgggatttgggtttgggtgtacatgttccaggcatggagggaagaatgggcagaatgacgaggatcaagccctggtggagcccccagaccagggccctgggcatatttccacttgccttcttctgcaaacttttgtgtgcctgttgggtggaaggtactatgctggggccatccaggatccggagcagtgtaagacatcatggcctgcatggtgtgacccttgacatctgaaaagaacgagctggtggagtgggaaggagacaagtggcagcagagttgacatcatcaggactgactgcaggacaggcggtgaaacgagccactgaggagttacccagtgccctggggagcttagatgtgagacttacaccacccagcactccccagctctgtgtccctgggtcccactgaacttgattgtattttagttgcctcttttctaagaccggagcaacaataccttccttgagtgtgcatgtgcagtccatagatggcagccagtgttctcttcccatgagaagactctgagcctcctcactagagggtggtctaaaaacaaatggatccatccacagaaggtctgaaaggttttcatagaatcttgacttggtagcacttcaggatctaactcgtgctttccagaagtgtggcctgtggtgttctgtctggagtatttggtcctcccatccacctccaccttgctgtcctgtcctgtgactctcactagctcagtcaccgggtcaggaagccctgccatgaaatgctagatttggaggcattgccaaggtaccacaaaccatactcaaacaaggtcataatagactagtgatctcactgtggctaacaggttcatgtgatttaaagaatgacagcattttttctaaattttataaattttataaatttctcctaaatacaaatctgaatgtgtttacctttagacagattttcccagaaaattgtcagtgttctcgaatttgaaagtagatcagatctcctccctctagttttgaaaatctcaagtaggtttagcctctccccagagtgacaacggcacaagaagtttataattttatgcacagctaaatgcaaactgaaaagtgtggtttgtgggtatttcatttttcccataatgttcatcaatttggcaattcaaataggattcagaatccaaggtgttcgcagcattttatatgaaaatgtgcctgagagtttggggaatagaaattcttaccaaataagttaaatttgctcttgataagaatatattttgtaaaatgtagaaaactgagaaaaaaagtttgacacctgttttatctgcatccttttattaaacagtggcctgaatttactaaaggacagagaacagggttgagaggtaatcactgaataatagcttcgctaatcccacagtgactgcttcttatgacaagcaagagggtcaacttagaggcaggactgtcttcaggggcaaaagcaagtcagcacctacaaacctctccaagagagtgagaaaaagcaggttgtatggctcattttgcagcttgccagaagcaatgtgggaatattgtcagactgcacagacctggggccagctggctcctagagtgcgaggagctctcagtgactgctgtgcatactcacctgctctgtgactttgttcagtccctaccctggatgtgtggtgaagggtgccaggcttagctgctggaccagtgaggtccctgagggggcagggctaagaggtgtagcagtcgcacttgaccagtcattgattcactggttgggaatttgttcattgaggggacaccattactccccatgcctcacgtgcaggtgagtgtgtgtatatttgcattaacacacaaacacacttatgtgtgtccctgtatgtgcagctgcagtaccttacacatcttccagtgcctctcaagcatcataaaaacagcttccacaaaacctctactacccacctggcatccacagagctcccagtgattggctcccaaaagatactgaactttggcatggaacagagtgagtttccacatttgctgttgtacataattacctgtccagctagaatagtacacacttcttttactgagcccagaagtttatgtgcctgaacacggatggtacaggaacaagggtgagcgcttatcaattcagcattactctggagacatgaaacaaactaataggtacagctatattttgttttttaaacaattttgtgaaccacatatttgggacaaaaatcaacaagtaaatttgaattacactaggcaaaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnactttccaaaagaagacatacatgtggcccacaatcatatgaaataaagttcatcatcattgatcattagagaaatgcaaatcaaaaccacaatgagataccatctcacaccagtcagaatggttattaataaaaagtcaaagaatgacagttgctggtgaggttgtagagaaaaaggaacgcttatacactgttgaggggattgtaaattagttcaaccatgtggaagacagtgtggcaattcctcaaagacctatataccatttgacccagcaatcccattactgcatatatacccaaaggaatatgagtcattctaccgtaagacacatgcacgcatttgtttgttgcagcactattcacgatagcaaaaacatggaatcaacctacatgcccatcaatgatagactggataaagaaaatgtggtacatataccccatggaatactatgcagccataagaaaaagaatgagatcatgccctttgcaggaacatggatggagctggaggccattatccttagcaaactaacccaggaacagaaaaccaagtgcagatgttctcacttttaagtgtgagctgaatgaggagaatacatgggcacatagaggggcctatcagagggtggagggtgggagaaggaagagtatcagaaaaaataacaggtagtagatttaataccggatgacaaaacaatctgtataacaaacccccatgacatgagtttacctatataacaaacccgcacatgtactcctgaacttaaaagttaaattaaaaaaaaattaatgtctaataatatattacagtattcttcatattcaatggcaatgtgtgaagtgggaagtgtcttgacagaattcggtgtttcaaggcttacactttgatgcccaagactgcacaaggctacattttctactggtgagacaaattccagacgcattgcattcagatctaatctcttagctccttaatcttcagggtactggtaaacatgaagacctccccagtgctgtagtcatcatgatatgtacagcaggtggctgagctctggatgtagactgcagggatatattaggaagttaattctcaaggcaagtcatcttcaagcaccatatcagcatgatcagcaatataagtagtatctcagtgctttgttgtttagtcagagttttgtactctatcacccattgtaatgttcctatttgcaaaaggtaatacataccctttaaaacatctttgctttttctcccattatcgagatgctagcagcttcataaagcagaataactaagggcaaacagattatataaagggttggagctcaatgaagacaacaagaacagcaaaggttattgtaaaactggctgcttgcaggccaacaagcacatccatatggaggcaatcagtttatgctacctctgtctgtttgatgggattcataatattgactttatccattagatttggactaccaggggaataaaataagcagatggagagtaaggatttgctaggaaataattcagccagtcactttgaaagctgttcaagaaacagctttcaaagtgtctctcaaactatgtttgcccattatcccaataatttatttcccaataatttcatgggaaaagaaggaagttctgtggtcagataaatctggaaaacactggtttaagcaaagttcagtaggtctgcttccctgcaggtcacctcagagtctttactctgctaacctaggaactcatccaacaagtttaatttaacagctacactgtgtacgtcactttaacagtcactgagctgtgactcttgggggaaagattgtgcgtgtgtgtgtgtgtgtgtacacatgtgtgcacatgtgcagaatctaccaaatcttaagagaaaggaacatgctgggaaactgtcctgtgaaagagaatagaaacctgaagatttgaggcagtgatagcatttatgaaagcagcagataaggactaatcaccaaaaggggtagctcttttgttggttggggaaaacaggaatttttcccccacccaatgtgctgcattttctaattttctatgaacacttcctaagaaaaagctgaatgaagaacatttgcgatgcaatcagctcattaagaaacacgcacttttgtggagatacgtgctgtcccaggagatgctctgcgaggagccgagtgtttggactggagctgctgaatggtttctcacagttctagaatgtttggggctgcaccctctaagatgttgaacccatcagtaattgctccaaaccactttatgggatataatgctgtgagttgacacctgaggggattgtggtcctgttcatgagtaattacttttctgttgcctatagaagggccagcaatagcagatgagtagctgaacagtggttttgagtaataaaacgttcttttttaaaaaaaagtaatgctttctgttaaactctgactatactctctcctggtatcacaacccagctttctttttgccttctttattgcagttacatatggggctgatgactttagggatttccatgcaataattcccaaatctttctctcgtaagtatatgccgtgcttctggaaaacaaaagcatgccttcatctcctatcatgtaaatatcgtacgtgcatgttccttcatcaacccccgagatacattaaatattcactgttctattcgttagacacctaccatatcatttttgggtatttataccataaagtgcaaaacgaaggtctaggcagttgtgcggtgtcctgggagcatggcagtggagtaacagtaagggttggagtcacagtagcactgatgggattgttacttcgcggatgctgctggacagctttgagattactcctgtaatcctttttattgagtgtgaggataaaatggccatattttctgtcaccaacaaagaactgaacatggtttcaagataatttttacaattttgtgggacaggagaaggagatatgctcttcatctgtggttctggagtattaatttcagaactgagaagagaaaattgcaggcctccaggccgttattctgtggtgcatcgctgctggagccaacgtactgttcctgcttggtgcccgcaggaccttctctgatctgagctgttaaaccaaaaacagatgtgaatttcatttttcttttttagatattgagctgataaatgataaatatatttgggtaacatcctcaaatgagtactttaaagaacagagagtgcttttgaaaatgtatagagagctgaatatttaaagccatacaagttgataatccccttaggacctgtattagtaaatcctctaatactataaagcaacatcagaaaacaggtcgcatttgttaacactgtgacaattataattataggctctaatttgaacagtgccagtaacagttaaagacaggtgtctgacatcctggttatcaaaaactatctggtgtctaaggaatttaacagtatcaaagtacatctttttgctcacaaactagattggctacttttccagcctatagaagttacagaaatctttcttttactgatattcctttgattccactttaaagcaatagcttgatacctactttttgagatgtatatgtatgtacatgtaaatgcttatatatgtgtatttgtttacacgtgagcttatatgaacatataaaacattatggtattggacagagaaatgatattgatttgaagaatcatattgttgaagtattttgggaagtcaaatgcacttgagagtaagctaatgcatcctaaaacatgtttctgtgaagtctgaggaaggtgtcagccagagcatatgttgaagcagacccttcagtgaagccttcagtctgtaagaatcgctgcatgtgaagatgtgttaatgttatgatagttacagtttttataaaagagatgatatacacttggatatgctttctgtctatatttatgcaaatgtgtccataaggtattggtgtctctctttctctcccactctccccagtgttggaattgtgactatcttctcacacaagcggctacttggtcttgatgccttcccccgcaaaacagcaaccaaactgttctgggccaatatcaccaccttgtggtcatgatgaagaattgccccctttgccctcaacacctcttttcttcttgaaaattaaaaacaacccctttcaccccctctactgtccttattccagtttgtgtccgtagttgctggaggaaagaaaatgcctattgctcttttttttattctctttatctgtttactcttctgcctttcttttctctccctgacttcattccatttaaaggccttaaattgcaaataacgaaaaaagtattttctaataatataccctagtgggacgaaaacaaccttctacattttaaatgatattaagttataataaatggttccatgaactttaaaacgcttaaaagttttataaatctcttttagaggcaacacaaaaatatctatatatatatcttctcttcacctcaaattttcatttaattaccgtgattcaagatatatcttaaatatttccatttcatttgatttttacttgctagtcaccagtgttgcaagaatatttctgtaccatttttcaagtaaaatattgagcatttcaagcttacatggcctaaactcacactagagtgactacttcggactatcttttcaatggaaaaatgcgttctgagtaccaaacatttactttttcagtaaatatgaagacacattctaaaaaggaaagggaaatgaagaggaagcttaattcattggtcaggtggggactaacagtgtacattatacctatgcattaaaaaatgtttaattatccatgagcacatacagtgcctggcacagattcaggcctcttggctcctcttggcatctgagttccttggattctccagattcttcaatccaaacttgtctatctaccaaagtccaccttccatacaggggtgtggggtctctcttagtactgttgggtgccaataacatagaagccctccaagataggtcaatgagattttaatttttcccaactttaaatagcatctgggaaggaaagcagcttttgactaggagtttgaaaacatccactcttcatatttattgtcacatttattgagtaataaaattgggctcttgtccattatctctcagtcaatgaaagagcccacggtgggcatgagccaaagtgttccggagaaagagaggaccagtctccatttcatgttctatatttaatcagttcaattcagcaccttactgagtttgacatttttctaagtaatggggtggggggttacaaaatatttataactatctttcctatcttcagggagatgtaccatttcactgaagcaataccacagctaagcagttccagctccgagtaacagaggaaggagtgagcgatttaggaactcacagaagggcacggccaggcaactcgggccctggcaaatgttccatagagacagcatccatggggttgaaccaagcacaatgcctgcaaatcgggcaggcgggttcatggaattgattctagggcaggtatgatcagcaccatttaaggagtggcagttgttaagaaactgaagggatttctcatatggcattttcaacagaattcagcaggagccttgcatatcccttgggatgggttccggggtattatggagctgccaggaggtgctcagcttcagtaagtgccagtcattccttcccaacctcctccttcattagtggaagtatcagctggtgtcattgccttcttcaggaggatggatttcaaaatgaagggccaacaaaactcacattctcgcagagcctccgtcacaactgcatgtgttcactgccatcaacaggccaacacccacttgttcttttcttctaggtaaaggaaaaggtctgtgggacaaaggccctgaactcctcactccttgaatgggaggcatattggtggaggctgtcacacaactacaggtggcaggaacctgccatcagggttcccatcagcctccagggcttgcttctctgccctgtgtgtggacaccttccatcactggaaacccctctctcagaagaaccacttcttgccctcatctcccacttgcctctcctcggcaccttctccaccctcaggggccaagctgaggaagtgtgcatcctgtgccaccaaccttgctcgcaggaattagtttcagtccccagtgactgactcttccaaacctgcaccagcctatgctgcccttttgaaaggaggcgtgcgtacagcctggctggtacagaagattccagatttcagtgactacaggacgctgtcaccccttctgtttttcttttttctgtccacatctctgattgagcataccttcagggaaaaccccagaaacctttttcacacttacatgggaagccaagacactctcatcctgggcttgtgtttttaaaatctatattttaatttcacaggtccttacatttatgactaatagatttcagattttgagatacaatctgtagttgcaacttatgaagatagtttcaagccctgatttctgtcatctatgaaaacagtaagcaagttgcttgtattctcctcctagctggataagagacccccgttttcatggacagcctccttgggtggacagaagtctcctgatcttgtctatgtaaccagcacccactttgcatttttccgcaaagaaaagaggagcttaaccccatttacgggaaatccacgcactgcttgaatcttacgcgccccgtggtgacggtgttgcccactctgttcccttcccaccaaatcctgccagcacctggcagtcatccagtccttgtcttagacttcaccaacctttcccgtcataacatggcttagaagttgtccgaatagtgctagaagctttcagccctggaatgctcagcatctgccatctaacttccatttaaaacgttttgagcatttgctgatacaggttcctctgtcctttccccattattttcagttccttggccttgcccatagtgatctgtggatattgtctgcatactcttttttagaaacctagagcatcgcagtgtccttaattttcctcttcaaactctatatattcctgagctgatcatccctactgctgttcctacagaactgtgtgactaatcttctatatatgtccctacatctagccatctaggtggagatctaggtacctatctccctaaaattgtacttggtatccacattgacctcaggacagtatgtgataggctcttgtgccttttcgactaggagtttgaaaacatccactcttcatatttattgtcacatttgttgaataataaaattgggctcttgtccattatgtctcagtcagtgaaagagcccagggtgggcctgagccagagtgtttgtgtccctagttctcttttggttctgttacagctctcagtgacagtgtcattgaggctaacaaggacagagtactgctttcagccaccatttgtccaatgagtggctgatctccaggcctctggctttgagaacatctgtgatatctaaggcagcatccattgtgggctttcccccatgcttctgtttccttcctgtcacatagctttgcctcctcctgcaagcagcctgctgtagcagaaccggtgttcctgaagccagaaacccaaaggtcgtgtccaatgcttccctgctgttctgctccccacctgcaagcgcccacacactgatcaacagcacacgccatagagcatgccaaagaatcccagaaatactcattcttaatgatccagaagaacaagtgatagcttctggcaagttctaataggccatgtgtgcccatgggaaagcaagagtcaattctctctagctggttgcctctgaatttatgaagtcaagccgcgtaggggaacatgccaagaggattatcccaatgcctgttctgcgtggtgtcctttttctagcctcggaagcactaggcctacaccttcgctatagccctcgtcttagcgcctgtatttgaaaaacttgccacaccaatcttaatttgctccattgtgttctaatctcattttaaaaaccacaaggtaaatgattaaaaataatcttagattaaggagtacacagatctttgcagcctcattgtgtttccagagcgggctagtgtagacactggtgaacaaggagggcctagagaattagctttctcccagaaagatgcacagcctctacctgagagtaccaattccagagaactcaatggtcattaagcaccattgcctcgacagccagccagcctcacttgcctgcctatctcctttattttccaagtatcttgtccctggcagtggggagaggttagcaggaggctgctcagatgctctcggtctctgatcttcaggatctgaaggggagagcatttgaagaatccccattgctggatttctcaggacaatcctgcataatgccaggatctgatggaggagacaggcagctctgttaatcctctggtgcatcctcacttctgtggtctccaagtccaccatgtcccagttaattcatttcattattcatctgtaagtcatttccctaaagagctaataagaaaacactggcagtacaatcagccctccatatccatgggttcagcctctggaaattcaacccactgtggcttgaaaatacagtattcaagagacatggaacctgtggatatagaaggcagatttttcgtatccataggttctatagggccattttagggacttgcacatctacagaccttcaggagtctcagaactgatgcactgcagataccaagagatgactgtaagtggttaggaatttggatgctggggccaggctgcctgcagttaccttccagctctgccacttgccagctatgtgaccttagcaagttgttcaacctctctgtgccttggcttcttcaactgtaaaataggataatgatagcacttcccttatggagtccttgtgaaggttaaatggcagagtacaattaatgtgctgtgtgcccagcgtgtggtattggggttaggtgaaagactgtactgggatcactgggggtgagcctccatgtgccatgccccaaccactatcctcagctaacttcttgtctgtcagtgttaggctggtgctataataatttccattttcatggatgaggaaatcaaggcacagagaagttacatgacttgcctaagatctcagtgcttttaaatagtgcagctaagattccagaccaggtatttttatttcagtgtctggactgtagatctctaaatcgagaggaactccctgaataaaataagcttggagtgctgttaactaagttggttatttaagacagttgttctcagtcctcagtgtacattagaatcttctggagggtatgttaaaacagactgctgggcccaccgagagttcctgagcctgcaactctgggttgagcctgagagtctgtgcttctagtaagttctcaggtgatgcttatgctgcttctcccaaattttgagaaccattgattgaaaatgttgatcaaaaattatgtggtctaggctgagcacagtggctcacaactgtaatctcaacactttgggaggccaagtcaggtggatcactgagctcaggagttcgagagcagcctggtcaacatgacaagacccatctctacaaaaaacaccaaaaaaaaatggctggatgtggtggtgcacacctgtagtcacaactactggggaggctgaggtgggaggatcacttgagcccgggagacagagcaagaccctgtctcaaaaaagaaacatttagtcttgattgtcatctatctcattgatcattttacttggcaaaatttacctacttactcttattagtctgtaaaaatggttattaaaatggtggctttcagtgtaactacaaattctcttagtcattatagtgttggattcaccaatgtatcatcagtcagtgtttctgaagtgtgtaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccctttggaaaaaaaagctcttccagatacctacattcataaactatcccaattaacccttcagcaagtggaagaagtgtaagaaaggatacctcttctttagaacacagggtttgtttttatgttatttaagataaacaggaattcaaatggtcatgtaccaaagcaacacaaagaacttccggaaatctgaaagggaactgtggtcagaactctgagcatttttatgtttactgagttttgtcccaaagtttattaatgtttacatgccacaaggaaaggtagcatcacaataagagacgtttttcaggcttgataaccacttattaggtattttgccaaacaagttcacacatcctagagagctggattgtgtgacccagaacccaccctctagggcaaggtgcccatctgatgggtagggtgtaggagtaggcctcagaccactcctgacgtgaacctgcttaaagtgagggcccaattctaaagtgggaactatgtaaatacctttctagtgcattttcagataatcgccactgggcctatggatggagagggctggcagatctccctgtaaccccaggtgcatcccgaggcctgccaccgaagcccactcaaggctgaatgcacggcgagctcaggctgctctccccttggtatttgctaagaacttctgtttagtagctctccacacctatttgattgtctttttgctgctgtgttgttttgttgagttttttttttgcaatgacactgagtggcctcctgtattgtttctttcagccagtaatgttaaagtagagactcagagtgatgaagagaatgggcgtgcctgtgaaatgaatggggaagaatgtgcggaggatttacgaatgcttgatgcctcgggagagaaaatgaatggctcccacagggaccaaggcagctcggctttgtcgggagttggaggcattcgacttcctaacggaaaactaaagtgtgatatctgtgggatcatttgcatcgggcccaatgtgctcatggttcacaaaagaagccacactggtaaggcctggctcagtttttcctttagtggcctggagaaggtgcatggggtttgaaggaggaaagcatcctgtcttccttgtgttctgagcatgtttctaattgactggtagctcagttgttgcaagcgattggttccaagtggtaccgagtcatagagtccttgttctggtacagccttgtaaaggacttctcaacacgtaccaattccaccctataaataaaacaagggaaaagtgaacagcatcacatgagaggcttggcgagggctgctattatagtaacacatactaagtagtctcagctgagccctcagggtacgtgtgctgagtggtcaccctccacaaaacaaaaaatcctgatacaccaaaacttactcctcaaagtttccactgagaaaccatgagtaaaatgtgtgtttaaattgtatccaaactaacagggtttgatgtttagaaacaataatcaatgatggaatagcagcaaaatcgagttttcagaaagacctcagatgagctttcaaatggcttgccctctaacaggaaagactttgaatcagatgcttctattgccactggttatcagctcaaattcctaaagaacttcatcccaaataccctgtcttgctgaaaggtttactggaagtataagagaatgtcatgttctgtgtccagaaaggaaggaacacgggcaccctagtgtcagcgagttgtgctcaggctcacaggatgccccctcaccagaggcgtgggaacacggcgagccccagctggccgcgctctgccactgtttctaatagccggtcacgttgatggaagtgtcacagagttgtccaacagaactgtccagtcagaaaaccaccactcatggtgctggagtgtcttagaagtaaaatatgaataacacacacttatttaactgtaggcaggaggtttcttatgaattgaagagaaacttttctttgcgtgggaagctgttctaaagttgggtaaaacacaatagatccaccacctctagcagccactgatagctgaaacgtgaaacatagagaccctaagctatcactgcctctgagctggcattgttaggtcatcataaagctagcgtctcccactgcaaaacccaagaggaaaaaaatagttgaaaatcctattttaaaggcctagcagattctataagataccttgggaaaatgatgacgatgacttgaaatcagaccctcgtatgctgcttccgtgggggcgaacaaaaatatgttcatcaaaaattaagcagaaatgcagaaaattttgtgagccaaaaaagctgtgttatcaggaaatgcagatatttgtggggttgtaattttttatatttgaatcgggcggttttcaaaatgatctattccatttgtagtgtatctgaaaacctataaaaataagttgatatcaatagatatccatcttccataaaaattcaacttctaaaattaagcaaactttgctttttctaatggcccctttatcctcaaattacccactgaaatagacggatcacactcagccctaagtgaagcaagcgtgcatgagagtagtcccagcctcgcctttgtaatgaggtggaaattaacatgaaggtaggctaccctgtgatagacacttaacaggatactcggggacccatggtaatacatccctgataaggaatagacctcacaaatgaactacttgcctgttaattcatttaaagcctgactgtacagtgaaaattctcttaaataaatatttgataagtgaatcaaattctggcttactaaattgccaaaatataatgactgcctgccttgataaaaagaataattacatttaatgaataaacctgccaagtacagatatgccaggtggcacctgctgtttgctgctcacttctcccaacaaatagcagctaggtgccacctgcacaccaataagctgagtttttcacttacggaacaaataactttcagaagtcaattttatagtttctgccttgccctttgttaaaaaaatacacacacttgaagcaatgaactcatgaattgttttcatcatgcatttccacttgcctaaatataaagggtcccaggtagatacagaaatacctggtttggccaaacttggtttgaataactagacatgctagaaaaggttttcattttcctgggatctgagtggaatatgttagaaaaggcatgctttctgaattctctatgcttaaaacatttctagagcagtgcttctcaaacttgaaagagcatgtaaatcacctgagatctcgtgaacatacaactctgcttcagacctggggggaggcaggagagcaagcattcctaacaagctcccagcttgtggagcacagagccgcctcaggcagcagggcagtgcagctgagcagtgacagtgaacagggccattcagagggctctccacctggggcttaggtacgacgggaatccccactggacaggctaggacttgcactgtggccattgttcctcctcctgcccatggctgagtcagcttctcagtcccttccaggatacactgagaggattcaggggcggtctcgcctctgcccatatccccacgttggtgaagtaccactggcgccattttctaatcagctcatcggcaccagcacgtcacttcccctgttgtgcagctcagttttatatttctgactcgggtgtaatagtaacatcttccccaccaatgtctcagggttattgtgagaaccagagaggagagaggtaggaaggaagcaggaaatgcagggtgcaaatacaccacattattattctaaataatgggatttttaataacaaagaccaagaagattgtctgtgcctatctagttcccatctgtaagataaaaaggtgcagtccctgagcctcctaaaaacagcaccctaatggcactgctcctcccaggtatgattgcagtagacctacgtcagttcttgcagttcaaacacattttttcactttcttctgaaatgccctcaaattctatgacatagtatccatgaagacttccctttttacccagtgaagttactagagggggttcaaaccttcttacagagggttcctaaaatgggagatctgtggagtcattgggattaaaaattaaatttcaaattcatgacatcaatgtcctcatcccagttaaataaaagtaaatacaaccttgaagaaatttgacctactcagctgcaatagctgttgacctgcagaaggcaaatgatggaccccggccacgcaagaacacacatggcgtgggctgcgttcttgtgccccagctccatggacgtgtcttcttagctgtggacccctccaaaggaaactgcttgagtggagtgctctgtattgtcactcctgggaatgctctcttaacacccccatgccttgtgctatgtgttcataccagcataggcactcagaagcaaaaaaggtttccagtgaaatttgtttgcaggcaggtattaagacatcagacactgcaggatccaagtgaacccctgcccgcctgcctgcctgccctgctctgctctgcagaagggcatgtgtctgtagcaatctgccctttctgtctgcgatgggcagagaccctggctctgcctcctgttttccctgtagccctccagacctggggagagacatgggactccagcacctgcccagcacggaagggggtctttcccaggtgtaagtgtagggctgcattcactaatttagggtcataccacaaacactgttgtgtcaccaggatgttgtcacatgcttattgtgagcatttttgtgacatgagctttctcctgagaggccaccctgtccaaatgagagctgtagttggaggcacatccgtctcatgctgcctgggtctccctgcaccagctcactctacttttcctttttatccacttggagttaaatgcacacatttatgcacaagtgcacagaaggcccagaactgttcctaatagataattaaatgatctctctccagtggaaactctcctgggctacctggctgctagctgttttagcctcttcatccagtattgatttacatgcatcggtttgtaactcagacagtatagttagttagtttgtttcaccatcaccttccaacctgcttacgtttaaactccttctctctgcttagctaatacagatttctgtaaggatttggagaaataccagatacctcctggttagtatcaggacctctccattggcctataattgaacatcactgtaaattagtttcagcttttatagtaatgcatctaacccgccagcttaaaaaaaaagtgatgataatcatgaaattcaagtgtcaatatagacttttaaatctggtgtggatgttaatagtgccagatatgcttctgtgtaatcatttttgagaagtgctgtcttctttaccataatcacattaatcaatcgggaaatggttaaatagacattttaatacattgttttttcctgagaaaaaaagtgactccaggaaatatgttgttacaatatctcaacaccaggaattgtggtcacatagcattcttcttctaaataaagcatttgttttacaaaagagtttcatgtttacttaaacgtgacaaatgtatcactcttcgaagtgagagttaaatgaaatgttccctgatttagattccaagacctgtgactactcagtaggacaatagcatatttcttttactcagatacctgtttatccctttgtcagctccagaatggagacacaggtgctgccacacagaggagagggtcaggtgttttcttagtcacaaatgcagcagtctcacccctgaaagaattccttcataacaactaaattgcacctcttagaatacctgtacttaaaatataatttgtcttctatggatatagacaaataatagcttaaatgttttaggatttgtaaagaaagaaaaagctagaaatctcaatgcaactctgacttgtatgtcctgccataggaaggtttgggacttttctttggaagatgggaggcttccttcacagtttcttaacttctcattttattcaatctttctccatctctctctctctttctctcatcctcacgctctctgtctgtctctctcctgatttgtctgcttagggacagacaggtaatggagaagaaattgaaagggaaaatacagggaaaatgtaaatgaaaagaagttattataactgttataatgaagtgcctttcatttaaatataagaatgtaacgctgaaatgaacttgtgatcctgaaatgcatttttaatgagtttcctttttattttgctgcttcagtggcatattttaaagaccctttgaaaaaagccacattaaaaaaccccaccaaatgccacaacacgcaaaattggatattggtttattccaaaactgctgatcaggaagagtggctcttcatcacaaaatgttgcagtcactttatttaaatgagtttgaatttgcattgtgatgtgccattctgatttagggaaaaaaaattagattttcagatcaaattgacccagccagtgaagcgttaaggagctggcaggtttagtctgaaagcctcatgttctatcaaacctgcagccggtggaagtcaccaggcccccgtgggaaacaactttctcgtagcatcgtcctcatgtccccacgctgagtttagttctcaccagctctcctctctccgtcccaggagaacggcccttccagtgcaatcagtgcggggcctcattcacccagaagggcaacctgctccggcacatcaagctgcattccggggagaagcccttcaaatgccacctctgcaactacgcctgccgccggagggacgccctcactggccacctgaggacgcactccggtaggtcccctggatgcagtccggggctgtctgggtgtcccgggattcctccactctgcccgcctgggtcccggattgtgtccttgctggctaaccctgagtccctcccagctcgcagtcctgcatcgggtgtgagctgttgcttctttgacattgccccatcccccctccccatattctccttttcccactgcaccagggagattgggcgcaggacccccatgcacatacacacacagaagtctcaccttaggtagcatgtttcagaacaggcctcctcatcccgtttgtcaggctggtatggtttccctaaaggattttgcgggaaatgttttcaccaagtgtactgctaagacccaaaacgttttcaagtacaattctttctgttgttaagtcccgctttggagtgttttacacaggtgtaatggatagcttttttgcagagctggtagagaagggtgatttagggcgcacccacccagactgagccccgtgtggctctcacaccaaaaaccagccaaggccacagttacagaggccagtctggggctgttaccagattttagacagcagcctttctctttgaattagacagttaaagtacaacccacataatctggagtcttgacaagatcatcataggcataaacgctctatcattctcaaaacagtctcagcctgcaaagttcaaatccactaaagtttggttagatcctctgcctcctgagaaatggtcctgggtgtttcattatccagcagtcccataattctacagggcagaggaagagagggctcttggccggcctgtcatggatcatgtttgcctacagtgtggtctatacaacatgacatggcacaggtctccttcataccgtccagttggggatatttgctgtagcatactgcatgagacttcggaggcgaaaggttgatggcttttgtccttcccctcaaggagcttcctgccccagccagccaccagccagggcccttctccaagcagcagcctctctaagccggtgccctgggggatggcaatgcctcagaccagctactcctcacccaccctgggtagcaggataaggaggagcctccctcagggaggcagacgtgtgttctttgtgaaatatctgcagcggcccaggccatctcttcccaaatgtgatgcgtgtatttgatggttgagggttttagaggctgctcattgtgtccatctctttatcacacatttactgagcacccctgggtgcccattctgcacagaagacctcaggtgcacacaaggaaagcaccaatgtgttacaggaggcatgacagagtgtctgaggggacagtgggagcataaggaaggggacagtgggtcctggggtggaaagtcaggagagacttcccatagaagggaggggcttctgaagtacatgctggaaggcgagtgtctgaggtttgctttagagacattctaaactagtgtgtgagtcggcagtaatcccagagaggggtgcggcacccatgttggcaagaactcggtctcactcctggcaggtggtccctgcagtagttcacccagttggctggagacaaaaaggagaggagtcacaggggctggtgcatcacctcctctccatcctgacctccttcctggcggtgcacatggagaaggatccccacatgctcgccatcagaaaattgtcatgatttgggtgatttgacttcctaaaaacttccaagaaaggagctataccaagctgaggagttgcttgcccgagagggcgggcagatcagcaggggggccatggagtgggacacttgccttgttacagagggacagggagaacaggtggttcccctgagataggaagacagtagcatgacggtgagcatctttaaatgttcacatgggtgatgagcatgtatggtggtcccacctggagacaaaggtggtacctgggcctgataagcaaggcccatggaggcctcagctaagagaactgtgcagtctgtctgccatgctaaccagtggtctaggaagaagcttcacatctgttgtttctaaggagccatgtagacatagacacagttggcagcaatattgccttgggttagtgggaagcaccacttcccatgtcagtggaaaacacagacactcattcttaggttgacaccaaccataggtcatcatcactcctagattactctgattgcaatggaatctctcatgcccatcagtccttaaaagcagagctgctctctttcctttcttgttgtggagttaggaacatgtagtggagtattttatgttattctggctccaggcctatgtatttcatttgaggcatgatggtttcctattctaagtaccactaagtattgagtagttataaaatggtggtagactttggactgtgtatttctattctggatccacggatgagcaagtggagaaaacccatcatggatgcagggctgctggggatctgtctgtccgaaaatgctatagagacacacactgctcttggggaaaaaaacagtgatgatttcttcaaaatgatttcactgaagtgaaataaggactttggccttgctctggcaaattcaaatgtggccacactctactccattgtggaatggtgactcccctgtcccatgaaaaaccaggatcaacatcacagctttctctagcaactggtggtggcctgaggtcttatgaactagcatgttagcagggatagagttagggaatttgtccgatgctgacagcaagagggtgctgggggagctggaggggtggagaagtgatctcccttcctgcctcatggcttcctttggaagttgcaagcttagaatttctttcccaaagaatattggactatgcttcaagagacacttgagttcagttgcttacagtgaacatacttcttatgttccagagttaaactcaatcatattttcagaaaaatagatattcagacatcatgtcatatttacaggaagctatttgatcatggaatttactgaagtgacagctttttcaggaaagggtatcgagtggttatctatatcctattaatttctaaaagcaatgctcaataaaatgtgcaattttaggcaatattctgtgtttcaacattatttccttatgttgggggtacatcactttatatagataaagaaagatccttttcattctctattaaatggtcgagaagtcaaattttggctttcatgttggtcttcttactgtagcttctgttcacctaagaaagagatttaaccaacataagctttggctaaaccattgtaccaaacatttctatttggatgctcttaacttttatacaatactttgaaatgtgttcaataaaacaacatgagaaagaagtagaagattctgctattaggttggaaattgatattccttacataagtgattaaagatactttattcagtttatcccttaaaatggtatctactgaagtccttaaacttaggcatgatattaattcctggctagtctttctttttcctaaaatatcactcaataaaatccaagaaggactaaaactcattatatagaactgcactgcccaatacagcagccactagccacatgcagtatttttaattataataagttaaaattaaacaaaattaaaacttcagccctcagtggcactagccacactttttgtgtccaacagctacatatggctggtggctgccatattggacagcactaatagagagcatttctatcatcataggaagttctgttgaacaaggctgatctggaagctacaccatcctaaagctctttggcaagaaagcagagcttttccataagctcggtttatgaacaatatattttgtattttctatgtatatgtatatgagaatacgtatacatagaaatatatgaaaatacatatacatataaatatacatatacataaaatagaaatacatatacatagaaaatacaaaatattttgtattacatatacatatgcatggaaatacaaaatattttgtattatataatgcaaatataagatatatttatattatgtaagaaaatacatttgtgcaataaaacgcttatttcattcaagcatatttgtccagcatggtttcttagagactgaagttacccagtttagcacctggaactgaattcactctggctgtgttagatgtagcaccagcgtcatgacagatccagcccacagcatagactgaggcctactctggaggcaaatctgcagacaatgtggccaacacatgggccttcctcacatctctgtccagtcgctggcatccacgttataacacagcagtggctcgttttctccagttaaaggctaggcttccgtgattgaagcaggagagaatttggtagtcagtaaagtagacaaactaagacaaaacaagagtcgcatgagttcttggtacaattaaagaaacccttggccaccaacgtttttaaattcaggaatttcaccaagtccgtaacagttttagctctcaagggtagaattttttttttaacttttttggtaataattgtattgcatgcattccccttacacagaaggctggcatttaattggggtcttgaactcaattgtgttttctgcagttggtaaacctcacaaatgtggatattgtggccgaagctataaacagcgaagctctttagaggaacataaagagcgctgccacaactacttggaaagcatgggccttccgggcacactgtacccaggtaagcgctgctgctcggaggccagcctggtgggctctccccccagcacggtggggaaggagggcgctctgcatgcagccttaggagcagagccttgggcctgcttcctgccggggctaggagggagggaagtttttggccaatagcatcagtttcaccagaagcacgttgtgcttcccagctttctaggtcctcatctgaccagagagagcttgattttaaaacccttcccacttccaatcgggagaaactcctaggatagcagtgaccttgaaagttttggggttgttttttggatgttggtgattttaaaacaacaacaaaaaaaacacctcaagtagtgatatttctttgtaaacaaaataaaatgtaaaatattgttttgaaacaattttttaacaaagttgatcaaataagaactttcaggctgtgattttaagcatcagttcagactgagggcagggtatccactcctgcatggagtgtgaggttgaagtttgttggaagcccctggtagttgataatattgaggttgttgaaggatgagaggaaaggtcgcttctttcttaggagctgtgatgctccactgtattgcataacgagatagcacttgattcagaccccagagcctgtagaataaatgatgtggagagagtattgaaaaaggctggatttatctgggggaatggcaatgttataaaaggttcttccctaattttttaagagataagcaatttataaagagatcaaataaaactaatctctttcaaaacagtattcatttagcactacccctggaaaaatcatcactagactgtgagtcgaaatttaacgaatggaggaaaatttattaagcctcattcacctttcggactttaacaaatggttcaaaagggaaaattcaccagagtaccctcagattattaatggcagatgagagcaggaaaaaagaatgttgagaatggctaaaaattgattccaattagtcttggcatggagaggcaacatctcacctggccagagccctgcagccagagtgctgtctcctctgccagtcagccagggatctggggcttacaggcgattcctccaggcctcaatcttctcacctgtgaaatgggaagataccattaaattgtcatttggcttctttcaaaatctcaggtctagaatggaaaggcattgaaggtgagtggaagagaagaaactggatgttaaaataataataatgtaacagttattaattcacatggccagaccccagggcagaagactaatggacgagaggatgattatgttcctttgaaataaaatgtcaacattcaaatattgtttttttctgtaaaaaataagtgaatgggtcttggaaggaagtgctcctaatgatgtagtttacatattaatgcttaataaaccattttatttactcaacaaatattcactgaggacttataatcaataataccaagccctattgaatacagtaatctaatatacacatagaattgaaaagacaaaatgaacaaaagaaacagacagtatatcatttctgtttcctccactgttttcattactaaagaaacaagctgcagtacacagccggctgagagctgcttccgggggagcaggagaagcagcactcatttcactgagacctgggtttgagttctctgtttttgaatgtgacccagagctcatcgcttaaatgcgactgataattcgtgcctggccaccctcatagcagcgctctgaaagaaacataaaggagtggatacacgtgtgagcaggagcctagacatgtgtcaggtacttacctaaacatggatgtttaggtcactgacatactgacaccatcaagctaattcttctctattggtctctatgtcagtaaggctacgtgccagtaatgtgtattaaatattaccctgtggtgagtatcaatttcaccctaaaatgttcatttattccctttggtggttaagttacttggactaccacagtgatgcctctatgtccccacactcaggaggtatgaaagcgtctctaggaaggagcagtggtctggtctcagtgtggcagcagacaaagccaggctcgcacttaattacattgaattatttctgtctggtatggcctcaaaaggtgcaaaatgatcataaatatctttcgacagtcacctttggtttttgcccttgccagcacctggcccttgtaggtgctgctggtttaaggaacttggagtattaaggggatccataaaaggactttgacagaagtcttcctgaactgtgcttagggccaggaaggcaggcaggggcttggtcatttcagctgtgctgtacccggatgagtggaaactgtgccttctgatgcatctctcctcctctgttcccctctaagaaccccttgtctgtgctcagatggatgagcaagtagtctcttctcccaccccaaaaacctccttagattgggtggattcagtaaaatcaaagcctcagttaggcaatataggaaaagatgaatttttgtgaatataattttctttagtaaaaggcttttggtcacctcttataatttctcaatgtctttatggaaaaaataagtttctcttgagcctttggtgcacaaacagagtcaccagcccttggaggtgcatgcatctaatgacagagcagcctgtgactcgcgagcatcaggctcacttgttccttgctgtgattgtctctggggggtggaggcttttgggaggccctgcgccatggtgcagaggaagacccctgacctctgggagccctgggcaggctgtgggtgtggcttggcagagaaggatggacatgtcaggaagcatattagcttaatagatgaagtgtgtgaccagtgtaattgggttttatggatttatatttatcttgcatataaatcagggtgtggcctatatatgtttgcccatttaataaaaaacacatattccaaatgttaaaacataaaatataccagcaacaatagccaatttgaaatatatgttttcaaagtaacattcataatagcaatgaagacataaatacttagaaatgaagaaaaccagcaagccatagtgaggcaagaaagaaaacatgggagattggagaggtagagaggtctggatgccgtccatgggcctctgcccaaattagtgtatcatttcaacataaaactggcttgtaaattttactggaatctggtaaccatgtatcataaagtatctggatatatacatgagataattggcaactttttaaaagaagaataatgtcaagtgatgtatgaaaatgtagctgaaatggatggaactctttgaagaatagacaaacaaatcaataatagagatggataccctactgaagaccccatgataaatcagcatgaaatatccgaggcaggaggaagcataaggcaggaacggtattggaagaattgatcaggcatttaagataatcagtttacattatcatctccttatacactaggataaattgccgggaaatgaaagagttatatttttataactccaaccacaataactgatgtaaatatagatccagctatgcaggatacaaagttgtatcttcaattatggaaagagatgacatagaacaattgagaatgactagaaatggcccacacatcagcatttacctccataatttctaaattttctacagcagtcaggggtgctttgattttcaggagtttgttgtatgctcagggataaggggctctgggtttttcctccacattgcccagatctgctgtaggctcttgggggccacatttttgtatctccgttcactgtgctggtccatgaagtcagatgttagatcacacagttctttgcgtctcagagggctgctgttagggactgactgaggtagcagatttgggagtattatgaaaagttaaaaggacttgtcaaagggacatcaatacttaatcccagtccagcctctggtgatggtggtggtgcctgtgcatttggacttaaagaggatgatgtgtggtgagcagctgttggaggaagaagcatttgcaggtggctggtcattggcattgctccggctgcctctgcctgtctggaagtgttgctgggaagattagaattaatctctaggaagggcctggctcttgtaggcacttaacaaatgtcagatttaacattggacgcgactgaaccctttaaacataagcctttctaaactggcctctctgtctttgactttagtcattaaagaagaaactaatcacagtgaaatggcagaagacctgtgcaagataggatcagagagatctctcgtgctggacagactagcaagtaacgtcgccaaacgtaagagctctatgcctcagaaatttcttggtaagagttaaatgtttgctgtctcttaaaaaaaaactatgtgggtgttttagatgcaagtagaaatgagttgagggtggaagaaagggaaaaaaatcttattttttcaaaaggaaaaattggtaagcttaacattccttaaatatcttagaattttttccaataagtatcttaaaaataacaaacctcccatcagtttttcctagatttgattttgcagcatctggggcctgccctgtgatctgcctgtggacatcgctcttaggggcggctgcaccagcgtgcacagggtggagagtttgggcctggctcgtccgggggacaccacactgcaggacactccaggcctggccggcttctcagagcttcagatcctcatttttcatatgaagctcctaatgctccccttatgggggactctgaagggttaatgggaggaatcatacagtgactgacccctgagaagtgtccagtgaagacagggcttagctaggattgctgttttgcctaatgctctgcgggattaaaaaaaaaaaagaagaagaacaagaccattcgtctctctaggagcattgcccagagtaggtattagacacaccaacaccaccatccagccagacgctgcagggacagtgagccagggtccgagtggaaaggcgctaggcttgggaaccagctcagagtcaatacagagccaccgccactcaccaactctgtcagcttagtaaaatggctctgcccctagagccctggttccatcctttagtatctcacagggtgattgtgaatatcccatgactccaagattgagaaaacgtttagaatccctcggtgtgaaggttaactctgtccggaaagaggaccagtaaaagcttcatgaggctgagatgcactttggaagaggaatagagtttcagcacattctaggtgttggaggaatgggggaatctaggcagatgtttaaaatcaatgagaaaccagaatgctgaccatgagggttggagtgggggcctaaggacatgacggaggagcagggtgtgttcccagcttaactcaggtacccatggggaagcaggaaaagtgaaggtgtcctaggcagctctgccacaggatgaatggcttcagatgccaggtgagcgagggacccttcattcagtcagcaggaaagaagcactggcatattttttatgagaacaaaggctaggatagtaaagacagcaagtaccaaaaaatgactggaaaagggagactgtggaggcagtggcagcaggcatggaaagaagggcttgtgaaggggaaggggtggtgtcagaggaacatagggctgggggcagggattaggtgagggaaaccatgagtcacactgattctagagtagtgtgcccttgatgaaaaggataacaccaggttctaggaaaagatggggttctgtttttgacgtgttgattttcaaggacttctggtgtttgtgacacatggggaaattgtggtgggagagaggtggggccagaacaggggctggtgaggccaagggtcccagagggcacctgttgacctgcaggatgacatgaagggggaaggacagaggcaaggccaagtcctgggcaccagcctccctcttgcagcttcaaatagggctccattttgaccttttgattaattagaggtttgtcataggttgggggttgagaggagcaagggagagaaggattcagtgtacaaaaagaatgaaagccactggctgagccagtggggagttgtccacacacacatgagcctttggaccatgagaacgagggaggccttgccttcctgaacggagtaggagtgaggtcctgtgctgagcgtaagcagtgggattcccacagcactgggcacagagcccacgggctgcctcctgagcagccagcatctgcctggggtggacacagtgacagagagatgggtggtgactggggtatgggcagagataaggcagcaagtgtgtgcaaggggagtgaagggttactgaccttaagaagcagggatggcgtcctctgtcaggtgaggagcctggagaatgctttggtgaatgaacgtttgcagccccttttagcttttggagacttgaaaccaaaggagaaattcatctgtgaaactctactggagccactccccaacccccacccttgtgagaccacaatgtgggcgttggcttgagatgcttctgtgttagtagaagaaataaacaacacagtgctctgatgaggcaaagcgaagatgaaaaaggagttcccaggggacatagtaggaacagtggacgagggtagcagaagaggagtttggagcaaaagactcacaagcagctgcataatctgttggtgcttggcagttcatttgtaaaaatgatgcctcttcc

SEQ ID NO: 1161 - DNA, 3629 bp, Homo sapiens
  misc_feature (3078)..(3078): "n" at position 3078 can be any base
gaattccggcgtcgcggacgcatcccagtctgggcgggacgctcggccgcggcgaggcgggcaagcctggcagggcagagggagccccggctccgaggttgctcttcgcccccgaggatcagtcttggccccaaagcgcgacgcacaaatccacataacctgaggaccatggatgctgatgagggtcaagacatgtcccaagtttcagggaaggaaagcccccctgtaagcgatactccagatgagggcgatgagcccatgccgatccccgaggacctctccaccacctcgggaggacagcaaagctccaagagtgacagagtcgtggccagtaatgttaaagtagagactcagagtgatgaagagaatgggcgtgcctgtgaaatgaatggggaagaatgtgcggaggatttacgaatgcttgatgcctcgggagagaaaatgaatggctcccacagggaccaaggcagctcggctttgtcgggagttggaggcattcgacttcctaacggaaaactaaagtgtgatatctgtgggatcatttgcatcgggcccaatgtgctcatggttcacaaaagaagccacactggagaacggcccttccagtgcaatcagtgcggggcctcattcacccagaagggcaacctgctccggcacatcaagctgcattccggggagaagcccttcaaatgccacctctgcaactacgcctgccgccggagggacgccctcactggccacctgaggacgcactccgttggtaaacctcacaaatgtggatattgtggccgaagctataaacagcgaagctctttagaggaacataaagagcgctgccacaactacttggaaagcatgggccttccgggcacactgtacccagtcattaaagaagaaactaatcacagtgaaatggcagaagacctgtgcaagataggatcagagagatctctcgtgctggacagactagcaagtaacgtcgccaaacgtaagagctctatgcctcagaaatttcttggggacaagggcctgtccgacacgccctacgacagcagcgccagctacgagaaggagaacgaaatgatgaagtcccacgtgatggaccaagccatcaacaacgccatcaactacctgggggccgagtccctgcgcccgctggtgcagacgcccccgggcggttccgaggtggtcccggtcatcagcccgatgtaccagctgcacaagccgctcgcggagggcaccccgcgctccaaccactcggcccaggacagcgccgtggagaacctgctgctgctctccaaggccaagttggtgccctcggagcgcgaggcgtccccgagcaacagctgtcaagactccacggacaccgagagcaacaacgaggagcagcgcagcggtctcatctacctgaccaaccacatcgccccgcacgcgcgcaacggcttgtcgctcaaggaggagcaccgcgcctacgacctgctgcgcgccgcctccgagaactcgcaggacgcgctccgcgtggtcagcaccagcggggagcagatgaaggtgtacaagtgcgaacactgccgggtgctcttcctggatcacgtcatgtacaccatccacatgggctgccacggcttccgtgatccttttgagtgcaacatgtgcggctaccacagccaggaccggtacgagttctcgtcgcacataacgcgaggggagcaccgcttccacatgagctaaagccctcccgcgcccccaccccagaccccgagccaccccaggaaaagcacaaggactgccgccttctcgctcccgccagcagcatagactggactggaccagacaatgttgtgtttggatttgtaactgttttttgttttttgtttgagttggttgattggggtttgatttgcttttgaaaagatttttatttttagaggcagggctgcattgggagcatccagaactgctaccttcctagatgtttccccagacgctggctgagattccctcacctgtcgcttcctagaatccccttctccaaacgattagtctaaattttcagagagaaatagataaaacacgccacagcctgggaaggagcgtgctctaccctgtgctaagcacggggttcgcgcaccaggtgtctttttccagtccccagaagcagagagcacagcccctgctgtgtgggtctgcaggtgagcagacaggacaggtgtgccgccacccaagtgccaagacacagcagggccaacaacctgtgcccaggccagcttcgagctacatgcatctagggcggagaggctgcacttgtgagagaaaatacttatttcaagtcatattctgcggtaggaaaatgattgggttggggaaagtcggtgtctgtcagactgccctgggtggagggagacgccgggttagagcctttgggatcgtcctggattcactggcttgggggaggctgttcagatggcctgagcctcccgaggcttgctgccccgtaggaggagactgtcttcccgtgggcatatctggggagccctgttccccgctttttcactcccatacctttaatggcccccaaaatctgtcactacaatttaaacaccagtcccgaaatttggatcttctttctttttgaatctctcaaacggcaacattcctcagaaaccaaagctttatttcaaatctcttccttccctggctggttccatctagtaccagaggcctcttttcctgaagaaatccaatcctagccctcattttaattatgtacatctgtttgtagccacaagcctgaatttctcagtgttggtaagtttctttacctaccctcactatatattattctcgttttaaaacccataaaggagtgatttagaacatcattaattttccaactcaatgaaaatatgtgaagcccagcatctctgttgctaacacacagagctcacctgttgaaacccaagctttcaaacatgttgaagctctttactgtaaaggcaagccagcatgtgtgtccacacatacataggatggctggctctgcacctgtaggatattggaatgcacagggcaattgagggnctgagccagaccttcggagagtaatgccaccagatcccctaggaaagaggaggcaaatggcactgcaggtgagaaccccgcccatccgtgctatgacatggaggcactgaagcccgaggaaggtgtgtggagattctaatcccaacaagcaagggtctccttcaagattaatgctatcaatcattaaggtcattactctcaaccacctaggcaatgaagaatataccatttcaaatatttacagtacttgtcttcaccaacactgtcccaaggtgaaatgaagcaacagagaggaaattgtacataagtacctcagcatttaatccaaacaggggttcttagtctcagcactatgacattttgggctgactacttatttgttaggcgggagctctcctgtgcattgtaggataattagcagtatccctggtggctacccaatagacgccagtagcaccccgaattgacaacccaaactctccagacatcaccaactgtcccctgcgaggagaaatcactcctgggggagaaccactgacccaaatgaattc

SEQ ID NO: 1162 - DNA, 1560 bp, Homo sapiens
atggatgctgatgagggtcaagacatgtcccaagtttcagggaaggaaagcccccctgtaagcgatactccagatgagggcgatgagcccatgccgatccccgaggacctctccaccacctcgggaggacagcaaagctccaagagtgacagagtcgtggccagtaatgttaaagtagagactcagagtgatgaagagaatgggcgtgcctgtgaaatgaatggggaagaatgtgcggaggatttacgaatgcttgatgcctcgggagagaaaatgaatggctcccacagggaccaaggcagctcggctttgtcgggagttggaggcattcgacttcctaacggaaaactaaagtgtgatatctgtgggatcatttgcatcgggcccaatgtgctcatggttcacaaaagaagccacactggagaacggcccttccagtgcaatcagtgcggggcctcattcacccagaagggcaacctgctccggcacatcaagctgcattccggggagaagcccttcaaatgccacctctgcaactacgcctgccgccggagggacgccctcactggccacctgaggacgcactccgttggtaaacctcacaaatgtggatattgtggccgaagctataaacagcgaagctctttagaggaacataaagagcgctgccacaactacttggaaagcatgggccttccgggcacactgtacccagtcattaaagaagaaactaatcacagtgaaatggcagaagacctgtgcaagataggatcagagagatctctcgtgctggacagactagcaagtaacgtcgccaaacgtaagagctctatgcctcagaaatttcttggggacaagggcctgtccgacacgccctacgacagcagcgccagctacgagaaggagaacgaaatgatgaagtcccacgtgatggaccaagccatcaacaacgccatcaactacctgggggccgagtccctgcgcccgctggtgcagacgcccccgggcggttccgaggtggtcccggtcatcagcccgatgtaccagctgcacaagccgctcgcggagggcaccccgcgctccaaccactcggcccaggacagcgccgtggagaacctgctgctgctctccaaggccaagttggtgccctcggagcgcgaggcgtccccgagcaacagctgtcaagactccacggacaccgagagcaacaacgaggagcagcgcagcggtctcatctacctgaccaaccacatcgccccgcacgcgcgcaacggcttgtcgctcaaggaggagcaccgcgcctacgacctgctgcgcgccgcctccgagaactcgcaggacgcgctccgcgtggtcagcaccagcggggagcagatgaaggtgtacaagtgcgaacactgccgggtgctcttcctggatcacgtcatgtacaccatccacatgggctgccacggcttccgtgatccttttgagtgcaacatgtgcggctaccacagccaggaccggtacgagttctcgtcgcacataacgcgaggggagcaccgcttccacatgagctaa

SEQ ID NO: 1163 - DNA, 37135 bp, Mus musculus
  misc_feature (3625)..(3644): "n" at positions 3625 thru 3644 can be any base
  misc_feature (29292)..(29311): "n" at positions 29292 thru 29311 can be any base
  misc_feature (32697)..(33214): "n" at positions 32697 thru 33214 can be any base
  misc_feature (34975)..(35306): "n" at positions 34975 thru 35306 can be any base
  misc_feature (36024)..(36502): "n" at positions 36024 thru 36502 can be any base
ttggcagcagggacaagcagaaaaactggggttttgtctccaaaatcactgagaaagggattagagaaagcagaagccaaatggggtgatatgtctagggtagcaggtgttccgagaggccccagagcccaggccagtgcacacaggcacagatatttccccctgcagggcaaggaaatggactggtatttcaacttccagctattgcttcagatgctaagaacttgcctgaccctgatgctaacctcccctccctgacccacagtgtcagaatctggtgctggtgacaggaaaaaaacaggcgggtattaggggagggagggagggaggtgtgtgtgtgggaactaataggctacctcaccagccaccccacccccagccatttctaggtcctgcacagaatgccagctgcccatggccctggtgggaggaggtttccacggtgccttgtgatacacactgggtcgctgagaggggtgaactatagacatcaggcctcagggagatcacagacttgtgtgtcagagtgaatctgcatctggggtgataagtggggttaatctcaaggtcagatctagccaatccattttcatgccaacttggccctgggtgccctgcatggtggcagctgagactcggatgtcccctttactagagatggtgccttgcctggcttgtctccccactatggttatcggtttccaatcattacctttatttctattccattacctagagatctaaggaccctgaacggtccttactgttcgctgttttaggagactcagaaaagaaatgggattgagagtgaaggctcatgggaaaggatgtccagcctgagggaggggcggagccctaacccatcaggcatctcagatagatacacaaaccagactctcagcctctttgctctgctccctggggttcatcgcactgccctatgctctcgggactcacctcaggctctgccttttacaggctgtgactgtcaccatgttcataggaagaggggggactaggaaagctctaagaataagctggagggccaaagtagactccagcaggactcagagttgctaaggtgatagagaggaggcagtttggagaggcaagaaactgggtgagttggctagctgtctttgcagcagttaaccagagactagagagtgagaaggacttccatacagggtctctggtgttggagtgcagggagtgcaatgtggctagggtggggtgggtgaaggaagatctatgctgtccttcctttaaggaggaatgtgtccagaggggactaaaaaacagaattccaaacaactcatgaacagggccaggccagcatcttcttgtccccagtccagcccccgcctctgaagcccccccccccccgcacacctctggaagccctcctcagcacccccaccccaccaaagcccacagccctggggaagctgtgtggccttgtcaccacggacccagtgtcgtgccggctgtggcttcttccttctgacctattttttaatcatttgataagatcccccctcccaaaccaaaccccggcccccgggcccgtcagctccaccgcgtgtcaaaaccacccttgtcagtttgcgttggtttcttagtccagtagcccctcccctcagggcctgagagcgaaggctaattacccagctgctgagtgcattccccccaccccaccccctgctactccacccccagccccaacagagggggccctggaggcctgctgctagaagaagctggggcctcctttccctcctattgcagggcaggaagtccttcctgctgtctaacctccattcttttctctgtcctgcccctagtggtgctgaatggcagatgcaaggactgatattctagactggaagggactttgaggcatcatctcctttaaggaaagtaaaagtcgcagcctcctgacctggatttagagatgtcctcctgggtctcacagaattgtaggggatggtctctgccaagggtctcaattacaggacagaaaactgagatgcagcgagagaaaaggacaggcccaaggtcatgttcggctggtggggtagctaggatcagaacccagacctttctgtctttctgtctgttgctgggtctccctcactccattctgtttcagtttctccctacccgtgtgtgtgtgtgtgtgtgtgtgtgtgtgtgtgtgtgtgtgtgtgtgtgtgtgttgatacacactctatgggagcttgtggaggccacaggtcagtgttaggcatcttcttcaacttggtcttcaaatacatttatttaaacattttttttctaatgcgtgcaagtgttagcatacatgtatatatgtcatcatatggatgtgtggtgcccttggccgccaaaaggggagttactgatgtttgtgaaccaccatgtggatgctgggactggacctgggtcctttgcaagagtagtcagtgctcttaaccattgagccatgtctccaaccctccccgcccacacacacttttatttttggagatggggtctctcactgaatctggagcttgccagtgtgactggtctggctggctggtcactgggtcccaggaatcctgcagcctctttcttcccagagctgggataataagtggatatgttgtgcttaacacagaggtgtgggagagttaactctggtcctcatttcttgaaacgagccctttattgactgagcccatttttcattctgtctttgtttttgagacagagtcttaccatgtagcccaggctggcctggaactcagcatcttcctaccttaaaccccccccccccagagtgctgacattctaggcatgtgacactacacccaccttattttctcagtgactcagtccttattccctgagcaaggacatcacttcgtgccccttgcgagcctcatcctcaggtctggggttgtccagcttgctccatacaccattagagattgatcactcctccagcgtgtagctgctgtcccctcttccctcagactatcagctgctccatatcaacttaccctgtcacattatcgagaagggcaaagccaagggtctgtgtgtgagagaggcctcaaaaaggaggccctgcaccaggtatacaggcatacaatagagtgcagttggactggccttgaggctctgacagacttggagatgcagagacagacagacagacagacagacagacagacagacagatacaaatccatgatagagatcacagtaagttcttggagccagggataacaggaatactcgaaaaggcagggacagagagagaccctattattcgacatcagcaggcatatttgttatgaaatataatgcggcaagggggtacctggcacaaccatgccaaggtgtgtccatgagtaactacaccacacaacagagttggtataaagaaagtttactgggagaagggagaagagcaaggacttggagcaggggtagaggcaggagagtggacatgtagacagacggacagatgggagcagactcatgggggcagagaagtggccaggagagggagcagagaaggacaggaagagggaagaaagaatgctgggaacacgtgggaacacagagagaactgggnnnnnnnnnnnnnnnnnnnnatgtaagccactgataggttcctgggaggagcctagtggaactgctgtaagctaacagtatttattgttgttttagttttaattaattttcagatagagtatactgtagtccaggctggtcttcaacttgataggtaggccaggctagcctttaacttgatcaggagtttgagatgaccttgacttcctggtcatcctgtctctacctctcaagcgctggcattatagacaagtcccaccaaggctgacaagacaggagcggttccacagatccagacagaggcagatgcggccaagacccacgaagctgcagacaggacacaaggctctagagacatgtgcaggccaccaccaccaaggccaagaaacaccaacggaaaaagctgtagtcctggtgcttaatcccagcactcgataagcagaagccggcagatctccgtgagttcgaagccagtctggcctacatagttgtaagccagccagtgctacagtctcagaaaataaaggaaggaagaagacagagagagctacagacagacagacaggctcaagagcctgggagaaagcagggctcatgcagatggtgaggttagcttgcccggcctggcactgctggactgttcaggaagctagatagcttcccgaggagacagggacagaggagtccagctacacaggagttaaggttggctctccagccttgccctggcttctctctcccttccctcctcccaggctccctttacccaaggccctggcattcccccacccccacccttggtaaccagaccctgcttcctgctgagattaaggcctgcctgccagattctggggtggggggggcaacacctcccctagggccttcctaaagcttgtgctcaccctcagtaccctggcagcctctgtgattacagggttgctccagtgatagcattaagggaaccctcatccctagacatggggtgcctgtggaaaagttaggggggaaaggaccgtagtttgggactgagttgttgttcaggaccagagggtaaacggtacccatcttaagaggtattcagagtggcaaagggtgaccctcaacccggacatgagatcctgaagcccttgaccttggagtaaaccccgggtgctggctactggggattccgacctcttgcagctgtcgcggttgggggtggggtgtgctgtccaggtgctggccactgccctgccctctccctgctaagccgtcggttccggccatgggcatagccatgctctctgaggactggctggtctgggccctgagctgggagggctccagggtgggtggataacagtgggatgtgagcagacctgaaggcaggattgaggggttatcttgaggaggactctgtgtttggcatgtttatgtacatgggaggaaccggtgtgtgcaggaacctatctgggttgccagtctgcctctgggcataagtggcctgacgtacaggcgagatctgaagtgcatggtcactcacctagctgggagctcttgggggagaaggctaattctaagttttcagagtccccaggcctagttgattacaaccggcaggaaatggtgtacggggtcaggagggaagcaggcttgcccctactcactgagaggagtctcctgaacaggttcgcttctggccccaggtcctagtggaggagggggtgagcatgaggggtcttttgtggaggacccacaaagctagatggaagacagggaagatgtgggtggctggaagcaagagacaggcagacaaggcagcacagcctgggcctccattcccttccttcctcagggcaaggctctcggcctttagagtccaaatgaatctttttcactgacaaggaaagcagagctgtcaggatgcagggcaaaggtcacccagagagtgaggcttggacttggggggttcccaccaagccacctgtggaagatattgtttccctttgtcaggcttttgataccccaaagccttttagcttctgaggtctttgctttcaagggcatcccccttccttgttctctccccccccccaggggcctgagactttctcactgagtcacagctaaggctctgacttcatggtttcttgactctgaatctctcctgagcatatcctgagccagggactccttcctctgagcgcctcgttcaatcactgttctggcctctgtggttccaaggcagagacttggctcctggtgccctgggctctgggccaccagccctacccaccccccactccgtttctatccttcactgcaaccctgggatggaggacttggtcctgcacacatgttcaggagaggatcaggcccactgatgcacctgagaagggagaatctggccgtagagtgtccaccagggcactggaacgcctgcgatgtggcttcccttgcctttcatccacctattccctgtccctggaagtttctgacttggagatagcagagaggaagagggaggatcctggacgtgggatgtgaggcatcctcaaaggctattgtcaccttaagttcttaactcaagacactgtcgggccccagcatcaacattgtctaaggagcaagtcccagaaacccacatgacagcttgctgggacaggtggtggcttagaggaatgaccagggctgtgtggccttgggagagaatccctggtactctgtgtcttagacttgaaagaagtcttgcgcacttgtagaacagcacatggtgaggagaaccagtgccaagttggagggcttaggctcagccctaagcctggggtgggaggtggcagtctctccccgctgctccctgtttccctaatcttttctaagagactatcagaccttttcttttgtgtggtgctggggatggagctacagtctcctacatgccaagtgtgtcacatatgtgcgtgcatatatacctgctataccaccatgccctcatcccttggctagttttcatttacttgacttctggaaagaacgctgggctggtcatctacctcagaccctccgccctagctctgtggctaacagggtgtgtgacttctgaagtgttctgtctcccacgttccccagggccagcctatgggtagcacgtactggcaggatgagagaggggctgggagcagcagccacagggcagagaggggatcccaagggggcctcctttcctcaatcctggcttcccacctctctagccctggagactgggaaggggggttgaggtggcagcaggaggtgtcactgtcggggttcttcttctcacccaagctggcagaggggcgggactggcagtggtgacaccagggccactcagcccccgcttttcacaagcactttcttttttgggtgaaagaaattagagggagtgggggggtgagagtggtgagaatctgaggttaataaggcaggctctatcgacccatcaggttatggggaaaccattctcgggcccccctcactccaaagatgcacttccaggaccacccagctgtgatagtcattcccttctgctctgaagagcttgttgggagcatagaacattttgttccgaagcagggggatggctcacttgacctgaggatcagcgtggaagatcagggatggaaaggctgaggaacaagactccatttggcctttcacaatgggacactcagcaaaaatgctcccccaaagagttgtcggtgttcaaaaattttacctcctggggaaatcagtcatttgaatgaatcccagaaatctattttccacaatagggagccaagggtgcaaaggtcaccttctttcaagtcctggtgtctcattttgaccaacaacacacagaagcctttatgggcgagtagggggtgagggagtgaggaggaggccagacctcgatatctgctgctgtcatggatccaggcctcattctcaagagctgtgctgattgtctgcccccacctttccctgggtcatgtctgcctcctggggtccctaacttcaccttcccctggcagcctgtctcttggttcagctctagttggaaggagagtgtccccctgggtccctacgggtgaagtcctattgggctgggacagagatgtagagatgaagtcacaccccaggggagaagtggggtggggcagagatgagggaaagaaatctctttttaacgaaataaaactgcatggaagtattttttgaagcattctttaagatgtaaatctttatatatttgacatgcaaaaaaaaaatccattacaccgtgctgagtgaagaaaaaaaccaagaacccacgtggtaaagcggactgcgaagttgatgtaaaattagacatctgtgtgtgtgtacaaaagacagagacacaggagggtctatacaagggaggtatccagaagggttttcttaaaatgttaatacgggagctagtatgggagggtggtggtttgtctgacttctgtttttcttcactgcctagattttctgtacagaggatgattttagtcctgaggccagcaagatggctcagcagttaaaggcacttgttgtccaagcctgatgacctgagttccagactcagaacccacataaggatggaaagaaaggactgaccccacacagctggactctgaactctaaacatgcaccatggcacagatgtccacacacaataacaagtaacttgcttcctggcggtgacgccctccctctgagattatgcctcactcgcaagggtctccttcatcactctccagaagaggagaagaggaaacacaagaaaaagcgcctggtgcagagccccaattcctactttatggatgtgatatgcccaggatgatataaaatcaccagtctttttttaaaattaatttatttattatatgtaagtacactgtagctgtcttcagacactccagaagagggtgccagatctcattaccgatggttgtgagctaccatgtggttgctgggatttgaactcaggaccttcggaagagcagtcaatgctcttaaccgctgagccatctctccagcccaagtaactcttaaacgatactttacttcttatttacttacttttgagataagatcccctgtaacccaggctggcccaaattgtagctgaagatgaccttaaacttctgatcctctaccaaccctctcaagtgctgggatgacaggcatgtgccaccatgccccatctatacaaagctgggggtggaaccagaagcgtgggtgtatgctaagcaggcactccatcagttgaactatatcccagaccccggggatgctttttatttcaaaagaaaactcccaatggattcattttcagttaggaggtgagattcttctcaaaatgcaggacttaccgtagttattggaatagaacagcggaggaaggactgtctgtctccatcagagcaggtgctgggctccctgtcagccagcttggactacatacctttgtttttttctataatagaatggaaacagaggcacacagacaccggttggtataaggtacacagcccctacccccaatacgaatatttatttccccagcctaccccatcaggcctgagggactttcaggcaaaggaagtgacttacccaggtcctacacacccgagtcacagtcagagtcagccctgggactctgaacactgacagccaagcgctacttcccgtgtctttcgctagctgttacgctgccacgtgaacgagcttttgtgggagcatttcagccagcccagcccaccgtgggctgctttgggtgcaatcttcttgggagacagcttccaagtttcctcctgggctagagggacaagcatcatcctcgggcctggggggtggggtgggaggctagcgatggggggtgggggcggcggacaagagacagcgagcaaacactttgtgtaaagtcacaaagcctgggcatacaggaggcagcaacaaatatctgttgactatggatagtctaagtagctctgagcctgccagaggcgtgagaatgctcagatggtcccatctggggaaagggcctttgctgtgccttccaggactggcggaacttcctgggggagagaaaccgtttctctcctcgaagtttcagagtttcaggtggcaggttgactctttcccagattggggcgacaagagacttacacttaggagtgggggtcggggcttcagtcctcaccaaaagcgaattcgcgctgtattagccacgagggggcggggcggggcggggccaaggtggcggggtgaggggacccaaggagcttcataaagccacagcaaaggccgccgcgccgctagtgacagcgcgggctgcagagaaagcccaggagcagctgcgcgcctatccaacgcgcgctcaggagccaagcgtcccagctcccgctccagtgaagtttcattggtcttcggacgccgcccccgtcgccccagccctaaggaccctcgggtctcttcgacggctgctggaaggcgcccagcccgcctcggatgggcatcgtggagccgggctgcggagacatgctgaccggcaccgagccgatgccgagtgacgagggccgggggcccggagcggaccaacagcatcgtttcttctatcccgagccgggcgcacaggacccgaccgatcgccgcgcaggtagcagcctggggacgccctactctgggggcgccctggtgcctgccgcgccgggtcgcttccttggatccttcgcctacccgccccgggctcaggtggctggctttcccgggcctggcgagttcttcccgccgcccgcgggtgcggagggctacccgcccgtggatggctaccctgcccctgacccgcgcgcggggctctacccagggccgcgcgaggactacgcattgcccgcggggttggaggtgtctgggaagctgagagtcgcgctcagcaaccacctgttgtggtccaagttcaaccagcaccagacagagatgatcatcactaagcaaggacggtgagtgaggtgcgcgccgagcgcagcgagctcgcagggcggagccggcgggagtctggcctcggtggcccgccggaacaacgactttcctctttttttttttttttttttttgaaatcaaaatttgaagctgcaggttgctgagtctttgtgttcgtagactgagcttcagttttaggagacgggggagcagggttgcggggagggcaccgcaagctccggagagccgcgggtgctgagggtatcagagggctcaaaaaggatgatgctgtgggcgcaattagaagttactttggtgcagaggaaaggatgactctcgcttcaccgagagttggccggtggggggtggggggtgggggactggagggggttaatttgctccttgcctcagtctgggatctcagtgggcagcgaggagtgtgtgttatagacctgactgaccgcctttcggtccttaggtattcgggaaattgaagtgttgggggcagaatattttttgagatctcagtgtgcctgttcctttgctactgctgtgcttagggtagctttggtgtatgggggagggggggagcagactgggatttggtgacatggagaagcggtcgccaagtttcttttccggtcttactttgagatcatatgtctagagagggagagagagagagagagagagagaggagtgtgtgtgtgtgtgtgtgtgtgtgtgtgtgtgtgtgtgttgtgtagagaggtgggaagcagcaaaacttataaaggcacaaataaatgccgagggcctgaacgtgccaagttcaagaccagttgcagctggtgtccagtcttgcactgtgctctttgaggctagtccctaaaaatatgtccactttctcacccagctattcatcagtccagcctgggggaagatggagggggtcccctaagcctgttgcattagtggtatggtttgtggctcagcctgctgcttccggatcgagtctctttgctgaagaaagagaaacttgcagtttctgaggggtcatttatagtatgcaacacctcgagtggaccctcttgtgtcttatgggaagaggcagctacctttcccagtgaggaccagccagaactttgccattagtgagttaggatgtgcggtattaggatggagactcaaaatgtaattgagagattgcaagggtggggtttctgggagggggacagaaacccttgccggatcccaggaggcactgctagagtatattcccttcggatgatgtggggagagggcagatagctgctaactacagctggtttcaggctgctgagttcttcctcgcggggatgaactgagaataaaacatttgattggtttttggctcatccttcatccgcaaagacttctgaggagtttcctctgctcccccaatccttctctgagtgtctctggcactggccaggttgctggtcctagagaatgtctgaactggaaggatccagaagtccctgtctctcactgcatagagaaacagacctagagacagcaggggactcttcggaggttccccagctgggaccaggcctcagatggcacctgtctgctccttttttctccattctccacagccacctacactgtctgaaagccctgcgtggtacacccaagtgctttcgcttccattatttctaggcgagccaggcagggctggcccgtttcatacccacgaattctgagttgctgggataaccagtggcttacgctagtcccgcagtagactaggtggggcctctaaccatgggactttctagtatgtcagcaacaggaggccctctcatcccggggcctggccagtcctctcaatgccttgtcaggcctcagctcctccagtcagagagagcatcagccacaacctcagtgatggctgagctgggctggggcctgtctgtctgtgggctgggttgctaggggaggcatttggagggacacactctatatcactggggcctgtctgtctgtgggctgggttgctaggggaggcatttggagggacacactctatatcactggggcctgtctgtctgtgggctgggttgctaggggaggtatttggagggacacactctttatcattggcctggctctatggactcctctcctgtgtgcgcctataggatttttttcccatgaccacttttgctctctcccgtttggatcggtgctcttattattttaagtgctgtaattggaacctggggcctagtgtatactagtcatgtttttttgtttgtttgtttgttttaaagccagctgtggtagtgcaccccttaagtaatgcacacgcataattggaaactagcctgtgctacatagtaactttcccctccctctttctttctctttgctatgtagcaaaggcctcctttgaacttcagctcttcctacctctgcctccccagtgctgggattacaaggatgtgccaccacgcatgtttgacactctgtctcaaggaatcaaaactagtttacttttcaatgctaagaattgaacccagggccttatgtgtgctctgcacacacagtcacactgctactgagccacatctttaacttcttttttttttttttaagatttatttatttattatatgtaagtacactgtagctgtcttcagacactccagaagagggtgtcagatcttgttatagatggttgtgagccaccatgtggttgatgggatttgaactccggaccttcggaagagcagtcgggtgctcttacccactgagccgtctcaccagcccaatttcttattatgacaaatcacactgtataaaaataaaaggccaggcgtggtggcacattcaatcccagcactcaagaggtagaggcaggcagaactctgtgagttcgaggccagcttagtctacaaagtgagttccaggacagccagggctacacagagaaaccctgtcttgaaaacatcaaacaaacacacaagaccaaaaacccaaaaaacaaaaataaacataaaagtagaaaatatatcatcaggcttggctttaaaactattcagtattggtctggtcttttttgttgtgagttattttgcttgtttggtttttgttttctttttgactcggggtctcactctacaggctcagcgggcctggaactcactatagagatggggctaaccttgaacttatagagattcctctgttcttgcctcctgagtgctgccattaaaggcatttgccaccttgtgggtattttgagataggatcttgccttgcaatcaagattggtcagcaattgttgatctttctgctttgaatctttatgtttctctgaaaatgaatttcggttgagacaagatcttaattcatgtattccagattagcctggaattctcaacccacctgcttcaccctcgggaatgctgggatcacaagtgtgcactgtaaccatgcttgacttaaaagtggaattaaaaaaaagggggggctggcaaaacggctcattgggtaaaggcacttgctgccacacctgacaacctgggtttgattgccctgtgggtttgattgccagggcccaaatggttgaaggagagaattgactcccatagattgttctctgaactccaaacatacactatgacatgtgggtattgtccaccacttgcaccatccaagaaaagaaaagtaaaaataagaaaaacaacaacaaaacaaaacaaataaaaaacaaaacaaaacaaaaaaatcaaccagggttgaagagatggctcagtcagtgaagtgcttgttttgccaacgtgaggacctggcatgaggcagagactggccggtggatctgtgtaaattcaaagccaggtctacagagtgaattccaggacagccagagctataaagagaaactccatctcaaaaaacaaacaaacaaacaaaacaaaaacaaaaaataaaaaaatagccaattacctaggtatggtggtgttcgtaatacctggccagccagcctagagtaatcagagacctttaggccaatgaaagacccttgtgtttagatagatagatagatagatagatagatagatagatagatagatagatagagtagacagacagacagacagtgcctgagaaattatatctgagttgtcttctggcttctacattgacatgggcacacatacatacgtgcaagtgcacacacacacacacatgaataaataatttaaaaaatccaattagcacacctaaaaaagaaattcctaaatgccttctgagtgtttcataagagtgtgctagcatcatgtgtgtgtgtgtggggggggcaatcctcatattttggatcctaaggccacactgcatgacatggggtccctgttggatggggcagtgactccccatcatttcctttgatgcctctcttcagatcagatcccaggggtcccatcctggaaagcagacagggaataccacatcagttcagccttaccaagccctgtggcctctgtatcttccaagtttgagctccagctatctgggaggtcctggctgtttccttttgctgagagttttgggctcagagcagagtcctttcagtcctcctgctttggcaggctggcctgtccctctgtaggtttcagtgacctgtaagtcactaccacatcacccacggctttctttctttttgaaaaattcttccatcccagacctagccacagcccctcagccgttggtcctgggctgactcagtctgtccctggtccctcctctcccacccaccctgggctcacccactagtatggatctgtggtagcgatgcttttggttctgagtgaagaacagggggatgacggctgatgagggcggttctagtggggctcagagagggaaatggagcacaagaagagtttgaggtgagccagagaaatggctcagaagtgagggtgcttcctgtaatcctgacaaactgagttcagatccccccacatactcgtgcggagtaggttaccccaacacgcaggcatacacctccctacagaataaaaataataaaatgtaatacttgtctttttctttggttccccctaccagggattttgagacaggctgccctggaactctctctgtagaccagggtggccttgaactcagacatctgcctgtctctgcctcccaagtgatgggattaaaggcatgtgccaccacctttctattagatataataccttaaaaacaaacaaacaaacaaacaaacaaacaaacaaacaggaagaagagtctggagtctccttggtgcacttttggagcaacccgggagcactgcgtgcaggctgagccagtcagtgtgtagtgaatggtaaatacaaataatagccgtaggacgaaaggctttctcagtaggcaagagaggccggtccccgtgggcgtgtgggtgggtactaattgctggtaatccccacttttctggctgtgattggttgattattataattaagataactttggggagagctggtgttaagtagctcggtttgcagatgcgcttggttatgtgacgtccgggtggcgaaggcgcttcctacttcatgtgaggtagtgccacagcgccttagtgtcttttccccatcgtctcaactctcgaaatttttaattacttttttttttttacttattattttacttctaaaattacttttactttttaaatatgtttttatgagtatatgtgtgtgggagggatcatgtatatgctatgagtatggaggagcctatagagattggaggtcagagctcctggaactggaattatataggtggtatggagcctatagagaagtctagtacagcaggcgtggtggcgcacgcctttaatccccagcactcgggaggcaaaggcaggcagatttctgagtttgaggccagcctggtctacaaagtgagttccaggacagccagggctatacagagaaatcctgtctcgaaaaaccaaaaaaaaaaaaaaaaaaaaagatgtcaattatgggtcctctgtaagggcagaatgtatttttagccactgagccatctctccagtctttcatttctttttctcttttggtaagacagaggctcactccaggctagccttgagctccctgtatccaggttacccttgaatgtgcagcacaccttttgcctcaggttcctaagtgctgagattttaagtgtaagacactgtatcccactaagctttcagactttttttttttaatttagatttattttatttgtaaatctaatgtttggaattataaaatcgaatgtttaataattactcatctaatgaatgaatgctttgctcatgtgtatgtatgtctgtacacaacatgcatgtctggtgtgctcagaagtcagaagatgatgttgaaggcagagttataggtagttgtgagccaccatgtgtgtgggctctgggtattgaacccaaatcctctgcaagaacaagtgcttcttttttttttttttgttttgttatgagacagggtttctctatgtagccctggctgtcctgaaactcactctgtagaccaggctggccccgaactcagagatccacctgcctctgcctcctgagtgctgggattaaaggcgtgcaccaccacacccggctataagtgcttctttaaaaacaaaaaaaaatatttatttttattttatgtacatcggtgttttgcctacatgtatgtctgtgttgagtgctggatcccttgaaacaggagttacagacaggggtaagctgccatgtgggtgcttggaattgaaactaggtcctcttagaagagcagccagtgctcttaagtggtacaccatctctccagcccccaaaacaagtgcatttaattgctgagccacctctccacccatggattttttgttgttggtggtgctatattaaacccagggtctcatggatgctaggcaatcaatggttttttttttaatttttttttttattttttaagtactttgatgttttgcctgcatgtatctctgtatcagggtgtcagatcccctggaacgggagatacagatacttgtgagccgccatgtgggtgctaggaatagaacttggatcttctggaagagcagccagtgctcttaaccctgagctgcctcgccaaaccctaaacatgcactcctatactgagttgcgaccccaatttaacttctcacatctttacaaaacacttgtttcaagagtcctctttctcctcctccagagtctgggcccatggactaagaatctcaaaatctcttggaaacggctactcagaaaagcctagctgttctttacctgctctgaggaggactcagctggtcaatcccatggaaagttgattgatgtctgaaactagtcattgctttgttgttggagacagtgtctcactgtgtagccttgtctggcctagaactcactatgttccctgccatgtcccacagccgtgtaaaaatcatcgctaggcgggttagccttggggcagcagagagtcatgggatcttgactctgtaagtagttttaaggaggtcaacttggtagcagattcatctccactactggtttcttcttagtaaagcaacatgtagatcagggagctatttggggattctagctgctggttatttcagtagtgtgtgtgcatatgtgtgtgtgtgtgtgtgtgtgtgtatgtacatgtacaagtgtgaacatttgtgtaaaggccattagttaaccttgaaagtcattcctctggaatcctctctgtctgtctgtctgtctgtctgtctgtctgtctgtctctctgtgtctctctttctctgtctctctctccagaatctctatatgtaggctggcttcaaactcacagtgatctgcctctgcctctcaaattctgggattaaaggcatgcgccagcatgcttggttcatttattaattaatttgtttgtttgtttatttttgagacagggtctcattagcctagagtctaccaagaaggctaggctggttgacaagaatctaaatgtctctgcttccccagttttggaattctaagtagatgtcaccacaccagatgtcaccacaccaggctgcctcttcctcttctcctcctcctcctcttcagtgtgggcactgggtactcatgtcttcgtgattgtgcagcatctcgccatcttttaaagtgaaactaagaccccccctcctttgcctttcacttacaatcttcctgtatcttttgtcacccactatcgggacaacagtaggacagatggacagaaaccgtagtgtggggtattcatcaatctctctataagcttcagtgtcttcaggtgtagagtttcaagacgttttgtttctccaaggactgtcttgatgagttggcttgtgcgtaagtggaggatggataaacatagtatgaggctgggtatggggcttagtggcagggccctagcctaacatccgcgaggccctgggttctatatttggcaccaaaaaggtgtttgctattctgttcctttagaatagaaaatatgaatgagacctggtcactaggtaagaaaatatatatgttttatgtttttttatgtgtatgaatgttacgtcttcatgcatgtgttacaggtagttgtggcccatcatgtgggtgtggagaatcaagcccaggtcgtctgggaaagcagagccatctctccagccaccttaccctcttaagacagagtctccctgtcccgtagctctagctaccctagaactgcatacgtagaccaggctggcctcagactcatggagatccatttgcctttccctcctgagtgctgggattaaagacaagtgccaagccaggcatggtgggtggacctctgtgggtcagaggccagcctggctcacatagcaaattctaggatagccagaattacatatgaaaccctgcttcaaaataataaaatacgctaggcagtggtggcgcacacttttaatcccagcacttgggaggagaggcaagcagatttctgagttcgagaccagtctgatctacagagtgagttccaggacagccagggctactcagagaaaccctgtctcgaaaaaccaaataaataaataaataaataaataaataaataaataaataataaataagcaagcaagctaggcagtggtgacacacacctttaatcccagcatttgggaggtagacccaggtggatctctaagtttgagaccagtctggtctacataacaagttccaggacagccagggttacacagagaaaccttgtcttgaaaaagaaacagggcaggagaggtgtctaatggctaagagtactgactggctgctttcccaggggtcctcatttcaactctcagcaaccacatggtggttcatgaccatctatagagagatctgatgcccttttctggcctgcaggtgaacatgcagcagagcactcatatataaaataaaataaaataaaataaagtctaaaatgttttttaaaagcaacaaatattaataaagacatgcaccaccatgcccaactccctattttttaaacttatttttatctacatgtatgtgtgcttttgtgagtttatgtgcaccgtatgtgtgcaggttcttgtgtaggccagggcctgttgaatctcctgtagagttacagacaacttgtgagctgcctggtgtggttctgggaaccaaaccctgatctacagaagagcattaagcgcttcaatttcagaaactacaatctgaatggcttaaagtgaatgggtgagggaaatggattgaaaatattctccccacctcgggttttccatacttagctcttggtctagggatgtagcaaagctggtaggattcttgtctaaaattcactatgtcttaggtggatccctaacactacacaaactgggtatagtggtgtgcaccctaatccttgcactttggaagttgaggcaggaaaattcagtcatccttagctacattgtgagtttgaggctcctctagtctataggtttcttgattaagagacaaaagctttcctatcccatgtggctccctgagaggtgggatgtgggacctaaagggatgtccagtgagtgtttgaatctgttgttctgaccacaccgctctccccgccccctccccactcccagctggggcacaaaggcagagctcagtcattggaactggtgatgcagagactgggcatggtggctgtggcagtgaaggctgtggctagagtggacagaagagatggtgatggtagcgcttggagacaagacggctgtgatggtgataatgaaagtcaagactagcgtaatggcaactgtgagtcagtggctgtaactatgatggagatggtgggtgtggtgacgggagtgacgatggccatggtcatggcggaggcgtagccagagtgagggtgggagtggtggctttgacggaggtggtggtttgagagatagaagacatggtgaaatcgatggatatattaataagattgtagagatggtagctgcagatgtggtggaggtggtgtctgtagagatggaggtagcggtgtctgtattatggtggacatggtggctgtattggtggtggtggtggggtggaggtggtactggagacaacatagctgtaatcatggtaatggcaacggcaatgattgtggaagtgatagtaacaaccctggaagttgtactggtggagacggtgtcaccgtgatggtggagatagcggtgagaatgatagtggttgtgatatggaggtggtggttgtcgtgatcgtgataatggggggcagccatggtggcggtggtggggaggcctttgcaggagagcgctcccttttctgatgctttcactttagaacaagggagggtcacgcagggtcccacccacccaccaacctgggacccaagactaagcataagaacgattagagccttcaggatgcctagggtgtttgatgagtttctgaaggccagacttggggcagggcacactatagatgtgactggagtgtgggacagggaggacctgtcagtgacttccatggggcaggagtgtgttgcagagcgggagagtcatggtggagctgtggaactcaggcacacccaccttctgggactatctttaaagggttgcctggtgcctttggcccatgcaggaagctcactaatgttagagacagtggtttccagataattatctagtaactgatcttttgagaggaaagcgttatcaaaagtctgcaggctgggatgtggctcagtggtagagtgcttgcccatcatgcattaagccttgggtttaatcagcagcagtacagaggggtaggcactgatttactgtgtctgctggtgccctgcagctgactctaagctaccaacatgacagggttgaacacagaattgggggcaatgcacagtagccattgtctctgttcttcagctgcctcagacaaagacacaagtaagctcaagccggggccacagtacaacacgtcagagcactgagaagagactcttgggttgtgtgtaccttggcttttggtagaacgtgattattgttaagtgtgaacaatttaattttgtttttgtttttgttttgtttttcaggacagggtatctctgtgtagtcctggctatcctgagacttggttttatagaccaggctggcctcaaacttcagcgatcctcctgcctactgctcttaggtgctaagattaaagatgtgttctaccacactggctagtgcaatttaactttaaaaaaaagatgtattgctgggcgtggtggcgcacgcctttgatcccagcatttgggaggcagaggcaggtggatttctgagttcgaggccagcctggtctacaaagtgagctccaggacagccagggctacacagagaaactctgtctcaaaaaaaaaaaagatatattattaattttgtgtgtgtgtgtgtgtgtgtgtgtgtgtgtgtatggacatgtgggtgtcagtggaatccagaggcattggatcaccttggagctggagttaaagactgttgtaagctgacgtgggtgctgagaactgaactcagtccccctggaagaacactatatgctcttaaccattgagccatttcttcagtcctatgaattaattttctgttacacacacacagacacacacacgtatatttaaatttatttatttatttatttcatatatgattacactgcagctgtcttcagacacaccataagaggactacagatcccattacagatggttgtgagccaccatgtggttgctgggaattgaactcatgctctccggaagagcagtcagtgctcttaaccgctgagccatctctccagcctacatctatatttaataactaacaagctagctaccttctgacacacttgtcagttggctcttgaggacaagtgaaggccggctacagcttgacacatgcacacaggtgactgccactgagccctggctgatggtccctggaacttctctgttccccacaggcgaatgttcccattcctgtccttcaccgtggccgggctggagcccacaagccattacaggatgtttgtggatgtggtcttggtggaccagcaccactggcggtaccagagcggcaagtgggtgcagtgtggaaaggcagaaggcagcatgccaggtacaagcttcgggagtggtgggcatgcgtttcctcctagacagggcgccccctggtggattactcaagcccttaccccgatgtgaaggattgaaccctacagcctatccacccacctcacccttcctttggcttcttacctcttctctaatttgatttaactgaggtggggagtgggggagggagaaagagactcactctgctcagtcctctgcccttatctgcccctgctcagcctgtctgtcctctcccttgcatctttctcacggtccactcagaagaggcaaaatcccacatctccagtgtctggtcgatacttgacaataaggttaactgtccacagggaaccgcttatatgtccacccagactcccccaacaccggagcccactggatgcgccaggaagtttcatttgggaagctaaagctcaccaacaacaagggggcttccaacaatgtgacccaggtaggattgtcagacccacctgcctatatgtctgagatctaccccctgacatttcctaagacccactttgtactgttggagtctcgtctcctctcctctcctcttctcctctcttccctacatagccaaggataaccatgaacttctgttccatctgctcctgagggtgagatcacaggcatgcaccaccaggcctgattgatgtggttcaatcagatattgcaccagactagacaaaggtgctagcaattgagctgctctatgccccggctccttttcttcctctctatgagtctttcctacccatctttgggagacaatgagatgggtggacactggatctctggcagtggttgctcctgggtcaacacaagtcagaacaacatgagggcttcttcactagatcatgatctgtcaccgagatggtcctagagcttcagggaatggatgttcagtgtgaaagtgactttacattgaacaattatgggtcttgttttggtttgttttacacatttacttcatccatccatccatccatccatccatccatccatccatccatccattcatccatctatccatccatccatctatccatccatccatccatccatctatctatctatctatctatctatctatctatctatctatctatctatctatctatcatctatctacttatgtagttatttacttagtaagttactcagttagttagttgtgggggagtaagttgctatgatgtgtttgtggaggtcagaggacaacttgctgaagttgattccctttttctaccacgtggatcccagggatcaaactcaggtcgccaggcttggcagcaaatgcctttatctgatgagccatctccacagacccagtcctgttttgtttttttgttttttgtttttttaaattaaacaacaaaacaaaacctggagctggagagaagattcagttggtaaagtgtttcccttgaaagacaaagacctgagtttcatccctagaacctaggttaaaagagaaaagaaaagccagttgtaatggcatgaaccagttatttaaacactgggagcgggtggcggggacacaggtggatccctagggctcactggccagccagcctacttggtgagttccagtagggatgcttaggggaagttgcatggtggtaaggtggtcgaagccacaagatgaactcaggcatcctttctagtctgtctcactgtggggctagtagttacgtaggagagtgcatctagagatgaggccagcttgaggtcaggaggaccttccttccagctccttccgtgaccctgtcaccccctggcccctctccagatgatcgtcctgcagtctctccacaagtaccagccccggctgcacatcgtggaggtgaatgatggagagccagaggctgcctgcagtgcttctaacacacacgtctttactttccaagagacccagttcattgcagtgactgcctaccagaacgcagaggtgagcccggggacgggcatctgccagagggagggtgggacagacttcttgaggaggaagaggggactcagagaactctatttccccgtctctagatcactcagctgaaaatcgacaacaacccctttgccaaaggattccgggagaactttgagtcgtaagtgttctgagttcaaatcccctttggtctttctgagatgggactgtggttcagtgctcaacatgccctgtctctgcttcaggggtctggggaccatcatattagaagcctaatatagccttgatctctctttctctctctctgtctctctctgtctctctctgtctctgtctctctgtatttattttatttatacgagtacacagtagctgtcttcagacacaccagaagagggcattggatctcattacagacggctgtgagccaccatgtggttgttgggaattgaactcaggacctctggaagagcaagcagccagtgctcttaactgctgagccatctctctagccccctcattcattgtttttatttttatttattttttagcatgtacgcatctgttgatacgagtgtcccctcgccacctggacccaactgtcaactgcttgggggagaccccttctcacctcttctatccaaccagtatcctgttcccagccgtttctaccccgaccttccaggccagcccaaggatatgatctcacagccttactggctggggacacctcgggaacacagttatgaagcggagttccgagctgtgagcatgaagcccacactcctaccctctgccccggggcccactgtgccctactaccggggccaagacgtcctggcgcctggagctggttggcccgtggcccctcaatacccgcccaagatgagcccagctggctggttccggcccatgcgaactctgcccatggacccgggcctgggatcctcagaggaacagggctcctccccctcgctgtggcctgaggtcacctccctccagccggagcccagcgactcaggactaggcgaaggagacactaagaggaggaggatatccccctatccttccagtggcgacagctcctctcccgctggggccccttctccttttgataaggaaaccgaaggccagttttataattattttcccaactgagaaaatgccgctgaattggaaggtgcccactaacttagaaaacagacgcggggctgagagccccgagctcttccccatcccttccctgtatagtgattggttggagaggaagcggggcaagaaggattctggggtttacttcttgtttcctggcccacaaggaaatacgacaggagtgtcccctgcccctttctctgcccgaactacagtcacgaacctggtgctgcttctgaccccatggttccatggagaacggagaatggactccagagagttttggacccagagggacttcatggctttctgcgaggtggaggggtcggggtggggagtccaggagagctgctctcttcccctgtccagtcagtaactttcaactgttggtctgacacctgtgttaatctctgacctgaaagtgaagatacacgcatttttacaacagccagccaaacagagaagactcaggtgactgcgggcggactgggccacctgcgaggagacaagagagggtgggtgcagaggaagggtttgaagggtgcacatttcaccaggcgaggtcactttgaaccggtgtgtacacacacgggtgtctcttttttatttcttcgggaggggggaggctatttattgtagagagtggtgtctggatgtatttcttctgttttgcatcactttctggaaataaacatggacctggtaaacacgccctccttctgtggctggtcggtaggaggtgtgtgtgtgtggatcaaagtttgctgatctagcaaagttgtcctgtgggctcttgattttggggggtaactgccaggaacctaaagtgaccccacttagggataaactcagagtatgtcttgtcctcagcactccagctgatggttcatgccaccacatgtgaccaaaggaccagcccctcagcctatgttgcctgctcagaaccctggagggaggcagtgtgggagcaaggttaggaccaggctgggtcgggtggagtttaggaaagccaggactcttgatttatctttgcatcactctccattttttaggagtttgttcaagtgttaaaggcataagtagaaattataccatgtgatgttgccactcttttgtaggtcacgatcaggcatacactagcaattccacatgagtcaccttagtacacactcgggcaggattagcgcttgatgaagtcctcagtgtgggagctgtcattgtgaactggtgtgcactctcctctctcttttccccccacccctcttatttagttttcattcataaccataaacttaactctgaaatccagctagacttggaggggaagaagggaaatatgggaccccaggcacttcagtgagagcagagattacagggtgttgcgagcagatgacgtgggggtgctttcctgagctacagaagaaatggtctggtgggtaagatgctcgaaagtcaaaagaattagagttgtccatggttggaagtggggatcttattttcctcctggttttgccattcctggacccccaaacattccatggcttccacgatgttcatgccttctctccccttcccctcagtcttggcaatgcaggtaaaaaaccagtgggaagcattaatgtttggtccagcatttgcatggacaagatgccaatgaccggggtgcttcaggatgaagttctcatgctcaaacttctccctgtagatggacctgccgccagtgccacggtggtgtgtgacatcaccaccttggcacatgaatcctagaattactctgtgagagtaggaacccttacacccaaatcctatctctccagacagagctcagagcacggaagttctctgctgcctttggaactgtgtctacaaacagcttcaagattatgttgtaacccaggctggcttccaattcacggtgatcctcccatctcatcctcccaagagctaggattacagacacaaaccaccatgcccagctttctagctctctgtttctgagagagagagagagagagagagagagagagagagagagagaatttgagtcaggggtaaatggctagttgcacagactgaccacccaagcttgatgccttgaattcatgcaacagctgaatctggtagcacacatctgccatcccagagctcctaagagatgggaggcagagacaggagggtgtgcttggcagcttaccagatgactggcacagtaggacagtaggaaaacagtggggaagagaacagttttaacttggcaagaagagaaccaacctcaaaagattgctctgatttccaggttggccttacaacatagaccaggctggcctcaaacttacagagatccacctgcctctgcttcctgagagctgggatcaaagatgtgccccaccacacccagctgtgtatgtgtatatttgtgtgggtgccatggaaaccagaagtgggtatcagattccctgaagctggagtcagatgtggttttgagcctccagatcagtgatagtttggtgggaaccaaactcaggccctctgtgacatcatcagatgctctcaactgatgagccactgctccacaccctaaaattaaaaaaacaaaacaattcaagccagttgaggtggcaagtgcctgcaaactcagcactcgggtgactgagacaggaaggcagacagttggagaccaacccaggctgcacagtgagaccctatagtgaggaaaagaataaggacaactgcaaatgatatcaaattttgctacacttgaataactgacattaccattcaacgggttagacaaacagaaatggtttataaaattgtgaccctacagaaatcacgtttttgtcttaatgaaaatgattnnnnnnnnnnnnnnnnnnnnaaaaaaaatagtctttgaaaggaacgctgtaaggttaagaaaggttttttgagctagagttatagatagttgtgagccactatgtggatgctgggaattgaacctgggccctctgcaggagcaaccagtgctcttaaccactaagccatctttccagtgcattaaattcttttgtattcatttacttgctcatttttatacggattagtgttttgcctgcatctatggctgtacacttgggtagagtgcctgatgcccacagaggtcagaagagggtgtcagatgccctgagactggaatttcagagggttgtgagccaccatgtgggtgttgggaattgaacctaggactctccagaagagcaaccagtgctttacccactgacctatctagctccacaccacaaactcctaaggcatttctccactatgttttagtcgataccatctctcttaggaattatgatgctattttgattcatgatcatccactttaaatgtaggtgtttctttcatcttctgtgttctgaatattgaatggcacatgttggtttgaagtcttgtggcaggctgggagtgggtatgtgcatgtgggtggatgttactgaggctcaaacccagggcctcgggtgtgctaggcaggcaccccaccagagagctacatttccagtctcatcgatgttaaaccaggggttctcaacctgtgggtctcgaccccccccttccaaagcactgatgattacgttgcgattcaaagttatagtcatgaagcaacaagatgattttgtgtgtgtgtgagggcagttctcaccacagcatgaggaattctactaaagagttgcagcattaggaaggtggagaatcagggctctggattctctttcacattgaagtcttaaatactgggtgatccttatcaactcacatttagtagcaaggctctggtagtccctttaagagcacttgggtgtataggagaagtggctatctctcacgggcttcccatagggtgatccgggagggtgaccctgcagagaagctggcagtggggtgctggatctgacctcgattagcttatgaagcctgaatgtattgaatgcggtggcacctttaatcccagaggcagttggctctctgtgagttcaagaccagcctggtctacataagtgagtttcaggacagctagggctatatattagagaaaccctgtcttaaagaacaacaacaacaaaagaccctcaggccacactcgcatgcaatctgttccttaagacaaagaactaacaggtgccagccatacctgttaagagtccttaactctgagggaaaagccagcccagcttcaccctccctccctttctctctttctctctctctctctctctttctctctctctctcctctctctctctctctctctctttctctctctctctcctctctctctctctctctctctctctctctctctctctctctctctgggacagagttgatgagaaatactggactgtggtcttacagttccaccttatagtcctgtctagtgccttttctgtgccccttgacaggtaggcaaggttagaccatgtaatatgaagcttgcccactgaaaacctgtaagtgtcagaaactgctctcttcatctgcatttgaaggaatacctctcctctttccacctttaaggatccattatggctgtgatagtgtaactgatagtctgtgagctcaagggtctgagtgagccttcatgtcccttcatgccccatcatactagacatggtgagtatctctcctaatgaggccactgtcacttctcagggccccatgtcatgaagctgttgtgaagggtgacctcatctcggctcctttctatgaatctgtccattctctcttaagttgaaacagaacaagtatagctttccctcacggcatccggtggcatcaggttggtagcttgacatcgcccatagtgggaatatttacactatgggaatagatccgtgctgcagtaaggcacagcccctcccaaagagcttgtttcctaacgcaaacttgagagttggcatcccctgcaatatgagtgcacggagagacccctcctgagaggatccattctccacaggaaagcccccagcagctgacagcgccctgtgagtggggcaggagaatggaaaaaatggaaggtcacttttttcacccccaatttctatgtgtttatggtgtgtgtgtgcatgcatgcacacgtgtgtatgtgagtgtgtgcacgtgcatgtgctatggcatgtgcactgaggtcaggggacatccttgggtatcagccctcccctcccaccttgtttgagactctattatttttctaccgtgtgtataaattgctggcttgtgagcttttagggattctcctgtcttcatctatcatctcctgggagcacagggattacaggtgtgtgaactgcgtgccaagcttctccatgagtgccggggacataaacaaaggtgtatcaccttgtatgacaagggctcttactcactgagccatctctcttgaccctctgtgacaagtgtgactttgattttcttttttccattttgccaaaccgctcttactacctttaggctcccaagtcctgcctttctcctcctctccagagaaggactctctgcttctaggtggggatgctggtgagacggctctgggcgctcagcgtgagaagcagacatgagcatcttgtcatgtctgaattcagacttctgatcatctactagttctctgcaaggggctcaaccccctccttccaccgcagctgactgccccttgggggatgaatcagctccctcgttgctaggccttttagaagacatgctaattctctgctccattttgtgcaatggtgttattcccaagtcattctcagccacatagaaagctagaggccagcacaggctccataagaccatgtctcaaaataatctgtgagatcatagtccttatttttaaaaattctgtccccaacctctccctcagtaggtcaggtttatatgatgggaaggggtctcctcttgtgcctcaccttataccttatcagagcttggtgaaaggggcttgttacatggaggagatgggattgagagtagctagcagattcgggtggccttcaaatggaggctgcgtgaactgtgttgtaatggagctgtcagggagatgggcatgtgggaggggtggggtccttagtgctgtgttgctatgaggatacaagccatgaccaaaagcacgtggggtggggggagaagtttttatatttagtttacacattctgatcttggtctattattgaggaaatataaggcaggagctgaagcggggaccatggaacaatgctgctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctctctctctctctctctctctctctctctctctctctctctctctctctctctttctagcacagaattgtcttcccagaagtggcaccactcagagtggactatgctctctcacaacaatcagacttgcctacaggtcaatcaagtggaggcagtccctcagttgagatgccgacttcccaaatgactggagtttatgtcaagtagacaaaaataaaataaaattaaattaaattaaagcaaattaaattaaagtaaaataaaaataaaataaaatataaacactctactaggcatctatactctcatttctctggaatctgaggcaagagagtagccatgaactcaaagcaagcccaaggtattgagatgagcgtgaacctatctcagtgcacagacacaggaacacagtgttagtgttggtggccggagcaagagcacaggaagaaattccctggtcccagctcctctgaggtcgtcctgatgctccctgcgtcctgcagccactgcaggtgctggcggcagcgtccctttggtttggagtgggcgtctgaaagtcttcagcacatgtcactgaggatatcctcgcccagtcatggtaagcagtctctgtgagcaagagggcaaagacgcgatgtacgcacttccttttatgggaagatgctacccagctcttcccacagcaatatcggctacccaggctgggggtgggatggagtcagagaccacatctcacccctgtggacatcattttcagatcaagaaggtggtgttgtcgttcctagatcttgctgaagtttttgttctccttttccttttgagacaggctttcctgcagagttaaggagacagttctctgagacagggtttctctatgtagtcttggctgtcctgaaactcactctgtagaccaggctggcctcgatctgtgtgaaagcaaagcttgtggagtttgctactgtatactcctaaccatggagttaaagtcagaaagatggctagtgatttttttaaaaatatttatttgtttatttcatgtatgtgaatacactgttgctgtcctcagacacactagaagagggcatctaatcccattacagatggttctgagccaccatgtggttgctgggaattgaactcaggacctctggaagagcagtcagtgctcttaaccgctgagccatctctccagcccccgtgatgttgttcttcttgaggatgcaggtcctattcccatcacctatctagcatctcataatcaactgtaactccagtccccgggtattcgatgccctcttgtggtctctgtatgcacagatatacatgcagacaaaacacccatacacataaaaataatataatttaatttcttattataaaaactttgggagctgctatgagttcaagtgtgacctgctcttcacatggaattctgggcaggccagggctatgtagtgaaaacctgtctcaagaaacaaacattacagagtaggtccatatcttatggtgctcagaaaatgacttgtggttcattctgattgatctgccagacatgggcagtcaatttggctgtggagttggaagctgactgatgggcacaatctgggagcaaaaatgaacccagattagtttaattatcctgggtgatgataaaatgagggagatagttctttaaaggaaattcatatgagagttctttgtctatctgtccatctgtctgtctgtctctctatctctctctgggtctctctgtgtgtgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattattcacaacactgtgtgtgtgtgtgtgtgtgtgcgcatatatgagtacatacaaatataggtatgtgtgtgtgcatatacatattggagctgccaaaatggctcagcatttgcaaccaaatctgatactgtaagagtaaaacgtaaaaacaaaattctaggcctttaggcccaggcttgggaataaggcctttgtcctttgtgactcaatgttccaaggtatgctaatcctaaaacagatagcgacatccctccacccacccacttcctgggttcaaggagtattcattcaaagaaagtcaccctgacctaccctgaccattgctggaacccgctatgcaaaggtgctattgttaggggctcttagaaactgtcttgagaaataaccctcacaattaccaggtattcctcgtgactcttgtgactttgcacttccttgtgactcttaactggcatctttggtattttttttccaacaatgcccttcccacctccttgagttgtggtttcttcctttaaatacccccttatccagctactcggggcgtcaaggtcctctacccctgcgtggtgtatgaccgtgggcctgagagcgctcttgaataaaaatcctcttgcagtttgcagcaagaccgtttcttgtgggtgattttggggtgtcgcctctcctgagtcagaacgtgggggagtcctcacgttgtgggtctttcaatacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntccttgatcccccagaagtcatgagaaaagctgagcactgtggggtgcaccccaacgcccagcactgggggagtgaggacaggctggttccagaggatggcccaccagccaacttaacttaatcaggcggagtctccctccctcccccaggcaagtgggctgcatctggggatcacagacacgcacatacaccacacatctgttcataaacccacatgcacatgagaacacacacacggtatgtttgcatgcattggctgcctttgaagacggtcgtgttgaaataggagcatcaatgcagtgttggtggaagacggagcctttgagcagtgaccaagagggatgaaagtcctctcacgggaagagcgggtccttggggaatgcgcccagtcctccttgttctgttttatatttactctcaccatcccactttctgtcatgtgacagtgccctagccagatggtgctgttatgtccgtggacacccagcttccagaaccgtaatttagaccaacttctctctgtaaattacccagttgtgaatattggcataacaacagaaaacggactgaaagctaaatatccatttacatgaaaccaaatcacagaagggaataaaatccttcttgttccc

SEQ ID NO: 1164 - DNA, 2482 bp, Mus musculus
gcggccgcgtcgaccgcgcgctcaggagccaagcgtcccagctcccgctccagtgaagtttcattggtcttcggacgccgcccccgtcgccccagccctaaggaccctcgggtctcttcgacggctgctggaaggcgcccagcccgcctcggatgggcatcgtggagccgggctgcggagacatgctgaccggcaccgagccgatgccgagtgacgagggccgggggcccggagcggaccaacagcatcgtttcttctatcccgagccgggcgcacaggacccgaccgatcgccgcgcaggtagcagcctggggacgccctactctgggggcgccctggtgcctgccgcgccgggtcgcttccttggatccttcgcctacccgccccgggctcaggtggctggctttcccgggcctggcgagttcttcccgccgcccgcgggtgcggagggctacccgcccgtggatggctaccctgcccctgacccgcgcgcggggctctacccagggccgcgcgaggactacgcattgcccgcggggttggaggtgtctgggaagctgagagtcgcgctcagcaaccacctgttgtggtccaagttcaaccagcaccagacagagatgatcatcactaagcaaggacggcgaatgttcccattcctgtccttcaccgtggctgggctggagcccacaagccattacaggatgtttgtggatgtggtcttggtggaccagcaccactggcggtaccagagcggcaagtgggtgcagtgtggaaaggcagaaggcagcatgccagggaaccgcttatatgtccacccagactcccccaacaccggagcccactggatgcgccaggaagtttcatttgggaagctaaagctcaccaacaacaagggggcttccaacaatgtgacccagatgatcgtcctgcagtctctccacaagtaccagccccggctgcacatcgtggaggtgaatgatggagagccagaggctgcctgcagtgcttctaacacacacgtctttactttccaagagacccagttcattgcagtgactgcctaccagaacgcagagatcactcagctgaaaatcgacaacaacccctttgccaaaggattccgggagaactttgagtccatgtacgcatctgttgatacgagtgtcccctcgccacctggacccaactgtcaactgcttgggggagaccccttctcacctcttctatccaaccagtatcctgttcccagccgtttctaccccgaccttccaggccagcccaaggatatgatctcacagccttactggctggggacacctcgggaacacagttatgaagcggagttccgagctgtgagcatgaagcccacactcctaccctctgccccggggcccactgtgccctactaccggggccaagacgtcctggcgcctggagctggttggcccgtggcccctcaatacccgcccaagatgagcccagctggctggttccggcccatgcgaactctgcccatggacccgggcctgggatcctcagaggaacagggctcctccccctcgctgtggcctgaggtcacctccctccagccggagtccagcgactcaggactaggcgaaggagacactaagaggaggaggatatccccctatccttccagtggcgacagctcctctcccgctggggccccttctccttttgataaggaaaccgaaggccagttttataattattttcccaactgagaaaatgccgctgaattggaaggtgcccactaacttagaaaacagacgcggggctgagagccccgagctcttccccatcccttccctgtatagtgattggttggagaggaagcggggcaagaaggattctggggtttacttcttgtttcctggcccacaaggaaatacgacaggagtgtcccctgcccctttctctgcccgaactacagtcacgaacctggtgctgcttctgaccccatggttccatggagaacggagaatggactccagagagttttggacccagagggacttcatggctttctgcgaggtggaggggtcggggtggggagtccaggagagctgctctcttcccctgtccagtcagtaactttcaactgttggtctgacacctgtgttaatctctgacctgaaagtgaagatacacgcatttttacaacagccagccaaacagagaagactcaggtgactgcgggcggactgggccacctgcgaggagacaagagagggtgggtgcagaggaagggtttgaagggtgcacatttcaccaggcgaggtcactttgaaccggtgtgtacacacacgggtgtctcttttttatttcttcgggaggggggaggctatttattgtagagagtggtgtctggatgtatttcttctgttttgcatcactttctggaaataaacatggacctggtaaaaaaaaaaaaaaaaaaaaaaaaaaaaaaaaaaaaaaa

SEQ ID NO: 1165 - DNA, 1593 bp, Mus musculus
atgggcatcgtggagccgggctgcggagacatgctgaccggcaccgagccgatgccgagtgacgagggccgggggcccggagcggaccaacagcatcgtttcttctatcccgagccgggcgcacaggacccgaccgatcgccgcgcaggtagcagcctggggacgccctactctgggggcgccctggtgcctgccgcgccgggtcgcttccttggatccttcgcctacccgccccgggctcaggtggctggctttcccgggcctggcgagttcttcccgccgcccgcgggtgcggagggctacccgcccgtggatggctaccctgcccctgacccgcgcgcggggctctacccagggccgcgcgaggactacgcattgcccgcggggttggaggtgtctgggaagctgagagtcgcgctcagcaaccacctgttgtggtccaagttcaaccagcaccagacagagatgatcatcactaagcaaggacggcgaatgttcccattcctgtccttcaccgtggctgggctggagcccacaagccattacaggatgtttgtggatgtggtcttggtggaccagcaccactggcggtaccagagcggcaagtgggtgcagtgtggaaaggcagaaggcagcatgccagggaaccgcttatatgtccacccagactcccccaacaccggagcccactggatgcgccaggaagtttcatttgggaagctaaagctcaccaacaacaagggggcttccaacaatgtgacccagatgatcgtcctgcagtctctccacaagtaccagccccggctgcacatcgtggaggtgaatgatggagagccagaggctgcctgcagtgcttctaacacacacgtctttactttccaagagacccagttcattgcagtgactgcctaccagaacgcagagatcactcagctgaaaatcgacaacaacccctttgccaaaggattccgggagaactttgagtccatgtacgcatctgttgatacgagtgtcccctcgccacctggacccaactgtcaactgcttgggggagaccccttctcacctcttctatccaaccagtatcctgttcccagccgtttctaccccgaccttccaggccagcccaaggatatgatctcacagccttactggctggggacacctcgggaacacagttatgaagcggagttccgagctgtgagcatgaagcccacactcctaccctctgccccggggcccactgtgccctactaccggggccaagacgtcctggcgcctggagctggttggcccgtggcccctcaatacccgcccaagatgagcccagctggctggttccggcccatgcgaactctgcccatggacccgggcctgggatcctcagaggaacagggctcctccccctcgctgtggcctgaggtcacctccctccagccggagtccagcgactcaggactaggcgaaggagacactaagaggaggaggatatccccctatccttccagtggcgacagctcctctcccgctggggccccttctccttttgataaggaaaccgaaggccagttttataattattttcccaactga

SEQ ID NO: 1166 - DNA, 32874 bp, Homo sapiens
accatgttggccaggatggtctcaatctcctgaccctgtgatcctcccgcctcggcctcccaaagtgctgggattacagacatgagccactgtgcctggctgatacttaacttttttatatctcagtttccttgtctgtaaaatgggaacaatggttcccacccagttgccttcacaccattgtgaagtctaatgaaatcaaaggtatattgactagtcttaaccaaaaaaaaaaaaaaaaaaaagaagagagagagagagaaagaaagaaaggaaataaagggtacgagttgcctggggatgttctttttttttttttttttgacagtctctctctgttgcccaggctggagtgcagtggtacagcctcagctcactgcaacctccgcctcccgggtccaagcaattctcctgcctcagcctccctagtaggtgggattacaggcacctaccaccacgaccagataggtttttttgtatttttagtagagatggggtttcaccatgttggtcaggctggtttcgaactcctgatctcaagtgatctgcccacttcggcctcccaaagtgctaggattacaggcatgagccactatgcctggccgggatattctcttatctcatcctttacccctcaacccagagtggtgataggaggagggggttaattaggaagaactggggtttttacagtttccaaactcactgggagtcaaggattgagacaaagtacaagctagatttggcaacatccagggtcatgcatgggaacctgggagccccatgccccactgcctatttgcagggccctgggtcttgggtggccctagttcagtgtgtgcatgtgtgtgaaatgcaaggtgatgaggtcagtatctcaactcccagttactggtccagttgctaagaacttgcctgaccataaccatcctttcccaactcacagaatgtcaggttctgatgccagtgattggaaagaaatggcggtgagcaaggagagggggcaatgctgggcagccatgccacctttatgtcccctgtggccagagacgtgggtccagggcccttctcagtgcccagctcggtccagccagctgcccatggccctggtgggaggaggtaggctggacgccttctgacacttcctgggtaactgagcggggcaagcagcaaacagcaggctcctggggaaatctcagacttgtgtgtcagagcggatctgtgtctggggtggtaagtggggttaaactcaaggtcagacctagccaatccattttcgcgccaacatggccttgggtgtcctccattccagtggctgggacccaggtgcccactcagctggagacagcactgctgggagcctaatgcctggtttgtccctctgcttcacacactggttgcttgcctgatttctgcctgtgcctaggatttataaggaagggagttgtggcatgtggatcccaggcctccgttctactcccaaatttcaggtgctaatctctccatgagtttcagtgacctcagaaaaggaaatgggattaagctgcaatttaaggggttgtgggaagacagctgaaagaatgtcccagtcttcagtagaggaggtgggaggtggctgtaaactgcctaaatcgggggaacactaccaggaatctcaaattgctgtacaatgcagacacagtcaatcagcctccacctacttagatctctaagtgcttagagatcaccaacctgtcccaggctcctgagtctattacctcactcctccttgttctctgcctttcccaggctactgtggttatgatttgtggcagaagttgggaaggcagaaaaggagagaaggagggaaaaggacaatctgagaacaagctggagggccaaagtggaccccttgcagagttggcaagatggcaaaggggatgcagtggcaggtgaattagttcagatgggcaagaaatgtaggataagtcagcaagctgcctttgcgcaggagatccctaggtgagaaggtaagaagggcttccacatgcggcagtagcctcagtgtttctggaatggagtttgtatatatgttgtgggtggggtagggggaacagaagaagagctgcagcatcctgcctttgaggaggaagatggtacaacaggaaggccaggaggtgggctgcaggtaaaatgtccccgtgagacagggttgagggaagcagagggccagctgctgggcctgcagccttcttgcccccactcccagctcacccgcccactgcgaacactcctcagctcccccaccccattctggcccacagccctggggaagcgacatggcgttctcaccacggacccagtgccggctgtggcttcttccctctgacctattttttaatcatttgatgggatttttcccccccaaaccaaacccccagccccctgggcccgtcagctccaccgcgtgtcaaaaccacccctgtcactttgcgttggtttctcagtccagccagcccctccccgcagggcctgagagcgatggctaattacccagctgctgaacgccccccactcctgcccctccacccctagccctgacagaggggccctggaggactgctgggagaagctggggcctcctcaccctcccactgcttggcaggaagtccttcctgctgtctaacctccattcttccctctgtcctgcccctagtggtgctgaatcgcagacacagaggctgttggtactataagggtctttgggatacctccttaagggacagaaaggggcaactagtcttctgtcctgggtttagggatgtcttctgtcactctggctctctaacagaattctaggggatggtccttgctgtctcattttacagagcagaaaactgcgacacacagagggaaagggcctagcccaaggtgatctacgccagtggcggagccagaatcagaacctagagttccatgtttgtctttccacctgtttctgggtcctgtttctggtatgtagagggcccacccccacataccaactaggtctgtttctgtttctgtgcaactccgctgccagccctgagcaggtgtgttccctgccatgccctctctcccttgccccctggccacacagagcttcaccctggcatttcagggctgggcagcttgcttcaggcactatttaggaatgggactctttcccccaataccacccatgcccttttccctcttcctctctcattcatccctaaccaagtccgtaagtctgctctgtctcacccgcaccctgagacattaaccaggtggacaaggcaaaaagctctaggccagacacaggaaggccagagccaactcacagatgaggcctagtcccagatggacagatagacatgcaggagatacatggagcgctggatagccctggagacacggacagtgacatgaagatgcagagacagacacaaacacgctacagagacaaggcaagttccgaggcccacaggtaacagacagacacagagacgcagacagaggcacagaacctacactcaggaccagcgtgcagacctctcacaggtcccagggataggagtggacgtaaagaggatacacaagacgcaggcaaaaacacagggacccagagaggggccgaatcagaccagaggaacccagacactcaggagccctgagagacatgggcacacagggctgcccacagatcccaggaagccagagagaaccttggggagagaggaggccccagggggtgggtggccctctgaaggacagcgaggcctggcctggcagagcctgactgtgccaggaagtcatgccaagatggcaagatgggaagcagagaggagcttggcagcgtgggggttaacccctcagcctgtgccctccctccaagtcccttttccttggctcttctttttcttccctcctctcccagctccttttacccaaagccctggatatttcccgcctccccagcccaactcctggtaaccagaccctgcttcctgcctgagattaagggcctgtctgctgagaggcaggaagggtgggggcacagcctctccccagtgcctcctgaagcttgggcttgcccatccatactgtggcatgccctcctgataacagagttacccaagtacctgatgtctgaatatcccttcaggagggcgcaggagccctagcctgggagtgcagcgggggcggcctactgcatgcgtgggtgtgcatggagggtgtgggtcttatgtgaaatgctggcaggggtgagagcagctagagatagagagaggatagatgattcaaaataagatgccacggagaaggaggactgaaaggcacccaggcctggcctggagcccaggggtaagggccgctcaggcttggtggggggtgtgtggggaagggtgacccagcctgcagatgagagcctggagcccttgaccttgggaggagccctctgttctgtgttcacactgaccacctggtgctgggtgctggggactcggaactcctgcagctgtcacggggcgggggggttctacaggtgcttgtccctccccttcccccctctctggctgttaatctgatggttccggccatgccctctgaaggactggcagtctgggcccagagggggaggggattcagggcacgcggggtgggcagagtcagatgctgaaggagctctgggatgctggatgtggggcaagagcaggcggtggggctgcagggactggatcgcagagatttccctagcatagctctgcatggggtgtgtgtgcacatgcgtggatgatggcgtgtgtgcacgtggtgtgttgtgagtctacaccccaggagcaagagggctgagggggtcactttgctaggagctctttgggggcagggactgaccctaatttatctttgtgatcccagatctccaagggcctggcttatcccagcgctcaggtacccagggaatggtatatgggtatcaggaggggaagcctgtccctttctaatatgtgagtcttatgaacagaggggctctcttttggccccaggccctgagtggaggctgaggatggacctgaaggacactttgtggatgagccactaagccagagggaggaaagggcaggtgtaagtggctgggagtagaggaaagagggcttagcacagtttatgcctctgttttgtttcagccttaggacagcatccctcaaccttcacatgacagacccagtcagtcctggcagaggtctgatagctccatttactgacaaaaaaaacccagagaggttaagatactttaataggtagcacagccagtaagggttgggattgaggttccaacccagccacccaactaagtctccccaccccatttctctctgccccagctccagcacccccaggcctctctgcctctgcagactttcctcccattggcccatctctgtctgtctcctttctttcatgcccctctcgcaggcccagcctgagactttcccactgagtcacgatctgggtccctgactttgtggtccctgtccctctctgggtctaaatctttctttcagaaatgcaccctaagcctctcactttgctctctctttcttttcacgccttctccccaactcgctgccccctctcttttactatctaccctctcacagcctctaaggctctgcccagcagggtggagggtggaaatcctgggtcctggtgccatgccatgctccactaacagtttccagtaggctgggcgtggtggctgatgcctgtaatcccaacactttgggaggctgaggcgggcagatcacgaggtcaggagatcgagaccagcctggccaacatggtgaaaccccatctctactaaaaatacaaaaaattagccggtcgtggtggcatgtgcctctagtcccacccaccacgggaggctgaggcaggagaattgcttgaacccgggaggtggaggttgcagtgagctgagatcgcaccactgcactccagcctgggtgacagagcaagtgactctgtctcaaaaaacaaaacaaaacaaaacaaaacaaaaaaacagtttccagtaatagccgctcctccccagctgccccaccaaacccatccaagagccttccaggtgcctagggagctcagcactccatacgttttcaggagaggacccaggtggctggtagactctggggtgaggaatcatctggtcctagagcatcaataaggaaatctcaatgcctgcagccaccctcctcaggcatgaaacctcctccaccgccctcagtgtgcatacccagcaagctcaaggcacactgactcgcaggatgggacttggagatgggacagcaaaatgggagggagcctgagagtggggtgcatggactccctgaagtccaacgcatcacctggagtccttaaacatacagattctagagacccgccacaggcctgggcctcagaatctctagaagcaagtcccagaaatccacatcgttgtggcttcctggcatagtctgcagcccacaggtgaagcaagtgctgtgtgaccttcggggagcctctctcattttgagtcttcatgggaaacagtttgaaaggaagccctgaacgtttgcagaggacaacagcgtggagagaaccagtgtctaggctgtgggattaggcatgattttcttttctgttttctaaaccttttcttttctttttctttttgtttctttgagaccgagtctccctctgtcactcaggctggagtgcagtggcacagtctcagctcactgcaacctcctcctcctggggtcaagtgattctcttgcctcagcctcctgagtagctgggattacaggggccagccaccacacctgctaatttttatttttgtttttgtttttgttttgagatggagtcttgctctgtctcccgggctggagtgcagcggcacgatctcggctcactgcaacctctgcctcctgggttcaagtgattctcctgcctcagcctcctgagtagctgggattacaggcgcccatcatgcccagctaatttttgtgtttttagtagagatggggttttgtcatgttggccagggtagtctagaacttctggcctcaagtgatttgctggccttggcatcccaaagtgttgggattacaggcatgagccaccacgcccggcctgttttctaaaccttttccagtgttagtatgattcttcctcattcttgtgggaagagcactggcctgggagtcaagagacctgggttctagcttcagctctgccacaaatgcactgtgtgagtttggtgtcttattccattttgcatagttaccatccaccgtgtctcataaaatgtgatgctggttggaggccatgtctctctcattcctggacacttatcttgtgtttcttcactccggtctcaccaggaccagcctcataatgctccctgtattgatgggatagagagggctgggaggagcagccatggggaagtgaggggatcccagggggcctcatctcctcactcctcttctcccacctttccagccccagggcccgggaggagggtgaggtggcagctggaggagaaggtgtcactgccagggcccttattctcacccaagctggcagaggggcgggactggcagcagtgacaccagggccactcagcccccgcttttcacaagcactttcttttttgggtggaagaaattggagagagggggtgagaaatcggggattgaggaaccaggctgtaagaccctataacagcctgtcaggttctagagagaccacccccagccttcctcttcctccagaggcatggccccagggccacctgattctgagattcataattccacctgccccagaaagctgggtgggagctcatgtcatcctgttcagaggcaaggggatgaatcacttgacctgaggattaatgtggaaaagaggagggggagagagagggaggagcaagactccatttgatcttcaacagccaagcactgagcaaaaatgtcccccaaaggggtgtcagcattcaacagtctcacatctcctagggaatcagtcattcaggagggtcttactgaaagctctcatgtttccccaaaagtagtgaaggatcccaaggtcaccctctcttccaagcaatgctgccccactttgaacatcaggcagaaacttccctgttccttaaggtacggagaaatggtgggtaaggtgttggggaggaggccagtcctgtgtttctggtactgtcatgtatccggtctccaacctcaaaagatgtgctgattctctctcccccaagcctccctgggtcatgcccacctcctggagtccccagctttgcctttgcctgccaacttgcctcttggttcagctctatttgggagcagagagtccccataggcccctaagggtgaagccctgtcaggctgggacagaaatgtagagctggggccagttcccaggggagaactggggaggactggggtgaaggtagagagaggagaagttaaactttaacatgacaaaaatattaaagtatttttcaaagtactcttaaaaatgtaaatctttatctatatactgatatgcaaaatattccatgacaccttgtggagtgaaaaaaaagtacacattataaagcagcatgtgtagtgtttatataaattatatatttgtgcatgtgtgcaaaagacagagacagagagtatataaggagtgaggtctcagagggtgttcactgaaatgttaatcctgtttggctttagggggtggaatttggggtgatttatacagtctcgtttttacttttctgtgctgcttaaatttcctatataagtatgtttcatctttatacacaggaaaactcccaatgatgctattttcaattggggggggggaaacggatagttttcatcataaaaggagtctaatacattagttaacataaaaggaaaatggagaaagaaaagcctccatcgtcctatctccgaggcagcccttcagagcatgtggtgggtttccttcctgtcagccggctctgaatctgttcaaagcagcttttccatccaggtataataatagattggaaagtgctgcacacgtacaccctctcatgtaaggcttgcagcccccctgaaaagtagatctgtttatttcccccagtctatggatgaggcacgtgaggttgactttcaggcaaggaaaatgacttgcctgggtcacatatacctggcaggcagagccagacctgggactctcagcactggcagcccaatgctacttccagtgcccatgactgccatgcagggtaggggagcttttgtgggccctgccaggcccagctcagggccctgcaaacccctggctgctgctgatgcagtgcgctttaaggaacatttcctgttgtccatcaggttccaggtctgcccccagggctagagctacaagatgcagccaactcagcacatgtggacctctggtggggagaaagagggcaacccgaaaggtcacttagcacagagtctgggcacacagtaggtatcaataaagatcgattgaatgttcatggtcaaagttgcttctagtgtgcccgtgctccgagcctctgagtgccaggagaatgcccagcgagtcccacttgggccatctcggaaggcttcctgtaggagagggcctttgagctgagacttcaaagctgggctgaatttccccgagggtccagaagagagccacgggctggtgtgtcaggcagcggagctgacactcccagaaagcaagatcttcgaactacagggtgcgcgcaggctctcgcttctctccaccatggggggccctgcagtactcgccaagagcgtagaatttgcctagtattagccacgagagggcggggtggggcgaggcggagcagggccgaggtggcggagtgggggggagccggagagcttcataaagccacagcaaagcgctgcgactctagtgacagcggcccgctggagaggaagcccgagagctgccgcgcgcctgccggacgagggcgtagaagccaggcgtcagagcccgggctccggtggggtcccccacccggccctcgggtcccccgccccctgctccctgcccatcccagcccacgcgaccctctcgcgcgcggaggggcgggtcctcgacggctacgggaaggtgccagcccgccccggatgggcatcgtggagccgggttgcggagacatgctgacgggcaccgagccgatgccggggagcgacgagggccgggcgcctggcgccgacccgcagcaccgctacttctacccggagccgggcgcgcaggacgcggacgagcgtcgcgggggcggcagcctggggtctccctacccggggggcgccttggtgcccgccccgccgagccgcttccttggagcctacgcctacccgccgcgaccccaggcggccggcttccccggcgcgggcgagtccttcccgccgcccgcggacgccgagggctaccagccgggcgagggctacgccgccccggacccgcgcgccgggctctacccggggccgcgtgaggactacgcgctacccgcgggactggaggtgtcggggaaactgagggtcgcgctcaacaaccacctgttgtggtccaagtttaatcagcaccagacagagatgatcatcaccaagcagggacggtgagtgcggcgcgccggcccttggggcctctgtgcccgcgccggaacaagaacgtctcgtctgtttttctggctcgacaatgcttctgactccgtgtccctcactgctttggcttcagcgtagggagacaggggaatggggttgttaggaggacagggaaagctccggaggggcgtctgtgcccaggctgttgcaccaacagccagaggactcacaagggagacgggtgagtgcgggacagtgagaagtcaccttgatttaggggaagggtgactgtggcttcacctagaattggtgtgcgcccctgccccactctctactgtagaggagtcgcagcgggcagtgaaagcctgtgctctgggcggacaggacgcctgggcctcctgtgtgggaaactggaggggaagggagccccttatctccgggccccctgcgcccacctcccccggctcctttgctgctggtgtgctcaggtcagctttagtggtggtagtggtggtggtagcggtggtggtggtgtgtgtgtacggggggagattgggatttggtgacatggagaagcagtcgccaagtttcctttccggtcttactttgagatcatatgtctggtgtgtgtgtgtgtgtgtgtgtgtgtgtgtgtgtgtgtgtgtgtgtgtgtatgtgtgtgtgggtgtgtgtgtatgggggctagtgcagtaaagcttgtagggggcacagatcccttccaggcacaaatgcccacgggctgggcagatgaagctcacccaggggtccagcctggtagccagccccacactgcaccctttgaggctggtccagtgaaaaccttccccacactcctgtccagaaattcaccggttcagcctggagaagtggggaaggggtgtcccatggcttcatggctcagggttcctgagccccgtgcgtgatggggagagtttggggctgagggtgctgcttccggatagagcctcctgcgcaaggaaagaaacagaaacctgtgacttgtgtggtatttgtttagtaagcaacccccggagtggactgtgtctgatgtgggctgtgcgcacccacccttcccagtgcggcccatgtgagcaggggaccagcgaggaccagtgtggaagggctgttgtcattggtggacctgggatgctgggtcccaggtccgagaggtgtggataccaaacgtggggcttggggtggaggggagagggagaaggccatgttggaccccagaggttggtattcgatctgggcattgctggaacattcttccctccagatgatttttgtggggtagcctgggactggggaacctgttgccagccacaactggcttcaagttactgagctgttccactttccctgggatgaacccaggaaagttggcgtgttctttgatggctcagccttcatctcttaagccttctgataatttctctctgctccccccaaccctagtcaccctttgggtgtacccagacacagcccaagcttctggtcccaatgtgtctgaattggaagggacccagaagatcctgtccctctcactgcacagacagggaaacaggcccagagatagcaagagactcttccaaggtcacacaacacactcattgcaggcagagctggcactacagcccagatagtatttgcttgggtttctttctctggccccctacggccaccagtaaaaacagccacccacgctctctgaaggccctgatgcattcagagtgctttcacttccattatttcactgtgcgttaggtaggccaagcagtctccccattttacagttgaggtcactgagttgcagggtcagctaggggcttgcactccatcacacagcagaccagaagtggggcctcttaaccttccactctgttgtgtggtcaggaggacttcccaccctgggcccttgctggggtctccccacagcctctgccaggcctctgcctcctcctgccagtcttgagggatggggtggatggagcatcagccagcactctagggagttggccagtgctagggggctgcctctctgcctgtagagccagcttcagggaggctgtagagcacttcagggaggcacttgaggggatgattctcgaagtgtgtatcaccatctctactcccatggcctcctttccttggtgttcctgctgagtaattctcacttgacaagtttttttgtcccccttttagatacatacacttacatttttttattatgaaaaattccactacatacaaacatggacagaagaatgtaacagacttccatccccagcttccacagttgtcaatatgggtccaatcttgtttctgcatcctcacttcgcttcttctgtctgcaactatattagtaatatagtaattactaagtacattctagatattattttatctctgcacctctaaaaatgactttttaaaatgaatgcattaccattagcaaacctgaaaagaatttcctaaatatcaccaagcttctctgattgcttcataaatgtgtgtgtgtgtgtgttttccaatcctcacactttttgctccattctgaggggctccatacgcggggtccctgttgaaggaggcagtggctcttcactgtttcttttggtgctttttcttggatcaggcttcatagaccccacgctgccatggaggggacagaggacacacaaccccaattcagtcccactagccccaggttacctccataccttctcagcttgggctcctgagatctgggaaatcagtggccatttcctctcaaaacaggcttttgggcttatagcacagcttcctttccgtcttcctgcttttgtgggctggcctatccctccgtgggttccagtgacccaccagtcacaccacatcacccatgaccttcttcctttttgaaaggttctcccacctcaggcccacctacagcctacagccccacggctttttgccttgagctgactcacgccgtcccggattcttcctctcccacccaccctggatctatccctcggtattgaccagcgccagtggcatgctcttcccaacgggcagaaatggggcagggcacagggggtgattcctgggtctggagattgatcaaggcagctcagatggggctgagagaggggaactgagaacaaaacggtggattatcccagtaggagactttggtgtctacgtttgtgtctggagatttggggcagcctgataatgccccacacaggcttgtgcgagggtttctgtgtggcagtgtgtgtgtgttgcgaatgtgttggcgagtatataatagttgatggtagacattctcagtagaggaagagagaggcctgtgtctctgtgggtgtgtgggtgtgtattaattgctggcaatccccactttctgggtgtgattggttgattattataattaagataactttgggtagctgtgttgtgttaagctcaatctgcatttggatttgtgcatgtgaagacagaggttggtaaaacaacaatttcagtcccacactatccttgctatcctcacagtcattacaatttttttttgtctccactttcccaactccaagaactttaatttttttatttgtaatatttttcatgggccaggaagtggacttgaacctcccacatagataactttagtcgataactttctacatctttttttttttttgagatggagtctcactctgtcccccaggctggagtgcagtggctcaatcttggctcactgcaacctgcacctcccaggttcaagtgattctcctgcctcagcctcccaagtagctgggattacaggcagaagccaccaagcccagctaatttatgtatttttagtagagacggggtttcgccatgttggccaggctggtcccaaacacctgacttcaagtgatcccccgcctcggcctctcaaagtgctgggattacaggtgtgagccaccgcacctggcccaacttttcagatcttaaaaaattttttttaatttattttttatggagacagaatattactgtgttgcccaggcggtctcaaatccctgatctcaagcaatctcccgcctcagcctcccaaagtgctgggattacaggcatgagccattgtgcccagctaaaaacattttttttaggcttaagcatgcttaactggtttcatttgtcttggggcaagtgaaaacaactttaattaaaaattttttttaaatgagacatggtcttgctctgtcacccacgctggagtgcagtggtgcgattatggctcactgcagcctcaacctgctgggctcaagcaatcctcccatcccagcctcctgagaaactgggactataggcgcacatcaccatgtccggctaattgtttctattttttgtagagatggggtctcactatgttgcccaggctgcagctttgctttttgtctggctgtttgccagtggctgtctgagtctattaagtggatctgaggttggtaagacgaggagttcccttgatgcccaagcacattttgtactttggtaggtacgacacattgccagaataccctcccaaaaggtgctaccaatttacgcccacaccaatagtctatgagaggacccattttctcacagcctcatcagcagtagatattatcacattttttttttttttgagacaaagtctcgttctgttgcccaggctgaagtgcagtggcatgatctctgctcaccgcaacctccgcctcccaggttcaagcgattctcccacctcagcctcccaagtagctgggattaccggcatgcaccaccacgcctggctaatttttgtatttttaatagagatggggtttcaccatgttacccaggctggtctcaaactcctgacctcaggtgatccacctgcctcggcctcccaaagtgctgggattacaggcgtgagccaccacgccgggccaatattatcaatttttaaacattgaccaatatgactgagaagaactatctatctccttgctattttaatttgcacttaattacagtgaagcagagcctgtgccaggagctccgaatctgggagaggtatgacgaccctgtgaaccatcccaaggctacttagttcttagggccagcagaggaatttggggtcttggaccctgtcttatgagggtgggatggtaagtggcctttagggacgctcaatttgacaccagacccatcaccactctcggttccttcccagcaaagtgtcatgtaaatcaggggctattttgggattccagctggtggtgattctagacttttagggagaaaccgagatctcctttctcttctcccttttccccagcctcttcctgtgtctccatttccctctactagtgataaaaacaggatgagctgggcatggtggtgagcacctataaccccgctcgggtgactcgggaggccaaggcaggaggattgcctgtgcccaggcatttgagcagagcctgtgcagcatagcagactccatctcttaaaaaaaaatcagtatggcctgggcgcggtggctcacccctgtaatcccagcactttgggaggtcgaggccagtggatcacctgaggtcaggagttcgagaccagcttgattaacatggtgaaaccccgtctctactaaaagtacaaaaattagccaggtgtggtggcgggcgcctgtagtcccagctactcgggaggctgaggcaggagaataatggcgtgaaccttggaggcggagcttgcagtgagccaagatcacaccactgcactacagcctgggcaacagagcgagactccgtctcaaaaaaaaaaaaaaaattagccaggcgcagtgttgggtgcctgtagtcaaggagaatctcttgaacctgggaggcagaggttgcagtgagccgagatcacaccactgcactccagcctgggggacagagcgagactctgtctaaaaaaaaagaaagaaaaaaatgaatatgaagaaatggggaccacagagcacagcatgcactctgcagtcagaagacctcacctctgctctcccaccgaggaccgtcaccaaacctctcggagcgtcagtttcttcaaatataaaattggaaataacattttattttttattttttctttgagatggagtctcacactgttgcccaggctggagtgcagtggcgccatctcgggtcaccgcaaccttcgcctcccaggttcaagcgattctccttgcctcagcctccaaagtagctgggactacaggtgcatgccaccacaccaggctaattttctgtatttttagtagatatggggtttcactatgttggccaggctggtctcgaactcctgagctcaggaaatccaccctcctcggcctcacaaagtgctgggattacgagtgtgagccactgtgctgggccatctttcgaactttttaacagctttcagaggaaagatggacaggagttagactctccatttacatgtgaagaaactgagatttgggctgggtgcagtggcccatgtctataatcccagcactttggaaacctgaggcgggtagaccacttgaggtcaggagttcgagaccagcttggccaacgtgaaactccatctctactaaaaatacaaaaattagccgggtatggtggcacatgcctgtagtcccagctcttgggaggctgaggcaggagaatcacttgaacctggaaggtggaggttagagtgagctgagatcacgccactgcactccagcctgcatgacagagcgaaactccatttcaaaaagaaactgagatttggcttgagaattaacttatccagggtcatagggtagtaatctatttttctcaactcaggaaagtcaggggaagacaggcgtgtgacagcacccttctaggacaccttcccaaggttgttaggtaagttgtcctggggacctctggggattagaagtccctcaaaaacagttcctaggcccctggaaccctccctcctccaggtttcctgactcagataggtccctttttcctcatccttcagggcttctcatgagaggagggggaagtgtgtggaaatgaaaaataattctgatgaggattagcttctgccattctgaaaactctgctcttcctgcttgtgttagaagagaaaggctaagccattggagctggtgatggaattggtgctggtggaggtggtggttgtagtgacggtactactggtggtggttgtgacggtgaaggtggtggctgtagatggtggtgcccgtgctggtgctggtggagatcgtggttatcgtgatggtggagggggcagttgtagtgacggtggttgtgatggtggtgatgggtggttacagtgctactggtggtgatggtgctggttgtagtggtggtggtgacggggctagtgaaggtgttagtggtggagatggtgatggtagaagagtgcttcttttctgaatctgttactctggcacaacagcggaatcatacagcatcccaccccctaacttcctctacttttcctggaaacaaggactttgaacatgagccccgtgttcaatagagccttctttcaggtggatgggaagctccctgttcaactaggatgtgtgcaacttctctaaaggctgagggcagactataccgcaggtggcagacccaggagcatgggagagggagggcctgtgagtgggtgtcatgggtctgggagtgtgttagcactgtgagagccacggcagagagggtggctgaggaactgaggcgtgaggaccttccaggaactgcctgtggagagctggtggtgccccctcctaggaagcagctaaggttagagacaggggtgtgcaggtagatgtcgagcaactgaccctctgaaagaacattttaaaaaactctgatttgtagtgtttgctgatccctgtggtgtaaatactcctgctatggatgatttcaagcgactcatgtgagtcattgaacacagagccgggaagagactcacagtgcactgtgatttagtacctcctccatgcagctgcgatagacggaagtaacctcgacagtgcagacaatagtaaaacgtaaaataactgggcagtgatgattttttagtttttactccttttttttttttttgagatggagacttgctcttgtcatccaggctggagggcagtggcgcgatctcagctcactgtaacctctgcctcctgggttcaagccattctcctgcctcagcctcctgagtagctaggattacaggcgcccacgaccacacccagctatttttgttgttgttgttgtactttttagtagagacggggtttcgccatgttggccaggctggtctcgaactcctgacctcaggtgatccgcccgccttggcctctcaaagtgctgggattacaggcatgagccactgtgccgggcctactttgactgttaatatgtcttgaattgcaagtttatataatttaatttttaattatggctgtgtttaaccactggctggcaaactccctaaacaccttccagctggttcttgtgagtgggaggaagccggctacagcacaccactgatgcctgggcactgttgcaggggggactggctgtcaagctggagctgatgggtgctgggggctttctctcttctctccaggcggatgttcccattcctgtcatttactgtggccgggctggagcccaccagccactacaggatgtttgtggacgtggtcttggtggaccagcaccactggcggtaccagagcggcaagtgggtgcagtgtggaaaggccgagggcagcatgccaggtgcgcgcgcccctgggagcggtgggctctgtttcgctgggactgggcgccccctggtgggcccaccaagcccctacccctaattcctagacctttaaccccctcccactccatcccacgccattgcatccctcctgtttctggcttcctgctttgctctagcctgtcctctgctgagtcctctgcccttccctgcctggtcctccccctgtgtccttccttacgtccctctcgggacaggcaaagccctacatcaccagggttctgtcccgggggctgcatgtcaaagaggtgaactgtccacaggaaaccgcctgtacgtccacccggactcccccaacacaggagcgcactggatgcgccaggaagtttcatttgggaaactaaagctcacaaacaacaagggggcgtccaacaatgtgacccaggtaggacctgctcttcaaaaggtagcctcgccctgctccccaccctgggtctgagacctccaaggccacaagggtcctgcggggccagtttggttcattttttcttccttcctacaggaaggaaggttcgtttttcttctgtcctaaacgaagggtcatttttcctccttcctaaactctggctgtttctcacccaccttgggaggaagatgagatgggatgaagctgaatcttggacgggggtcatattcaggccacacaggccaacccagcctcagggtttcttcaccaaatcatgggttgccattgctccggcaccatgaaaggcacagagttggccctgtggtcccagggaatagatgccgagtttctctaggttgaacaatcctgttaaaagtgcccttgctggctgggtgtggtggctcacacccataatcccagcactttgggaggccaaggcgggtggatcacaaggtcaggagttcaagaccagcctggccaagatgatgaaaccccgtctctactaaaaatacaaaaattagccaagcatggtggcgggtgcctgtaatcccagctactcaagaggcggaggcaggagaatcgcttgaacccgggaggcagaggttacagtgagctgagatcatgccattgcactccagcctgggtgacagagtgagactccgtctcaaaaaaaaaaaaaaaagaaaaaagaaaaaagaaaaaaaagtgcccttgccctaaagccctgtttgtgctgataccttggtctcaattgacatctggaggtagaagagggggcaagaggctagaattggtgccccaaagagtccggacactggagttggaaagcttgggggaagttacatggtggcagagcaggggaatggacaggatgacctcaaggtgcttgctagcctcacgtggggccagctgttggtgggggtgatgggatcctcgaaatccttcctccccacccctacaaccgtcttgctctgtctacagatgattgtgctccagtccctccataagtaccagccccggctgcatatcgttgaggtgaacgacggagagccagaggcagcctgcaacgcttccaacacgcatatctttactttccaagaaacccagttcattgccgtgactgcctaccagaatgccgaggtgagggctgcctgagccccggtggggaggagggcagagtggggcccactgtcttccttgggagggatttggaaagttcccgagccccagactcaggactcaggtgactctatttcccttctctctagattactcagctgaaaattgataataacccctttgccaaaggattccgggagaactttgagtcgtaagtgccactgggttcaactcagctttggtccctcctgagacacatcctctccctgcccctgaaaacaggagggtgggggacagatgctacaggtgggcaggccagggaaggagggtcggagaaggaatgtgtgaaacaggtaggctcacaggtgactggttctgcttgtgacccgttttcttgccttctatttttttctagcatgtacacatctgttgacaccagcatcccctccccgcctggacccaactgtcaattccttgggggagatcactactctcctctcctacccaaccagtatcctgttcccagccgcttctaccccgaccttcctggccaggcgaaggatgtggttccccaggcttactggctgggggccccccgggaccacagctatgaggctgagtttcgagcagtcagcatgaagcctgcattcttgccctctgcccctgggcccaccatgtcctactaccgaggccaggaggtcctggcacctggagctggctggcctgtggcaccccagtaccctcccaagatgggcccggccagctggttccgccctatgcggactctgcccatggaacccggccctggaggctcagagggacggggaccagaggaccagggtccccccttggtgtggactgagattgcccccatccggccggaatccagtgattcaggactgggcgaaggagactctaagaggaggcgcgtgtccccctatccttccagtggtgacagctcctcccctgctggggccccttctccttttgataaggaagctgaaggacagttttataactattttcccaactgagcagatgacatgatgaaaggaacagaaacagtgttattaggttggaggacaccgactaatttgggaaacggatgaaggactgagaaggcccccgctccctctggcccttctctgtttagtagttggttggggaagtggggctcaagaaggattttggggttcaccagatgcttcctggcccacgatgaaacctgagaggggtgtccccttgccccatcctctgccctaactacagtcgtttacctggtgctgcgtcttgcttttggtttccagctggagaaaagaagacaagaaagtcttgggcatgaaggagctttttgcatctagtgggtgggaggggtcaggtgtgggacatgggagcaggagactccactttcttcctttgtacagtaactttcaaccttttcgttggcatgtgtgttaatccctgatccaaaaagaacaaatacacgtatgttataaccatcagcccgccagggtcagggaaaggactcacctgactttggacagctggcctgggctccccctgctcaaacacagtggggatcagagaaaaggggctggaaaggggggaatggcccacatctcaagaagcaagatattgtttgtggtggttgtgtgtgggtgtgtgttttttctttttctttctttttattttttttgaatgggggaggctatttattgtactgagagtggtgtctggatatattccttttgtcttcatcactttctgaaaataaacataaaactgttgaatgtgcctgcctcagtgccagcatggggggacatggatggggactcagttggggttgtacccaagctggtgtacccaaggtgttctgtcagctttcatttatggggaacctgctaagaccctgaaatgactccagctgagttacagcaaggccacatgtcctaccttcagcactcagggggttggttgatgctacctcttaaggcatcttgggacggacagagaagaatcccttgccctgtgtgcaccctgacattgaaaggaggggtgtgagggcaaggccaagggctggactgggagcgggggtgcagggcgctgtgaggcggtggcacttgatttttctttgcatttctagcagccctccacctttatctctagggttattcaaggattaaagaaataaatataaaatgagccatgtgaaattaccatttttgtaggtcgaaaagccaaatattagcaattttatgtgactcaagctaatacatgtaaagggtttaagaacattgcctgacaaacagtaagcactcactgtgtaagctactgttaccaacagtttctagctgtttctgtctgtctttttatacacactgaattgtgtttgtaaaataatacatacttttttttttttttttgagacagagttttgctcttgttgcccaggctggaatgcaatggtgcgatctcagctcactgaaaccttcgcctcccaggttcaagtgattctcctgcctcaccctcctgagtagctgggattacagatgtgcaccaccatgcctggctaatttttgtatttttagtagagacggtgtttcgccatattggccaggctggtctcgaactcctgacgtcaggtgatctacccaccttggcttcccaaagtgctgggattacaggcgtgcgtcaccacactcagcctatacatgcttcttttaaataattcaagcaaggaagaaaagtataaagacaacaataaattatctcaaatcttacccatcaagaattatcattaacattaggtgggttagacagaaatagttttataaattggaaccatactgaaaaggctttttcttaatgaaaatggttaaattttagcttatagaatttagtcacacacacacacacacacacacacacacacatcaagacaagcaaaacctctcaaactctcaagtgaaatgaagggagttgctaaacttaagataaatttttcttcactacaagaaatattttcttggttttttttttttttgagacagagtctcgctctgttgcccaggctggagtgcagtggcacgatctcagctcactgcaacctccacctcctgggttcaagcagttctcctgcctcagcctcccgagtagctgagactacaggcgtgtgccaccacgcccggctttttttgtgtttttggtagagacggggttttcaccatattagccaggatggtctcgatctcttgacctcgtgatctgtctgcctcggcctcccaaagtgctaggattataggcgtgagccaccgtgcccaggcaagaaatagtttctaaaagaacactctcaggctaagacaggtgcttataggaaacattaagaagttagagttactatgttgccccaccacagtccagggtgcaccccattctaatggggaaacatcatcatgggctttgggtagttctcccagttctgtttaaggtctggaaaacctgttttttttttttttttttttttggtcacagttcacatcccatccttttttgctctctactcagaggcaccttctagttagaaggaaaaaatacggtggcatacttggctccctttcctttgaatttggaatctcataattttgtaaatgacaggagatctgccacattgtgctctgtgagttcagattatttgtccccctactcctaccccgtggctgtcactttctaaagttaatgggttgggtctatttcctttcttggaggaactgtggttgataattataatactcttttcgctcaccatttaaaaatgatttttgctcccttcattagatatgaagttaagtgacttgtgatcaagccatactttaccatcttttctagaagtctgactgcatgttttgatgtggtgttatttgactcataaaggttcattactattatttcttcactattagatgtaccttttactgtatatactgtgtatatatacacataccacatatatctataatatatataacctaaataccacacaactcaagatatttcttcaagatttaaacaccaataatatcacaactatatttcctccatctaatctcctgcctttccctcatagataaccagtatctttaattttgtgttttgcttttcttgccttttatttgttatattttttatttttatttttgtagagatagggtcttgctatgttgcccaggctggtcttgaactcttgggctcaagagatcctcccaccttggccttccaaagtgctgagattacagtcatgagccattgcatccagcccctttcttgcttcttaaaattaagtgttaacactttatgtaagtctaactactatgctatgtagttttacttgtttttaactttataaaataatatatatgtgtgtgtgtgtatgtatacatacacacatatatgttttgatttttgactcaacactgtttttaagattcatccatttgtggcaggtagctatgtatttcattcatttttcactattttatgatattccactatgtgtatgtttgctataatttacttatctattttcctgttgacaatttacacatttttgttattatgaacagtttttaaaatatttttaatgtgtcttcaggcacacaagtgctaaaatttctcaagtcaagtctgtatctagaaatgggtagggtatgtgaatgtacaatttaacaagagaatgccaaattactttaccaatttacactctcaccagtaatgtacaagagaacatgttgagtttctttctttctttcagcagtagtaaggttgagcctttcttcatatgttttctaatcataggtttgtaaaatgatttgttcatatctttcgctcatattgctattagagtatttgtctttttctcattggttctggttctttatatattcttgacttgatatcaaccattatttggttatttatattgcaattatcttcctctagattattgttcctcttttcattttctttaaagtggttttctgatgaacaaaaatttgtagttttaatgtagctaaatttaacaattttactttttttttttttttttaagagacagggtcttgttctgtcacccaggctagaatgcagtggtgtcattatagctcactgcagctgcaaactcctggcctcaagtgatccttccactcagcctccccagtagttaggactacaggcatatgccaccatgcatggctaatttaaattttttctgtagcgatgaggtctcgctatgtcacccaagctcatcttgaactcctgacctcaagtgaccctctcgccttgacctcccaaagtgttggggtggcatgagccaccacacctggccaacattttatagttagtacttttccttgtctcatttaagaaaactttttctgcttgagggttagaaagatattcatctgtatttttttttccataggatttgaagttttgcatttgacatttaattccttttagtgtttggtgtgaaggattcatttttgttttcgttttccaatttttcctgtttgtttttgttgaatagtctttcttttgcccatggtagtagtctcacatactacttctggtagagcaacgtcctctttttaaagtttcttcttctgaagtgctttgactatgcctagctctttgcccttctatatgatatatataataacttggaaattttcataacaaccagactgagatttttattgaggttggactaaatctattgttcgatttgagagaagagataactttgtgatattgtctttctatgcatgaacatgggatatttcttcatttatttaggtcatctttaaggttctttagcaaagttttccaatttgtaggtgtaggacttttatatcttttgttaaatttattcttgggtatttctttttttctctgtaaaaggcatattttaaaatatatgtttcctagctgtttgttactagtttgcagaattacaattgatttttgtatattgatcatgagatccagccatgttgctaaagtcttttattattttgggggaatttcctataacttctttagagctatctctgtggccaatcatattatttgaaaaaatgagagttttagccgggcatgacggcgggcgcctgtagtcccagctactcaggaggctgaggcaggagaatggcatgaacccgggaggcggagcttgcagtgagccaagatcgcaccgctgcactacagcctgggtgacagagcgagactctgtctcaaaaaaaaaaaaaaagagagtaaaaaaaatgagagttttatttccttgtttctaatcattatgcttctaatttattttccttatcttattcgactggtcataacctcaagtgctggttttttgtcttttgggggatggtttctttcactattttttgaccccacctctgatggggtctcactccgtcactcaggttggagtacaatggtgtgatcatagctcactgcagcattgaacttctgggttcaagtgatgcttctgcctcagcctcccaaatagctaggactacagatgtgcacattatgaagcctagctaattaaaatttttttttttttttttttttttgtagaaacagggcctagttatattgtccaggctgctcttgaactcttggcttcaagtgatcctcctgcattggcctcccaaagcactgggattagaagagtgagctgccatgctcagctcagttttcccctatttattacacttttttttccttttacttgtttgcatttctataatttatttattttagtggcttatctatacattttaataagtatatttaataatgaatgatgttttatcctcccttctcgtcagtaagataattttagatcactttaattctgatcttcctccttctgacttactgttcctccttctgacttactaataaaaacttacttccttcttctgacttattgataactcttatattatcattttagtagccattctaataaccttttttcattcatgtttttctcctctcaacttactcatttcagttctttctttttttaacccctaaaaattagactcctttattattttattgagactatgctttgtctggacttacctttatgttaccattctttttgttcattttcccttttttgcatttctcttttttgggggatcatttacctatatctttaaatcctttataagttcttttagagaagttctctttgtaaacttcccctgggcttgtttcttataaatgttatcattttccctattggtattgagtgattgttttgctgaatacacaattttgggtgaatagtattttatttatttatttttttttttttttgaggtgaagtcgtactcattgtgtcacccaggttgaagtgcagtggcacgatctcggctcactgcaacctctgcctcccaggttcaagtgattctcctgactcagcctcctgagtagctgggattacaggcatccaccaccatgtctggctaattttttttatttttttttttatttttagtagagatggggtttcaccatgttggccaggctggtcttgaactcccgacctcaagtgatctgctcgccttggcctcctgaagtgctgggattacaggcatgagccactgcacccagccttttcttatcattttatatgagtaattccactgtcttctggcttcattgttgtgagatctgctgctattctaattatcattctttgttaggtcttctgtgttttttctctgctttccagatcttctatttatattcatgccctaaagattcactacgatgtgagaaggcatgattttatttttccttatcctatttgggatacattgtgtttcatggatctttgcattcatcattttcatgagctctgaaaattctcagtcatcatctctttaaatattgcttctttctattctctccaatttcatcctttaggactccaatcagatgggtgtcttttttttttttttttttgacagggtctggctctgttgcccaggctggagtgcggtggcactttcttggctcactgcaacctccacctcctgggcttaagccatcctcccacctcaacctcctgagtagctgggactacaggcatgcacgaccatacctagctaattaaaagaaattttttgtgtgtgtgtggagacagggtctcgctatgttgcctaggttggtcttaaactctgggctcaagcgatcttcccactttggtttcccaaagtgctgggattacaggtgtgaaccatgtttatccttataattgcattatttgtttttgtaaacattctatacctagctattctgtattttcaacatctgctgtccttgtagggggtgatgatagggttgttgtctaaatctgttgtttcttctgattctcaatgatagtgggtttgccttcttccttgcttggtggtcttctttctttgtttattaaattttgctaaagaaaatcttcaaggagtctttaggcaataacacttctgagtatttaacatgtctttattttacttacacatgtgagtgatagcttgacccagtataaaagtctaggttgaaatcactttctctcagaattttttttcttaaagaccagtatgatagtactctcagatttttttttttcctgagatggagtctcagtcgctctgttgcccaggcaagagtgcaatggtgccctctcggctcactgcaaccactgcctcctgggttcaagtgattctcctgcctcagccactggagtagctgggattagaggtgtacgccaccacgcctggctaatttttatatttttagtagagatgcggtttcaccatgctggccaggctggtctcgaactcctggcttcaagtgacccacctgccttggcctcccagagtgctgggattacaggcatgaaccatcgcacctgccctacttacagaatttttaaagcatttttttcattgtcacttagtttttagtattgctcttaagaagtctgatgccattttgattcatgatcctttttggtaggtttttagatcctctcttgcttcccagtgttttaaacattctgtattatataccttggtctgaagccctttttcatttgctattctggcacacccaatgagaactatcaacccagaaacgctgttcttcattcttagaaagtgtctcttccttgctggttcagtggctcatgcctgtaatcccagcactttgggaggctgaggcgagcagatcacttgaggtcaggagttcaagaccagcctggccaacgtggcaaaactctgtctctacaaaagtacaaaaattagccgggcgtggtgatgcatgcctgtaatcccagtcactcaggaggctgaggcaggagaatcgcttgaacccaggaggcggaagttccagtgagccaagattgcaccattgcactccagcctgggcgaatgagtgagacactgtctcaaaaagaaagaaagtttctcttcctttttaaaaaacatttttcatatttttaattttttttttttttttttttttttttagagatgaagtctcactatgttggtcaggttggtcttgaactcctggccaaaaaattcttcaagcaagagcatacttcctcccagagagctggtttactaccacaccactgggagctgatttattaggctggggcccccacaatgttagtgtgtagagatatgagttctcctaaagagacttttccaaatttcttaccagctgactggagaatattgtaggagtgaaatatgagaagagaaaccgaggggctaatttttttcttttgcaagctttcacttacattttcttcttccagctttgcctcacccttcctagacactgtctttggtatccccaagtcccatgtctttttctttcattttctttagaatgacactctatacttctaggtggtagtggtagtgaaatagttattttgttgctcagggcgggaagcagtcatgggcatcttgatacatctgatttcagacttttagccaatccaccaattgtcagtaccatgcctcaatcccagcttccactgtgccaagttctgagcctcttaagcattctttcgggctaaatcagttcactcattgttaatcctgtttgtagacactgtgggctatagctccatgttgcttaatcatgcactactcctccgtctgctttctagtttccaaaaacttgttgaaatgtattgtctggttccttttcctctgctgttctctttgttcctgtggtttcatacatttgaaaaattcctatattatcattttagtaaccaatatacaattttttttttttgagacagagtctcgctctgtcgcccagactagagtgcagtggtgcaatctcggctcactgcagcctctgcctcctgaattcaagcgattctcctgcctcagcctcctgagtagttgggattacaggtgcgcaccaccatgcccggctaatttttgtagttttagctgagacggggtttcaccatgttggtcaggctggtctcgaactcctgaccttgtcatctgcccgcctcggcctcccaaagtgctgggattacaggcatgagccaccgcgcccggcccaaatatacaaattttaacctaaacactcttcatcaattttgaatggaacttggtacattttttcagccttcatggattggccttcttctttctctaccccacacccccaaatttcagacaagttttcttctattttgtctccgattacctcctatccagctagtatttatttttcagagacattcattactcttcgactagatctcaaccctctgtttctctccattttctttctttctttctttctttttttttttttttgagacagagtctcactctgttgcccaggctggagtgcagtggagtgccgcgatctcggctcactgcaagctctgcctccagggttcacaccattctcctgcctcagcctcccaagtagctggaatcacaggctcccgccacgccaccacacctggctaattttttgtatttttagtagagatggggtttcaccatgttagccaggatggtctccatctcctgaccttgtgatccacctgccttggcctcctaaagtgctgggattacaggcgtgagccaccacgcccgacatttttttttttttttttttttgagacaggatctcactcctgttgcccaggctggggtgcagtggcgctatcacagctcactgccacctcgacttcccaggctcaggtgattctcccacctcagcctcctaagtagctgggattacaggcacatgccaccatgcccagctaaatttttgtgtttttagtagggacaaaatttcatcattttacctaggctggtctcaaattcctgggctcaagcaatctgcccgccttggcctctctaaatgttgagattacaggcgtgtgccactgcacccggcctttgtttctcttcctattacttagttttcattttttgactttatattctgtcctctgggagagatttccaaagttatcttagtagtggcatattaacttggggatggctgaagattaatttctaaggagagagtgatccagaaggataaatatctgtacttatgatttacatgaatgcctttctgagtgtctgtggttacagctatctcttaatatgccatattttgtaagagtttatatggcaagagttataaacagct

SEQ ID NO: 1167 - DNA, 2589 bp, Homo sapiens
cggcccgctggagaggaagcccgagagctgccgcgcgcctgccggacgagggcgtagaagccaggcgtcagagcccgggctccggtggggtcccccacccggccctcgggtcccccgccccctgctccctgcccatcccagcccacgcgaccctctcgcgcgcggaggggcgggtcctcgacggctacgggaaggtgccagcccgccccggatgggcatcgtggagccgggttgcggagacatgctgacgggcaccgagccgatgccggggagcgacgagggccgggcgcctggcgccgacccgcagcaccgctacttctacccggagccgggcgcgcaggacgcggacgagcgtcgcgggggcggcagcctggggtctccctacccggggggcgccttggtgcccgccccgccgagccgcttccttggagcctacgcctacccgccgcgaccccaggcggccggcttccccggcgcgggcgagtccttcccgccgcccgcggacgccgagggctaccagccgggcgagggctacgccgccccggacccgcgcgccgggctctacccggggccgcgtgaggactacgcgctacccgcgggactggaggtgtcggggaaactgagggtcgcgctcaacaaccacctgttgtggtccaagtttaatcagcaccagacagagatgatcatcaccaagcagggacggcggatgttcccattcctgtcatttactgtggccgggctggagcccaccagccactacaggatgtttgtggacgtggtcttggtggaccagcaccactggcggtaccagagcggcaagtgggtgcagtgtggaaaggccgagggcagcatgccaggaaaccgcctgtacgtccacccggactcccccaacacaggagcgcactggatgcgccaggaagtttcatttgggaaactaaagctcacaaacaacaagggggcgtccaacaatgtgacccagatgattgtgctccagtccctccataagtaccagccccggctgcatatcgttgaggtgaacgacggagagccagaggcagcctgcaacgcttccaacacgcatatctttactttccaagaaacccagttcattgccgtgactgcctaccagaatgccgagattactcagctgaaaattgataataacccctttgccaaaggattccgggagaactttgagtccatgtacacatctgttgacaccagcatcccctccccgcctggacccaactgtcaattccttgggggagatcactactctcctctcctacccaaccagtatcctgttcccagccgcttctaccccgaccttcctggccaggcgaaggatgtggttccccaggcttactggctgggggccccccgggaccacagctatgaggctgagtttcgagcagtcagcatgaagcctgcattcttgccctctgcccctgggcccaccatgtcctactaccgaggccaggaggtcctggcacctggagctggctggcctgtggcaccccagtaccctcccaagatgggcccggccagctggttccgccctatgcggactctgcccatggaacccggccctggaggctcagagggacggggaccagaggaccagggtccccccttggtgtggactgagattgcccccatccggccggaatccagtgattcaggactgggcgaaggagactctaagaggaggcgcgtgtccccctatccttccagtggtgacagctcctcccctgctggggccccttctccttttgataaggaagctgaaggacagttttataactattttcccaactgagcagatgacatgatgaaaggaacagaaacagtgttattaggttggaggacaccgactaatttgggaaacggatgaaggactgagaaggcccccgctccctctggcccttctctgtttagtagttggttggggaagtggggctcaagaaggattttggggttcaccagatgcttcctggcccacgatgaaacctgagaggggtgtccccttgccccatcctctgccctaactacagtcgtttacctggtgctgcgtcttgcttttggtttccagctggagaaaagaagacaagaaagtcttgggcatgaaggagctttttgcatctagtgggtgggaggggtcaggtgtgggacatgggagcaggagactccactttcttcctttgtacagtaactttcaaccttttcgttggcatgtgtgttaatccctgatccaaaaagaacaaatacacgtatgttataaccatcagcccgccagggtcagggaaaggactcacctgactttggacagctggcctgggctccccctgctcaaacacagtggggatcagagaaaaggggctggaaaggggggaatggcccacatctcaagaagcaagatattgtttgtggtggttgtgtgtgggtgtgtgttttttctttttctttctttttattttttttgaatgggggaggctatttattgtactgagagtggtgtctggatatattccttttgtcttcatcactttctgaaaataaacataaaactgttaaaaaaaaaaaaaaaaa

SEQ ID NO: 1168 - DNA, 1608 bp, Homo sapiens
atgggcatcgtggagccgggttgcggagacatgctgacgggcaccgagccgatgccggggagcgacgagggccgggcgcctggcgccgacccgcagcaccgctacttctacccggagccgggcgcgcaggacgcggacgagcgtcgcgggggcggcagcctggggtctccctacccggggggcgccttggtgcccgccccgccgagccgcttccttggagcctacgcctacccgccgcgaccccaggcggccggcttccccggcgcgggcgagtccttcccgccgcccgcggacgccgagggctaccagccgggcgagggctacgccgccccggacccgcgcgccgggctctacccggggccgcgtgaggactacgcgctacccgcgggactggaggtgtcggggaaactgagggtcgcgctcaacaaccacctgttgtggtccaagtttaatcagcaccagacagagatgatcatcaccaagcagggacggcggatgttcccattcctgtcatttactgtggccgggctggagcccaccagccactacaggatgtttgtggacgtggtcttggtggaccagcaccactggcggtaccagagcggcaagtgggtgcagtgtggaaaggccgagggcagcatgccaggaaaccgcctgtacgtccacccggactcccccaacacaggagcgcactggatgcgccaggaagtttcatttgggaaactaaagctcacaaacaacaagggggcgtccaacaatgtgacccagatgattgtgctccagtccctccataagtaccagccccggctgcatatcgttgaggtgaacgacggagagccagaggcagcctgcaacgcttccaacacgcatatctttactttccaagaaacccagttcattgccgtgactgcctaccagaatgccgagattactcagctgaaaattgataataacccctttgccaaaggattccgggagaactttgagtccatgtacacatctgttgacaccagcatcccctccccgcctggacccaactgtcaattccttgggggagatcactactctcctctcctacccaaccagtatcctgttcccagccgcttctaccccgaccttcctggccaggcgaaggatgtggttccccaggcttactggctgggggccccccgggaccacagctatgaggctgagtttcgagcagtcagcatgaagcctgcattcttgccctctgcccctgggcccaccatgtcctactaccgaggccaggaggtcctggcacctggagctggctggcctgtggcaccccagtaccctcccaagatgggcccggccagctggttccgccctatgcggactctgcccatggaacccggccctggaggctcagagggacggggaccagaggaccagggtccccccttggtgtggactgagattgcccccatccggccggaatccagtgattcaggactgggcgaaggagactctaagaggaggcgcgtgtccccctatccttccagtggtgacagctcctcccctgctggggccccttctccttttgataaggaagctgaaggacagttttataactattttcccaactga

SEQ ID NO: 1169 - DNA, 30848 bp, Mus musculus
  misc_feature (6564)..(6583): "n" at positions 6564 thru 6583 can be any base
  misc_feature (20848)..(24868): "n" at positions 20848 thru 24868 can be any base
  misc_feature (27132)..(28373): "n" at positions 27132 thru 28373 can be any base
caggggcgggcactgctgcttgtctcgtcacgattcctcgtgattcatcttagcatgtcaagtctgaaaatgtagagtgccactctgcccgccctatgggtggggttgcccagcccctccgttagagtgttgtccacccgattcacctactgatgtgccttttcctttcttttttttgtttttgaggtccagggaactgatagcagggccttgtgccttctaggccagagctctaccagtgggccgtgtctccaactccttctcattctgtgactagtaagaagcgtgcaaaggcaagaacatcctgtgcccagagatggatgttatctatggcttctgcagctttgatgctccttgtctgagtctactgtgtgtgtgtatgtgtctgtgtgtgtctctgtgtgtgtgtctgtgtgtatctctgtgtgtatctctgtgtgtgtctctgtgtgtgtctgtgtgtgtgggtatgtctgtgtgtatctgtgtgtgtgtctctgtgtgtgtctgtgtgtatctgtgtgtgtgtgtgtctgtgtctctgtgtgtgtatctctttgtgtgtctctgtgtgtgtgtctgtgtctctgtgtgtatatctgtgtgtgtgtctccgtgtgtgtgtctgtatctctgtgtatgtatctctgtgtgtgtctgtgtgtatgtgtatctctgtgtgtgtctctgtgtgtgtgtctctgtgtatctctgtgtgtgtccaagtgcacgcatgtatgtgcacaagtctatagaggccagagatcaatgttgggtgccttcctcaattgctttacagcagcagttctcaacctctctgggggttgaacgaccctttcaccaaagcccatgagaaaacaccgatatttatattacaacgcgtaacagtatcaaaactacagttatggaatagcacaaaaatagttttatggttgggggctcaccacaacatgaggaaccatattaagggtcgcagcgttagggaagttgagactgggtatctcagtgagcctggagcttgcccactgagctgtgggggccagcaagctccaaggatccttctgaatgccttcccagaactgggagcacaagtgcctgctgttctttaacatgggtcctgggaattgaactcagatcctaaagacagcacagtgagtgctttgccaaccaggagccgtctccccagcccagcctgctttctttttgagggagcacgtgttttaatataaacatggttgtatttaggtgagaagtttaaatatgcgagaatccactgatgtgtgcttactctctgcacgcagcaaatagccacccaacccccgcgccccccttttaccttctgtcctgtccttctgttcattacctctcttcttcccaaagcgacacacggtgggtgaagatttatgactgtcttcccagaattttattatctgtgttgcccgggcaaattttttccttttttgtttctttgtgggccactttcactcctgttcccttctcatgggcttatgattttttttttctcccctgaaagagaatcttctttctggttgcttataagctagtggttaggttgttttgttttgttttgttttgtttaaagggcagatggtgctagtattgacctacttttagatgtggtcatttaccctaaccttgctcggtcaggccagtatgaacacagtcttaatcttctaacactgtgtttcatattttctgtctctcaaagtccttgtattcggtgaccactcaacacagtaatgatgttgacattgacagtgagagcatccacatgaccagagacctggtcccttatccccctcccaggatccctcagttctcagcgggtgctgggaggtttaaccatttgcaatgctggcaccttgcctggaacttttcagatcagaaccaatgtttatccattgagtccatctgccaactgtccctagcctttgctaaaaccagagtctcccaacactgggtttctcctctctctttaaattattaagtgtgacaacgtgtgcacaagcacagagggtgacatgacaactcaccacaagttctcaggacacaggcggtgctgggcagtggcaacagggcactgcacagtcagggcctcttggcactgagagatggggtcatcttggtaatggcattaagggcatgtgccaccaggcctagcttttttctctttttcagttacagctttattgagatagaatcacgtgttataaaattcacctttttatttagtttggggtgtgtgtgtctgtctgtctgtaccatggcatgcttgtggaggtcagatgacagctaatggatgtttgctcttcactccactatgggtttcaggggtcaaactcaggtcatcagacttgaatgaccaatgcttttacctgagagccatttccctggccccatcaacattctaaaatgtccagaattcagtctcccgggcgttgtagtccattaccactgtccagcccagccttaatgtgttttcctcacttcctcgcttccccaaaagttcaacctcactcttttctgtggctctgaatttgcctattgtagaatcacagtgtagttcaggaagtttgtcctccacagttttcagtgttctccttctgagttgggggaacaggactcacagtgcccctgccccacccttccataggttcttgtctgtaaagcccttgtgtcagcgggactgattaagaaatcagagtatctgggactggagagatgacttagcaattaagagcactggctgctcctccacagatcctgagttcaagtcccagccaccacagggaggttcatagccatctataatgtgatctatacataaaaagggaaggaaggaatgaaagaagggaggaagggagggaggaaggaaggaagaagagtattagggccagcaaaatgactcagtggataatgatgattgccaccaagcctgacatcctgagtttgatccccagcacaacacacagtaggagaacaaaccccctacaagttattctctaactgccaaaggcgtgctatggtgtgtgcgcacacacgtgcatacgcgtgcgcacacaaatgcaataaaaataagaaaaagaataccttattcttaaaggaaggtaacttttgtcctgtggagcattaggaagcaggaggatagcaggagctgctcatcaatcagatgaagtttggaaaagcttgttggtggggtgaagatggaggtggggagaaggaagtgctaagtgtaagtgtgaaagaatcattggctctcctcaggggctgaccacactcaggctctgtgttacatacttacacacacacacacacacaactcagaagttatagaaactccgaatagtaaaaactaacctggcaaaccatatctctctgtgagtgttttaaaccctcatctctcctcaagccagaatttgttcagtccattggcagagtttcgctggaagcttccagcaagagagcctgctttccgccagggaagttacagcaaaacagtctctggtgttctgaaaaccttcagagtaatggctttgtttgcaaacgcttctgcttggggctgggagtgtgcctcagttggtagagctctcgactaacaggcacaaattgacccccagaactagagtaacagaacacacctataatctcagtacacaggaggtggagcaggaggagcaggtattgaactacataatgagtccagtgccagaggcaagcctgggctacccagagctgacctaaatatatttgttaaagaaaaagtttctgatagaatgttagctattgatacaacataacactgatcaccagcatagtagatatcccttcctttggtttccaataagcctgtgaagttgaggtttttataaacaggtacttctggccccttatttaaccttctccacccttggtctaggtgttctgggtcaacataggtgctgggtgtgtttagccggtatagcactctgtgtccaggccctggccaagctgtgaactccacaagtgtgactgcacagagctcggctgactgtcaacactgtcctaaaaatatgatggtgaatccagttcccagggtttagagcggcccctgtgatgatttaccagcgatacaaaccacttcccttgtcagaatgtcacgaactgaaaactgagctgccgggtcaataagcagagaagagcatgcgcatgcgcggggtaggctgtctccatgcgggtggaggagccgcccggtggctggattgaccatgggtacagggccggtgggggcccccccacttacacctgtgtgcacaatgtttcctggtgagtgtggagagttctgacaggcatgggagaaaagcactaaccagaccacaggtcttgagcatttaaactggtaaggagtgggaagagttttttgtctggagtgagttacttagcatttaggaagtggaggcaaggagctataatgggtacaacagtaaccttcataaatctatgtggataaaacccacagtttaaaagtaaaacggacatgactgtactatttagtgtggatatatatatacattttttttattttaactgacacaactgggaaagggcatgctccctcatacagtgtgcgatgatcagatcagcttaattgtcagatctgtcactcaacattgatgatgtgtttgtgctgggagcgttcagattccttctcctcgtgacggatagtgagcaaaatccacaccggagctctattttctatccctattaaagtacttttatgtcgtgaaactatgctgtatttttcaagataaggcaattaccactttgtatttaccagctattatccttcaaatactgtactattaaaaaaaaataccatgacacgctcagaattggaaacataaaaatattctgaccaaaaaattaatatatatattttttttctgacaaattctcagagctcagcattctactctttaataaaaactaagaacaaatataaaacctgaaacacaaattgcctttataccatgcagctccctagagttcttcttctgtttctgcaatattgtttttacatcttttgaagctggacacacctttactacccacatgagtgtaagtgtgaggtaaagataggtggatttctgtgagttcaaggttagctggtctacatgttaagttgcagaccagccaggtctactgagtgagactcagtctcaaaaaataaacaaaggcgtttgggttttttttaggtttggtttggtttggtttttgtttgtttgtttgtttgtttgtttgagataaagagagagagagagagagagagagagagagagagagaacgtatcatcttgtaaacccaggctggccttaaaccttgacctgtttaccaagtgctgggattgcaggtgtataccaccccattaagctgtttctctcttaaaacaacaataaactccggaaatatgctcagccaacaggacaggtaatagatttgtgtatttgttcatttagcctatcggttccctaccagtgtaggtcacaacccttttggggattgaatgactttctcacagggtcatctaagaccatcggaaaacacagatatttacattacaattcataacagcaaaattacagttatgaaggagcaatgaaataattttagagttggcatgaggaactgtattaaagggttgtagcattaggaagagtgagaaccacagatttagcaaatacttgtttactgctctctgtgctgggctgctacacatgcattttggggacagggcagttaagacatgtcctcttctattgcggttcagtggaaggagacaaattaaaacaaaagaaaactagacagaaaaatgacaggcctgtgtgatgaaagagagatcacccacatagagtcacccgagttatacagttatagctgaggagctcattaaagatgtttcattctacactgtagaatttcttcttcttttaaaaaaaatttgtttgtttgtttgtttattatatgagtacactgtagctgtacagatgggttgtgagccaccatgtggtcactgggaattgaactcaggacctttggaagagcagtcagtgctcttaactgctgagccatctctccggccctacaccgtagaatttcatactcatgttatgttctgtaataactttgaaaagagctgatctgaagctggagagacgactcagtcgttaagaggctgcccttccagaggacctgggttgtattcccagcaaccacatggcaactcacaaccatctgtaactccagttctaggagatctgaccccctcttctggtctccacaggtactacacacatgtggtccacagaccaacatgcaggcaaacacccacacattaagtagatcggaaaaatatatatcttaaaaaaggaaaaagcagacatgtccaattgtgtttgctcatatttgtttattaaagcaacaacaacagaatagtactgcttatctgccaagcacctatgtacataaagttatcgtgtgtttagtaaagatgatgcatgccagacagnnnnnnnnnnnnnnnnnnnnttggtgtctgttggaatcactcaaattttcattaagggagctactgtgaggccccacttccatcttgtcctagggctgagtgtgtgggcgtgcatatgtggatctgagtgtgtgtgtgtgtgtgtgcgcgcgcgtgtgcatgtgcgtgtgtgtgtgtgtgtgtgtgtgtgtgtgtatacttatggaggcttgagctattcacctcttaattttatttttgaaacagggtctcactctgttgccctggctggcctgaaactttctatatagaccaggctgaccctcaaactcatgaacagccacctacctctgccttgtgactatgacaccatacgcagccccttccctcgatgtcttttgagagagtttctaatctcctggagttcctgtctccatctcccagctctgagattacaagtgtccaccaggctttttacttggattctaggatttgaacttgggtcctcttgcttgcaaggcaaacactggctgaatcaccttcctagcccagtctgcatttgtttgttttcatatatttatgttgacttgctgtgtatgaatgttctgcacacatgtatatttgtgtactatgtgcatgcagtaccctggaaggccagaggagggcatcagatactctgggtctggagttacagatggttgtgagccatcaggtgggtgctgggaaacaagcccaggttctcctcaagagcaacagtgctcttcaccactgagccatctctccagcacccccctccttgttcttaactaagaaagagtgctacccgagccccactcttcgtctgtcaggcctctgcatgcttaaatctccagtctcctccactcccaatctctttactcttcctccaaaatcatgagctgctcctggtctgatttggagacttcactaaaacattgtacagttgtcttccagatgtttgactgggatgcagaattgctctcctgttccagttttcctgtgatgaactcacacccactgaactttgcagtattggaaaatctcactgttatctcagccctggagcctgaaagctccgagttaaaccatccaagtatcctatagccgcacacacatctaaaataggtaaccaaccggcacccaccctacacctcactgctagctaactgacctgccccataaatagctcagtgttactcgatccgacagccactgctcacagagagatctttgtttcctggcacacatgtgcgtgcagtctctgggagtcaacaaaacccaggtccagtgcactggaccatggctgtaacacaatccttaggcgaactgtgaaaatcagtagctaagtcattttgagattggattcaagacgcccagatccgtattaccaaaagcagtgttacagcaagtctggttttaatgtctgaagttcctattaacatagcttctccactctggggaatcccaggtctctgccaaatgcacttaattctcaggtctgtctgaaagggctcctagtagtttcagaaagcatctatttgtttgtttgtttgtttgcttgcttgcttgcttgcttgtttgtttgcatacactgtagctgtcttcagacacactagatcccatgacagacggttgtgagctatcatgaacttaggacctctggaagtatagtcagtgctcttaactgctgagccatctctccagcccccagaaagccattttctaaagcgtgtttttgttggtgcagcttgttttggttttgatgttgtttctttaagaaagagtcacaggaagcccacgctggccttgaattcttgatcctcctgccttcacattctgagttctgggattaaaggttctaccacaagatcctgttaaaaagaaaaaaaaaaaaacagataatctcactattgctgggactagtggcgccaagcctgtagtcttaggttaaattagaagacagcaagtttagtgggccatggtggaacaggcctttaatcccagcactcggaaggcagaggcaggcagatctctgagtttgaggccaacctggtctacaaagtgagttccaggacaaccaagagaaatcctgtctcaaaaaataaaacaacaacaaaaaagaaataatataaaatgaataaataaatgaaataaaataaaatgatgataagttgggctggagagatggctcagcagttaagagcactgactgctcttccaaaggtcctgagttcaaatcccagcaaccacatggtggctcacaaccatctgtaatgagatctgatgccctcttctggcatgtctgaagacagctacagtgtccttacatataacaataaataaatctttaaaaaaaagatgaaaagtttaaggtcagcctgggctacagagcgagtgcatagtcagcctacacaacttagtgagacactgtctccaaatagaaagtccaaaaggggcctggaatacaggtcagccatggagctcttgcccagcatggcccaggtcataggttcaatctccattacaaaaggaaacaacaaaccctacagaaaaccagccctgccgctcaccattgtcacacagcaatccattcttctcctagtccacacatactatttctgtgttgaactgtatgtatgtgcaaattccatagcagtaactccagaggtgaaagaacattggggagcttggcctgataagcctctgctctgggtaagagaatggccactaagccactaagataacacacaggcctcagtctgtcccgagattctccggtctttcagatcctgttcaaatcttcctgttcatcttccatttcacaaaacccaaataccaaacctagagttagttttcagttcactccgccgatcattcacgatgactgttggaaaggatgcttataacccacggcggtttcaagcaaacgccaagaccaggtctaggatattaaagctgttggcgacgccttcctgaatgccgctggttttgatggttctgctgcaatagtctatgcttcataggtccatttggggcccttcccacggccatgctgagtgtctgcattttgaaaacctgacaaagctggaagtcagttcgagaatattgatcctgggtagctgagatggttcagtgggtaaaggcggttaccgagcaacctggcaacctgcgtttgatccctcgaacccacataaagatgcaaggaaagaaacagctccataaagtcatcctctgacctctacacattcaccgcggcacgtgtgcgcctgcacacacatcacatacgataataaagaaaaaaatttttaaagatttgacctttagtgtaccaaaaggagagaaagcattcattcacttttaaaccccgtgcatatttactccagtggctttgaagggaatggggacaaacaaacaaacaaataaatcaaggtctttgtttaacaggttgtgaaccatggctatgtggatacaggctcagcagctccagggcgatgcccttcaccagatgcaggccttgtacggccagcatttccccatcgaggtgcgacattatttatcacagtggatcgaaagccaagcctggtaggtgaacagcttctagatcatcttttgggaagtacgaggatattgaactttgatgagaaaaatgttctaactgagactttaaaagttgtgagtaacctaggcttagtggtccccacctgtaaccgtcatgatcctagctgaggcagaagggttgcaagtttgaggccagcctgaattgcagagtgaggccctgtccctatcttggaagaagaagaagaggaggaggaggaggaggaagaggaggaggaggagctctgtgtgtcgggctgggtgtgtagctcagtggtaaagtacaggcatgaggctctagactcagccctcaggacctgtctccaagaaaagctgtttgaaaatcttcatgtaattcataaaaaggtattcagccttcttttagatgcagggagacgaaataattcttggagttttaatttttgttgttttttaaattatgtatatatgtgcacgtctgtgtatggatgcgtacacatgagggcacctatctgcagaggccagaaaacagctggagctggcgtttcaagtggttgcgaaccacctggtgtggccgctgggatctgaactcaggtcctcgggaagagcaggaagctctcttaaccacacaggcctctctccagcctctgagcttgccttgttttggtttgtttgtttgtttgtttgtttttgagacaaggtctctcactttttgagacaggccctggctgtcctggaactcaaaagtgctgagattaaaggcaagaaagaaccatgcctggcttttttttttccccccaaggtaaagtttcaccgtgtagttatgagtggcctgcattcactatatagaccagactagtcttggactcaagatcagcctttgtctcccatgtgctgaaatttatatcttataaatcagatatttaacatattgatttaataatcaaaacattcatagctctctggttttttgtttttctgagatagggtctcatactatatagctctggctgtcccggaactcactaaatggttttttttttttttctttttaaaaactaataatggttacatttcagtgttgacttagccaacatttttatctctattatgaattatatacttgagctttaaaattgttagatcggtataacacagttcagtagcaatgcatcttaccgtgcagtgctaggacaaagcttacaacacacgagacagctgtaccactgagcggctgcctcctcagccctgccgcatcctcaccagccatcagcggtgcccagcagcgtgcagggcagggagcttgcccgtcgttggcctcagtctgtccgtgagtgtccaagttcatcacaagttcatcagactagccaggctttgaccagggtggtgagctcctctttggagagccagccttgttgctgctgggagaaggctgtccctacccactggagatgttgccttacagtaattgctacagcttgttagcaaggctccgttcagaaacaagcctgccgaaggaaggcaattaaaaaaaatcccagcttcatataattaagagggggaaaaactgactaaatatgagaacatcaaacacacctcaattagtccagtccttttccttttctttctgttttaatgatttgggagatttcggaaaacattaataggaagtttctgctgattaaaaatctcacttagaggctagatcagcggtagagcattcgtccagctaagcagactggctccataccacaaaagagagaacaaaagccaactttcgtttattcgagtacaacagcgcattcctgtaattccagctactcaggaagctgaggcaggggaattacttaagcctaggaactcgagacagtcctaggcaaatgggctttcagccagcagatctcctgagtagtctacttattgaataagctttgggaaattggggttgatattaaggaaaacgtgggttttaggtagggttttgttttttccccatagagaaatagagatatcaccgaagagtttccagctctccgtattgaagctgtcatgaagtctctgattgtaggctatggttgagtccaaattgagaaccagactcctgtgttctgttcaaagactggatcctctcagccgggcagtggtggcgcacgcctttaatcccagcacttgggaggcagaggcaggtggatttctgagttcaaggccagcctggtctacaaagtgagttccaggacagccagggttatacagagaaaccctgtcttgaaaaaacaaacaaacaaaaaaagactagatcctttcaacagtgggctcccagtcagaacagaggagcaaggctgtgcctgcagcccgtctagccttccacttcatacatattttcttcaacccatagagaatacacttctaaaaattggctttgtccctaccctttccagacacaggttgggtggtctctggtaaggtcgtctcagggctttggtgcgcgtctgcctagctgtttgccaccagccacttgctaacttcagggatttgtgggtggctgtcttttagctgccgctggctctcttccctggctgtggacctggtcagcagtaattagatattatttcagcctgacagctgtttggtttgtcagcgtgctaagtcacttaagtattacccagcagcaattgttgcctaacttagtagacaaaaatcttttaaggacaaaaagaaagaagataaggaggaagtggacccaacccctgtcaccagctgaacagctcaggatgacacgaggtctggggactggcttctcgccttcactggaggagtcagtgttatttccaggtcccatatctgcagtgatgacagactattctcctgggtgtgaatacttgtaggcatcttctgtcctgatgcctcccttccagggtcccttaggaagggcagtgactgggggcctggagccagtcaaggttggaaagaacatgcagaactatataccctgtcccacataccctggagatacgagtataaactggaagttagaagaccccttattccctttattcctaggagggggtgggttaatatcagagtcagtcagtaaagggaagggaggaaggagtatttagagaaagaagtgtaaagctcagctaaaagaattgtagagtcaggcattgtagacatttagccaacttatgtcggggtgtttcttaacccgtgaattatagaagaaatcacgttccagactcccatgatggctcacacctataatcccagcacccacaaaacaaatgtagtatgtaaaggctgcatgtgtacaggctcctatgcatgtatgtatacagattgtgtaatttttttcccctagggactcaatagatcttgataatccacaggagaacattaaggccacccagctcctggagggcctggtgcaggagctgcagaagaaggcggagcaccaggtgggggaagatgggtttttgctgaagatcaagctggggcactatgccacacagctccaggtgggtacaaacactggccacacttaggccctgccctcttgaggacttcttcatttaattttctgtagacacgtgttctgatctttaacccggcatcgtagaaatgtgtgtttcacgcacatggttttgattggctttgtggttgcggctgttaccttctttgagacaagagtctcaccgtggggctggagagttggttctgtggttaagagcgcttcctgcttgtcttagggttattattgctgtgatgaaacactatgaccaaaagtgaattgaggagaacaccgtttatctggcttacacttccacatcacagttcgtcattggtggaagtcgggacaggaacccaaacaaagcaggaagttggtggcagaagctgatacagaggccatagaggaatgctgcttactggcttgctccccattgcttgctcagcctgctttctcatagctcccagaaccaccagcccaggggcggccccacacacaatgggctgggccctcccacatcaatcactaattaacaaaatgccctataggctttcctacaacccaaacctatcataagaaggcatttttctccactgaggcgccctcttctgatgactctaatttgtgtcaggttgatagaaaaccagccagcgtgctgctattgtagaggacctgggttcagctctcagcacccacatcaggaaactcacagtaacctggggcttggagccctcttctgacctcaacaggcatccacccacaagtgacatacagacacagaaataaaaatagaaactaatctttatttaaaaagaaatgaaaagtttcactatttaggtcagattggcctcaaactggggatcctcctgcatcaattccactccacccccagtatgggctgtaggtaagcaccactcccagccatgacttttactctcttttaacttcttatttcaaaataattttgaatttgcagaaagttgcagcagaggtacaacaaggcccccttcatatgctcaggttcatttacatcatcatctctctcacgctcctctctccctttcccgcccccacaccttcatgtacacatgtacacatacacacatacacactctcacacatacacacatactcatacaacacacacacatagttacacaatacacacacatacaaacatacacatacagatgcagacacatacacacacataccttcacgtacacatgcacacacacacacacacacacacatacacacacacacacatttctagttgcgagtaagttacatacatctctcccctgagtatctcagcatgtatgttctaagaacatgaacttcccttacagggtcacaatacagttattcaatttagtgtgtttaacattcacacaaacttttacttactattctgtctctattatccatttgtcaactgactcacaagtgtccctccagtccagggtccagtccaaagcctcatatgatatctagttgacatatctctttaatgttttatctggtttggtttcaactttgtgacgtgtctgttttggagatagggcctccatagtgttgtagcctatgctagtcttgaacgttaagcattgaacattaagcagtcatcttgtcccagcagtcctgtccacctttcccttttctttaacctgaaaacattcatttttcgaccttattttggctttgatattaacattttaaaataatcacttattcccttacttttaatatttttacattttatttttaaatttgtgtgtgggtatgtatgtgcacatgagtgtagtgccctcaggggtcagaagagggcatcacagcccctggagttggagttagaaatggttgtgagctgcctgaggtcggtgctgggaattgaactcgggtcttctgtgagagcattatgaggtagggcctcaccatgttgtctaagctgatctcaaattctaaataacggatgcattgtccttctgcaatgccccatccagagaaagaagatgccggtcttccctactgtgacagtaattctgattctaactgacaggaaatttcccagtcctgtgtcttgtctgctgtggccttttaaagactcacccgtttccaagaatgttgctgtagtgcttttggcattgaggttcagaaagtaaagcagccttaccttcttagtgcaactgcattttcataatgtctttctctccatcccgcccacaccggggaacagcactgcccatgactccatggttaccgcatctctaccatgagtgctccctgccctgggtccggttaacccacaacagagtggagcaaagtgatgtctgctgttgtcctctttcagagcacgtacgaccgctgccccatggagctggttcgctgtatccggcacattctgtacaacgaacagaggctggttcgcgaagccaacaacgtgagtgtgcccatggttgtgggagaggagttggggtgcccttcttgagccgtttccccctggatcccactttgttgaggtgacccaatatgcactagtgtctctttagggagctgaccttagctttataacttaagtgaggctacaaccacaaagcaaggtgaacatgtgcaaactaacttaaccaaagcaaatcagttttgtgttgaagcatgctcacaatcagggaaattacttagtagaaatttcttcacactctctgggccagctgctgaaggagtggatcatacctagtcacttaaacagccagatccacagggaccttgtgcatgcctcccccatcacttcctctgaggggctacagacacctaggagccttcgggtgtggcttcatccacggtagaagcaaatgggtagaagcaaatgatttcagcaccagtctgccttgagatagatacagaccatgttttattcccaatgtgtccccagcgaaatcacagtcatggtattggatcaatgagtgaatgtggaatcagggttatcatcatcaggaggaagacccaagtgacctctggggcatgtggagttctagtttctcaaaagaattgggcacacacatcctctgtgggacactcatgtggaggccagagctgaaacagaagtaggtttttaccgtgaagaaagcctgtcgagtcaaccgcctccactcgctttccattctaccccgattctcacatgtggcatttgtgatgtcttctgacctcaaatttaaccttgggggtcttagcttcacctagggattaagaccgaaggcttcttcccaccctcccacactggatctccccacctgtccccagggcagctctccagctggaagtcttgctgacgccatgtcccagaagcaccttcagatcaaccaaacgtttgaggagctgcgcctgatcacacaggacacggagaacgagctgaagaagctgcagcagacccaagagtacttcatcatccagtaccaggagagcctgcggatccaaggtgaggctggcagtggaatcctggaagctccgggggtgggagtaaggtctaggagcaagctctgaggaagcagaagagatcctggttccattctgagctgtgcctttgtctgagcagagtggaaccattcaggctgaagaaggagctgggtagcttagggagagaacatggcacctgatggggagagtgcagggtctcactcaggccttcctgttctcatgaagtttggggtcgctgtagaagatgtttcctttttgagatttaaggtgttcatgggctggagagatggctcagtagtggaaagcactggctgctcctccagaaggcctgagttcaattcccagcaaccacatagcagctcacaaccatctgtaactgtagtcccatagcggccaatgccctcttacggtgtgcatatatgcagacaaaatatgcatatatataagtaaataaatctttgccaggcatggtggctcacatctttaatcctagcatttggaatacagaggaaggtgactctatgagtttgagaacagcctggactacaaagagagttccaggacagccagggctattactcaggaactctatctcaaaaacaagcaaaaagcattcatagcttaataaatagcttacagaggacatattataattgtatatagtaaacattttctttttttaaagatttatttatttattatatgtaagtacactgtagctgtcttcagacactccagaagagggcatcagattttgttacggatggttgtgagccaccatgtggttgctgggatttgaactcaggaccttcagaagagcagtcagtgctcttgaccatcttgccagccccaaagtaaacatttttagagtaattgtttgtttgttttagacagggtttctctgtgtagccctgggtgtcctgagactcactttgtagaccaggctggcctcgaactcagaaatccgcctgcctctgcctcctgagtgctggtatcagaggcgtgcgcaaccactgccgggcctagtgtaggcattttatgaatgcagccttgctgggatgggaagtaggaagtacatcacatctaggagtgtgggtgtagctcagaggtagaatgctttcctaatgtgtgagagcctggcctccatccccagcactggaggatctctatttgtggtgcctgccattgagttgtatgcagttattcaagactttcctgtgaccctgtatgccttctggacagtgttccctagcctttgttctaaggcacacagaatttgagaattcttccaggagttgtggagcctccgcagcgctccctcttaaccctacgctttcttctctatgcgggcgtgcctgcctcagacagacagagggggctggggccatggcactagtgattaagagcactggcctcttttgcataggagttggatttggttcccagaatccacttggtggctcaaaactgtctgtaactccacttccgagtaatccaggaccctcttctaacctctgtgggcaccaagcatgcacgtagtacacagacatacacgtatgcaaaacactcatacgcgtgcaataaatctaacaccaattttaaaaataagactctcagaagaaacctgtccccacacccgcctaaggtctcctaaggtcatgtgtgtaaagcatagcgcattgctatgttgacattatttactgcctcccaggcttcccagatgataaatcattgagaaggaactctgtctattagctctgtgccctgaggccagcataaattacagttgcgggcttatcctggctgtcttagtgttgcttttgtccatcccagcttgtgtgtccctggggcaaggacaaggtcattgtgacatggttttcagaggccagccatgagcttcaatgagacatgcccgtatgcacaaattcttggcaagaccagaataaggatgctgggctactcaagggccaccggaggaaacaataatgccaggactccggtctttttctgggcatggagcaaggaacaagaaggtttgcaggcagtgatagtggacaggtagttcaacccaggacgtacttgatggagcagagccgatgaggactctatgtgactctgtgtcctgcttctgtctcccgggtctgtccattcgtattgaaaggtaccaaaagaaaaccgacgatgtagctcagttgggggagtgcttgcctagaatgcaaaaaaaaaaaacaaaacaaaaaaaaaaaaaaaaaacctggttttatccccagagcagcctcctgagccgctgtcaagagtctcccttcacagatggaagactgaagcgggaaatacagggatttacccaagttcgaccagctgataaaccacagggccacttgcacacataggctaacttcaaacctgtggggagggcaggatgccctctgtgtggggagtgtggaggcacacactactaagcagttgcttccccaacaaacacctgctcccggcctaggagaggccaggtcaggagaaccttgatccgccttctgagagagccccttcatcatgggacacccattgcgagctggaactctgacttactgttgatggggtgtctagatgaccctgagagtgggtgatccttcagacttcttactggacacaagaattgatggtggtgggtgtcctgtcccctcctccagctcagtttgcccagctgggacagctgaacccccaggagcgcatgagcagggagacggccctccagcagaagcaagtgtccctggagacctggctgcagcgagaggcacagacactgcagcagtaccgagtggttagtgcgtgccctgcgaccctctgccccagagggagctctgtcacctgagattcagggcaccaggtgggggacagagcctggatgggagcagggcccctctctcctggggtggagcgggtgtgagggggccaggccctgggttctaggccaggcactgagggatgctcgccgggagccagagagccgctgttccctcgcacaggagctggctgagaagcaccagaagaccctgcagctgctgcggaagcagcagaccatcatcctggacgacgagctgatccagtggaagcggagacagcagctggccgggaacgggggtccccccgagggcagcctggacgtgctgcagtcctggtgagggtgagaggtgggcggggtgggcagcttgggcaaggatgccagctgcctcttctgtccctgccgtggcgtgagcagcagatgcccactgtctgtgacagctctcactttagcagtatcttggctcttgatgggactcggctcttcagacctgtgccacctcccacaagggacagtggtgccttgggatgggcagggctacccttgagctggttggttccaagttggggccaccctgactgtcttctgcttttgaaaagtgggactctgctcagtgtgcctgtgcaggagagcggtggccaaggccagcacctttctggggcggggggtgctttggtgggaaggaggaagagtagcatgcatcttcctcccctggcctgggctggaacagcagccgccatccccctgaaggccccgggctccttgcaggtgtgagaagctggccgagatcatctggcagaaccggcagcaaatccgcagggctgagcacctgtgccagcagctgcccatcccatgccccgtggaggagatgctggctgaggtcaacgccaccatcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcactttttatggagtactgggcctagaccccagagccttgtgcatgctgggcaagcattctaccagctgaactataactatccccagcccatgatgaacattttcagaatgtctccatgaggaggggtccttattgcatgctgttagaagaacttaactctcagaagcgtgataaaagtgtcctcgttattcgacacatccaagtctgtctttctctagtgtgagactcttggctcttcaactgtcatctttagagaaccgggctttattgcaaaggcagggtttttatgagatcttccctgtgtgtgctgcaaaagcagagtttagactcctaaaaaataaaaaaaaaaattaaaaaaaaaaaggccacagtacactgctttcaaagtttcaaagccttatggattagattgcttcacctccatccctgttgtccacgaagctttctgtaaccttgacgtgccctgcaatgtgtaaccagtagggtatcttgtccaaataatatgaaattttttacattctcagtgatgctgatgactaagttatcttgaatgctatttaaaaataaatacagaaagtttgatagagtcgaccatctcagtacttgggcagccaggactacatagagaaaccctgtctcaggaaggagggggggcgagggagagagagagagagggagagaaagagaaagggagagagaggtgttatgcatgttggaatccagctgtgattctgggtcctccatttcctccctctcggagtatccagacaccactgtatgctgggatttattcaggataggcttgtatgcattgtatgcatacacactttattcggggtgaaccagggctgtgtatatgaacctaggagagtggaaaggggttcttcttaaagtgaaattacattggctgaggcttgggggtacctcatttgcatggagaggcattccttgaatttcaccatggattatgtgacctcccccagagtatggtttgggctccccagatcagaagaagaggaagccctgcttagagaaggttgtttttttgttttgttttgttttgttttgttttgttttgttttgttttgtttttttggttttggttttttgagacagggtttctctgtgtagccctggctgtcctggaactcactttgtagaccaggctggcctcgaactcagaaatccgcctgcctctgcctcccgagtgctgggattaaaggcgagagccaccacgcccgactggttgttcttcattttacaccaagctcagggaagctgtccggacatggtagactatataaccttagtagtgaggtacaacagacagacagacagatgataggtagtcccctgaacagtcatggtaatgcactcctgtaatcttagcccttgggaggtagagtcagaaggatcagaagttcatgtttatcctggctatatattaatttcaagttcaaggccagattggcctgcatgagacctatcccaaactaagaaaggggcttgggggatggcttagtaaagtgcttgccatgcaaatatggagacatgagtttttatattttattttatacatgtgagagttttgcctacatgtatatgtgtgtagcatgttgtgcctgtggcccatgaggccagaagagagcatcagatcccctggaactggggttacagatgattgtgagctgccatgtgggtgctgcaaaaacagccagtgctcttcatcacttgagctatctctccagccccaataataaattttaagaagtggagaactcatgaaaaaagacacctgaggttgacctctgacctccacctatgtgcacatatgtgcttcaccctcacacacccccacagggaggggaggaggaaggaagcaggaaggtgaagagagaggaagtcccctctcctggccatcttggtcactgccctgtgtggtgcgagcaccagaccacatccctctggccctaactaccctcgtacctactgaccagccagctgaatagaatgagaggcagtgtattacaagttcatattctaactgtttctcaatcaagttgccaactagaaactttccactcctccatgccaagttgcttcactgtgagctagagttcttggcaggtgtcaaggacaagcaagtattatacttggggctgcacatgtgtgccctccctctgctcacttagaaagccaggcttgtctgtctgactgctctctctctctctctctctctctctcactcccttcttccctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagcaagcagcaagtgagggggggtggcggggcggggtggggggagtcctgtttacttagcagtggattccctgaagagcagtaaagtagaagtgaaggggggaggcatggcagggaggggggatccatctctcctgaggggtcagaggaggtttctgaggaagtgacacgtgaatagacttgaacaaagtaaggaaactggctttgcagagacccagaggacaagcatcctaggctgagagagaaagcccagctggggtggctgaaaagctccccagagcccctaggctgcctccagccaagcaggaagttggtgatgggaactgaggccagggcacctcagtaatggaggtcggggtgaaaggtcaaagcgtgcataatcctaagtgccctgatttcacacacacacacacacacacacacacacacacacacacacacacacagagttgcaggtcagtaatgcattcatgtagcactgtcttcaggattgcacaggattccattacctagtgactttcgaagatcacggttaggcaattgagattcttagtatttaatttacttcattttcactaatgactgatattgagataacctagtacaagtaccttgttcaactattccttcagataaattcctaagcagaattaggtcaaagggcataagctttataagcttttttttttttgacgcatccaaaactgcattcaaaaacccaaattcacatttcccacagctctctgttggacatctgcttctctgtctttttgccaaccacagaatagcctccattcatgtctgccagtctggttggcatgaaaatggtacattataagtcctgtgtgtatttatctgattctaggcaacctttgcatatgatgattaataattccagattaattagcatggtagcagaagctagcatttgctggatggctctgagtttcctagagtatccgtcttagtcactgttctaccactgtggagagacaccgtgaccaagacagctcttacaaaggaaaacatttcattgagagctggcttatagtgtgactggaactcctcttttacaggaaactgaggcatagggaaatcaaataatttgccaaagatcccaggactgggaaggggccaagccagggtttcagcttggcttagctcctgaacctagattcttcatccaccaatggccagctctggccattgataatttttttctgtgaaaaacatgtttgtatttcttccttggttttttgaagttatatttttatatagaaaatatactcatctgagggtgagatgctcagtctacagagtacttgctgcgagtttaatccctagagcccatactttttaaaaagccaggtgatgtggcacttgtaatactagtgtatgtgttcctccacatgcctgggcacacacatgcatgtacacacatgcacataaatatgccgcacagaaacatgtgtgtatatacacacacacaagaaaaatagttaatcccctattgatttatctatacagaaaatcttttctctgtattaagttttattttctcaagaacaaagacttgtgatttccatagaaacccaatctgtctgtttttagtgtgtgtgtgtgtgtgtgtgtgtgttacacacatataccatggtgtgcatgtggggagtaggaagacagtcactgggagtcggcagtcttcttccactgtgtgagtcccaggggtgggacttgtgtgatcaagctttgtgacaaggacctttacccactgagctgtcttgccagctccaactgtgaagttttcaaagcttttatttttcaattatgcctgcaagcacagtcatagtctcagtttgggaggctgaggcagcaagatccaaaatgcaacacctgcctggggtagagagtgagttcaaagccagcatgtgcaacttagcaagacactgtctgaaaagaggtggggggatcttaggggtagagcttttgcctagtatatacgatgccctagtatatacgatgccctaggttcttcagtccccaataccagacaaaaagtcagacatagtcataaattcataaggtagagacaggcagatctctgtgaacatgaaggcagcctatcctacatagtgagatcctgcttcaaaagaaaaaattttttttcacaaatatgcaccactagaagttaactacacgcgcatggaagtgtctgccttctctgtggggactttctaaaccgtgccagctgacctggaaggtggcccaatttgtactttcagtgcctcacatcggcagcaagcctcccagaagacagaaatgttacctgctgtgtcggtcatgttctgagttgagattaagaggctgtgtcctaaccctagaaaagataagttcttgagggaggtgtctctgaggtccctggttttcactgttcttctccccggcagcgaaagcagctgacggatacgtgaagccaca

SEQ ID NO: 1170 - DNA, 2574 bp, Mus musculus
aaggtcctgcaacggggagggagcgagcgggcgtgcgagagagcgtgcgggaccggagagaccctggctctggtggggcagaacgaggttgtgaaccatggctatgtggatacaggctcagcagctccagggcgatgcccttcaccagatgcaggccttgtacggccagcatttccccatcgaggtgcgacattatttatcacagtggatcgaaagccaagcctgggactcaatagatcttgataatccacaggagaacattaaggccacccagctcctggagggcctggtgcaggagctgcagaagaaggcggagcaccaggtgggggaagatgggtttttgctgaagatcaagctggggcactatgccacacagctccagagcacgtacgaccgctgccccatggagctggttcgctgtatccggcacattctgtacaacgaacagaggctggttcgcgaagccaacaacggcagctctccagctggaagtcttgctgacgccatgtcccagaagcaccttcagatcaaccaaacgtttgaggagctgcgcctgatcacacaggacacggagaacgagctgaagaagctgcagcagacccaagagtacttcatcatccagtaccaggagagcctgcggatccaagctcagtttgcccagctgggacagctgaacccccaggagcgcatgagcagggagacggccctccagcagaagcaagtgtccctggagacctggctgcagcgagaggcacagacactgcagcagtaccgagtggagctggctgagaagcaccagaagaccctgcagctgctgcggaagcagcagaccatcatcctggacgacgagctgatccagtggaagcggagacagcagctggccgggaacgggggtccccccgagggcagcctggacgtgctgcagtcctggtgtgagaagctggccgagatcatctggcagaatcggcagcagatccgcagggctgagcacctgtgccagcagctgcccatcccaggccccgtggaggagatgctggctgaggtcaacgccaccatcacggacatcatctcagccctggtcaccagcacgttcatcatcgagaagcagcctcctcaggtcctgaagacccagaccaagtttgcggccactgtgcgcctgctggtgggggggaagctgaatgtgcacatgaaccccccgcaggtgaaggcgaccatcatcagcgagcagcaggccaagtccctgctcaagaatgagaacacccgcaatgattacagcggcgagatcctgaacaactgttgcgtcatggagtaccaccaggccactggcacgctcagcgcccacttcagaaacatgtccctgaaacgaatcaagagatctgaccgccgtggtgcagagtcagtaacggaagagaagttcacgatcctgtttgactcacagttcagcgtcggtggaaacgagctggtctttcaagtcaagaccttgtcgctcccggtggtggtgattgttcacggcagccaggacaacaatgccacagccactgtcctctgggacaacgcctttgcagagcctggcagggtgccatttgccgtgcctgacaaggtgctgtggccgcagctgtgtgaagcgctcaacatgaaattcaaggctgaagtacagagcaaccggggcttgaccaaggagaacctcgtgttcctggcacagaaactgttcaacatcagcagcaaccacctcgaggactacaacagcatgtccgtgtcctggtcccagttcaaccgggagaatttgccaggacggaattacactttctggcagtggtttgatggcgtgatggaagtattgaaaaaacatctcaagcctcactggaatgatggggctatcctgggtttcgtgaacaagcaacaggcccacgacctgctcatcaacaagccggacgggaccttcctgctgcgcttcagcgactcggaaatcgggggcatcaccattgcttggaagtttgactctcaggagagaatgttttggaatctgatgccttttaccactagagacttctctatccggtccctcgctgaccgcctgggggacctgaattacctcatatatgtgtttcctgatcggccaaaggatgaagtatattctaagtactacacaccggtcccctgtgagcccgcaactgcgaaagcagctgacggatacgtgaagccacagatcaagcaggtggtccccgagtttgcaaatgcatccacagatgctgggagtggcgccacctacatggatcaggctccttccccagtcgtgtgccctcaggctcactacaacatgtacccacccaacccggactccgtccttgataccgatggggacttcgatctggaagacacgatggacgtggcgcggcgcgtggaagagctcttaggccggcccatggacagtcagtggatccctcacgcacagtcatgaccagacctcaccacctgcagcttcatcgccctcgtggaggaacttcctgtggatgttttaattccatgaatcgcttctctttggaaacaatactcgtaatgtgaagtgttaatact

SEQ ID NO: 1171 - DNA, 2361 bp, Mus musculus
atggctatgtggatacaggctcagcagctccagggcgatgcccttcaccagatgcaggccttgtacggccagcatttccccatcgaggtgcgacattatttatcacagtggatcgaaagccaagcctgggactcaatagatcttgataatccacaggagaacattaaggccacccagctcctggagggcctggtgcaggagctgcagaagaaggcggagcaccaggtgggggaagatgggtttttgctgaagatcaagctggggcactatgccacacagctccagagcacgtacgaccgctgccccatggagctggttcgctgtatccggcacattctgtacaacgaacagaggctggttcgcgaagccaacaacggcagctctccagctggaagtcttgctgacgccatgtcccagaagcaccttcagatcaaccaaacgtttgaggagctgcgcctgatcacacaggacacggagaacgagctgaagaagctgcagcagacccaagagtacttcatcatccagtaccaggagagcctgcggatccaagctcagtttgcccagctgggacagctgaacccccaggagcgcatgagcagggagacggccctccagcagaagcaagtgtccctggagacctggctgcagcgagaggcacagacactgcagcagtaccgagtggagctggctgagaagcaccagaagaccctgcagctgctgcggaagcagcagaccatcatcctggacgacgagctgatccagtggaagcggagacagcagctggccgggaacgggggtccccccgagggcagcctggacgtgctgcagtcctggtgtgagaagctggccgagatcatctggcagaatcggcagcagatccgcagggctgagcacctgtgccagcagctgcccatcccaggccccgtggaggagatgctggctgaggtcaacgccaccatcacggacatcatctcagccctggtcaccagcacgttcatcatcgagaagcagcctcctcaggtcctgaagacccagaccaagtttgcggccactgtgcgcctgctggtgggggggaagctgaatgtgcacatgaaccccccgcaggtgaaggcgaccatcatcagcgagcagcaggccaagtccctgctcaagaatgagaacacccgcaatgattacagcggcgagatcctgaacaactgttgcgtcatggagtaccaccaggccactggcacgctcagcgcccacttcagaaacatgtccctgaaacgaatcaagagatctgaccgccgtggtgcagagtcagtaacggaagagaagttcacgatcctgtttgactcacagttcagcgtcggtggaaacgagctggtctttcaagtcaagaccttgtcgctcccggtggtggtgattgttcacggcagccaggacaacaatgccacagccactgtcctctgggacaacgcctttgcagagcctggcagggtgccatttgccgtgcctgacaaggtgctgtggccgcagctgtgtgaagcgctcaacatgaaattcaaggctgaagtacagagcaaccggggcttgaccaaggagaacctcgtgttcctggcacagaaactgttcaacatcagcagcaaccacctcgaggactacaacagcatgtccgtgtcctggtcccagttcaaccgggagaatttgccaggacggaattacactttctggcagtggtttgatggcgtgatggaagtattgaaaaaacatctcaagcctcactggaatgatggggctatcctgggtttcgtgaacaagcaacaggcccacgacctgctcatcaacaagccggacgggaccttcctgctgcgcttcagcgactcggaaatcgggggcatcaccattgcttggaagtttgactctcaggagagaatgttttggaatctgatgccttttaccactagagacttctctatccggtccctcgctgaccgcctgggggacctgaattacctcatatatgtgtttcctgatcggccaaaggatgaagtatattctaagtactacacaccggtcccctgtgagcccgcaactgcgaaagcagctgacggatacgtgaagccacagatcaagcaggtggtccccgagtttgcaaatgcatccacagatgctgggagtggcgccacctacatggatcaggctccttccccagtcgtgtgccctcaggctcactacaacatgtacccacccaacccggactccgtccttgataccgatggggacttcgatctggaagacacgatggacgtggcgcggcgcgtggaagagctcttaggccggcccatggacagtcagtggatccctcacgcacagtcatga

SEQ ID NO: 1172 - DNA, 94720 bp, Homo sapiens
  misc_feature (23326)..(24418): "n" at positionsm 23326 thru 24418 can be any base
  misc_feature (87811)..(87830): "n" at positions 87811 thru 87830 can be any base
agccctcccgtgcctcccaccctgaccctgtgcccagtggctgtgcccttggttgaccatccctcatttggtctctgactgtaaggccccgaatatctgtgtctttcattgcacatttccccttctgggttttttttttttttttttttttgagatggagtttcgctctcgttgcccagactggagtgcaatggcgcgatcttggctcacagcaacctccacctccaaggttcaagcgattctcctacctcagcctcccgagtagctgggattacaggcatgtgccaccactcctggctaattttgtatttctaattttgtatttttagtagaggcggtgtttctccatgttggtcaggctggtctcgaactcccgacctcaggtgatccacccgcctcggcctcccaaagtgctggaattacaggcatcagctaccatgcccggcccccactctggcttttattctctctgtgtctctcccttgtctccttaggtctccatctggttctctgattctgtctgggtttctctccatttcttcaggcctgttctccctttgagatgcagtggggaggaggaggagctatggaactttcccaggatgggcaaagggcacccaagggagtagagggaagggtgtcagagttgggttgggaagaggtgactgtagtcgtggctccagataacacaactacccagaaatgtcaaatttggggtttctttttgctttcagtccccttgtttgtccccttgtgtgggtgatttcccaccacaaagtgccctggtgattttggggaaccaggctgtggaggagaaaactgaggccacgggatgggggttcaggaagatcagaaactgtcaagggtctgactgagctgcggtccgaggctggcctccttgcccctaactgctcttcacccccaaatccaagtcacagtattagatggggagtgaggaaggattttagaaatcttacagaaatatattccccaggctaggtgcagtggctcacgcctgtaatcccagcactctgggaggctgaggtgggaggatcacttgaggccaggagtttgagaccagtctgaccaacatggtgaaacctcgtgtctactaaaaatacaaaacaattagctgggcgtggtgtcacgcacctgtaatcccagctactcgggaggctgaggcacaagaatctcttgaacacaggaggcggaggttgcagtgagccgagatcataccactgcactccagcctgggcaacagagtcagactctgtctcaaaaaaaaagaaaagaaaaaaaaaaaagcaatatattctccaaaagaagacctcctatattttattaggaataataatagtctgcagcctaggcttcagttggcacactatattcgtatcctgaactacatcaaggcacatttgtgtacagacatggttgtgctcttcaactcaacggatcctttcaataaccttgaaggcagtcagggccagaatcacaccctttgattagtccatgaaagaaacctgcccaaagctgtctggccagtaagtgcacagatggcaccaggatccaagttgccgggccttgtgggcagggtctcagtataacctttctaagcttccccaagcccagcacacaccggcggagtgaagaggcctccctgggctgggctagcccaccatttttctgcggtgcggagcatggcatctccattctcgcccagcctacacccctgctctattgaatgggacagtgtgctctgtgcacacttacatgaaggtgggtttgagtttatggattaagagaattatcccaaagggccgggcatggtggctcacgcctgtagtcccagcactttgggaggctgaggcgggtgcatcacctgaggtcaggagttcgagatcagcctggccaatatggtgaaaccccgtctctactaaaaatccaaaaattagctgggcgtggtggtgcacacctgtagtcccagctactcagtacgctgaggcaggataatcacttgaaccagggaggtggaggttgcagttagctgagatcacgccgttgcactccagcctgggcaacaaaagcgaaactccgtcacaaaaagaaaaaaaaaaaaagagggagagagaaagaattatcccaggtcccctttctgccttgcccttgacgatcaggtctgcccatgcccctaccctggggagaacagattgaggtcaccttgacttgaccttccttggggggtggagggaggtggtacagagatgcctttgtttcctgtgctccaagtcccttcttcaaggagagttcctgttacatgggagccagaggggaggtggggtaggggtgaagggccttcccaagaaagctggaggctttctaggaagtatcttttcaccctgcggcaaaggggagaagccctggagcacttaaacatcctgtttcacccccaccttgcctctgcttggacagcctacctgcactccagcccccaccggagaaggcttctagaagtggggccatgggcccatgctcagagtataccccacctctgaggccaggccctggtacctccctatagaaatgccacccccattcttgtccaagaagacagatcaggacctagggagggtgtgtgtttatatgcacagggtgaggacttctgtgcaaatctgggggaagggaaggagctgccggagcttgggtgaagcccgttcctgccgctgtcccctatccaccactcttcagggaagtcactttacagtgaagtcaccaagagaacacaaggccatcctgcctgaggcatagtgactgtcctctgtttctgggaatagcatgaggggaagggtgtggggctggacagggtgggtaggagaggagtcctgcttcctctgcccagctgcccagcctgcctgccctgggggagaggcttgtaggccggtttctttctggacgaagagaagaggatgcagagtctgtgccaggttcacatttcccagccagtcaggtgggcaggaggagcccaccctttgcagccccctcattgcagggccaggcccaggagcctggagagaggagagagggcacacagagccaggcagctgagtggaattggcactgtcctgggcagccctgggtcaagcctggcttctcatcctcatccatgatgactatcaggccgctcttcccgctgagctagtttctcctccttccagcccaacaagaaatcttttgtgccttggccagcccagtacccaacctcaagccctctgggggttgtgtgcgagggggctgagcatcttccacgacacctcccagtactctgccactttcctttgttatgactggagggggttcctttctgtagaatctgtttctcattgtttcttcgtttcttaagtctcagatctacccacatcttccttgctccaagcctcaaaaaagtgcttcggccaggcttttccccttacgctggcctctcaactccaagcactagcccctttcattccatctacctggaatgtcattcctcccttggccacctggtgaaattggcctcatctttcctagggttagtgtggcctagaggaaaacacaaaggctttggagtcataaggtcctggtgcagaccctggctctgctgtaggatcttgagtgagtgagtctgcctcttggatctaagcatcctcacttgtaaagaaatagcaagacccactgctgggatttctgttaagacccagtcacaggcccggtgcggtggctcaagcctgtaatcctagcactttgggaggctgaggcaggtggatcacctgaggtcaggagtttgaggccagcctgaccaagccagcacagactcagcatggtgaaaccttgtctctattaaaaataaaaaaattagccaggtgtggtggcagatgcctgtaatcccagctatttgggaggctgaggcaggagaatcacttgaacctgggaggcagaggtggcagtgagatgagatcacaccactgcactccagcctgggtgacagagcgagactctgtctaaaaaaaaaagactcagtcacagtggctggtgcattgtaggtgctcagaggccttggccagtagagctgggtgttttttcctctgcccttcaatcccatctgtattacaggccccttcttatggccctaacacattgcctaaagggctatgtcccactgcttgtccacaatagagtcttcataaatatctgttggattaatgaaggcccctaaaccagcacagaacttccggagctttgacggttcagggcagccccctgttcactgaccacccccaccatggttcccagaagactctccccctgctgccctggcctctgcctgctctggtcccactgagctgcttttctacacacagtggcagcagcagcctcatctttgcctggtgctgggctgaattttgagttcttaacctgcctggcaagccagcaagatactggctgcagtggcactctgctccctcctctgcgtccgccccaccctccctggataatgctgcatcccccaggactctgggtggagagagcccagtgaccctgtcccaagaggcggggtcgggggatccttggcctttccagagagcccaccctttagcctttagctctggctggaagggagcccagattggtgaggcacacaggagcaagactgagagcaggtgtgtgagactctccaggtggcgagtcctccatgcacctgcacatccatcgctcccgtcctctcccctcccctccatgtgacaaagcaccagctctctcctggccagcacactggctgggattaggctgagggaaagaaagagagaaaatgcttttttatcaagtgccaggcacagtgcttagttgccttcacaaatgctctcctttttcctttaaaaaaactgtctattttactaatgttttaatagggagcatctgcacatgatatatgtattttgtaacaaaagattcaaaagggtatgtggtgaaaagttagtctctgccctttcctgtcccccagggcccttctggaggggcaacaacagttgctggggtcttttgtgcatttaaatgcacggaaggattctgtggatttgaaacatatattacactctaccccctaactatgatttacacgtgatgggaaactgagatcctcagagacattaagtacctagaccaaagtcacacagctagtttttttttgtttttgtttttgttttttttttttgagacggaatctcgctctgtcgcccaggctggagtgcagtggcgcgatctctgctcactgcaacctcagcctcccgggttcacgccattctcctggctcagcctccggagtagctgggactacaggcgcccgccaccacgcccggctaatttttggtatttttagtagagtcagggtttcaccgtgttagccaggatggtctcgatcgcctgacctcctgacccacccgcctcggcctcccaaagtgctgggattacaggtgtgagccaccgcgcccggccaacagctagtaagttagcagagctgggatttagaaccatatctaacttttcaccaccaatgctctggcagaagtaagcaggggcactgacagagccctccgaaactgcagagcccattccaaaccgaggccacgccattctgaggccttggagatctggcatccccgccttcttttctgttgagcatcctataccttctccacatggctccagggtcctgtactgacctatccccctatggaaggattcatccccacagggaaaaagggacattcccacagtgccctttcttagcaaatgtgtggccggtggttgcccagggtcagcctgactcctgggatgcaggagggaagccataataacgaaggcctctggtttctggccagaggggatcatggttgtggcttcagtgacgttcccagaaaatggcctcatgatctctggggcaggagtgagggaggatgtgaagcagggaagctgccccctctgaaagccatgtgttcatctatgagagagagaggggaggaggctgtaggatgggagcaggggcatgcatggacaagggctgtggactagacccccaggctcttcccccaagcctctctcctgggtcaggctggtgcactaagggatgagaccctccagtggacattgctgcatctccaggtaccttcttgggtcattcctgatgggttggactgtggggtctttcaggatcctagcttcctgttcagtttctttctttctgtcatgtcttaagtctggtgtcccctcaatttaagggaatatgtccccgaggcctagaagaagagggtcccaccccatcagaactgtcaagcagagaagcaggtgtcaggccttcccatcccaggatgacaacattctgttttgctgaggtagtgacccagaacattctgtcctcagcatctgtgcacacacccagccaggtctagcttggtgcctggtgaccatcagtcagagatgtgcctagagctgcaagaatcaagaggcattcccacccacccttcaggacatttttttttttttttctgagatggagttttgctcttgctgcccaggctggagtgcaatggtgtgattttggctcaccgcaacctccgcctcccagtttcaagtgattctcctgcctcagcctcccaagtagctgggattacaggcatgtaatcctgtaatggcaccaccatgcccagctaattttgtatttttagtaaagacgaggtttctccacgttggttaggctggtctcgaactcccgatctcgggtgatccacccgcctcggcctcctaaagtgctgggattacaggcgtgagccactgcgcccggcccccttcaggacatttaaactagcgccctgtggctgccacaaaccagctggcttgagtcctagaccgccggtcttgggaagaggagtattcatcttagctgctactaaacaccacagtagtagttaaccgctatacagtgctttacagtgaagcactttacatgtagtaaacacttatttcccgcaacccgatgaggtaggtactgtctctatcaccacattacaaacgagaagatagaggaaaacacactcaagattacccagctcaaggaattgacagagtctggtttgagaacctgtacttttttttttttttctttttttgagacaggtctcactctgtcgcccaggctggagagcagtggcacaatcatggctcactacagcttcaggctgggcacagtggctcacaaatgtaattccagcactttgggaggctgaggagggagggttgcttgagccataagttcttgaacagcccaggcaatataatgagaccctgtctttacaaatatttttttttttttgagatggagtctcactctgtcgccccaggctggagtgcagtttcgtgatctcggctcactgcaacctctgcctctcgggttcaagcaattctcctgcctcagcctccccagtagctgggactacaggcgcgcaccaccacgtccagctaatttttgtatttttagtagagacagggtttcaacatattggccaggctggtctggaacacctgacctcgtgatccaccgaccttggcttcccaaagtgctgggactacaggcgtgagccaccgtgcccggcctacaaataattttaaaaaattaatctgggagtagtggtgcacgtctgtggtcccagttactcataaggctgaggcaggaggattgcttgagcccaggaggttgccttgagctgtgattgtgccaccacaccatgagacctttttctgtgagactgtctccaaaaaataaaaataaaaaaaaatcatcacacccttgacctcccaggctcaagtgatcctcccaccttagcctcctcagtagctgggaccacaggtgtgtgtcgccacaccgggctagaccctgtcctcttaatgactgcatagtccttgtaacctccatttgcattcctagagcatagcatttgttccaaaaatatttattgagtgtctgttctgggcttgaacacgagtaggaggatttaaaagtgaatagcatattgcgtctgcccttggggacagagacagaaacatgaaaacatgaaattgtccttcaacacaagaagtgctgtaatagaggcatgaataacgcggtgggaaacaaggagggaggtcatgctgcctgaagcaaatgtcaccgaagggcagacatcaagaaggcaggacattccaggcagagggaatagcatgtgtgcagggatgaaagctcacaagaaagagaaacatgagtcaggtgcggtggctgatgcctgtaatcccagcactttgggaggctgaggcgggcagattacgaggtcaggagttcgagaccagcctggccaacatggtgaaaccccgtctctactacaaaaatacaaaaattagccggatgtggtggtgtgcgcctgtaatcccagctactcaggaggctgaggaaggagaatcacttgaacccaggaggtggaggttgccgtgagctgagaccgcaccatttcactccagcctgggcaacagagagagactccgtctcaaaaaaaaaaaaaaagaaaagaaaaagaaaagataaaagagaaatatggagaacatggagcacctgagtgtcaaaacatcatgggcagtaactgtcagggagattgccagagagctcggggttggttggcgcatccatcctgcttcctgcttccttctctggcctccaagctccctgaacctactctgtgcaaagcactgtgccaggtgttggcccagagtatgggactgcagcagtggcctgggtagcggagaagggttttttgaccagctggagacctttgtggctggtgtcattctggaggtgaagagaaggccgctggaaagagctgcccagggaggactatgggagaacttgcagctctgggccatctctggacatgaacgttttgcatacacacaggggagctctgtgtgtctgagtgggggcgggaggggtccttctctctcttttggcccctgcagcttggcttctggagctttcctatgtcttgctttagtgctagcccttggagggttgccagggaaaccgctggccagctccgggagatagacgtagcagaggaaaggagagtgggtgactcagcctggcttcccacaaccgcaaccccctcctcagcacgtggaaaggatctgggggacccccttcccctggatcctacagatgaccctgtttattctttcttctctagagagagcagtccctcccgcagctctgactggtgggagccagccagattttcccaggaagggaaccggccccaggcgccccgtcccccgtaggttcaccctggaactcggacaggtgaattcggcctgggcgaatgtgaattcctgccgtgcccatgcaggcggcaggagccctggctgagacgccctcccgggggcaaacccaggataattattgatcggggcccctgtggacttctgacctcggcctcggcgggagaggacccggaacgcgggcctgggctcccagggagagaggtgggcgggccgcggagggggccaaccaaaacgaccacgacagtgcgccctagccctgctagtggtggtcgacccaacccaaacaaagcagcatgtgcttgcggtgcggcgtcggctagggagccgagccgggaagacaccccaccgccgcagaaagggggtgcgcgcggcgccggcaccggcaccgccgagcgcgccgccacctcgggtgtgccgagggggtccgggtccttcaagggcggtcgcggagggggcgcgagggacagcgggctagcgagcgcgcgccgggcggaaccaggaagcggggcgcgctccgggttgccagcggcgcgcgtccctgggcctccgcgcgtgagcggcgcgcgcgcccccgcgggccccggcgggaggagagtcggcggccggagccgtcaccccgggcggggacccagcgcaggcaactccgcgcggcggcccggccgagggagggagcgagcgggcgggcgggcaagccagacagctgggccggagcagccgcgggcgcccgaggggccgagcgaggtaggagctgcggggcgagccctgggcccggggccgggggagccaggccggggagccagcccgggcggggcccgcgctccagccgctcagccgcccgtcagggccgcgccgccgccatcactcccgggccgcggtggttgcgcgctgggcgaggggcgcgcgcggggagagggggtccgggttggctgccggggaggctgagggcaatgcggggtgcgcgagggggacttgcgaacgccgcggcgccgcggggggcgtgcgctttaaaggctgcgtgcgcgtgtgctgagtgggtgtgtggggaccccgcgccgaccccataggagctcagggggctgctgtcagccgcctcacaccttcacgttgcaattccgaatatccccagccgtcttccttgctttaacttctttctttcaaaagaggttcccgggactccggggatgggatgagcctgcgggggtgcctggtgcggtggggggtattagcaaagcttcaagaaacagggccttataaggaatcaagacaacaaatacgaacgtttcgataagactctggggggcgggatcccacatcaggacccgccaggcctgggctcgtgcgtgtggccgtgggatgcagtgtgctttttctttctagtcagggataaagggttaaaagtgctcctggtgtcggggggtagatatggagagtcggaaggggagttgtatcacaaaagctggtctgaggctaaaggaatctggcaagatggtcggggtgaacaaagaggaaagaactcacacggagcaagaggcggttgcaaacacttgtagccagcagtgatggaaaagccaaagaagaaaaccaagtgtcagcttttagaaagacgggattaatgaaaagcacaagaattttaaagactaaaagagataccgattctctctttgccaaagagccagagtcagttcttttcttcttggtccctgtgatcccgccatacctcgtatcaaataaatagtgccaaaagtgggtcaaagaatgttagagctggaaaggaacccagcgatgatgccattcttttattgtacaaatgaggaaactgaggcccagataggtggagtaagtggcctgctcaggtgacacggctgtttgttgagtatccagggattgaaacttcaaggactctgagattcgtgctcttcccaaagcatcgtgcagtatacagatctttgcctagatacaattccatacattttctctgcagtgtcctcagggaatgccctttgaaagggccagcgtgacactgaatatcatacttgggcttatgtcatttttttcagtcttcaagtggtgtttatggtctgcttggatcttaggtttccaaagctgttggatagccgcctgggccataataagctttcagctgttgggtctacattatttcaaataattttgttatctttcaattaaggtaatagaactgtgcctctctccccaacattctattgttgtccatttgcttatgttatattgcgttatgttcattgcctgtgagttcctaggtgaggatgtattttattgagtgtgcctttcatgttttaaaatttcattttgtaacactgtaaatattggagtggttctgatcacttcaaatggggagaatcttattgattgattttattttaaggctttgggttgttttgtttattcatttgggtaccagtttccatctcatggaagatcacagttgttagaatggacatggctaaataagagaaggggctgctgattttaagaaaaacttcctatgtgacaatttgtggtatctgttacgtttaattcaaacaagtccacaccttgggtcaggtaagcgcgttatctaggagatgacttgtttgctactgtagcctctggaagatgaaatttcaagctccagattgagacacagggaaggaatggagaggttttttttttttttttttttttttttgtaaagcaaaccatcagaaaaaaaaagttgatttctatcaccagtagtttggttattgcataacttgaagctaaactctgcacaaaataatctttgctatatacccaactaggtaaactatcccaccttctcatcagttctcaccttttcggtgcttgtattttttgcccacgggatattaatatggattgtgttcagaaatttaaggtgtgtacttcatagtatgtatgattgtaggagaaaaatgtgctatcatcgtttggagtgttacaacataaatattttggtcaacacttcctatcctgctctgacttttcatctcatctccattttcttcctctcttgattgtttttatgtcatttacatatgtaaaagccacatcaagactaaagttgccatttattactttttgatacttaagtcgagttttttcaaatcatagtattgttagtattcaaattgtctgtaatttttgttaggcttatatattatgaatccatttgttgtggtttatttggcttgttgttatgtaggtaggtgacacaggtagtcttattgtaaaaggaagacgttatagataggtaaataacatgctcaagattagatgcaggttacaggtggaatcgaaggaagcctaactattttcgtgccctacaaaaatgtctgtatctcataaagttattcacagatttctggacattctatctgtgacacattttttccctttctgttaagagtgcagattactgcattattcctacaaaaggaagcaaaataaccctagtttgtatgatttttctgataatttgaaacttattcgtttaaaaagctatctggcaattccaggttactggactcttgagaagaatatccttttattttgatactataaaatatcaaagtatcaaaatactttaactgtgcaacttaataaaaataatgcttcaaagttagctctgcactatcgctgtcctcaaatgtgtggtatttaaaggaagaaaatgtttttaattctgagctttgtgaatagaactcttctaaaatcagaagtttttttttttctcctgcagtgttggaaacacaacagttttatgcttatttctgggaataagaaagtcaaacttaacaatctagtttccattgatcagacagtttttgtacttaaatttaagttctaagcatcagagtgataaatactttttaaaattgtattcactgttaattatagtggccttatttgaagtaaaatcttgacattgggtgttttattaatgatgatcctctgctactgaaaagcctatgtcagtttggagaagattttgcacatctaaatctatgctgtttttactaatcaaaagagaagagcaatttacaggtgttagatttttagttggttgaatgagaccctcacttttgatggtttcagagttgaagtgacgttttattacttttgttagtttgggtcacacccatcacttccttggaaggtatctttgaggtttggtttcctttttttttaaatggtaatattggggtgggggtgcttcctgtttgtattttcaaaattaggtccacatgttaaccttcttgtagtgtcacatttttattttaaacttatacagacaaacatcagatgccatgtggtttgtctctgaccctttgcgctacttcatgacagctttactgagtgaagcctgaatacccaatcgggaaggcaagatgttcttgtcttttcccaactctcttcaaagtttaacagccttggaaggagtcttagaacagcaacaaaagcacaatttacagaaaaatggaggtgctgctatctgtttcctcgcaggtacttggaaaatgtatagcactaagatagagttgaaacatgttatgtagagccttgaatgtcggtgcttcaaagaggagttgctctgggtttacatgatacagaaccccatggtttatattaagtagtaatgatagccgtttttctggactcgcttaaaagccatacacagtgtcatggaaaagagttaagaacaaggtgaaattcagggtatggtattagagctcaggaggaatcaccttcagccttaaaactcttcctttactctcctggatcacttaagtgataggtcacttttaatataaatgttgcaggatgagttaagtggagccttgagaaatatgtgtagattgtttcagtgattaaagcaagtgttcttttcctggcctttaactcgctttatgctaagaagtgtaataactaaatagactcctaattgaattgacattcagatgtgtttgcagtttagggggagtttacctcttctaaattttcatttggatcccattactaaaagcagtattgcattagcatggtgcacaattatgtacaattcaatttgcaaatgaagttaatacttggagtatcttgacttcctattcccctgctgccccaatattcaagaaaggagaagttataatttgtcacatacaagatggtttcttctttaggtttattcttaataactatgtccattttcacatggatgacaccactgagatgatgaatacctgtattgattgattgatgaagaacatttatctttttctacctacttttggaagctagcttgcaaaatctactgcaacattcactcttcatgtatccttctattacctttggtaccctgaataaccttttaaaaatttttgtacttttctaatatgaagagaagtagcttcatattctatgctagttttctgaggtgcttgtgctgactcattttttaaattatactaagatatagagcatggtttgagagcagtaatgagattctcagaaaatatgaaaactttcctttctgactagttagagaaaggttggggaagacaaggggaaatacatcaatgagccaatcaattattgttatttgttgggattaatttggtgactaatatttttaatgcccatcaggctactaaatgtgaatttggctttaccctgtaatgataacaggacaaacccaacgggtttctaacattgcttgttttcccctggtaggggatttctttgcatatgggaaatcaggccgaagttgccagtaacagccacatccatgatttgtattaaaaataactattcatcattctgggctagagctctgcttaccatggctcacctgggaagatattctgattatgtatctaatcattatgatgccacctttcgagaggtgagcagacaattaacaagtccttcaaattatgttcaaaacccagagtttgagaaaatgttccaacgccttcaagtgtgaagataataaaaacattacctaatgcttaccgttcactgacagtgtgctgggcagacattgttttcagctctggccttgtgttaactcgtgattctcagaggagtgggtattattcccagatggaagatgaagaaatggccacagagaagttaagtaatttgtccaaggtcacattactgttcttggcggggctgattccagagactgcatccctaactagtgtacagcaaaagcgagctggccactgccactttgttataagacattttgtttctttgaggcttgtatttctttgtgttcccaaatggagtctcgttggtttttgaatagaaaatatttttatatgtttaggatttttttaaatgttgatgaagatggtgataaatatttttccaattaaagtatatacttctggtggaaattatattaaagaagagaaagtcttaatttttattataagttgtctttcattcttcttcccctagcattaccgtgtacatcatagaagaagagctataagctgtctccttggcctctgtttacaaacaaagggatcatttgtgccaatgtagtgggtttgtgttgacatgcacgtctgtactgagaactcaacaatcccactcattttatttacaactttattttgcggggatttctgtcctattcttgttgcattaaagctttttagagcattagtcatgatttctgagacagatttaagaattttacttatttgggctaatttattattattatttcttgagacagagcctcgctctgtcacccaggctggaatgcagtggcgcgatcttggctcactgcaacctccgtctcctgggttcaagagattctcctgcccagcctccggagtagctaggactacaggcatgtgccaccatgcccagctaatttttgtatttttagtagagacggggttttgacatgttggccaggctggtctcgaactcctgacctcaggtgatcctcctgccttggccttccgaagtgctgggattacaggcataagccaccatgcccagcctatttgggcgaatttttaaggcaactgaactattgtatgtctagagctctgcaaaggccattagaaaatagtctcagatttttttttttttttcatttatgatgcttactttctctcagcacttttccttgggagtggattgtgaagttaagtcttggaaacagaattcacaaccctaaagcgtagtgctttaactttgggagatcaagtcacagacaagaagaacttcaattccctgtgcagagtataaacttgttcaaataaacagaggatgttagcttccaggattgtcaactgtcacctttgaccagggttgaattttctttgaatgttgacagaagttacaatgtcagtggaaaaagcttaatgtgaggtatctataactcagaatttccttatgtttgtgtcagtgagatcctacaattaaagctgcttctttttttctatgtctgatgagttttaaaagccttcactggggttttccagcctttaggtgagagtaagttaaaaagtttgtgagaaactattttttgttgtctaaaattcagagcctaggtcgggcccagtggctcacgcctgtaatcctaacaatttgggaggccgaggcaagcggatcacgtgaggtcaggagttggagaccagcctggccaacatggtgaaaccctgtctctactaaaaatacaaaaattagccaggtgtggtggtgcacgcctgtaatcccagctactcaggaggctgaggcagaagaatcacttgaacccaggaggcagaggttacagtgagccgagatcgcactactgtgctccagcctgggagacggagcgagactccatctcaaaaaaataaataaattaaataaattcagagcctatagctggtggcaagtcactgtttttgaaggagtgggattttaaaaaatctaacctgggctaaatgttaagttacattcatacatgtcattgtagcctatataaaaagaaacttgaacacttgatctcttaaagtactaaaaattggaattcatcagctttgtaatatagcattcattctacagtatatttaaataggtaaaatgttctgttagaaataatgctaattctgtttttttgtttaatgtttctaaaaatcttttggtcatcttttaggtttaggaaaagtagcaaattagagatctacagaaatctacagctctttaaaaatgaaacagttcaccctgtgaatttgtttgcaggattggtgatctgtttctgatgccaggaaggtgggactcctatctcatttctgatagaaagtgagggaaagctatgtatagtgagaactggatactagattcttattccgaaggcatggaaggtttaatatgtaaggatacaatgtaaatagtccctctttttgtatttttctttggttattgttacgtaactatagtcgtttgtcacttaatgatacatggtgacaaagttctaagaaatgcattaggcgattttgtcattgtggtaccatcatagagggtacttacacaaacgtagatggtgagccctactgcacacctaggctgtatgataaagcctattgctcctagactacaaacctgtggaacatgtatactgtattgagtactgtagacaattgtaacacaagggtaagtatttgtgtatctaaacatatctaaatatagaaaagttacagtaaaaacatggcataaaggataaaaaatggtacatctatatagggtacttaacaggaatggagcttgcaggactggaagttgctctgggcaactcagtgggtgaatggtgagtgaatgtgaaggcctaggacattactgtacattactgtagattttaaaaatactgtctggttaggctacattaaatgtattttgaaaattgtttctttcttcaataataaccttagcctactgtaatacttttactttgtaaactttttactttttttttttttttttgagatggagtcttgctcttgtggcccaggctggagtgcagtggcgtgatctcggatcactgcaacctctacctcccggttcaagcaattctccttcctcagcctcccgaatagctgggattacaggcgtgtgccaccacgcctggctaatttttgtatttttagtagagacggggtttcaccatgttggccaggctggtctcaaacttctgacctcaggtgatccacccactttgacctcccaaagtgctcggattataggtgtgagccgccgtgcccggccaactgtttacttttttacacttttaaactcttttgtagtaacacttagcttaacacataaacatgtacagctgtgcaacaatattttctttatgtttttattcttttactttttctctttttaaataatttttaatttttcaaaactttaaaaactttttaatttttcaaaactttaaaaactttttcttaaaagtgaaggcataaacacacacattagtctaggcctacacagggtcagggtcatcagtatcactgtcttgcacctccacatcttgttccactgaaaggtcttcaggggcagtaacacatatggagctgtcatctcttgtgataacaatgcctcctgaaggacctgcctgaggctgttttacagttaacttttttttttaagtagaaggagtacactctaaaataacgataaaaagtatggtaaatacataaaccagtaacataggcatttattatcattatcaagtatgtactgcacgcaattgtatgtgctagactttcacatgactggcagtgcagtgggtttgtttacaccagcattgccacaaacatgtgagtcatgcattgcattacaacattatgatggctacagcgtcactagaggataggaatttttcagctacgttttattatcttatgggaccacagtgatatatgtggtctgtcattgactgaaacgtcattatgtggtgcctgactacatatatggaaactctgagtgtagtcatgttttacaaatgagtttatcttgcagtgagtttaaatatcaagtaaaaatactaatttcattgtaatgtatgaagagattggcctttctcctcatgttgaaggtatcaaaacaaaatagaaaatatttggcttcctgagtggcatggctacaattcacatgctgagttggtgatgaggcaagatcccttgactttgcaataccagaaaaatgcacatagttaaaaaaaaatagagacaggggtcttgctatgtctccaggtgatccctcccacctccacctccacacctcccacctcaaccttccacagtattgggattacaggaatgagtcactgcaccgggccaaaaagcatataattttaagggaatgatttttttttttttttttttattttttgagacagtgtcttgctctgttgcccaggatgagtgaagtgtgccaggagtgggtccttaagtaagaaaacgtattactttagacacacatttaaaattttgtccaaaaatgtgatattctcaaaatttatggttttgaattttatttattattttaatttattattattattttttaaagagtggggtctcactatgttgcccgggctggtctcaaagtcctgagctcaagtgatcctcccacctcagcctccagagtagatgggactgcaggtgtgagcccctgagcctggctagttttgaatttttattacccaaatgtgaagaggtctagtttgcacagaacttaacattacattccagttttattggtaaatttgaacaggatataagtggctttaataactaataaaagaagatacatcttatagatacacatatgtctttttatatgtatacataaatatttaaaacttctttatgccaaaaaatgccagaaaccaaagctaagtgacaaaataagaaaaatatttctaatatatatgacaaagcattatgggtaaatattcgtaatatataagtaatctatataagtagtaagaaaaagatgattcccataatagaaaatgaacaaaagaagaactacaaatagccgataatcatatgaaacagtgttcacccatactggaaatcaagaaatgcaaataaaaatgacaagttttttcagttaacagatttatgaagactaaaaatattgaaaaataagagcagtgttgcttgggaatgtgggaaactggcactttcatactcattggttgaaatgtaaatgggtgctttttttggatggcagtttgatacatgtattgagagcttaaaagagtgcatactcaagctgggcatgggagctcaggcctgtaatcccagcactttgggaagctaaggcagtcggatcacgaggtcaggagttcaagaccatcccggccaacatggtgaaaccccgtctctactaaaaatacaaaaattagctgggcatggtggcacgtgcctgtaatcccagctactcgggaggctgaggcagggagtcagaggttgctgtgagccgagatcacactactgcactccagcctggtgacagagcgagacttcgtctcaaaaaaaaaaaagaagagtacataccctttgacttagcagtttcatttagatgaatttcattctaggacatctgaaatatgtttaaagatttgtacaaataggcatgggcaaggacttcatgtctaaaacaccaaaagcgatggcaacaaaagacaaaattgacaaatgggatctaattagactaaagagcttctgcacagcaaaagaaactaccatcagagtgaacaggcaacctacaaaatgggagaaaattttcgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaaaaaatgctcaccatcactggccatcagagaaatgcaaatcaaaaccacaatgagataccatctcacaccagttagaatggcaatcattaaaaagtcaggaaacaacaggtgctggagaggatgtggagaaataggaacacttttacactgttgatgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcagtattcacaatagcaaagacttggaaccaacccagatgtccaacaacgatagactggattaagaaaatgtggcacatacacaccatggaatactatgcagccataaaaaatgatgagttcatgtcctttgtagggacatggatgaaattggaaatcatcattctcagtaaactatcgcaagaacaaaaaaccaaacaccacatattctcactcataggtgggaattgaataatgggaacacatggacacaggaaggggaacatcacactctggggactgttgtggggtggggggaggggggagggatagcattgggagatatacctaatgccagatgacgagttagtgggtgcagcacaccagcatggcacatgtatacgtatgtaactaacctgcacaatgtgcacatgtaccctaaaacttaaagtataataataaataaattaaaaaaaaaagatttgtacaaaaggagtgttacttaaaatagcaataaattggaaaaatcttggtatttccattagaggtttaataaactaaatcatttattacacctgtgtatagctgtccaatagaatactgtccagctatttaaattatgttataaaacaatatttaatgacctacacaaaattcactatatattactaaatgaaaaatgaaattacaaacaatcatatacaattgtgccggaaaaaagaacaggcgctgaaaaaagatttcttctgggtcgtggagttccctgtgtgtgtgtgtgtgtgtgtgtgtgtgtgtgtgtgtgtgcgcgctttctagtatctttccatttttctataataaacagattatggctgggcacagtgactcatgcctatatttccagcactttgggaggctgaggtgggaggatcacttgagtccaggagttcaagatcagcctgggcaacatagcaagaccctatctctacaaaaaattaaaaaattagctgggcctggtggcacatgcctgtggtctcaactacttgggaagatgaagtaggaggatcacttgagcctgggagttcgaggctgcaatgagctgtgattgagccactgcattcgtcctgggtgacagagtgagaccttgtctcaaaaacaacaaataaaaacaaacaaaaaaacagatgataatacagggaatccttttgtaatcaggaaaaaaaagttatctttaaaatggctgtgtgtattgatatgtcttagaacgtagaatttgttttttgttatcagtgttttctttttagaagcagaaaaaagagtttgtgatgtttttgttaattttttggtatagtatcctgttttttgacatcttttgttgaactatgttaaaatcatcataatttcatttaacatttttagagtttaaataatttgaacttcaggactgtgttatttcctgtgcttcgtggtagcctgtatatttttacacagaagcttatggagaattatattgttatataatataataaattgttagggagacagaggtgaaaggattgcttgaacctgggaagtggaggctgcagtgagctataatggtgccattgcactccccaagcccgggcaatggacagagacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatctctataaaaatacaaaaattagctagacgtggtggtgtgtgcctgtagtcccagctacttgggagcctgaggtgggaggatggcttgagcccaggaggcagaggttacagtgagctgagattgcaccactgcactccagcctgggtgacagagtgagaccctgtctcaaaaataaataaataaaaataaaaaataaaaaatctatcttaacttggattgtgcattgtaatttattatagtgaaattgctataacagaattttattttaagccagtttggggaataccaaaacatttttaaaaatcacgtagtactttttagtgcttttaaaacctaaatccataaagtagttaattaaaatgcatgaagtaaataagtgtttttctgtattaaagataaaactataaacatatattgttcaatatgcctacataaataaatcattctcttctttttggttattttttgcttatcacctcttacctcctctacttcctaaaaacatgataatctcgtttaattcaaaattatgttttctggccatacatggtggattatgcctgtaatcctaacactttgggaggctgaggtgggcggaccacttgagtcaggaggtcgagaccagcctggcccgcttggtgagaccctgtctctactaaaaatacaaaaattagccgggcgtggtggcacatgtctgtagtctcaggaggctgaggcaggagaatcatttgaacacaggtggcagatgttgcagtgagctgagattgcaccactgcacttcagcctcggcgacaaaatgagactctgtctcaagaaaaaaaaaaaaaaggtaagacatataaactaggaaactaagcaataattgtgtacagtatgtggaatatttatgttctagaccagcactgttcaatacaaatataatgtgagctccaattgtaattttcttagtctgtatcacaataaaaagtaaaaataaaattaattttaacaatatactttaatatataaaaattatcatttcaacatttgatcaatataaaaattattgattaatgaggtattttgggccagtttggggagccaaagcaggaggatcacttgagtccaggagttcgagaccagcctgggcaacatagtgagacccagtctctaacaacaacaacaacaaaattagctaggcatggtgatgtgcacctatagtcccagctacttgggaggccaaggtgggaggatcacttgagccgaggaggttaaggctgcagtgagtcgtgttcgtgctactgcattccagcctgggcaacagagtgagaccctgtctcaaaaaaaaacaaacgaacccaaaagcccacaaaaacactgagatattttacattcctttttttgtacgaatgcttcaaaatctggtgtgtatcttacagttataaaatctctcaatttagccaccaaattttcaccagaaatgcatgaactgtgttcagatttcataaaactttcagttgataaagtagattcacatactgaaggtgttccaaacgtactgaaaggttttccaagtattaaattgaacaccagtttccaggtttacatttaagttaattcaaatgagataaaatttgcaattcagttccccagtcgcactagctacatttcaagtgcttaggtagcacatgctgctagaggctaccataataaacagtgtggctataggccttctaacgaagggaaatgaaatatagggctgtctcctgctttataacatctggcttacaatcaacaaatacaaatagggtcgcttggtgcagcaaaccaccatggcacatgtttacctgtgtaacaaatctgcacatcctgcacatgtatcctggaacttaaaataaaacaaaacaaatagggtctcttgccctgtgggaactgaagccactgctctgtaggaaataaaagtgtctttcttttttgttttttttttgagacagaatctcgctattttgccgagtgaagtggcatgatcttggctcactgaagcctccccccgacaggttcaagcaattctcctgcctcagcctcccaagtagctgggattacaggcacctgccaccacgcccggctaatttttgtatttttagtagatacggggtttcgctgtgttggccaggctggtctcaaactcctgacctcaggtgatccacccaccttggccttccaaactgttaggattacaggcgtgagccaccgcgcccagcacaaaagtgtctcttacctaaagaaagtgatgcccttaaagcttcctaccattccctcacccccaagacacacccagacacccacagatgcaccctcttgtttgaaaactgctgcatccttgcatggctgaagcattacccatgtccttgaagctcctgctttcagaggacctctcatttcttgggagtagaaaagccctctctggccaggtgcagtggctcacgcctgtaatcccaacactttgggaggccaaggtgggaggatcgcttgagcccaagagtttcaagtcagcctgggcaacatagtgagatcccatctctgaaaacaaaattctgaataaaaataaacagcccaccctgtttcaggtatacctcaactgtcaaatcacttttaggcagggtgttttgttatttttgttttgtttcagagtgttgtttaactttatttttgaaactgaatttgtctagaaaagaatcatattcaccttttggtcttagctactcttcatttttataaaatacatcaagttgatgcttaaaattggggatctagttacagatgaaatttttcctttcaaaagagagttccccccagttttgctgtagtcttaggagatacttaagggaggggaatcatttttagttccccctaggtgaggtggtagcctccctaaactgccaagttcacaccatgactggtaacaccactgtgtgaggaatactgaacaaacggagcttcagaagggagacttgcagagattctggaatctaggtaatgccacttcctacttagtttatcttaatggttttgtttgtttgtttgttttgagacggagtctcgctctgtttcccaggctggagtgcaatggcgtgatctcagatcactgcaacctccgtctcccaggttcaagtgattctcgtgcctcagcctcccagatagctgggattacaggcaagttccaccatgcccagctaatttttgtatttttagtagagacagggtttcaccatgttcgtcaggctggtctcaaactcctgacctcaggtgatccttccgcttcagcctcccaaagtgctgggattacaggcataagctaccgtgcccagccttaatggtctttttaaaggatacctgatttcagaaggaacctttgaagaaatggctagaacttctgtgtttctttggatattgcctgacatctaagccaaattagttgaccttttaatgttaaataaaatattcaataacttttactaatgggtgggctttaggaacccctttattttactatgttgccaaaagtaggttcattataacattggaaacatcctgatgtaatttattgaatgtaaaattattcctcaatacatttgaggatgatttccataaagggaaacaaattcctttcttccaaatatactgtgacagcctattttgaaatatttaaaatatgtccctaaagatgaaaattaaagagcggacacaaagttgttatgctctaaggagtcattcttttgatttaaaattcattataattccctggttgtctagtggttaggattcagcactctcataaaattcattatattgattctataaaagtatattgtgttggattaagaaacacatggacatttttaagtgtttcaaaatatttttgttatacctaggttttcactgtggtggtatttgttgttttagtagaatttgacctatattttattctatgggaaaaagaagaaagtaaacattggctagctatctaccaccctgtactgctatttgtgtgtggtcccattgtgaatttttaactccatgctctatatttttagtgctttgtgaagattgaatctgcaaatcacctttgaaagacaaaggatttgatttgattgtggcaatcatgaaagttatcctgtaaataaaactgtatgtcctggaccaaagctggaataatgccacactgaaatgatcttaactgtggaatccttgattggacccgatttgttttgcacatacaatagctccataaagatgataggctttcagcagggatgaacagatgttctggttttatcagaaattgcttttgcatcaccaagacttcacaaaagccagtaatccccctgtttgatgttgtggaggtgcttttaaaacttcttcccagatactggtttgaacacacagactttgtcattgacctgtaagattcaattgtcaggtggtatctgttttctcccaacagaaataaagagaagaagaataaaaacaaaaactagaaagtgtagcaggggcacaattatttatttaaactttaaagtatttaatattacataccagaatctaagttacataaagcatgtctgttttgttcactgccacattcttagtacctagaacagagcccaacatgtaatagttactcaataagtatctgttaaataagtatagtagtcctgccttatcccaagggatgcctgaaacctcaggtaatactgaaccctacatatatatattgttttttcctatgcatatataattatgataaagttcaatttataaattaggcacagtaagagattaagaacaatgataataaaatagaacaagtatgtagtctttttttttttttttttttttttttttgagacagagtctcgctctgtcacccaggctggagtgcagtggcgcaatctccgttcactgcacgctctgcttcctgggttcatgccattctcctgcctcagcctccccagtagctgggactacaggcatctgccaccacacccggctaattttttgtattttgtttagtagagacggggtttcaccatgttagccaggatggtctcgatctcctaacctcgtgacctgctcgcctcagcctcccaaaatgctgggattacaggcgtgagccactgtgcctggccgaatgtagtctatcttaaaatactgtatcttactatgctgtactgtgggtaacagaaaccatagaaaacaaaatctcagataaggaaagactattgtattcccctttaatctcaatacagcaggtgtatccagagaacttcaaccctcagaaggactgaaagtgtgccttttactgtggaagaaagaaaagagagggggctgggtgcagtggctcatgcctataatcccagtactatgggaggctgagccaggagggtcacttgagcccatgagttagagaccagcctgggccacagagtgagacgctgtctcaaaaaaagttggggggatgggggagaagagagaggagacagcaaatatctctttgtttcctttggatttcagcattaaagatagaaaaaatgtgagtttattaggcaaaaactggttttttaaccccattttaaagattgtggagttacgtatatatatcataaaatttaccatttttaaccttttattttgagatggagtttctctgtgtcacccaggctggaggttagctcattgcaaccttcacctcctggattcaagcaattctcctgcctcagcctcctgagtagctgggattacaggtgcacgccaccatgcctggctaattttggtatttttagtagaggtggggtttcaccatgttaaccagggtggtctggaactcctgaccttaggtgaaccgccctcggcctcccaaagtgctgggattacaggcgcgagccgctgtgcccggccattttcactgttttaaagtacagttccgtggcattaagcacattcacattgttgtgtgaccgtcagcacctggtccatctccagaattttttcatcctaaactaaaatcctgtattcattaaacagtaatgagaataaaactctccatttgcccctccccgcaggctctgacaaccgccattcattctttctgtctctatgagtttgactactccaggcatcttatatcagtggaatcatacactatctgcccctttgtgtttattcctttttttgcaacataattcttttggttggagacttcacagtttttctttcctttgattgtttagtttttgctttgtacctagacctggccagtgatgcatgtgcaatgagtatgcaaagacaagttaattcagcagcttgttgcataccactagggagttattaaagctttcaaaatgtgattcctcatctgtatgcctgtggcttatctactccaagtcttgctgataaacctgcactgagagtaatagcaaagattagtctttctccatgtttcataaaacaaattgttctcattcttacagcctgattatgaactggaaaattacaggtacattgttgtaattgtttatacagacaatgagacatactctccacaggggacctcagctgcaggggaggttctgattgcgtgtcattaagaaacgacagttaagaaacttttttttttttagacggagtctcgctccattgccaggctggagtgcagtggcacgatctcggctccctgcaacctctgcctcctgggttcaagtggttctcctgcctcagcctcccaagtagctgggactacaggcgcatgccaccacacccagctaatttttgtattttttgtagagacagggtttcaccatgttggccaggatggtctcaatctcctgacctcgtgatccgcctgcctaggcctcccaaagtgttgggattacaggcatgagccaccgcaccgaccttctttttttttccatttttaaaaattttctattctcattacatcttcctttctccctacttttccttcccttcccttccagtttgtccttccctctctctctttcttccttttttctttctttttcattctcatttttctgagtagttgctgaagacacagcctgaccctaggggtccaaatatagatgaaacaatcatagctctctagcagttcacctggagggagagagaaaaagagagtaagagaaccaaaatgaaggggaaatattcttaatttttttttttttaaggacagaaactaacttgttgaggaaaaagagaaatatactgggagttctgactgataggaacaaagagaggacagcttcgaaggatgatttgaaaagtaatctatggaatttagctttaaagcaggatcttgggctgtagactactttattattattattttttaagagacagagtgcagtggtgcagtcatggctcactgtagcctcaaactcctgggctcaagccatcctcccacctcagccttctgagtagctaggattacaggtacataccagcacgcctggctaattttttaatttttattttgtagagatgaggtcttgctgtgttgcccaggctggtcttgaactcctggcctcaagtgatcctcctgcctcagcatcccaaagtgctgggatgttgtggactcctttagagcctcttgaaatagggctagtaaagtgattttctaccactgtatctgtgctcatttacattgggcagatcacttctgcttgacttcatagtttcaacctataacatgaggggtcaacaggtagattcggaaccatcagagtttaggccgaagcccatagaatatgaaagttatttttaaaatttatttttacaatgtctacaaatgcagttgttaaagtgccagagacagaagtattgacaatgagaaattatccaaaaccaggccaggcgcggtgactcacgcctgtaatcccagcactttgggaggcaaaggtggcaagatgacttgaggccaggagtcacaggctgcaatgagttgtgttcatgccactgctctccagtctgggccacagaacaagaccctgtctctaaaaataatcatcatcatccaaaaccaagactggctcctattggaaaggtggaaatggttgtgatggaattcagcaacaccaataccttggtatttctgactttcaggatgttaggagactctttcagtccttcctgtttaaatatgaatggatatgtattgccattattgccctgcccctacatctcccaaatttagattgctagtatttatgtaagtttactagtcacaaatagattcttgcatttcccatctcttgtcatagggccctctttgagttcaatatgcttttattggcacttactttggttttctttacagcagcagctgctaattagtgacagcttttgagcaagcagcttgtcatttttggcagagataggggacatccatagcaagtcaagactatattttcatttgctaaatttactttgctacatggaaatacatcttggataaaaaatagtctgtagtcaaaggtggctgtgtttactgaattatcttcctgagttggcattctgtcctgtagttgaagaactcacagagatgaaaaaaagaaagaaagaaagaaagaaagaaagaaaggttcaacgtctatcagactgatgccataagtcctgagtcatccttctaacattaatctacattctgggtatagaacctcatcatcttgttttggcacaatcataaatctttctggattgtagttagtggcatacatggtaactgaatgagtgaattgttgacaaatgtgcttttcgtttatactcagcttctttcttgagatataattaaaagaaaggttagtttgcttagagaagatcctttctttggaattttagctcatcttagcatcatcatatttcatgtaattcttctctttgaaattgctgcaataaagtgttagctctattttacaaacttgtcacgatgtttatgagggtggcacaacttgctattatgtttaccttgattagcaccaatgatgagtcaaaacctccgtcatggtttctataaagtgtgattcactcccattattcctgtaataaggattcagattaatgacctccacagtgttaaaaatatcctgaaggaaataactgacctaccatccatttcccccaatttaggtcctttttgtaacatggaggtctataaaaattgtattcaatacacaattactaaataccaaccatgtatatcaagtactatattggggaaatcaaaatgaatcagagagacatggtccttgctccaggatggcttacagtctattagttggccagcagataacttagttgccttggttcttatgtccagagtgtagggtaaattctaattctagaggaggaaaacatcccatcttttaaaaataagattatcaaaatgatcaaagacattggatacaaatattgtactgattctatttctacctaaaggtgttaaagattgtttgaggcacttttcctaggcttgtggaactgccaggcatccttgtcccaaatttccccttgatatatcgcacagcactgttaaattcagaagttgccttctgtatcagagtgtctatttcttgatggcatagcttggagaacccagatgatcttctagcattcaactcatacttaatgtacatcaacagtaacatagttatttgtatattttcttttctttttttctttttttttttttttgagacggagccttgctctgtcacccaggctggaatgcagtggcacgatctcggctcactgcaacctccacctcctgggttcgagccattctcctgcctcagcctccccagtagctgggattacaggcacgcatcaccacgcccagctaattttttgtatttttagtagagacggggtttcaccatgctggccagtctggtcttgagctcctgaccttgtgattcgcctaccttggcctcccaaagtgctgagattacaggtgtgagccaccgcacccaatctatttgtatattttcatttgaacatttattaattatagtaggaatttatcatgtataccttgtctccaacccaatgcacagtagcatcaggtaagttgctgtttagttataggtatcatgtgaacaggtatccagatggcagctaacttcagtatcctttgttatcctgtcttacacactggggtgttttacaagttgctttctcatttctattaatgacatttccccctgtatgtaaaatgttttctgccattagaaagcctaagtttcagatgttctgtgataaatattggtgatggataataatgtaactaatggaagccccttaaggaatttgcgaacaagtttaacaaagttaacaactcagcttcttataggaaatgttgcattgctaattctgaccacaagtggtcaggatctaggttttggccttatgggaaagttacccaagcccaggacagttctcgttattctcctcccactcacttttacaatctaaagcttttggctaatttctgattgatttaaaagaatgaaggtgaacccccaccccccaaatatggcatcctttggttgtgcttgaaggtttgtcttcttagtgctaaccctcagggaagggagtcttatttaaagcctttttttttggattgtcaaataatctttttgtattcatttgtgaattgcattttatgataattcattttgtggctcgtgttataaaggagttaaactgcaggtatcactgtcaggagaaactcatttgactagctgatgatttttttttttttttttttgagacagagtttccctctatcacccaggctggagtgcagtggcatgatctccactcactgcatcctccgcctcctaggttcaagtgattctcctgcctcagcctcccgagtagctgggactacaggtgcctgccaccacgcctggctaattttttgtatttttagtagagatggggtttcaccatgctagccaggatggtctcgatctcctgacctcatgatccgcccgccttggcctcctaaagtgctgggattacaggcatgagccaccgcgcccggcctcgtgatgattttcaataagtaaaccactgtggttcacagcctgagctccgaaggtggacaaaactccttgaatatttattactactactgttattataattctattactactgctgctagtactttatttttctcatttcccatgcttattcctttgctattatttaaggtttggtgatgaagtataggaagggcttggaaatgaagtcatttattttgtttccaacacaaaacagtttctagtgtgggtgtgtgggtggcttaatttaacataacaaactaatacgtttttccttgaactccatactatcttcatttcaaactaggtattctcagagtggggttaaaatactctccatcatcaaagcccagacattttagaacaagagcttgtctcacaaaaagcctggtgtctctgttgccaccacaacctgaaactaacgagttagaaaccacatagagccaacgacatggggtaggagctcgtaacattttctcgcaagttttgtgtagatagttaagccgggaaccgatctggttgagaaaaatgtttaaaatcatcattttcccttccttctccttcacttttatactcaaaagggtctaattttgctcctctgggaagattgaatgcgtaggctttcatgtagtttaacactctcttaatttaaagaagtctgggtttggtgcagtggctcacgcctgtcatcccagcactttggagggccgaggtgggtggagcgcttgagttcaagagttcgagaccagcctgggcaacataatgaagccccgtttctactaaaaatacaaaaaatgagccaggcatagtggcacacacctgtggtcccagctactcaggagactgagacaagaggattgctagagcctgggaggcagaggttgcagggagctgagatcacgccactgcactccagcatgggtgacagggtgagaccctgtctcaaaaaaaaaaattatattttctatcctcttcccctttttgttatgtgttttacagtcttttctccatgtctaatctaagaaacttatatattcattgtatatatatctactggttgtcagcattgaaccttgcctgtgccctagcatgttgcagaatgactgacttgactttattttgagaataagttcaaaatttattctttttttatcagttgactagggaccttatctgttgttgcatttattatctctaaaataccatcttctttttctttttattttttttgagatagagtctcactctgttgcccaggctggagtgcagtggtgcaatcttggctctctgctacctccacctcccaggttcaagcaattctcctgcctcagcctcccgagtagctgggattacagtcacgcgccaccacacccagctaattttgtatatttttggtagagacggggtttcaccatgctagccagactggtctcaaactcctgacctcaagtgatccactggccttggcctcccaaagtgctgggattacaggcctgagccacctcacccagcctaccatcttatttttagatggagacttctggacattggtataaaatctggatggttccagtcctgaccttttcttcatgtttaatctcaccttcctaacacttccaccacgttgaaaaagcgtagctccatatgatcttactgcccttcgttcagtcaagcgagacactgacattgtgtagattctgggtctcacatttgctttgtttttatctggagctttactggaaactaaatgctattgcgtactagctgcagaagcaggaggggaagttggcaagaattcgctgctttctgtttggtctgtctgaggcagctgaccttttggaaggaaatcgctgctcttcgcttcttccggtaacagtgccgcctgtgaaagaacacatacacagaagggctctgccgttatcctggctgatgccttgcagcataagctgttagttaagaggtgggagcctttcagtgcatctgttgtgtgctgtaggagcatgcactcaagttcctacaccatgctaagttgtgtgtagatctactattagaggtatagtgagagacggtctgttaccagaaaaagtaggttgctttagcaaaagtaattgcattttatttactcccactatgagtgctgtagtaaatgtggacaattattttgtgcacaattttagttcatcttaatgttaaatgtcctggtaattgctttttatacctggataaccgttgttgttttttttttttccccagcaggacaaacattttgatttgctaagacatgagctcttattaaatgtcatttcttctcagaattagaataagatttttttttttttttttttttttggacaagatcttacaatgtcacccaggctggagtgcagcgacacaatcacggctcacagcagcctcaaactcctgggcttaagcagttcttctgcctgtctcctgagtagctagaactacaggcatgcgccaccacactgggctaatttgtaaattttttgtagagatggagtctcactatgtcgcctaggcttgtttcaaactcctggcctaatcagtcttcccatctcggcctcccagagtgctgggtttacaggcatgagccactgtgcctggcccagaattatcttcttctttttctcatacattttttttttttttagagaatgagtctggctctgtcatccatctggcatgcagtggcgcaatcatagttcactgcagctactaactcctaggctcaagtgattctcccacctcatcctcccaagtaactaagactacaggtgtgcgccaccacacgctactactttttgttttgctttctttgtaaagacagagccttgatatgttgcccaagctggtcttgaactcctgagctcaggtgatcctcctgcctcagcctcccaaagtgctgagattacaggtgtgagccactacacctggccaagatttagcttcttaacaaacctgctactcgttggatccactttttctgcaggacttgttttacttaaacacaggtagtaggacaccccacaacttgggattatttttggaaagctgtagttgggtttcatatcacccagtaagcaaacaagggaactaaccagctgatgaagcgtttctctcttaaaagaggagatttcagttttgtattgttttaactaaaacatattcagttcagtttttattttgttatttgaaatgacatattcaagttatgtctaagtaaaaatgaaacattttaattcatggcaaattaagagaacacagctacctggaaaacggggcaaactgccatatccttctgtatttagttttggttcggtggataggtgtgcttttctaaggtattattggtctcttccctagatttgctgttgatggcagagatggttgggtgaaggtttgtgttgatgtacataaaagacatagagattagtacagagagaaacatctcagggcccccttagcaagattgccctgcagtgcttctgttcttggaaactggtctgatctgttccactttcctggggtaatgaagaatccagggggaatacaaaccctgcgttggttttaggtataggttcttggcacaaaataaattgatatcaacaaaacaggaagatttctccccggttctgttggcctttgagtaggagcgaagttaggaaccaacagctgaggtttcctgtgatctgctcttgtaatgatagctttctagacaccttgaattgttactcttgaactgtcaacggccttcacgtaagccagttgtgttcaggtatgtgattagaggtaagggatgtgtttgtttgtgtttagaaatggggtctcactttgtggctcaggcttgagcatagcggcgtgatcatagctcactgcagccttgacctcctgggagcgctcctgtctcagcctcctgagtagcttggactgcagaagtgagtcaccatgcccagctagaaagttttttattttaaagaaattctggtaccgttgtgagtgactttctgtgtatttcgttctatttacagttggtacaagtttgcttagtcacatcaaagatgaaagagggccactaatatatataaatatatgtcagaattacaaattaatctgctattaacagtcttaaatcactatttgaaaacacatttaaggcactatatatttgaaagtgaaagaattgcattttaaaaaaaatttttttataattctgaatttttactttataattctgaatgttctacttaaaattaaaatttttttataattctgaatttttactttataattctgaatgttctacttaaatcaaggctgcccaggtaagacagtgtcataacctggatattatcatgttaggaaatatttcttcctgtgttttatgtctctttaaacttggttcctgtgggatagtcagtagtaccaattccccattgattattaaatttatatcttaagttttacattttaaacacaatttaatcaaaaactttacaaaaattgtaccaaaaagccccttcacctaaatgtaacaactgtttacacttctctttgacctttctctatttgccctcttgcatacgtgttgcatacacttttcatttaacattcttttatttctactctaaaaaaatgtgtctacaggccaggtgtgatggctcacatctgtaatcccagcagtttgggaggccgaggtgggaggatcacaaggccaagagttggacaccaggctggccaacatggtgaaaccccatctctactaaaaatacaaaaattagggctgggcggggtggctcacgcctgtaattccagcactttgggaggccgaggtgggcagatcacccgaggtcaggagttcgaaaccagcctggccaacatggtgaaaacccgtctctattaaaaatacaaaaaattagccgggcatggtggtgggcacctgtaatcccagctactcgggaggctgaggcaggagaattgcttgaacctggggggcggaggttgcagtgagccaagatcgcgccattacactccagcctgggcaataagagcaaaactccgtctcaaaaaaataaaaataaaaaattagccaggcattggtggcagatgcctatggtcccagctgctcaggaggctgagacaagagaattgcatgaacgcgagaggtgggggttgcagtgagccaagatcatgccactgcactttaaccctgttgaaagagcaagactcagccaggcgcggtagctcacgcctgtaattccagcactttgggaggccaaggtgggcggatcacaaggtcatgaggtcgagaccatcttggccaacatggtgaaaccctgtctctactaaaactacaaaaattagctgggcatggtggcgcgtgcctgtagtcccagctattcgggaggctgaggcaggagaatcgcttgaacctgggaggcagaggttgcagtgagccgagatcgcgccactgcactccaacctgggtgacagagtgagactccatctcaaaaaaaaaaaaaaaaaaaaaattagccaggcattggtggcagatgcctatctatggtcccagctgctcaggaggctgagacaagagaattggttgaacacgagcggtgggggttgcagtgagccaagattgtgccactgcactttaacccggttgaaagagcaagactctgtctcaaaaaaataaataaataaaataaaaatttaaaaatgcgtctacatggtttttatatttcaacatagcttttatatttcatttaactggttgcaccatatcccattagattaatacattatagtctaatcatccccctattttggacattttggttatttctgtttgtcccgacggtatatatccctgggaattggcctgaatcaaggcacttgtcaaagaaaattttgctaggtagaaactaaacactgtaattctcaatggtaagagggaggccatgaactttaatagggaaaatattggtaacatgtgtggatttattaataaattgcctgttttgtttgtttttaactttcaaacaagaggaaagggattatatttcatttaagcagtatagaaacagggtattgtagtagctgaggagtttttttcctgaactaaaagatttgaattgtccaagagacagattctaagatgagttgatcttgaattacagtacaaatataaaccttcactagaaattctgaggctggctgggtgtggtggctcacacttgtcatcccagcactttgggaggccgaggtaagaggatcacttgagcccaggagttcatgaccagcctgggcaacatagcaagaccccatctctaaaaaaaaaaaaaaaaaaattagccgggcatggtggcacacacctgtggtcccagctactcagggggctaagggaggaggatcacctgaacccaggaggttgagactgcagtgagcagtgattacgccatagcacttcagcctgagtgacagagtgagaccctgtctcaaaaaaaaaaaaagaaaagaaaagaaagaaaaaaattctgaaggtaagataggactacatggcagcttcaaatcatttcttatttttccgtaatgcagatggtcattaattttgggctacagcaagtgcttttagtcatctggaaagtgatacagatgtagcttcttcccaaagggatcgcaaatccattatctccatggatttggacatggagataatgataacacatgtacactgtgggccaccatggcacaagagagcccaacttgcatgctggtggcctgcaagctgcagcacaacgcctaagaagtccagatttttattgaccaccagggacagtttcaaagtgagagtcaaacctctgctttcattgctttgtttttcttttttggaatgtttgcccttcattttgattttgaaaaaagtgtacatgacttaaaagtggaaagaatagaacaatgagtactcgcatatacttcacctaggttgagccagtgttcacagttgttagatttactttcccacactccccaccactgtcactcttccgtttctcctgccaaagtaagatgcagacgacatggccatttaccctcaaatacttgacagtgtatctactcccagcaagggcattcttctacgcaacctgaatgccattgtcactctcaagaaatttagcagtgataaagtaatatctaatatataatgatataatggcctttagagctgtgggtgtttttgtttgttttgagacagagtctcactcagttgcccagcctggagtgcaagtggcgcaatctcagctcaccacaacctctgcctcccgggttcaagagattcttgtgcctcagccttcagagtagctgcaactacaggcgtgtgccaccacgcccaactaatttttatattttttttttatttattttttttaagtataaacacatatattttttaaagtttatttttaacattttttttttttaattgatcattcttgggtgtttctcgcagagggggatttggcagggtcacaggacaatagtggagggaaggtcagcagataaacaagtgaacaaaggtctctggttttcctaggcagagggaccctgtggccttccgcagtgtttgtgtccctgggtacttgagattagggagtggtgatgactcttaaggagcatgctgccttcaagcatctgtttaacaaagcacatcttgcaccgcccttaatccattcaaccctgagtggatacagcacatgtttcagagagcacagggttgggggtacaatttttgtatttttagtagagacagggtttcaccatgttggccaggctggtctcgaatgcttgaccttgagtgatcctctgggcttggcctcccaaagtgctgggattacaggcatgagccaccacacccagtcgtgtttttgtttttgaattacgctcttggttgtgtctcttcagtctcctttaacctagaacagttccacctgttttgggtggggggtgggatcattgattagagtctcacaatttggatttgtctgattgtttcttcatgatttagtttgtgtattcttttcagcaaatcatatctggaggcacataatgtcagtttatgccatgattggggatgtttgatcactcggttaaggcattgtccgccagatttatccacagaaatgcaccttttcccctttgaataataagtaatatgtgagtagtactttgagactaaatgctgttccccaacaactgtcacctaatggttttagtagctgtgatgatccttgtctgagtctactctctttatttttgagattgtgcatctttggccaagactttatatcctatatttagatgagagttttaaatatatagtaacctgctgattgaaacctgatttttatatttagtaagtagatcctttctctaccttctcctttattccctcccttacccttttcccctcctccattctctgttcttcctattgtaatatgcagtgatttggctgtgacataaagattaatggcggattgtcttcccagaatactatcatctctatgttgcctgggcacatttttccttgtttgcttctttgtgagccaaatgcttttattctttctgttctcttcccatctgtttaataatgtgattttttaaaaagagaattggcttcctgattgcatatagggtagtatttagaaaaaaaaaattaaagagcagatggctctggtattaacctgcttctagatgtgatagccttcttacttgatattagtccaattttaatatgaatgaagtcttaatcctttattgctgctattgaatatttttccgtccctcaaaatcgctatactaggctaggcatggtggctcaggcctgtaatcccaacactttgggaggccgaggtgggtggatcacttgaggtcaggagttcaagaccagcctggccaacatggtaaaaccctgcctctactaaaaatccaaaaattagccagacacagtggcacatgcctgtaattccagctactcaggaggctaaggcaggagaatctcttgaacccgggaggcagaggttgcagtgagccaagatcatgccactgcactccagcctgggtgacagagcaagactctgtctcaaaaaaaaaaaaaaattgctgtactaggtgaccaccaccatttaatatatttaataatgttggtatcaacagaaagcagtaaacataattagggaatttgctcttttttttttttttttgagatggagttacactcttgttgatccatcagcacaactggagtgcaatggtgcgatctcagctcaccgcaacttctacctcccaggttcaagcgattctcctgcctcagcatcccaagtagctgggattacaggcatgcaccaccacgcctggctaattttttgtatttttagtagagacagggtttctgcatgttggtcaggctggtcttgaactcccaacctcaggtgatctgcccgcctctgcctcacaaagtatgggattacaagcatgagccaccacgcctggctggaacttgctctttatattctgtacagaatccttagtcattcactggagctgataggtttaacagttttgaaccctggctccttgccttgtacttttcagatcagaagcaatgtttaaacgtcatctctttgatctgtcacccagccctagcctttgccaaaatcagagcccctcagtattaggtttcttactttaatttttcattctttgctctctttaaattatgaaatataacaaacaggcagaaaagtacatagaaaatggcaaaccaccttaagtcctcaacatgcatgcagcctggtgcagtggtgcaagtaagtgcaggttctcaggtaggtccagcccagatagtaccccttagtagtatggaccgaccctggagcaagtgtttcacctctttctctttttaaaaatagctttactgagatataatcacgcactataaaattcaccctttgaagtatattctcagagttatacaattatcaccactatctaattccggaacattttcatcatcccctcaaaaagcccttaccttttagcaatcattccccatttctccctcccctcagcccttggcaaccaacaatctattttccgtctctatggatttgcctattccggatatttcataaaaatggaatttacagtatgttcccttgcatgcctttcactttacataatgatttcaaggtcatccacactgtagcatgcgtcagtacttcattcctttttaacatctgcataatattccattttattcattgtatttatccattcctatccatatttatctgtttatcctttggtggacatttgagttgtttccactttggggcgattatgaggtgattatgaataatgcagctgtgaacatttgtgtacctgttttttgttttgctttgtttttgagacagagtcttgctgtgcttgccctgtcatccaggctggagtgcagtggcacagatctcggctcactgcaacctccacctcccagattcaagcaattcccctgcctcagtctcccaaatagctgggattacaggcacccgccaccgtgcccggctcatttttttcttttttaatttttagtagagatggggtttcgccatgttggccaggctggtctcgagctcctgacctcaggtgatccacccgcctcagcgtcccaaagtgctgggattacaggcgtgagccactgcacctggcctgtgtacccactttctggggacacatgttttcacttctcttaggcatatacccaggagtggaactactggataatgtagtaactctatgtttacccttttgtagaattgccagatagttttccaaaactgtttcaccatgttacaattctacttaatcttgatgaccctcaatttcctcatccataacggggataataatagtgcctacgtctgagggatttaggataaagagtagattcataaaagcacttgttataagtaatatactaagtgcttagctagctcttaaatctggatgggggataataataacactgataaatgttatttatttcttatcctatttctgaagtttatttttatttattagatgaattgaaatatttgttgctaataattcataaagcagtataataaatgaaaacttcaaatttcattagttgttttttgtactttaattattaaaagtcagatatgtccttggaaggaataggtaaaggcatggctccctgctggcttagtcctctctgttcaacaacatattagaaggaatggaataggtagttttcttctcctttttttttttttttttttttgagacagagtcttgctctgtcgccagcttggagtgcagtggcatgatcttggctcactgcaacctctgcctcctgggttcaagcgattcttctgcctcagcctcctgagtagctgggactacaggagcatggcaccacgcccagctaatttttgtatttttagtagagatgggttttcaccattttggccaggatggtcttgatctcttgacctcatgatccacccacctcggcctcccagagtgctgggattacaggcatgagccaccgcacccggcctcttcttttttcttttttttttaagagtttagtatgcatagggcaaaatcaaagccttgctgttactgtaccaccctcacccttcacaattctccattctttcattcaaagatgagagaacagacttcatggtgcctttccaccaccacctcccaagagttcctgtctgcagaagtccttgtgccagtgaaattgattaagaaataggaatgccatcttttaaaagggcccagcacagcctgtaatcccagcactttgggaggccgaggtgggtggatcacaaggtcagaagttcaagaccagcctggccaagatggtaaaactccatctctactaaaaatacaaaattagccaggcgtggtggcgggcagctgtaatcccagctgcttaggaggctgaggcagataattgcttaaacccgggaggcggaggttgcagtgagcccaggtcacgccactgcactccagcctgggtgacagaacgagactctgccttaaaaaaaaaaaaaaaaaaaaaggccaggcacaatggcttgtgcctctaatcccagcactctgggggaggctgacttgggaggatcacttgaggtgaggagtttgagaccagcctgggcaacatagtaagaccttgtctctacaaaaaaaaaaaaaaaagtttttttctttaattagccaggtgtgatggcatgtgcccacagtcctagctacttgggtggctgaggtaggagtatccctcaagcccaggagtttgaggctgcagtgaaccatgatcacaccactgcactccagcctgagtgatggagtaagaccctgtctcggatggatggatggatggatggatggatggatggatggatggatggatggatagaaaagtttatactggaggatattggttaaggagaaggatagcaagagctatttgtggaggattgatttttggaaagtttattaaattgagttaaaattagagatgggagaaagaagccggttttgtaagtttaaggtaacagtaagaacagtagtgagtacttacagagcacctgctcttagctagatactgttttaggtatgtacataaaactaattcattcttacagcagccccctaaggggcataagtattattattcccattgtacaaataagaaaactgaggcacagagaggcttaacaggctgtctttggcagaaccgtatttaggtgagttcagcatcatctctaaaagtttaaccccagtttagagactttggccctgggatggggggtaggatggagaatcggaattacaaaatgctttaaattatacatatgaatccagcagaccaaatctgctggattcatattattcatattatgcataatattattcatattaaccccctactcccaccccacactagaattcattcactgagttggcagatacacagtgggccttctaatgtcagacactactctccactgcagtttagctagggcaagaccttggtcacagtgttctacaagtcttcagagagagagtaatgtttttctttgttatagtttatattttacttttagaaaggaaaagcatctgagaaaagatatttatgactgagacaaaattattccaaatcccactcacttatatcatttatttatgtggtggacattcatttttatggttttcagtaagcctgtaacattatgagctattagactttgaaacttttattaacaagtgcctgagggcccgactgatttatttggctctccaagcccatgggtatatccagatatataaggttgaggtaggtgctttatgccttcagaaagtacagggttctgcatccagggctgtcttaggttgttctgaaatgtctgtgaacacagagtgcaactcagccgagctcaaatagttctcatctttggcctaaaaataagattgtgaatccatttcccagtctttagagaatcccctgtgatgatttaccaaagaacaaactacttcccttgtctgagcatcacgcactgaaattggagctgcccgtaaataagcagaagatggcgggtactggggacagaggtacagtctttgtagatgcagagtagcgttcgatggctagatgaatgccagttagaaggatgaatgccggttagatgaatgctactcatatcaggcatgtggacatagcctgataatggggtgaagagttgtgacatgtatgaagaaaaatactacttaactgccaggcacgctggctcacgcctgtaatcccagcactttgggaggccgaggcgggcaggtcacctgaggtcagtagttcaagaccaacctggccaacatggtgaaaccccatctctactaaaaaaaattagccaggcgtggtggtgagtgcctgtagtcccaggtactcaggaggctgaggcaggagaatcgcttgaactcgggaggcagaggctgcagtgagccgagatcatgccactgcactccagcctaggcgacagagtgagactccgtctcaaaaaacaaacaaacaaaaaaccactacatagcttctaggtgttattcacgtaactgggagaacagttggttttttcctaaactgggtgtttagaatttataatgataatctcagtaagtcatctcatatttcacatatagataattttcagtttaacagtaaaataaaaatgactctgtactagttagtgtacttttattttacacttttgaatagcagtgagcagaatctactctccagctctatcaaagcacttatgtgtagtgaaactatattgtatttatcaaaataaggtgattgccacttggtatttaccagctattatccttcaaatgggatgctattttagaaaataattattatggcatgttcataactagaatcataaaaatattctacaaattctaagagctcagcattctactctttgatgaaaactaagaaataatctaaaatttaaggcaaaatagagtgacattttttaatacccctacatgcatagtatatcaccacagtatttctttcctaaaacagtaataggctcctaaatatgcttgaccagcagggaatgttaaatatttgtttgtgtatttattcgctccgcaagtattttttgaccactttccataggcaagccaccgtactagacactggggacacagtcgtgaataagatgtgctcctggccgagcgtggtggctcacgcctgtaatcccagcactttgggaggccgaggagggcagatcacgaggtcaggagaccaagaccatcctggccaacatggtgaaaccccatctctactaaaaatacaaaacttagctgggcgtggcggtgtgtgcctgtagtcccagctactcgggaggctgaggcaggagaattgcttgaacccgggaggcaaagcctgcagcgagctgagatatctgcactccagtctgggcgacagagcaagactccgtctcaaaaaaaaaaaaaattgtaattgattatttaaatggaaatctgttccattttcatgccttggtgtttcatactgatatattgttcaattataactttgaaaagagccaatagaatcggtcaaattgtgtgtatacatttatttatgcaacaaaaaaattatgatgcttatgtgccaggtaccgttctagacccaggagaaagcacggtgaacaaaacaaagtcattgtgttcatggtgatttcaccctggtgggaagtcagtaagcaaatatatgatcaatatcaggaattgataaatgataagaaaaataaagcagattaagaggatagagagtgaccagaatgccgttttatttgagtgggctgggaaggagtctctggggagataaaagttttcatagctttccttcttttgtctctgaagtcaattcacctaatgaatgcagatgcaagagaatttttgtatctgttggtatcactcacatattcattgagagctatggtgagggcctacttcttactctttactacttaggaatactaacacctagattcttctcttcattcttttatcactcttccatatacttaagtgcctaagcaccttcattcatccatcccttatataattttttttcttgagacaaaatctggctctcttgccaggctggagtgcagtgatgtaatctcggctcactgccacctctgccacccagattcaagcgattctcctgcctcagcctcccaagtagctggaattatagacgcatggcaccacacctggctaattgttttgtaattttagtagagacggggtttcgccatgttggccaggcttgtcccgaactcctgacctcaggtgatccacccacctcagcctcctgaagtgctgggattacaagcgtgagccaccatgcctggccatccattccttatccttcatccaaaaatcatgatttggtatctgttctggttttccaaaatcttgcgatatgatttatttgattaaaaaatacattgtgcagttaagtgacttccagtgtttgattataaagtggaattgcttctggagagagctcttttatctaagtgttttggtgaactcacaaccactgaaatttgatgtcttgggtcaaattgggtctacagtgatcccagccttaatgcctaaaagccctaaataatacacttctcaagtgttctatagcattgcactagtctaaaatagataactggcactcccctacacctcattgttggctaactgacttgtcccataaatagcccagtgttacgtgatcagacaactacaactaacagaagagatttttatttcctgacacacttgtacagtctctggtagtaaacaaaatccaagtccaagtcaccggcccctaactgtaacctagttcttagaagaattgtgcaaatcagtagccaaatcatgtgggatggaattcaagataaccctgccttataccaaactctacattatggaaaatagtgttagagcaagattcattttcagtccttagagttacctgaagtcccttcccagtctacccaaatgtttctgccctaatctggttaaactcaaagagcatctgccagatgagttaaaaattgtcaggtgagtctgaggggggcatcatggtagttttataaagcctttctttaaaaaatcaagagcatgttaaaaaaagaaactaccggctgggtgcagtggctcacacctgtaattccagcactttgggaggctgaggtgggcggatcacaaggtcaggatatcgagaccatcctggctaacacggtgaaaccccatctctgctaaaagtacaaaaaattatccgggcgtggtggcgggcgcctgtagtcccagccactcgggaggctgaggcaggagaatggcgtgaacccgggaggcggggctagcagtgagctgagatcgcgtcacggcactccagcctgggcaacagagcaagactccgtctcaaattaaaaaaaaaaaaaaagaaactacctgctattggagtataatggttcatatttccaactcttaggtggaatgtattgtttttgtgtctgaaagatttgtaaatgctataatttaacaacattgcttcataaattccttagcagtaactcaggaggtgaaccttcgggcatttttccagataaatctgtgctctttgtgtgcaaagcattgctgcttaggtaactagtgataatgcatagggttcaatcaacacttcagatattttcacttttcttttactgggctttttcaaaatggcatatgtttattatatttctgaagtcaaaataccaaatctaaaacaagtgattttttaaaaaaaatctctcagctgggcgcagtggctcacacctataaccccagccctttgggagctgagatggatcacttgaggtcaggagtttgagaccatcctggccaacatggtgaaaccccatctctactgaaaatacaaaaattagctgggtgcggtggcgggcacctgtaatctcagctacttgggaggctgaggcagtagaattgcttgaacccgggaggcagaggttgcagtgagccgagatcttgccactgccctccagtctgggcaacagagcaagactctgtctcaaaaaaaaaaaaaaaaaaactctctgctaattatttattactgttgaaatgctgcttaccatggctgacaattttgaacaaaagtaaagaatatgtctacgatgtcaaagttagcaattctttccctaattctccttttgtacttttgcttataagaccttagtacatttcatagtcagagcttcatagacccagctgtgtatctttccatggccaggctgagtgtctacattttgaaaacattttaaagttaaaattcagttcaagaatattgtctttagtctaccaaaagggctaaaaacatttactttggccaaacgtggtggctcacgcctgtaatcccagcactttaggaggctgaggtgggaggatcacttaaggtcaggagttcgagaccagcctggccaacacggtgaaaccccatctctactaaaaatacaaaaattaaccaagcatggtagtgtgcccctgtaatcccagctactcaggaggctgagacaggagaatcatttgaaccggggaggcggaggttgtagtgagccaagattgtgccactgcactccagcttgggtggcagagcgagactgtctcaaaaaaataaaaataaaaataaataataaaataaaaacatttaccttggtaactaagtgaatatttactctggtggatgtaaggggaaaataaagaaaaaacgcccaaagcactgattgtttgttcaacagattgtaaaccatggctgtgtggatacaagctcagcagctccaaggagaagcccttcatcagatgcaagcgttatatggccagcattttcccattgaggtgcggcattatttatcccagtggattgaaagccaagcatggtaggtgaacaaggatgtttgcatcatattttgtgaaacacaagaatattggagtttgtttagaaagatgtcatgatggcaactttcaaagttgtatttttaaacatttttaaatgtgatccataaaaaggtatttaaaattttttttctttttataggtgaaaggtatttaagcccatcttagattgaggggatggaataactcttgggatttttaaaacaggatttgttcccctttaatagtaaatactgtctaaaagcattagaatattactgctaagaaagagcagccaacaaatatgtttcgagtgcccatgggatgcctagcagtgtcctaagtagtagaatttatatgaaaaaaattaaagcccaacattgtgttgtaatcccaacactttgggaggccaaggcaggtgtactgcttgagcccaggagttcaaggaaggcctgagcaacatagcaaaaccctgtctctgtacaaaatacaaaaattagccaggtgtggtggtgtgcacctgtagtaccagctacttgggaggctgaggtgggaggatcacttgagcctgggaggcaaaggttgctgtaacccatgatcacaccactacactccagcctaagcaacagagtgagaccctgtctcaaaacaaacaaacaaacaaaattaaagccctcatctccagataattcagtgtttcactggacatggtggtgcacacctataatcccagctacccaggatgctgaggtgggaggattgcttgaccccagcagtttgaggccagcctaggcaacatagcaagatcctatgtcaaaaaataataataataatttagtgtttaatggggcagataggtgtgaatatgcatataatttaattataatttatttcttatagtttattaaatataaattattttacatttcttaataagtttacatctaacaaaaaactaaaaattaataatttaacagtggagacattggtgtttttaatttatatgtattttatatatacacataaagactaaaagaaaattgagtgggtgttgtggctcatgcctgtaatcccagcactttgggaggccaaggcaggcagatcactggaggccaggagttctgagacaagcctggccaacatggcaaaatcccatctctactgaaaatacaaaaaattagttgggcgtggtgacgggcgcctgtaatcccagctactctggaggctaaagcatgagaatcgcttgaagtcgggaggcagaggttgcagtgagccgagatcgcactactgcactccagcctgggcaacagagtgagactgcctttaaaaaaaaaaaacaaaactaaacgaaaatatacccaaatgttaacactaattacattctggtggtagatttgataagcattttaatttttctttattttccagattactgattacatacttgggggaggggagagttgttttaaatttcttttagaattagtacagtgcagtcgactaacagcacaggtttttaattggtatcattattacacaccaggcagcaggatgtacactgctctgctcaaggtctgggaggttgctggttggttacagtctgtcagtcgatctgacatattcatttgatacttcaagcctcaccgtcttagccatgggtcctctttgacagtccctgagagaaccagctttgatgctgctatttgcaaagggccatatacctgtctgtaatgttgccttagaataatcgcaatgcgtgttagtagcaaatttctgttcagaaactaaagatcaccaaagaaaggcaattttctaggcaattaaaaaaaaactcaacttcatgtaattaagtgagggaaaaaaattagctaaatatgagaatgtcagctgtacctcgtttagtgctttccactcccttttcattttctctcctgttttctgatgtggaggatttagaaaaacatgagtaggaagttgctgttaatttcagatttcacttagcagagttctcatttggtgttctcactgaatgaattaaaagacttgtgttgatattaaggaaaacttgaaattttttagctttggttttcttcagaatataaagattttaatgaagaattttcaattcttttttttttttgagatggagtctcgctctgtcaccaggctgcagtggcgtgatctcggctcactgcaatctccgcctcccgggttcaagcaattctcgtgcctcagcttcccgagtagctgggactgcaggtgcccgccaccacaccgagctaatttttgtatttttaatagagaccggggttcatcatgttggccaggctggtctctaactcctgaccttgtgatctgcccatttcggcctcccaaagtgctgggattaaaagcttgagccaccgggcccagccaaatctttagttctttatgtttaagccatctaagcaagtcttttttttttttaacagagaattaaggtttcaagtaaagaaccaatacctgacttctgtgagttttgctcagagactggatccttttaagagtgggctcctggccgggcacggtggctcacgcctgtaatcccagcactttgggaggctgaggtgggtggatcacttgagatcaggagtttgagaccagcctggccaacatggtaaaaccccgtctctattaaaaatacaaaaattagccaggcgtggtggtgcacgcctgtaattccagctacttgggaggctgaggcaggagaatcacttgaacccgggaggcagaggttgcagtgagctaagatcgtgctactgcatcccagcctgggtgacagagtgagacttcgtctcaaagaaaaagagtgggtttccagaccaagggcattgttgccagttgaaacagaggtgcagggctgccctcattccttccagcctttcatttaatacgtattctatttaatacatagggcacacatatttagaatctgacttgccttaactgccttctcaaggcgcagattggggtgtactatttgatggactatggtatcactgctttttttgttttgttttgttatgttttcgtagagagaatcttgctttgtcacccaggctggagtgcagtggcgcaatcttggctcactgcaacctccacctcctgggttcaagcagttctcctgcctcagcctcccaagtagctgggactacaggcacatgccgccacgcccggataatttcttttgtgttttagtagagatggggtttcaccgtgttgcccaggctgatctccaactcctgagctcaggtaatccgcctgcctcggcctcccaaaatgctaggatcacaggcgtgagccaccacgcccggccggtctcactgttttgatacacttgttggtgcctcttttttgaaattagttgctatcttcagggatttagggatggcagagccttttagctaccactatcttgtttggctccagacccagtcagcagttattgaatgttatttcagtccgacagctgtttggtttcttcagtgagtaagtaatttggtacttcccagtgtcaattgttgcctaagtagtagaaaggaaggaaggaacggaaggaaagaaggaaagaaggaaagaaaggagggagggagaccatccaacccccgtcaccagttcagtagcttgaaatcaatgcaaagtctgtagcgtggttttccttgtttactggaaaagttggcattgccttcaggtcctgggtctgcaactagtgacatgaatgtctgactcgtataaattcttgtaggcaccctctgcctgaatgtctcatttccagggcttcttagaaatagcaataacttgtttcacctgtctctacctaagaaacccacagataccaaactccttgaggctggaaaggacatgtagaagagtcttggccttgtgcctcctttacacccatgaggggtaactataaataggaaattatccaagtccttatttccttcagagtacacagaaccctttccttttccttgcatttctcggagcaaatagcataagcaccaagcacatcattgagagaaaggaagaagggcagcacattgttaaaaatttttttttttaaaagaaggaaatctactgtataatccaactatttagtaaattacaaatagattaacataggcattgagtccatttctgttgggctgtttcttaaaatttgcagtgaggattaaaaacatcactttagttgaagaaaaagtaggatgtgttgaggctgtatttatacaggctcacgtgcatgtatgtatacagattatgtaatttttttcccctagggactcagtagatcttgataatccacaggagaacattaaggccacccagctcctggagggcctggtgcaggagctgcagaagaaggcagagcaccaggtgggggaagatgggtttttactgaagatcaagctggggcactatgccacacagctccaggtgggtgtgggctctggggtcacacttaattaccttcccttgggggtcttcttcctgtagagactttctttctctccttcagtccagcattgttgagttacacgtgcataaggttcttgttgtgtggttttggtctttttttttttttttactttttatttgagaataatttcatacttccagaaagttacaagaatcatacaaagattccccacatatgcccatattcacctgttgttgacttttatgttgtcatatactcctcgctgtctctcgacacacacgtttttcagtcactggagagtaagttgcataccttgtgtccctgcaccagtaagtacctctgtgcattttctatttatttatttatttatttatttatttatttatttatttatttatttatttttgagacggagtcttgctctgtcgcccaggctggagtgcagtggagcaatctcagctcactgcaacctctgcctcccgggttcaagcgattcttctgcctcagcctctcaagtagctgggattacaggctcctgccaccatgcctggcagtttttttttttttttggtatttttagtggagacggggttttgccatgttggccacagtggtcttgaactcctgacctcaggtgatccgcccacctcagcctcccaaagtgttgaaattataggcatgagccactatgcccggtccctctgtgcattgtctttttttttttttttttttgagatggagtttcactcttgttgcccaggctggagtgcagtggcgcggtctcggctcaccgcaacctccacctcccgggttcaagtgattctcctgcctcagcctcccaagtagctgggactacaggtgcatgccaccacacccgcctaatttttgtatttttagtagagatggggtttctccatgttggtcaggctggtttcgaactcccgacctcaggtgattcaccctcctcggcctcccaaagtgctgggattacaggcatgagccaccgcacccagcccctctgtgcattttctaagaatgaaccttgtcttgcatggttataatacactgatcaacttcactaaatttagcattgatataatacttttaggtactcatctggatttccattttgtcaactaattcaaacatgtcctttagggtatttttccccgctgcagtccagaatccagcccaagatcacatattgcatctagtcatcatgtctctttaatctcctttaatctggaaccattttgcaaccttactttgtctttcattacattggcattttaaaataattaatgtaggctgggtgcagtggctcacaccagtaatcccagcactttgggaggctgaggcgggtgaatcatctgaggtcaggagttcgagaccagcctggccaacatggtgaaaccccatctctactaaaaatacagaaattaactgggtgtggcagtggacaactgtaatcccagctacttgggaggctgaggcaggagaatctcttaaacctgggaggcagaggttgcagtgagccgagaccgtgccattgcactccagcctgggtgacaagagtgaaattccatctcaaaaaataataataataattcatgtaccccctgctttttaaagataaaatgttcctcatttggggtttgtctgatgtttcctcatgattacgttaacattgcacatctccgagcagacttctaaatatagttggctgtccatgtccatgggttctgcatcctgattccaccaaccgcagctcagaaatattcaggaaaagaaaaaaagtaaaaacaaatagaaataaagatatgacagaacagctatttacatagcatttcttttgtattagatagtataagcaatctataggtggtttaaagtgtatgggaggattgtatgcattctatgcaaaacgatgccattttatataaggaacttgagcatctgcagattttggtatccaagtgggtcctggaaccagcccccacagatgccaagggacaattgtaggtgacttgtccttctcgggtatcacatccagaggggggcagtgtccctcgtcccctcattggtggtagtagttttgattgcccatttgagagtggcatccagtttctcctcttgcgaggcttttaaaacttatttattccgtttttaagaatgttccccggatactttaggcaaattaagatgcaaaaagtaaaacagcactttgggaggctaaggcaggtggatcacctgaggtcaggagttcgagaccagcctggccaacatggtggaaccccatctctactaaaaagacaaaaattagccaggcgtggtggcgggcccctgtaatcccagctactcggggggctaaggcaggagaattacttgaacccaggaggcagaggttgcagtggcccgaggttgtgccactgcactccagcctgggcaacagagtgagactcagtctcaaaaaaagaaaaaagaagtaaaacaatcttaccttttcactgcaattggatttccatgatgtgccttcttgttcctgttggtattggaggaacagtgcctcctgtgattcaggaggtccctcaggaggctccccatcctgaggcatggttagggcccatagtgtggagtggcacaaagtgatgtctgctgttggattctttcagaacacgtatgaccgctgccccatggagctggtccgctgcatccgccatatattgtacaatgaacagaggttggtccgagaagccaacaatgtgagtgtcccatagggatggggagggcagtcgggaagtcttttcttacccacctccctctggacccacctttgtcaaggtgactcagggtgcactattggtgtctctttaaagagagcttcatcctaaggggcacaaaagaaataggagacttgactgagtgcagcccagcactttgggaggctgaggcaggcagattgcctgagcccaggagttcgagagcaccctgggcaacatgatgaaaccccgtctctaccaaaaatacaaaaaaattagctgggcatggtggcatatgcctgtagtcctggctgttcgaaaacctgaagtgggaagatcccttgagcccaggaggtagaggctgcagtgagccatgatcgcacccctgcactcatgggtgatggagtgagaccctgtctcaaaaaaaaaaaaatgaaatagaagatgtggtctctgatcttaactgatttataaccttgatgagattgcaaccacaagacaatgtgaacaagtgcaaagtaattcaacctcagctgaataattttttagtaaaggcatgctcatattcaggtgagaatacttaggaaagacttttccctagcccctgaatcaggtgtggaaggagtggtctgatcaggtcacttacagggctgggtccacagagaccttgtttatgcctcccccatcacttcaccctggggtctccaggatgcctgcaagaggtttggcctcttccatggtggaagcaaatgattccatcacgagaatatcttgagtgaggacacagatgatgtgtgttcacatggccctgctccccatggcctccctaatgcttaatgccgtccttgcattgggtcagtgagtggaagaggaatcactccacctcctcattagtaggaaaacccaggtgacactggaccaggttacgttctagtttctccaaaggtaattcaatggacctcgtttggaatactctggtggaggtcagatctgaaatggaagcttctcccatgctttgtgatctgagccatgatctgtccgctcacctgtttctcacttttcccactccaccctgtgtctcatgatgacgtttgcttttcctcccgactcaaaatttaccttttggggtcttaccctggttgtaggagctggcttttcctggggattaaggcctcagtcttcctcccattcgcactgccttgcactgccccccatatgttcccagggtagctctccagctggaagccttgctgatgccatgtcccagaaacacctccagatcaaccagacgtttgaggagctgcgactggtcacgcaggacacagagaatgagttaaaaaagctgcagcagactcaggagtacttcatcatccagtaccaggagagcctgaggatccaaggtgaggcgcggtggaggcacattgtgcaacttgaggattgggcctggggactggaaagcagctctggtggggttgggagaaagcacactttccattcggaggcagcgacctttctctgagtagcagggacttatttgcattgaagacagtgctgagaggatgagatttaggaaggggagatgacaggaccccccgcttaagtgcatatctcactcaggtccccacatccagggagcttctgagctgccagggaagacatttcttcttttgagaaggagctcacagtctaaataaatactagcaaacaatacttttgtatatagtaggcatattataagtggagctttattgaaatgataaataggaaattatataattacatgtttaaaaatttttctggctgggcacggtggctcacacctgtaatcccagcactttgggaggctgaggcaggcggatcacctgaggtcaggagttcgagaccagcctggccaacatggtgaaaccccgtctctactaaaaatacaaaattagctgggcatcccagtggcgcatgcatgtaatcccagctacttgggaggctgaggcaagagaatctcttgaacccgggaggcggaggttgcagggagccgagatctcaccattgcactccagcctggacaaaaagagcaaaattctgtctcaaaaaaaaaaaaaaaaaattctaagctgggagtggttttgcacacctgtaatcctggtgctttgggaggccagggcaggaggatcacttgaggccagtagtttcagactagcttaggcaacatagtaagaccctatctctaagggggaaaagaaacctttctaagcaggtacgtgtaagtactaaggacctgtatatgatttctaatgttctatgcagttattcacagaggtcttcctgaaacagagtacacttaacgccccttaggtagcccttatggacagagcttccctagcctggtataaatcctgcttagtagttggggcacagagagcttcagtctgtggtgaggctgtggagccccaccagcgcccccttttgaccctgtagcagtttggcagtttgagctttaatagtttcctctctgcttccatgcccagctcagtctcagagaagccttggctcaaccacccagcccctccaaacacacacacacacagcacacacagacaacacagcacacacacacaccacacacatcacacacacagcacacacacacacagcacacacaccccccacagcacacagagacacacagtgcacacacacagcacacacacaccacacacagcacacacacagacacacagcacacacacaccacaccacacacaccacaccacacacagcacacacacaccacaccacacacagcacacacacaccacacatagcacacacacacaccacacatacacaccacacacacatagacacacagcacacacacacacacacagcacatgctcctctaattccatgtatgtaggttccattttatgtctatagtgatactacttatttactctttatcttctccactggaatataaatctttgagaagggactatatcttttatctctgtaccctgaggccagcacaatgcctgaaacataacagttattgagtaaaggttgacaggatgattctagcctgtcttccttttttatctgaatccatcctagactggccctagaagaagggcagctccttcagagaatggaaacggaagattttgggtggctattcctacccaagtccttagactgtcaacagtatttctgatcccgtgcctggcttttctgtttcctgtgcatggtggcggattaggtttggattcaggttgggtttggatctatcacgcagtgtcttctcagtcccatttgtcaagttcactcagcagaaacacagactattgatctgcttttgccagggaaggctcagctgcctccagtggagtagggaaattgcttcccgtctccctggcctccttcccaaaagcttctgcaaatttccaggagagccctaagtgggtcccttgcataggaaggctgggcccaggtgttgggatcaccaccaccctccctgtggctgggcaggattcctgaggtagccgtgcagataccttggatctgtccgtccctggatgatcctcttcctgctcgatacctgcagtgagattggagccatatttctgagttctagctctgggctgttcctggctacatagagttgcttttgtctgtcccagcttgtgcatcccatgggtcagggctggggtcagagtgacgtggccctcaggggccagccaggagctcgaccaagacatgctggtgcgcgcatcttctgactcagctcaagcaaggactctgggctgttgagaaggtgatgggaagggattaatagtcccagtgtggtggagacgggctgtcgctgggagggtggggtgggcctgcggtggtggttgtaactgtggacatgtttactttcttagcctgggttattgatacacaggtgctcctgtgttccacgttccctgtgtcttacctatttcataataatttttaaaaggtaatgaggcctaacttactccctgtcccgccatcaatgagactcctcacagatggtgtggagggaagccgcctcccttcggcctccctttcctgagagaatcttggtggctctgcatccccagtggccctggacatgctctccctctgcggtctgtctgtctgtccgtgttccctggttggttggctgggttcacagtgagctcacctggacaaacatgctgggccccttccagcctctcaagaatctcatcctcccctgaggagggattgctgtgctcagggactagacagagccgccggggctgggtttccctgaagaggccttgctgcgggagggatggggccgagcagctgcttgtctctgtcacctcttctctctgtcctgttccccgttaaccaagaagcacgaacctcacacagagctcacccatgtcaggcagctttctggcatcttccatgtcctcatgtatttaatcttaatgcaccccactgaggcaggtgccgagaatactcccgttttacacgtggggaagccaaggcacaggaaaggaaagcgatttgcccaggttcacctgcagtcaagggcatgggcacacttacaccccagacagcctggacccatgctgggccgcgagaagagggctggcagccctgtgaggcaggcgggcaggaggcaggcaggcctcctccccagctgccccagcacccgtgtgcccccagaggggacggctcagagtcaggaggctggtgagcagggcccagaggcgcctcctgaggcgccattcatcttggcccccctggctgtcaggaaccccgacttgctcttgatgcagtgtctgagcctgggagggtctcgctccagaacaggtgagtgggcttctctaggcctcctgttggacactaggaggtgatggtcatggtttcctcttctctcctctagctcagtttgcccagctggcccagctgagcccccaggagcgtctgagccgggagacggccctccagcagaagcaggtgtctctggaggcctggttgcagcgtgaggcacagacactgcagcagtaccgcgtggtgagtggggtcctgggcctctcctgggcgtgggtgccatgaagtcagtctctggggacccgagggagggctgggaccagcatgagagcagaacctgggagggcaggaggccttttttcctgggggccttgcgaggcagagcagcttggggagagggaacggcctgggccctgccctgccatttcccagcgaggccctgcggtgttctctgggagcccagaaggggctgctctcctcccttccctcaggagctggccgagaagcaccagaagaccctgcagctgctgcggaagcagcagaccatcatcctggatgacgagctgatccagtggaagcggcggcagcagctggccgggaacggcgggccccccgagggcagcctggacgtgctacagtcctggtaatggtgtggggcggccagcgggcagggcaggaggggctggtggggatcccggctgcttctgcgtcctgtgctggctcctgcagcaggccccctccatcctgggacagctcttgtttctccagggagcctggttcctcaatcagactttggtccccatcctgtgcacctcccccaggaagggggctgctgtcctgggggtgggatggggctcgggtgtgtggggtgatgcttgggctgtttgggcctagtcagggtcgcccctcctgtgtacgtctctaattctgggaggcagggagctctgctcttcccatgggtgggaagtgtggcgaaagcacagagccttcctgggggaacgggagctgtgtcttggggcctggcgtctgtgcggaggagccattgtcctcctgttggccttggggctctcgtgcaggtgtgagaagttggccgagatcatctggcagaaccggcagcagatccgcagggctgagcacctctgccagcagctgcccatccccggcccagtggaggagatgctggccgaggtcaacgccaccatcacggacattatctcagccctggtgaccaggtgactgctgcctgtttgccatgcccaggagcttggggcagctcctgcctgcgtggggggagccgcaggtgccttccagaccagcagatccacttcctgcctctcatccctcccaactccatctccagttgctgtggcccttgcccagtttctcctgtggacactgcaagagatgcccttgggctgcagcccatgccagcttctgtgttatctcactcccctctccatcctctccctggactctcacggcttccccaggaacagaggctgtgcccgagctcttcacctcctgagcccctcgggaggcagccccacccccaccacagagggactgagagccctttcccctgcaccagcccctcatcatgcatctgtccctgtgtcccctgcagcacgttcatcattgagaagcagcctcctcaggtcctgaagacccagaccaagtttgcagccactgtgcgcctgctggtgggcgggaagctgaacgtgcacatgaaccccccccaggtgaaggccaccatcatcagtgagcagcaggccaagtctctgctcaagaacgagaacacccgcaagtaattgtgcagcttcctctcattccctgctacttgtctcatgtcctggcaacaggaaaaaaagaattctgcctcctgtgtcagatccctgtttgcccttctggcctcttctgggcatcagcaaaggaatataaggaagttcttgggcctggtgtggtggctcacacctgtaatccaagcactttaagaggccgaggtgggcagatcacctgaggtcaggagttcaagaccagcctggccaacatggtgaaaccctgtctctactaaaaatacaaaaaattagccgggcgtggtggcaggcacctgtaatcccagccactagagagcctgaggcaggagaatcccttgaacctgggaggcagagattgcagtgagctgagattgcagtgagctgagatcacgccactgcactccagcctgggcaacaagagcaaaactccgtcacaaaaaaaaaaaaaaaagttctcttaggaactgttttctgtgaagatagtttgatcttgtttcattttgtagagatacgtccgagaagattacatgtatgtgttatgtagctaacatttcctctaaatgacgtacatttttagcaaacttctctatttcctgctaccccaaattatattatttactccgcatgtcctgagaccctggcatgggtttggagctggtctctctctgatttgcagtgattacagtggcgagatcttgaacaactgctgcgtcatggagtaccaccaagccacaggcacccttagtgcccacttcaggaatatggtgagggtggaagaagaggaagaatgaatttttccctggtctttgaggggaacaacttatatcttacgtttcatcttatgtttcttctttgtagtccctgaaacgaattaagaggtcagaccgtcgtggggcagagtcggtgacagaagaaaaatttacaatcctgtttgaatcccagttcagtgttggtggaaatgagctggtttttcaagtcaaggtaaagccttccctcagctctgcgtgtgcgtgtgcgtgtgtgtgtgtggtgtactttatgttacaaaatattttttttttatcacatagcatcttcttctttttgactgttggtaaactgaaaatggactgacctcaccctgagaactgtttcacttaggttctcttaagacatgaacagaggccaagcacagtggctcatgcttgtaatcccagcactttggtaggttgaggcagtcaggtcacttgaggtcaagagttcaagaccagcctggctaacacagtgaaaccccatctctactaaaaagtacaaaaattagccaggcgtggtggcacgtgcctataatcccagctactcaggagaatcacttgaacctgggaggctgaggttgtaatgaaccgagattgtgccactgcactccagcctgggtgaaagagtgagaccctgtctcaaaaaaaaaaaaaaaagacatgaacaagcaaggcccagtgcagtggctcacatctgtaatcctaacactttgggaggccaaggcaggaggattgcttgagttcaggagttccagaccagcctggagctggttgtgagaccccgtctcaacaacaacaacaaattaaaaaataaaaaataaaacatgaacaaacaataatgaactgaactagctggagaggtagactacaaaatggatatgagaaacattacttgggatgaatttgagtaaaggttgtggtaagttttaaatttgttatttgtattttcttcccagaaatatctccaatagtcttttctctctcctgttctccatgtaactttgagaaactttatccttcagaaatatctaagcaacattgcttgtaaaatatttaaaatttctaagattgtgccagtatgaaaagtcatattattcctggggccatttagattctgtgtctgagaggaacattaactgaaacttggaaaataaaagtgttgttataataagaaaaaaaaaaaagagagaaggagaagaacttgaggctcgtgggcgctcagccttctcttgtgtctttttagaccctgtccctgccagtggtggtgatcgttcatggcagccaggacaacaatgcgacggccactgttctctgggacaatgcttttgcagagcctgtgagtgtattcctcgggcatgtgggtcccaaaatcaatgccggtgtcatgaatctcatttatgtattatccttttaaaaagcataggaaaaggccgggtgcagtgactcacacttgtaatcccagcactttgggaggccgaggcggttggatcacctgaggtcaggagttcgagaccagcctggccaacatagcaaaatcctgtttctattaaaaaataccgaaaaattagctgggtgtggtggcacatgcctgtagtcccagctacttgggaggctgaggcacgacaatcacttgaacccgagcggcagaggttgcagtgagccgagatcgcaccactgcactccagcctgggtgacagagtgagactccatctcaataataaaaaaaaagcataggaaaaaagacgctgttttctttagtgggaggcagaatagaaagaatgtggaaagtggaaagaacatgggcttgacatcgggccagggtttgaactgagactccaccatttcctcactccatgaccacatgggcagttcactttacctctctgagcctgagtttccagcaagtgtctgcagcacagggatactcttgctctacagcattgttaggaagattaaattagataacatagaaaatgcttgccacacagtcagtactcagtaaatattattttgaatccttgggtgaaactatgaatgggatttgggactcctaggttcactccagaggttagatctctccagaggcttactttagcatagaagttgcttcataccctcttcctttcaataaatgaagatgctgttaaatgtcttttccaaattttagtttctgtgattcattctaggtctcatgaagaatgagatactttgcctcaaggaagatataatttggtggatttatgcacccaaacgctatctgaatcccactagcatgctgctcgatgagcattttaaagatctcataggctgggtgcggtggctcatgcctataatcccagcactccaggaggccaaggcaggcagatcccttgagctccagactagcctaggcagcatagcaaaatcctgtctctacaaaaaataccaaaaaattagccaggcatggtacaccagcctctagtcccagctacttggggggggctgaggcgggaggatcgcctgagcccaggaggtccaggctgcagtgagccaagattgtgccactgtactccagcctgggtgacaaagcgacaccctgtctcaaagaaaaaaatttttttagtaggcaaaggtcatttgttacatatttccaatagagattagtccataaaagcatgataaaagggttatcatttgggacataagagcatgtccttctctaagtatatccaacaaaccttgattatgttttgttttgtggctgttagaatataggatttgactgttagttcaacagctcatttacaaaacagcatggacagcatgggttaccttccagttgtgtgtaaagaaggtgaaatggaaccttctggctcacgtggagaggcttaacgtttcccaacactcctctttagagaaaaagtattttactgcaaaggtgagatttttaagagatttaccatacttcacttacaaactctgaatcagaagctcctttttgaaactgtctgtctgcctcttgtcctgataagcctcctagataagattgccacatctcttgtttccttccctgcctgtccacagatctcactctctgtgtacctttggcatctcctgcaccatgtaattactcaagtatcttgtctaaataaataagcatttttaacattctcagctatgttaatgactacttacatcttatgctatttttttttttttaatttttttgagacagagtcttgctctgtcacccaggctggagtacagtggcattatctcggctcactgcagcttctgccttctggattcaagcgattctcctgcctcagcctcccgagaagctgggattacaggtgcatgccaccacgcccaattaattttttatatttttagtagagaccaggtctcaccatgttggccaggctggtctcgaattcttgacctcaagtgatccacccacctcggcctcccaaagtgctgggattataggcatgagccactgcacccagccgaccttatgctatgttaaaaaaaagactttcagctgggcacggtggctcacacctgtaatcccagcactttgggaggccgaggcgggtggatcatttgaggtcaggaattcgagaccagcttggccaacatggtgagactctcatctctactaaaaatacaaaaattagctgggcgtggtggtgcgtgcctatgatcccagctactcgggaggctgaggcaggagaattgcttgaacctgggaggcagaggttgtagtgacctgagatggtgccactgcactccagcctgggcaacacagtgagactctgtctcaaaaaaataaaaaataaaaaataaataataaagacttgtggccaggcacagtggtttatgcctgcaatcccagcactttgggaggccaaggcaagcggatctcttgagcccaggaatttgaggccagccttgtcaacatagcaaaaccctgtctctacaaaaaacacacaaattagccaggcatggtggtgcacgcctgtagtcccagctgtttgggaggctgaggtaggataattacttgagctaaggaggcagaagttgcaatgagccaagattgggccactgtactccagcctggatgacagagcgagaccttacctaaaaaaaaaaataattgtggaaatttattctccatatatatttgcctatgtgtcctgtgggtcaaataacataagaacattgcagcattgttagtaatagctaaagatgaggctgtaacactgatgcccatctatgggggtctggtgaaatttctttatgtgctgatgggaggtctcccagatagaggattaagtgaaaagaggaagatgcagaacatgtggattttgtgctgtcatttgtgaagaaaaggaaaaggtatatgtcattgctggcatgcatagaatatctttggtgggatacacaagaaactgtgttaggtgcctttaaagaaaagaactgggttgctgggagacagggatagggagtgacttcactgtgtagccgtctgtgctttttgaattttaaatcatgtgaaaatcacctattgaaaaaagtgtttgtaacaaaataaaatggagtactatggctgaacgggttgaaaagcagtttattaaaagttaatcttctaacctatttctcaataaagccatccaactcaaaatttccactcttccataccaagttgttttactttgagctagaattcttggcagaaggagtcgagggcaatgattccacgtgtgtacacacatgccgacacgtgtgcacacatacgcacactctctctgtttgtacctagaggaccagtctttcagatttctaaattcccaaggtgtttacaatctaagagccagaccttggttatgttttggtttgtggccgttagaacataggatttgactgttagttcagcagctcatttacaaaacagcatggatagcatgggttaccttctagttgtgtgtaaagaaggtgaaacggaaccttctgaatttcacagaaccgtgtaccccagcagagtctgaatttatcctcaggccctgcaagacaaatgtgtgtaaccactcccagccatcagcgtttttcttttgtggcttgagggaataaatcatgcaactgttttctcatcagattctggcctctctccctctcagggcagggtgccatttgccgtgcctgacaaagtgctgtggccacagctgtgtgaggcgctcaacatgaaattcaaggccgaagtgcagagcaaccggggcctgaccaaggagaacctcgtgttcctggcgcagaaactgttcaacaacagcagcagccacctggaggactacagtggcctgtctgtgtcctggtcccagttcaacagggtgaggagcccagctgccagccgctgttagatcagtccttcccaaccagatgctctcaggagtctccctgccctgggcccttattcttcatgtctctaataaaatgtaccgaaagtaatagaagcttctgactagatggacaacttgagagttacccaggtcacgtgtagaaaattacatctttgcatattttaaataagttgacctttgtctacagttaatgcattttcttcctttgtaaaggaaatagagcaaagcagatgttaacatagctcatgagaagcaaagcttttgaggggatgcgaactctgggcctctctcccctttactctcttatgttccccatgtgtaatgccagatcaggctcctatgggaccctcaacccacaaagagggatgctgatgaaagaaactcctcctctagcatctgctaattcagacgtcactttgattttatttttattcattttttttttttgagacagagtttcgctcttgttgcccaggctggactgcaatggcacgatcttggctcaccgcaaccgccgcctcctggtttcaagcgattctcctgcctcagcctcccgagtagctgggattacaggcatgcggcaccacgccccgcaattttgtatttttagtggagacggggtttctccatgttggtcaggctggtctcgaactcccgacctcaggtgatctgcccgcctcggcctcccaaagtgctgggattacaggcgtgagtccactgtgcccaccctatttatttttgtttatttatttatttttgagatggtgtctcgctctgtcacaaggagtgcagtggtacattctgggctcactgcaacctccgtctcccagattcaagtgattctcctgtctcagcctcctgagtagccgggattacaggcacccgccaccatgtccagccaatttttgtatttttagtagagacggggtttcaccatgttggccaggatggtctcaaactcctgacctcaagtgatctgcctacctcagcctcccaaagtgctgggattacagacgtgagccaccatgcccggctatcaccttgatttgaatttaatttttgtttcttttcctacaccccccacccccaaggtgttttaaatgtttaatttggagcctaacaacgtgcatttctcagaagctcccaggtgacactgatgcttctggtcacagaccacacatcgaaactagcaagggacgggtcagcccagtcccaggtgaaagtgtctgtagcaggagcccactgggtgctggtaactgcagtttggtattttccccttcttccctcttttcctctccatggggccattaggtaaaactcaggtaggcggggatatttgtatgcctctgacaagggtagatgtttgtttcccatttaatttttccaattaaatatgtgtataatattccaagtgttactctggtgttcttatgttcactgttgtatctccaaccaggagaatttaccaggacggaattacactttctggcaatggtttgacggtgtgatggaagtgttaaaaaaacatctcaagcctcattggaatgatgggtgagaatcattatttcttaaggcgccgacagagtctgaaggtcttctctctggcatcgtaagtcacactctgcttctgtcctttgtccttggtgatccagggccattttggggtttgtaaacaagcaacaggcccatgacctactcattaacaagccagatgggaccttcctcctgagattcagtgactcagaaattggcggcatcaccattgcttggaagtttgattctcgtgagtgcccctcccttcttatgtccaaagttagctgctttcgttacaaaattattttaacaaataatttagtgggtacttactatttgttgaggtcagtactaattatgggaaacataaatgtatagccatgacatactcataataaggcagcctatgaaaaatactattatgggaaacacaattgctaatttggttatacatgaaagtatatggcagcatggttacacatgaacatttaaccatgacatggctacctatgatacaagagtccgtgcagaatctcagttgcttccctcttaaaatgtttgccttattgtactactctgcataaagcttatttcagtgaagaatttgatgatttggagttcttacagtagtaaaaatattcctttatcctaattaacatatggatattgccatcaaccatttctacccaagatgttagttcttttctttttttgaaacagggtctcactcttttgcccgggctggagtgcagcggcacaaacatggctcactgcagccttgacctcctggcctcaagcagtcctcctcccttagcctcccgattagctgggaccacagacgtgcaccaccacacccatctaatttttaaattttttgtatgttgcccaggctggtctcgaactcctgggctcaaacaatcccccactttggcttcccaaagtattgggattacgggcttgagccactgcaccagggcatcaggaaagttagttctctcctctgaccctcacaataagggtagcttgctggttcattttctgtgaattaaagtttttaataacttttggctgggtgcggtggctcatgcctgtaatcccagcactttgggagcctcaggcaggaggatctcttgaggccaggagttcaagcccagcttgggcaacatagtaagaccctgtctctaagtaaataaataaataaataagttaattaggtgggcatggtggtgctcatggtgtgcgcctgtagtcccagctactctggagggtgaggtgggatgatcacttgaccctgggagttcaaggttacagtgagtcatgatcacatcactgtactccagcctgggcaacagagtaagaccctgtctcttaaaagaaaaaaaaaaaaaggctgggtgcggtggctcacgcctgtaatcccagcactttgggaggccaaggcaggcggatcatgaggtcaggagatcgagaccatcctggccatcacagtgaaacccccgtctctactaaaaacacaaaaaaattagccgggtgtagttgtgggcacctgtagtcccagctacttgggaggctgaggcaggagaatggcgtgaacccgggaggcggagcttgcagtgagccgagatcgcgccactgcactccagcctgggcaacagagcaagactccatctcgaaaaaaaaaaaattcatcacttttaatagctcttatgctttctctggttgtgggcatgcttcctagcttttatatatctttgtatgggaaatcagggattgggggccagtaaaaactgtttcttctactgagggctagaatactgtttgaacttgaaacgtctgagatcattggatctcttgggaagtgatttttgtattacctgcttatctacccatggcttttatttttatttatttatttatttatttatttttgagatggggtctctgtcacccaggctggagtgcagtgtcatgatctcagctcactgcaacctccacctcccagcttcaagccattctcctacctcagcatagtacctgggactacggatgagtgccaccacacttggctgatttttgtatttttagtagagacagggttcatcatgttagccaggctggtcttgaactcctgacctcaggtgatccacctgcctaggcctccaaaagtgtgggattacaggcatgagccaacatgcctggcccctacccatggcttttaaaactatttcaggccgggcacggtggctcacgcctgtaatcccagcactttgggaggctgaggtgggtggatcatgaggtcaggagatcaagaccatcctggctgacatagggaaactccatctctactaaaaatacaaaattagccaggtgtggtggcgcgtgcctgtaatcccagctacttgggaggctgaggcaggagaatcgcttgaaccagggagttggaggttgcagtgagccaagatcgcaccactgcactccaacctggtaacagagtgagactccgtctcaaaataagtaagtaagtaagtaaataaataaaagtatttcatctataacccatggttatttttaaatggagatttctattggagccattataatggcaagcttgaatttatagtatgttggggttttaagatttcctaattcagaaatcatgtttagaatgtgattgttctgtttattgatctagaggaaagaatgttttggaatctgatgccttttaccaccagagacttctccattcggtccctagccgaccgcttgggagacttgaattaccttatctacgtgtttcctgatcggccaaaagatgaagtatactccaaatactacacaccagttccctgcgagtctgctactggtaacaatgttcgcattctgatttgattttgttgtgtgtgtgtgtgtgtgtgtgtgtgtgtgtgtgtgtgcatacctgcgtgtgttatctctcttgtgtgaaaacccacacaattaccattcagtgagagcagtttgagcattttccagggcagatgtaaaccttgggctggattcttcagtcatacagaaaacacatctaccactaaccccaaatatcaaattgaagaaaacaaattctttttaatacaagcttagatcaaacaaaattaggtaaaattttgtttttcatgacagagatggttttattgctttctgagtttagaagtattacatatttattataaaattttcagaagacacataaaggcataaaaaagaaaacaggctgggtacggtgggtcatgcctgtaatcccagaactttgggaggccaaggcaggcggatcatttgaggtcaggagttccagaccagcctggccaacatggtgaaaccctatctctacaaaaaatacaaaaattaggtgtggtggcaggcacttgtaatcgcaggtactcgggaggctgaggcatgagaatcacttgaacccaggaggtggagattgcagtgagctgagaccacgccaccacactccagcctgggcaatagggtgagactcagtctcaaaaaaaaaaaaaaaaggaaggtcgggcgtggtggctcacacctataatcccagcactttgggaggctgaggcaggcagatcacctgaggtcgggagttcaagaccagcctgaccaacgtggagaaaccccacctctactgaaaatacaaaattagcctggcatggtggcgcatgcctgtaatcccagctactcgggaaggctgaggcaggagaattgcttgaacccgagaggtggaagttgtggtgagctgaaatcgtgccattgcactccagcctgggcaacaagagtgaaactctgtctcaaaaacaaaagaaaagaaaacaaaaaaacagataccacacaacatctctcatctagagattaacctctatggatgatttagtgactattcttgcactctatatatagatatgtattatacattgcatcacccgttgcttgaacttcctgtgtggaggttatctagcagcagaacgaagaccataaacaaggaaacatattcaggccgggcgcggtggctcatgcctgtaatcccagacttttgggaggccgaggcaggcatatcacctgaggtcaggagtttgaaaccagcctggccaacatggtgaaaccccatctctactaaaaatacaaaaagtagtcaggtgtggtggtgggcgcctgtaattccagctacttgggagactgaggcaggagaatcgcttgaaccagggaggcaggagaattgcttgaaccagggaggcagaagttgcagtgagccgagactatgccactgcattccagtctggtgacagagcgagactccatctcaaaaacaaacaaaacacaaatatattaatttagtgatgggcgccctgaagacaaataaagcaaggtagagggatagagaagtggcagggaggagagtggaggtgttattttactagagtggtcaaggagggtttctctgaggacatgtttgttttttttgttgttgttttgtttgtttgtttgtttgagatggggtctcactttgttgcccaggctggagtacattgctcactgcagtctcaaactgctagactcaagggatcctcccacctcagcctcccacatagttgggactacaggcatgcaccaccaatcctggttaattattttatttttatagatatggggtcttgctgtgtttcccagactggtctcaaattcctgggctcaagcaatgttccttcctcagtcccccaaggttctgggattataggcatgagccactctacctagccaggatgtgatgtttgaaaagacctgaatgaagtgaggaagctagccatacaaagatctagagaaaaacattgtatgccaagagaacaagtacaaaaatcctgggttgagaatggccatgtctggaaagcctcaggagggccagggaggctggagcctcttgagcagggaagataagtggtaggaactgaggtcaggacactccagccttggagttcagggtgaaaggttggagtctagaccatatcatatgtaattttttgtgactttttttttttacttggaaatatatcctaggtagctgggcatggtggctcatgcctgtaatcccaacactttgggaggccaaggcaggtggatcacttgaggtcaggagtttgagaccagcctggccaacatggtgaaaccccatctctactaaaaaacatacaaaaattagccgggcatggtggcaggtacctgtaatcccacctactcaggaggctgaggcaagagaatcacttgaacccgggaggcggaggttgcagtgagccaagatcacaccactgcactccagcctgggcaacagagcgagactctgcctcaaaaaaaagaaatatatcctatgcagagttacagctcagtaaatgtaatcttccaacctcattttgatgactgcatacaatcccactgtatggtgagttacatgttggttatttaagatacttataatttgggcctgggcacagtggctcatgcctgtaattccagcacattagaaggcggaggaggaaggattgcttgagcctaggagtttgagaccagcctgggcaacatagtgagactccatctctacaaaaaagaaaaagttagctgcgcttggtggcgcatgcctgtagtcccagctactcagaaggcagaggctggaagattggttgagcccaggaatttgaggctgcaatgagctatgattgtgccattgcactgtagcctatgtgacagagtaagaccctgtctcagaaaaaaataaaatcctatttctggcagcatttctttgtttttaacttcttagccaatctataaaatactctgtacactgtaaagcacaaaaaacatgttatgaaaaggtcgctcctgacacttgaagccctagaagaagattagggtaataagcaattggtgaaccctgcagcgtttcaccctcttgggctacttaaatgacaagctccttgtcctataatcatagtgtgatcgtccttgcctagtataattaactttgtactgattcccatattcacgtacccagaaacaagacttcattctcccatgtcagataatcacattcttaccacctgcttacctggatttccatagtcagccttctgaaaaggtaactgtggttgaccagatcacgtgcaggtttatctgctcatctgccacatcccagtggggattctgtgggaagcaaaggacacatcgcattcttggcaccaacagcactcactgggactagtgacatcaaagtaccccaaatgcagaaacaccaggcgtgaaggagcgtgcaggtgctgggaaaagtagccttccctttcctgaaagactagacactcagagttagaggaacctcagacatcatcagatcagatcagcggctctccagtgcctaggcctttccattagatccctgacgtgtatgcacctcctgcttgaaaacctccggtgatggccaggcaccgtggctcacacctgtaatctcagcactttgggaggccaaggcgggtggatcacttgaggtcaggggttcgagaccagcctgaccaacatggagaaaccccatctctaccaaaaatataaaaagtagctgggcatggtggtgcgcacctgtaatcccagctactcgggaggctgaagcatgagaatcacttgaacccagaaggcagaggttgcagtgagctgagatcgcaccactgcactccagtgtgggcaacagagtaagactctgtcaaaaaagaaaaaaaagaaaacctccagtgacaaggaaatcagtccttcctaagataaatcatttcttttcctggcagttctacttagaacattcttccctgcatgactgaacatttgtcctcttatgacctgcccctcctggtcctgattttatcccctgggtcaggtagaacaaatcctgtctctctgctgcatcttggactttaagcttttcaaggtgtttttttttttttaattagtatgcaattagtgcttgacttagatttgtattgaagtacatagtttccatggtttgaagaatttattgaaacatccaagccaatttggaagatatcttgaatttcagttttagtgctgaccttctcctctaccaggtcttcctaacagattgaaatattaaatgcttggccaagtgcggtggcttatgcctgtaatcccagcaccttggggggccaaggtgggcagataacttgaggtcaggagttagaaaacagcctgggtgacatggtgaaaccccatctctactaaaaatacaaaaattagccaaagtgtggtggtgtacctgtaatccagctactcaggaggctgaggcatcggaatcatttgaacctgggaggcggaggctgcagtgagccgagattgcaccaccgtactccagcctggatgagagagtgagactgtttcaaaaaacaaaacaaaaaaatattaagtgcttgtgtcatatccttagataagttaggtggttgtgttctgtcctaagaaaagatgtgattcataaggaagatcacatttttgtttcacttgagaactttgatttactacattcttcccttggcagctaaagctgttgatggatacgtgaagccacagatcaagcaagtggtccctgagtaagtgtccaggtggctgtggctctccttctgcctctttcctcctcccccagaccctgcctcccatccttatcctggcccagctttccgctcccccggggaaactgtctcagccctggggaaggacctgggcttggtgatgctatgccagtacctgaggccccactcctgtagctggagccccagggccgagtggggcactttgtccttctacaccctgagaaagacaaagataccccttggtcccctccccaagtcagctgccctggcctccctggcagctgaagctctgttctcttccttctgcaggtttgtgaacgcatctgcagatgccgggggcggcagcgccacgtacatggaccaggccccctccccagctgtgtgtccccaggctcactataacatgtacccacagaagtaggtggcattcttgtgggggtccacaggggaggaactgggggcttggccccaggctggacccctggagggctggggtcaaaggaatccagagctcctctaggtctgagaccacacagccctggcccgggctctggcctttgggagggagagatttgaccagaagtgattggtggtttagagtcgggttgggcaaatgtcatctgttcccctctctcaatatggagatttttcttgctctaaggactgagtggagttgtgatgtgtctggacagccggtgtgagaggtaacaggggagggtatttcagtctgagttgctgtacagccagctgtttgaatggttgttcttttcccatgaagccccaggctgagggcataggctggctcagactgctcccctggtggcctgtggggcttggggtggtctctggcaggctttccccttcccttcatccctcttctttccctcccaagccctgactcagtccttgacaccgatggggacttcgatctggaggacacaatggacgtagcgcggcgtgtggaggagctcctgggccggccaatggacagtcagtggatcccgcacgcacaatcgtgaccccgcgacctctccatcttcagcttcttcatcttcaccagaggaatcactcttgtggatgttttaattccatgaatcgcttctcttttgaaacaatactcataatgtgaagtgttaatactagttgtgaccttagtgtttctgtgcatggtggcaccagcgaagggagtgcgagtatgtgtttgtgtgtgtgtgtgtgtgtgtgtgtgtgtgcgtgtttgcacgttatggtgtttctccctctcactgtctgagagtttagttgtagcagaggggccacagacagaagctgtggtggtttttactttgtgcaaaaaggcagtgagtttcgtgaagcctggaagttggccatgtgtcttaagagtggctggactttgacatgtggctgtttgaataagagaaggacaaagggaggagaaagcacatgtgctccagtgagtcttcgtcactctgtctgccaagcaattgatatataaccgtgattgtctctgcttttcttctgaaatgtagataactgctttttgacaaagagagccttccctctcccccacccctgtgttcttgggtaggaatgggaaaaggggcaacctacaaagattgttggggcaagggaagtcacaagctttcggatgggcggtggcttttcacaaaacatttagctcatcttattctctctttgtcctctctcccctcctgcccgcccgcaccctggaattgccactcagttcctctgggtgtgcacatatgtttggagaaatagaggagagaaaagagggccacgtaactgagagcttacagtgccaatgccgtttgtgttctggccagagtggagtgcgcagccctgactcccaggcgctgagattgttgcctggttacccaggaagctgctgttccggctgcccagcctttctctgagccagcggatgcacagtccgtggccttcttcaggcttattgatgatgctttttgcaaatgttgaatcatggttctgtttctaagttggatcttttttgttttctccttgccaccctaatttgacatcaaaattctctcttgtgcattgggccctgggtcattcaaacccaggtcacctcattccccttctctgttcacacctaatgtcttgaagagtaggtagcagcagtgtgggctgaacctaggccagcttgcttagcgggtcaccctgctgtgaagtcctggcaggtgttggtaatgtgtggaaatgcagtcagcaagtttgctggggagtttgataaaagtataaaacaaaacaaaaaaagcctcggtataattttgttccacgacttcttctgtagctttacaccagaaggaaggaatgggctacagcaggtagtggaggaagaggggggtgagcaggtgtattaaaatagcttacgggtaaggcctaaaaggtcacccctcggccccctctccaaaagaagggcatgggcacccccaggagaggatggccccaaaaaccttatttttatacatgagagtaaataaacatattttttttacaaaaataacttctgaatttatcagtgttttgccgttaaaaatattcctctatagtaaattatttattggaagatgacttttttaaagctgccgtttgccttggcttggtttcatacactgatttatttttctatgccaggcagtagagtctctctgcctctgaggagcaggctacccgcatcccactcagcccctccctacccctcaagatttgatgaaaattccaaccatgaggatgggtgcatcggggaagggtgagaaggagagcctgcctgctcagggatccaggctcgtagagtcactccctgcccgtctcccagagatgcttcaccagcacctgcctctgagacctcgctctctgttccagcaaccctggttggggggtcagacttgatacactttcaggttgggagtggacccaccccagggcctgctgaggacagagcagccaggccgtcctggctcactttgcagttggcactgggttggggaggaagagagctgatgagtgtggcttccctgagctggggtttccctgcttgtccagttgtgagctgtcctcggtgttaccgaggctgtgcctagagagtggagatttttgatgaaaggtgtgctcgctctctgcgttctatcttctctctcctccttgttcctgcaaaccacaagataaaggtagtggtgtgtctcgaccccatcagcctctcacccactcccagacacacacaagtcctcaaaagtttcagctccgtgtgtgagatgtgcaggttttttctagggggtagggggagactaaaatcgaatataacttaaaatgaaagtatactttttataatttttctttttaaaacttggtgaaattatttcagatacatattttagtgtcaaggcagattagttatttagccaccaaaaaaaagtattgtgtacaatttggggcctcaaatttgactctgcctcaaaaaaaagaaatatatcctatgcagagttacagtcacaaagttgtgtattttatgttacaataaagccttcctctgaagggatggtattgagtcctgtttttacttttttctgtcacatgccaagggagggcagcttgaacacggaaaagtttcaagtcatcagcgtgaccctgaaaaagggaactggttgggtggttgggagttggctgcctcagagggcacgtcattagctctgatggcagatggggcctttcataccttcctgctcatatgatgttttgaaaataagaatgatggtctcctagcctcctgactccagaaagcttgttagccaggatggtctcgatctcctgacctcatgatctgcccacctcagcctcccaaagtgctgggattacaggcgtgagccactacgcccggctgaaagcctgtccttaagattcagcacatttagagtacctgaccctgagttcagcgttgtgtgtgggatgagaaatggtgccttccctgcagaggctcacagttggagaaaggcagctaccacaactgattatgctaggatatcgcttcctgctgcaatcaaggcatcccaaagtcattatgcaaaagaacatgcaggaaggccactgagcaactcaagctttttttttattttatttttttattttaattgagtagctgggattacaggcgccaccactcccggctaatttttgcatttttagtagggacggggtttcaccatgttggccaggctggtctggacctcctgacctcaggtgatccacctgccttggcctcccaaaatgctgggattacaggcgtgaaccaccatgcccagcctggagctggctcttaaggaacaaatcagggccgggcacgnnnnnnnnnnnnnnnnnnnnatagggccgggcacggtggctcatgcctgtaatcccagcattttgggacgccaaggcaggtggatcacctgaggtcgggagttcgagaccagtctggccaacatgatgaaaccccgtctctactaaaaatacacaaaaattagctgggcgtggtggcacgcgcctgtaatcccagctacttgggaggctgaggcaggagaatcgcttgaacccggcaggcagagattgcagtgagccgagatcatgccattgcattccagcctggacaacagagcaagactctgtctcaaattaaaaaaaaacaaaaaacccagccattccacttgtaggtatctacataagaaccatgagaacatatatgtacagaaacacttgtgacaaatgttcataacagcattatgcataatagccaaagggcagaaacaacccaaatgtccatcaactgatgaataaacaaaatgtattatggtatatctgtacaatggaatatacggcaataaaaaggaatgaagtgctgacacacaggacatgatgttgtcacggatgaaccttgacaatatcatgctagatgaaagaagccaggccgggcacggtggctcatgactgggactccagcactttgggaggctgaggcgagggatcacttgagtgcagcagttcaagaccagcttggacaacacggtgaaaccccatctctacaaaaaaatacaaaaattagctggatgtggtggtgcacccctgtagtcccacctactcagggaggctgaggtgggaggatcacttgagctgtgatcatgctactgcactccagcctgggtgacagagcgaggaaaaagaaaagaagccaagtacaaaagaccgcatattatatgatgccatttataggaaatgtctaggataggcaaatctatggagacagaaagtaaatttgaggttgcctagaggctgggaaggagtttggaggtaatagtgaaaggatacagggtttgggggtttttttgttttgtttttttttttgtttgtttttcttgagacagagtctcgctctgtcacccagactggagtgcagtggcgccatctcggctcactacaaccactgcctcccagtttcaagcgattctcccacctcagcctcccaagtagctgggattataggcgccggccaccagaccctgctaatttttgtatttttagtagagacagtgttttgccatgttggccaggctggtcttgaactcctgacttcaggtgatccacctgccttggcctcccaaagtgctgggattataggtgtgagccaccacgcccagcctgagtttggggttttttattttattttattttattttattttattttattttattttattttattttatttaacgaattgggcagtctcctgaggcacagtaggctcagagagactctgcagggtttgtttttgaggtaaggaaaatgttattatctgtggtgttggttgcacatatctctggatatactagatcttgaattgtacactaaatgggtgatttgtatggtgtgtgaattatatctaataaagctgttactgggccaggtctagtggcttacacctgtaattccagcactttggaaggccaaggtaggaggatcgctgagaccgggagttccagaccagtctgggcaacatagtaagaccccctgtctctacaaaaaaaaaaaaaaaatgtttttaattagctgggtgtggtggcacatgcctgtagtcctagccactcagaggctggggtaggaggattgcttgatccccggagttcaaggttgcaatgagctgtgaccaggccactgaactccagcctggacaacagagcaagaccctgtctttaaataaataataaaagcaaatgcaagatctcagcgagaaaaaacgtgaaagtgaggtgagttagccagagtgagaacagacctgttgaaagaagctcagctgtgaagggaagagaggtgctcagcaagtagtagctctcttctcaaaggtatccagaggcaagtaaggggagaaagggagtggttttagtgttttgagagcctaggtcaagaacacaccagcctgggcaacatagggagctctctcgtctctacaaaaaataaaattagttgagcgtagtggtgcgtacctgtagttccagtcccttgggaggctgagacaggaggatctcttgagcccaggaggttgaggttgcagtgagctatgatcgcaccactgcactccagcctgggcaatagatcaagaccctgtctcaaaaacaaaaaacaaaaaaagagaagtttgtaattttccttgggataaaggcaacaggctaacacagatggtcacccagtaaccaggtaaagttaagataaactatatgtgactggctgggtgcagtggctcaggcctgtaatcccagcactttgggaggccgaggcaggtggatcacttgaggtcaggagtttgagaccagcctggccaacatggtgacatggtgaaaccccgtctctactaaaaatacaaaaaattagctgggtgtggtgatgcgtgcctgtaatcccagctactcgggaggctgaggcaggagaattgcttgaatctgggaggcggaggttgcagtgagctaagatcgtgccattgcactccagcctgggcaacaagaatagaactctgccaaaaaaacaaaaaaaaagaagtttgtaattttccttgggataaagccagcaagctaacacagatgttcacctaataaccatgtaaagttaagataaactatgtgactggctgggtgtggtggctcacacctgtaatcccagcactttgggaggccaaggagggtagatcacttgaggtcaagagtttgagaccagcctggccaacatggtgaaaccccatctctactgaaaatacaaaaattagctgggcgtggtggcacacacctgtaatcccagctgcttgggaggctggggcagcagaatcgcttgaacctgggaagtggaggttgcagtgagctgagattgtgccactgcactccagcctgggcaacagagcaagactgtgtctcaaaaaaaaaaaaaaaaaaaaaagataaactatatgtgacaagtcctcttacttgaggactcgttattgtttatcttgaaaacgtgtatgtaatgggttgtatgcgcttggctatacaaaaaagtaagatttcctcccttctttgcaagctcttagcagatcacctgtcatgtacatcacattgtggttgaatgcttattcaataataaaattgttttctttctcaactaccttgagggagaggatggggttttttttgttgttgtttttgttttgtttgtttttgagacggagtttcgctcattgcccaggctggagtacaatggcgcaatctcagctcactgcaacctccgcctcccaagttcaagtgattcttctgcctcagcctcccaagtagctgggattacaggcatgtgccaccacatctggctaattttgtatttttagtagagatggggtttcaccatgttggtcaggctggtgtcaaactcctgacctcagatgatccacccgcctcagcctcccaaagtgttgggaatacaggcgtgagccaccgcgcccagctgagttggggttttaagagttcttaagcttgcccctctcccagctcaagtggcttaatggcgttctttcccacacacacctttctgttccttcacctgcgcaagtttgaggaccatgctagtctggtcctaactgccccaactgccagcctgggctagcacccgacatgaagtcctgtaggcgacctgcccctttaagagcacccccctccttcagctcctccctcaggcctggtggccggatttcccagttggggcccagccttttaaagccatcgctccttctttctggccggatgtgtgctgagacccagagtcacccaggggtctccgtcacgtgccaggagtaggcagaagtgggctgtgacaggtgcatgtgggcatggaccccacagcctggggctcaggagggacaaggagctgggacagggtggatcccgagagaaagcaaagccactcgggagtgggcaagagatatcgttacgcagctgctgtgtgcccgaccgaccctgtccgaaacccttcctgtaccttcccttcctcttccttcttttctcccttttttttcttttctttttttttttgacagggtctcactctgttgcccaagctggggtgcagtggcacgatcttggctcactgtagccttgacatcctgggctcaagggatcctcccatctcagcctcccaagtagctgcgactatgggtgtgacaccacgctgggctagtttttcaattttttgtagagatggagtctccctatgttgctcaggccggttgcaaactcctgggctcaagtgattctcctgcctcagcctcccaaagtgctgggattacagatgatagccacctcacccggcccacccctaccttctgaaagaggcattcttattcttattcccattttgcagatcaggaaacagagctcagtgcagcccactaaattgctcagggccctacagctaacaagcggcagaggcaggatctgcactcaggtcagtgggactccaaagctttgatagtctctcctttgcatcacctgccccacagggtcctgccttcttcccaatttcatttttcctcggttttcctgtatgcagtagagcgtgggaggagaaatggataattgctgcatgcccccatatctcggttccttcctcttcccaggagctgcttggagatgctgctgtggccactgctgctgctgctgctgctgctgccaacattggccctgctcaggcagcagcggtcccaggatgccaggctgtcctggcttgctggcctccagcaccgagtggcatggggggccctggtctgggcagccacctggcagcggcggaggctggagcagagcacgctccatgtgcaccagagccagcagcaggccctgaggtggtgtctacagggagcccagcgcccccactgttccctcagaaggagcacaggtgtgtttcccagggtctggggaggtgacccaaagagaaagaaaccccacaggaccgtcagattccagagcctgatggcccccttacctcctccactgccaacggagtggcctgacccagagacccaggactggctttcttgtccaagatgaatttcccatgctgggtccttacatcctctctaccccaggcctattctcggttcctccctcaagggtctcaccagtcttgcctgaaactcttgggaaactggcttcctgaggcgtttctgttgtcattggggctatagacataagcaccttccggaatcatctccctctgaccaaggccagccagacccagcaggaagacagtggagagcagccactgcccccgacctcaaaccaggaccttggggaggcctctctgcaggtaatctaggatggccagagcccagtcctggccacagcccagtcccaccagagacctctgacttgcagccaaaccctccagtcatggtgggcaaagaacccccaaatgggggctctgggtctggctctgacaccagaccaacattctctctttcctcctccaggccaccttgctgggtctggcagccctaaacaaggcctacccagaagtgctggctcagggacgcactgcccgtgtgacgcttacatccccttggccccgacccctgccttggcctgggaataccctgggccaggtgggcacccctggaaccaaggaccctagggccctgctgctggacgcactgaggtccccagggctgagggcactggaggctgggacggctgtcgaacttctggatgttttcttgggcctggagactgatggtgaagagctagctggggcgatagctgccgggaaccctggagcgcctctccgtgaacgggcagctgagctccgggaggccctagagcaggggccacggggactggcccttcggctctggccaaagctgcaggtggtggtgactctggatgcaggaggccaggccgaggctgtggctgccctcggggccttgtggtgccaaggactagccttcttctctcctgcttatgctgcctcgggaggtcagtgggactcaagggcagtgaggtgggggcaacggtcagtggtcacatgacaagcagccatgcattgggccctacataatcatctcatttaatcctccccaacaagctgcatgctagggccagcagcctccttttacaagtgaagaaattcaggctctctaggttaagagtcttgtagctgggtgcagtggctcacgcctgtaatcccagcactttgggaggccaaggtggatggatcgttgaggtcaggagttccagaccagcctggccaacatggcgaaaccccatctctactaaaaatacaaaaactagcggagtatggtggtgcacgcctataatcccagctacctgggaggctgaggcgggaggattgcttaaaccttggaggcagaaattatagtgagctgagatcgcgccattgcactccagcctgggtgacagagcaagaccctgtctcaaaaaaaaaaaaaaaaaaaaaaggccggggcagtggctcacgggtgtaatcccagcactttgggagaggctgaggtgggtggatcacctgaagttaggagtttaagaccagcctggccaatgtggtgaaaccctgtctctactaaaaatacaaaaattagccaggtgtggtggcaggcgcctgtaatctcagctactcaggaggctcaggcaggagaatcacttgaacccaggaatcactgaatcactgagccgagatcgcaccactgcactc

SEQ ID NO: 1173 - DNA, 2782 bp, Homo sapiens
ggagccgtcaccccgggcggggacccagcgcaggcaactccgcgcggcgcccggccgagggagggagcgagcgggcgggcgggcaagccagacagctgggccggagcagccgccggcgcccgaggggccgagcgagattgtaaaccatggctgtgtggatacaagctcagcagctccaaggagaagcccttcatcagatgcaagcgttatatggccagcattttcccattgaggtgcggcattatttatcccagtggattgaaagccaagcatgggactcagtagatcttgataatccacaggagaacattaaggccacccagctcctggagggcctggtgcaggagctgcagaagaaggcagagcaccaggtgggggaagatgggtttttactgaagatcaagctggggcactatgccacacagctccagaacacgtatgaccgctgccccatggagctggtccgctgcatccgccatatattgtacaatgaacagaggttggtccgagaagccaacaatggtagctctccagctggaagccttgctgatgccatgtcccagaaacacctccagatcaaccagacgtttgaggagctgcgactggtcacgcaggacacagagaatgagttaaaaaagctgcagcagactcaggagtacttcatcatccagtaccaggagagcctgaggatccaagctcagtttggcccgctggcccagctgagcccccaggagcgtctgagccgggagacggccctccagcagaagcaggtgtctctggaggcctggttgcagcgtgaggcacagacactgcagcagtaccgcgtggagctgcccgagaagcaccagaagaccctgcagctgctgcggaagcagcagaccatcatcctggatgacgagctgatccagtggaagcggcggcagcagctggccgggaacggcgggccccccgagggcagcctggacgtgctacagtcctggtgtgagaagttggcggagatcatctggcagaaccggcagcagatccgcagggctgagcacctctgccagcagctgcccatccccggcccagtggaggagatgctggccgaggtcaacgccaccatcacggacattatctcagccctggtgaccagcacgttcatcattgagaagcagcctcctcaggtcctgaagacccagaccaagtttgcagccactgtgcgcctgctggtgggcgggaagctgaacgtgcacatgaaccccccccaggtgaaggccaccatcatcagtgagcagcaggccaagtctctgctcaagaacgagaacacccgcaatgattacagtggcgagatcttgaacaactgctgcgtcatggagtaccaccaagccacaggcacccttagtgcccacttcaggaatatgtccctgaaacgaattaagaggtcagaccgtcgtggggcagagtcggtgacagaagaaaaatttacaatcctgtttgaatcccagttcagtgttggtggaaatgagctggtttttcaagtcaagaccctgtccctgccagtggtggtgatcgttcatggcagccaggacaacaatgcgacggccactgttctctgggacaatgcttttgcagagcctggcagggtgccatttgccgtgcctgacaaagtgctgtggccacagctgtgtgaggcgctcaacatgaaattcaaggccgaagtgcagagcaaccggggcctgaccaaggagaacctcgtgttcctggcgcagaaactgttcaacaacagcagcagccacctggaggactacagtggcctgtctgtgtcctggtcccagttcaacagggagaatttaccaggacggaattacactttctggcaatggtttgacggtgtgatggaagtgttaaaaaaacatctcaagcctcattggaatgatggggccattttggggtttgtaaacaagcaacaggcccatgacctactgattaacaagccagatgggaccttcctcctgagattcagtgactcagaaattggcggcatcaccattgcttggaagtttgattctcaggaaagaatgttttggaatctgatgccttttaccaccagagacttctccatcaggtccctagccgaccgcttgggagacttgaattaccttatctacgtgtttcctgatcggccaaaagatgaagtatactccaaatactacacaccagttccctgcgagtctgctactgctaaagctgttgatggatacgtgaagccacagatcaagcaagtggtccctgagtttgtgaacgcatctgcagatgccgggggcggcagcgccacgtacatggaccaggccccctccccagctgtgtgtccccaggctcactataacatgtacccacagaaccctgactcagtccttgacaccgatggggacttcgatctggaggacacaatggacgtagcgcggcgtgtggaggagctcctgggccggccaatggacagtcagtggatcccgcacgcacaatcgtgaccccgcgacctctccatcttcagcttcttcatcttcaccagaggaatcactcttgtggatgttttaattccatgaatcgcttctcttttgaaacaatactcataatgtgaagtgttaatactagttgtgaccttagtgtttctgtgcatggtggcaccagcgaagggagtgcgagtatgtgtttgtgtgtgtgtgtgtgtgtgtgtgtgtgtgcgttggtgcacgttatggtgtttctccctctcactgtctgagagtttagttgtagcaga

SEQ ID NO: 1174 - DNA, 2364 bp, Homo sapiens
atggctgtgtggatacaagctcagcagctccaaggagaagcccttcatcagatgcaagcgttatatggccagcattttcccattgaggtgcggcattatttatcccagtggattgaaagccaagcatgggactcagtagatcttgataatccacaggagaacattaaggccacccagctcctggagggcctggtgcaggagctgcagaagaaggcagagcaccaggtgggggaagatgggtttttactgaagatcaagctggggcactatgccacacagctccagaacacgtatgaccgctgccccatggagctggtccgctgcatccgccatatattgtacaatgaacagaggttggtccgagaagccaacaatggtagctctccagctggaagccttgctgatgccatgtcccagaaacacctccagatcaaccagacgtttgaggagctgcgactggtcacgcaggacacagagaatgagttaaaaaagctgcagcagactcaggagtacttcatcatccagtaccaggagagcctgaggatccaagctcagtttggcccgctggcccagctgagcccccaggagcgtctgagccgggagacggccctccagcagaagcaggtgtctctggaggcctggttgcagcgtgaggcacagacactgcagcagtaccgcgtggagctgcccgagaagcaccagaagaccctgcagctgctgcggaagcagcagaccatcatcctggatgacgagctgatccagtggaagcggcggcagcagctggccgggaacggcgggccccccgagggcagcctggacgtgctacagtcctggtgtgagaagttggcggagatcatctggcagaaccggcagcagatccgcagggctgagcacctctgccagcagctgcccatccccggcccagtggaggagatgctggccgaggtcaacgccaccatcacggacattatctcagccctggtgaccagcacgttcatcattgagaagcagcctcctcaggtcctgaagacccagaccaagtttgcagccactgtgcgcctgctggtgggcgggaagctgaacgtgcacatgaaccccccccaggtgaaggccaccatcatcagtgagcagcaggccaagtctctgctcaagaacgagaacacccgcaatgattacagtggcgagatcttgaacaactgctgcgtcatggagtaccaccaagccacaggcacccttagtgcccacttcaggaatatgtccctgaaacgaattaagaggtcagaccgtcgtggggcagagtcggtgacagaagaaaaatttacaatcctgtttgaatcccagttcagtgttggtggaaatgagctggtttttcaagtcaagaccctgtccctgccagtggtggtgatcgttcatggcagccaggacaacaatgcgacggccactgttctctgggacaatgcttttgcagagcctggcagggtgccatttgccgtgcctgacaaagtgctgtggccacagctgtgtgaggcgctcaacatgaaattcaaggccgaagtgcagagcaaccggggcctgaccaaggagaacctcgtgttcctggcgcagaaactgttcaacaacagcagcagccacctggaggactacagtggcctgtctgtgtcctggtcccagttcaacagggagaatttaccaggacggaattacactttctggcaatggtttgacggtgtgatggaagtgttaaaaaaacatctcaagcctcattggaatgatggggccattttggggtttgtaaacaagcaacaggcccatgacctactgattaacaagccagatgggaccttcctcctgagattcagtgactcagaaattggcggcatcaccattgcttggaagtttgattctcaggaaagaatgttttggaatctgatgccttttaccaccagagacttctccatcaggtccctagccgaccgcttgggagacttgaattaccttatctacgtgtttcctgatcggccaaaagatgaagtatactccaaatactacacaccagttccctgcgagtctgctactgctaaagctgttgatggatacgtgaagccacagatcaagcaagtggtccctgagtttgtgaacgcatctgcagatgccgggggcggcagcgccacgtacatggaccaggccccctccccagctgtgtgtccccaggctcactataacatgtacccacagaaccctgactcagtccttgacaccgatggggacttcgatctggaggacacaatggacgtagcgcggcgtgtggaggagctcctgggccggccaatggacagtcagtggatcccgcacgcacaatcgtga

SEQ ID NO: 1175 - DNA, 39780 bp, Mus musculus
  misc_feature (8495)..(9138): "n" at positions 8495 thru 9138 can be any base
  misc_feature (26208)..(26227): "n" at positions 26208 thru 26627 can be any base
  misc_feature (34452)..(34570): "n" at positions 34452 thru 34570 can be any base
cccacccacctcctttcaccatcattccggggctcaggactccacacagaaatttagagtgtcctagtagttctcacggtagcagctgaaggtttcttacccagggccagagggctgccatcttatccctggccagccgctctcagtacaggtctgcgcggtccgcgggatccaggactaatacccagggtcctggaggagagtaagaactagttgggggcctgtggggctggaggaggagagaatgactcacaggtcgccaacctatacaaagaaatggtgttgtcaggatttaagcagcatcataacaatgacatgcctttgcccaggtctctgcagctggccggccactggtcctccacggaaccctgcttcatgtctggctctccctgcctccttagcgcacaccctgtttccgttactgttccattggcaccatggcggtcactctccgtacctggccacccagcgtgacacctacccaatgctcaggtttagggcatgagctgactgagctaaggccatctgaggcttgcctgcccctatgaggtagcttgagattgaatgctgacctagatggagatgtccagctgctcctgctagctagctgggctttgccaatgtaactacagtagggcacgtccctgccaactggaaatcttggctctggggatactctgaggcctgggaacaccagagctgggacaacagctttgtgtcaggcagccactccggagctcctggacccctcctgggactctccagggacaggtcctctggaattcagcagtcaggctggtgacagtattacctgggccagcatcgtagaggtgggatacctggctagtggctggcagggtgaggttggaaggccacacccggctgggagggaaggtgtggctgcactgttttctggaaccatagccaccagagtttcacctcctgtctgagcaaacgagcagctaggaatagacagagcaggctcctgtggcctgtgtcttcaggggtgtggagtccagggaacaatctgccgtaccacaaccactcaagatccccaggttgtgtttgctgtggtgctcaggagggtgcctgaaagtctatcttgtccccacaggagcacctaatggtaccctctttgtgatctattcccgttattagatcccagtgaggaaccgtaagtctaagacacagtacgtgtatacacacacacacagagagagagagagagagagagagagagagagagaggtgcatacctaagtgcatatctgcagatgtactcacaaacatgtagtcatgcatgtttacacacatctgcagatacataggtatgtgtgcacatgtgtatgcatgcacttacattgttagatgtcatgttacatgtcatatgcatgttatacacagagataacatttaacttggcacttgcatgtgtgcccatgtacatatacataacagacatggcatctgtgcacacacatgggcatgggtatgagcacaggtaaacacatgtcaaccagcaacacatgtcgctggttgacatgctgacacagatgtacacaagttcatgtgcacaatgtgtgtgtgtccactcatacacacacacagtaccctcaaggccattagcattctcaggccagagcaaggtgaccatgccctggctggggtcggtcctgtctccagttgcagcccctgctgagatttccagggtttgctggaggcagagagttgccctctgacagcccaggcagactgcagagggggctgcagttctttctcctgggtttagagtaggtgatcagccctcttagtgtagtaatggggccttcatgaccctgtctgtaatgggatgtcaggccttcttctggagggcctcagttgtcgcaggggagatctcagctttccctgggggaagggcgatgtatctctttgtttaaatttaaacaccgagagcaaggtcctgaacttggcattggatggagccgttcctggaaggcactgtggcagcctgtctgtgtgggtgtggcaggcacattgtttcaagtgagttttaaattacaccaaacagtgagtagtgtagagaaaagaagaaaagtcaagcccaacgccttcctccccttcctctacttctctgctccccccctcccctcctccccctcctctacttctctgctccctcccctcccctcctcctgttcccaggggcttcttttaaagagcaccagggtgttggcaaggcttttgccctctagtgtctgcccatggaataactgtgctctgcattgtggggttgggtctgcagggcaggagcctgcagctgtagtgagcacagcctggctgaacttgctctgtgcttctgttaaggcagcccagggccccagtaaaccccacagttcctacttttggtcaagactggcagaggagtttgctggctgccactgaaggccagaaggtggcattggattcccctggaactgaagtcccagatggttgtgagctgccgtgtgggtgctgtgagtggaagccaggttttctcaatctacaagagcaacaactgctcttaacctctgagccatctccccagcccctaccaatgcgttttatacagctgacatccaagggcagccccagccagaccaccctgggctggtgaagagttttggttatttcagccacttaaaaaaaaatgtttctcttaaaatttgttttagtcttgtgtcctgactttttcactccaggcacaagctgaggctcttgctctctgccccttgtcatgcacctccacccctcccccaccctcctaataaatgtattccccaccccccaccccctttggtgactgaggctgcactgtgggccctggtagcacattctgattatatttccactaaggaccattctctcttcccctggggttctaattgctccattttgagtgtttggtaattcattcttagctgttggtgcagcatcttagccatgttatcaggccccagcctctgagactttcctttttgcagctgatagaatgagaaaaaaaaaaaaaacccttattattctatgttcacagaatggctgttagacctccagacatctagtcttgagtttcagatagcagcatcaagagcgagcttaggggtccaaatgctggtggttttttttttttttttttttattattgttgttagcctatttcatggaattgtttctagtgctttccacttagatttctttaactagaagcagggtaagttacaaaggtgttgaactgggcgttctgcccaccagtgagagctcaggatctgttacctagaaggaggcaggaagtcacagaagcaggaggaggccaggctgggtggcaggagatttgaggggaggggagagctactgagcgtggggaggggcagttggatgaggaaggaggtgcatccaagacaagtttgcagattgggtgtccttactagccatggacccagccagagagtggggctgcaggtaggtgagtgtgctttagtggccagtgccttccttgtcctcccgtccacgtggttgactaaggagctgagggagtagtagggtttcatcctgggtctcggggatacatgtgtcttgtgacactctcacagctctgagaaggaagacgttaggtttctaaaatcctgtcctgatgctcgtgaactttaggggcagcccttctgcaccctgcccggcatgtcctttcatgtttctcagccagatgggtctcactccttgtggtgtctatgaaccacctcctgtccttccgtgctgtggtggggcatcctaattagcggcttgcgtgtccatcagctcacaggttcagggcaccatgttgggtctggtgttgggcaaagcccttctggtctgttagcccctggttctggactctctttcttggtatcttgctcggccccaccccacttcttttccagggcttaattaattagcttgttgttaatcaatttttgttaattaacaaaataattaattaaatcctgagccaggacctcactgtggaaccacggtaggactgggactcactgtgtagactggagcttgcctcccccaccccaccccaccccccccagtgttgcgattatggcctgggactacatatagactaaactagcaatgaactcacagagctccctctgacctatggttaaaggcctgtgctaccacctattaattttggaatctgttttgtatctttaaattttatttcagtcagggtcttctgtagcccagactgacctcagactacatagctaaggctagccccgaactcctctttcttctgccttcacctggtggtgcattgacattctaggtttatgaagggctggggatagaactttggggctttgcgcatgtgaagcaaacattctaccaatagagataaggaatgttttcttttctttttttttttttttaaataatctatttatttattacatgtaagtactgtcttcagacacaccagaggagggcgccagatctcattagggatggttgtgagccaccatgtggttgctgggatttgaactcaggaccttcggaagagcagtcagtgctcttaaccgctgagccatctctccagcccaggaatgttttcttataaaaaatgttcaagcaggaatgtgacctgcatgaccttggctggcgaccctggcaggcgttcagccttctctgttcacaccaacatctacttccatcagggggatgtgaagaggaaagaaatatccatgtcccatgctacctgaccctcgcagctggaacaaatcagagggcctcctgcgtgtcacagctcccttgttctgctcatctccagtttctgcaacacccaggatcttctgggcttagaccagtgccacctgtgcctctgtacctagagggtgcttgagatcagagtggtgttgctgtcctggctttccttagctgtgaatgctcagtgttggagggagttggtcaccatggcttggaccctagcaacccacagcccccttcctcactgtggcaggagaatgggctcttacgcgacaggacgcagcactgtgaacttgctcagcaaaacgcagagttcataattgtcggactcaccactgtctgtttcccagtcactgcctcagttcttggcttcctgctttctggttggatcagggtaggagtcaccccttgtgcttggctgctgtgaatttctagggtaggacaggggtccgtctggctcctattctgtagaaccgctgtctataattggagtcacctctttgcatgtcacctgtatctccttttgagctatagcgatagttaaggaaaatggtgagctgaactggcttagaatatcccactccttggaggaaggaggggttcgggctatctttaggaagcttctaaatccattgggatagaaaccagacagtcggggctggtgagatggctcagtgggtaagagcacccgactgctcttctgaaggtccagagttcaaatcccagcaaccacatggtggctcacaaccatccgtaatgagatctgatgccctcttctggtgtctgaagacagctacagtgtacttacatataatcaataaataaattataaaaaaaaaaaaagagagaggaagataaagaagagagggggcactttctattttaaaaaaaaaaaaaaaagaaaccagacagtctgtcctttagtaccggacagactaagggactgaatagagatgctggaagagcctgccctgccctctgtgggaggaagggtggggcaggggaggcctggcaagtgggtagatgccatgccagcattgggctcacatctggagactgttgtgctcccttcagcttctagtaaccacacccaaaggtgaggcggatctgtgtatcagggcagctggtgagtgactcagcgctgagctctgcatcctgggatcctggtgtgtgctgggcctcaggcttggctagggcaggtgaggacagggacagaggctcaagggacctggccacaagtccatcagacagcaaagcctggtcttctgtttcttgtttgtggacaaatcagagttaattgctagtgtttccatggtaattaacggcttcctggtgaggcaggaagagctcgggttgcctcctgggctagctatgacttttgatgtgacccactactcctgcagaatggggccctgaggctatgtcttcatgggtacggaggttagtgtgtgcttacatactgtatgtatgtatgtgagcacatgcgtgcattttcgtgcacatttgtgtatggctatgtgcattctgtgtgtctacccatgcatgtgcacccttacatgtattcccaggggagtgccctgtaaccgcaaacctctgatgtctggtaatattcctgggttagcatgtcagaagttgggaagtgagccctccagggaaactgagacccgtactgttcctttcagttgtggcatgtcaccaagcacctggctgtccctctagctagttatttccaccttggtgggtccatccatcttggtgtgttttagccttgttgtcttctctctgtgggatctgtctgtctggcagccccacaaatcctggatgccttccatgtccctcagcaggcaggttcagacaggatagacagtagaaagggatggaggggactgagaaccatctggagccgctgggacctatagtctcgtcctttccttcttttgcaggtcagacgggaacaccggcagccttggcatgacgtcgtgaaggtggccattgctaacctgacatgtggggactcaggaaccccaccccttatgggctccagtctgtgctgctggccccagctctggggctctaagaggtccttgctgctaccccacagcagcctgctgccatccatgtgtgcccgttgctgaaggcctcggtggcccctgcccatgaggatgtgtgcccccgttagggggctgttcttggccctggtggtagtgttgagaaccgcgggtggcatttgcacctgtgcctcggctcacctgggaacatggaggtaagtgagtgtgagccatgagtgagtgtgagtgtgggtgcagcagctctggagagtgtggggtccctgctttggatgctctgtggggtctgtcagggcaggcttaagccgctgggatgtcaaaggatgctgtgtgaccaggagaccccacagcaagcgccaagcttaggttggacggtgtatgtgacctcagtggctcacggcttacttaatgctgacgacatcccaggtacttatgctgcactgttgagattagctcagcctcagagaggtctccaggcccgatttccaggatggggacacactggctgtcccacattccagggagggaactttgtgaagacagaagccgggaagcaaagtgcactgagaatgtccaactctgaagctacctggacactccgggtgctgacttgtaggcaagttcagatgaagttcattgatgggggagggggcagaatgctgagctcagcatcacagcaggaacctccacactcaggaagttgatgcaggaggatcgtgagttccaggccagcctgggccacggagagagaccctgtctaagaagaccagtattgtgtatgtcctgcctgtgttaacatgttcttaaactggtgcaggtacgaaaaagcatcacttgtctctggaaatcattggtaatgagtgtaaatttgttttggagagagatgtgtcccccccacccccacccccatcatgacttttctttttttaaagggggcaccggggaaagaacataaaccctgcacacactaggcagatgttctaccaatgagcatctcagcccctcgttccagagttttcggtgttgagggtttcagagtaaggcatttacttcacgagtgagaaagttctcagtcattacgtattttgagcctacagtgggtggttaaagacacattaaagaggtagagtgtaaaccaagtgtcttcgtcagggtttccactgctgagaacagacaccatggccaaggcaactcttataaaggacactgtttaattggggctggcttacaggtttagagattcagaccattatcatcaaggcaggaagcatggcagcatccaggcaggcatggtgcaggaggagctgagagttctacgtcttcatctgagggcaaacaagaaaagactgatttccagggagctgggaatgattctcaaagcccacctccacagtgacatacttcctccaacaaggacacatctcctaatagtgccactccctgggccatgcatattcaaaccaccacaccaagtgtctgtgatgtgctagaagccccagcatgagaggtttggatctgggagacagaaaaggagatcaggagtatagcctggggatgcatgccatcctcagggatccagccgtgggctagctcctctcttgtacttggtggctgcattgaggttacctggggtggggggggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaacacacacacacacacacacacacacacacacacacacacacacacacagcctagaaagataacaaactcccacaagttgtccccacacagccacttacacaccatcacacattcacatctacacataataaagacgtaattgagcacaaggagatggcagcagcatcgtgggggtggggagtaggtagggggaggtggtgaaggggaattgaggtagcttacactaatcactggaaacgtcaaaaaaatgtaatagaaagctttaaggctgataaaaaagaacagatggaagcccccagttttggatagaatttaattgactatactttcattatgtggggctagggggtcataggacgacaaccttgggtgtctttccttgggtgctggccacttttaaaatttcattttttttgagacgtggtctctcaaccagcctggagcttgttaagtagactggcatggcatcactgcctccccagtgcacagtgccacacctagccttttcacatgaattctggggatcgaattcaggtttctgtgcttcctggcaagcacccactgagccattcgttggtctccccagccctctgctgctttgtccgaagttcagggctgtgttatccctgctagactggggatgatggtcccagaacatgaggaagccctaaggatgactctggggtctcagtccctgcctgctccctgaacctcttcctagtctgactttattctggctgcaaaccagtgagctttgagctgtggtgtgccttctgttgctgtctgctttatccagcagttccttggggtgggggtggggggaactgtggtgaactggctctgacacgttcctccctcacaggtatattggaaggtctctgaagacaaaaaatccaagtgtgcagagaaggggaaatcaaagcaggtaattgaccgcacgtacaaagagcccacgcacacagttcgcagttatttggatcttttccagtagcagtcttctgcatgcctacctggtatcacgtgagtctggtgggctcggtcctgctgtctcaaccctaccagcatcaggattggtgctctcaggccagtgccctgcatcctccgcactggagaagcctgttctcacggcttggcattatgactacaggatgttgtttctgctgcccactagtacctggtgtagaattggcctcccctatatgtttctggccttcttgaaccagctgaggcctaagaggtgttggggatttgatgggatttgttattgttgggtttattttttgttgttgttgggttttgtttttttgtgggttgttttttttttttttcctgtattttgttgtcagataccagtatgcgcactcagggagactgagccttgtatcctttttctcaggagctctgagtaccctcttgtgcctgcccacctggtgtcccaccagtgtcccagatgtttttagatcacgaatgtttttagatcacaggagccaggttgtccccaatattggtcatggtggctcagcagtggcagagtttatcagctgttagctgatttcagaaacagggattaaaacaaccactaggagccgggcgtggtggtacacacctttaatcccagcactctggaggcagaggcaggcggatttctgatttcgaggccagcctagtctacagagtgagttccaggacagccagggctacagagagaaaccctgtctcggaaaacaaaaacaaaaaccaaccactaggttaaactttcttggctaaatggtaactgaacactttccccgtcttactggtctctaactgtagtgttcactcaggacccaaggcaggcaggcattacgataggctccctgctgcaggaaatctgtgtagcggagtgagctgatgccttgcaccactggatgtggggacccacagtgaccttggcatggagccctcctgtgataccctgtccatttgagggttgttggggaaaaaagcaacaacaacaacaacaacaacaaaaacccctttcccaacttgagataatttcaggccatagcccatagactctaagtgctgttctcctgaaatagcacatgggctccaaattgccgtctttgttttcccactgggccctcagggatacacagctggctgtactcttgggtccagcctctctctcagttcctgctagtcgctatttctagttctgtgctggtggcaagagtatagggtggggtccccaggaaggtagaaggagcctgtacaatgtctgttttggcaatatgggcccccaaaatgaacggtgtgtgttcagcaagggtaaatacattgccatctgtagtgggctccccagtacaatttgaggtcagctctggtttggtctttgctttgcttggtcaccagatacaggctggccatctacttagggatagagctaaagtcatgcctggcacctgcactgcatgtggaccacagagataaagtttccgttgcagagcctggctcatggtgcagtgtgccccctctatgggcatagacagaccaaacctgagcagaggagagaacaaggcagcaaatgactggcctttaccatgtggatacaagggttctttgatgggtgcctgttaatggggtgtttcccttgcagacggaatgcctaaactacattcgagtactacagccactaagcagcacttccctctatgtgtgtgggaccaatgcgttccagcccacctgtgaccacctggtaagaccacaacatatccctgtgtgaagtgctcacgtaccagcctggctagcgactaaagcagagccagcctgtctcagtcaggctttctattcctgcacaaaacatcatgcatgactaagaagcaagctggggaggaaagggtttactcagcttacacttccacattgctattcatcaccaagggaagtcaggactggaacttaaacaggtcaggaagcaggagctgatgtagaggccatgaaggaatgctgcttactggcttgcttcccctggcttgctcagtttgctttcttatagaaccaagactaccatcccagggatggcaccacccacaatggaccctcccacccttgatcactaactgagaaaatgccttacagctggatctcatggaggcatttcctcaagggaggctcctttctctgtgataactccagcttgtgtcaagttgacatgcaaaaccagacagtacacagcctctcctgttctttctgcaaactgcaaggactaagaactatacagtcggatttctgacagcaacaattgccccgttcctcctgatgagggttctgtgaggtccatgggatgatctatggtagccatgaggtagctgtactttccaaaaagaataaataccgagagatcggtgttagatactgaaacatcaaattggatgtgcaaaacatccagcagaaatcagggcaatctgattaaggaagctggctggggttcccagcagagttctagtcagagcaagaatgtccatttgggtgggacttttaaataaaagaacaaacggcagcagagagatgccgttgccttgggagcatcaggcatccatcaagaactgactggggaagttgaggcagtcagctggagccatctctctgtagctgagatcccatgggtgacctcccccgccatccccaccctcactccccaacccccccaccccgccactgtattgtgagataaataacagtaagctcttctgcagatggttcaccccctagatgctctcaagggcacagtgtttctcaagggcacagtgtttctcaagggcacagtgtttttactctggggttgcttgctcttctctctgtcacagagtcagggaccttggaagacactgggaaaacatgcttgggtctgaaatggaggaggggaaaccctgctgccagaaccattttcccccttgagctcacacagcacaagaaagcttaccaatacgatgtatattacaggtcacttacttacttagcccttgctgtgaccaaatacttgataaaataagtagcttaaggggaaaagattatcgaaggcacctcagccaaacagaaggcatcttgtggacaagtaatgctggcctgtaaacacccaggcgcacccccagaaacccgctttcacggtaggtctcacttctacatccaccacctggagagacacccatgagcccatgggtgacattttacaaataaaacgataacaaatatgaaaacgtaatagatgggtttcctctcttctctgctgggcatagatccaaattttgcaccaaatgccaaaaccttggctcttcccaagccttatattgtatacctgatggccacgaggctaggtgttcaaggaaaggtagctagcctgttcaaggaaaggttggtctgctgagcacggggtgagtgatgccatgcagggcagggcagggcagctcaggaggcaggagagtagttcattgctctgctgcagccggctgcagatgactggaatcccgggtgggggaggcttctgaaatgaagagcctcattcacctaaactcagccagctgaagtttaaagcttgttcccagtaagagttcagttagagttgtcttagttagggttgtactgctgtgaacagacaccatgaccaatgcaaggcttacaaaggacaacatttaatcggggctggcttataggttcagaggttcagtccattatcattaaggtaggaacatggcggcagccaggcagtgcctggtgcaggcagagctgagagttctacatcttcatctgaaggctgctagcagaatactggcttccaggcagctaggatgagggtcttatagcccatacccacagtgacacacctactccaacagggccacaccttctaatagtgctactccctgggctgagcatgtacaaaccatcacaagaggcttacctagattgcaagagatgtttggttttgatccccaggaccacaatacactcaccacatgcctatacaccatacatacatacacacacatacatgtaccatacatacaccatacgtacatacacacacacaaactcccctcagttggggatataactagatagaacagactcattagaaattctcttaggcagctaggtatggtgggaaggctcctgagtatgaggtcagcctagcttacaagctcaaaaggaaaaaaaaaagagagagaattaagaaactaaatatttgtatagatgtctgaggagagaggccactgcacaggtttgactggctaaactaactgtgtactgggatacaaccaaaattctagtgtgtgtgtgtgtgtgtgtgtgtgtgtgtgtgtgtgtgtgtgtacacttgataagtgcggtccgtggatcccataggcctttagaagcatttctcctaagaatggggacattttcctgccaactggtttcatcattgcagataaggaagcacagtgattgccagtattccctccgcccctcccacctccccagtatcctccgcccctcccgcctccccagtatcctccggcccctcccacctccccagtatcctccgcccctcccacctccccagtatcctccgcccctcccgcctccccagtatcctctgcccctcccacctccccagtatcctccgcccctccctcttccccatagcttagagcagggcacagccccagtggcctccgggcatccctgggaggtgtgacgacagatgggtcttatcaggtgggtcacactgtcaccccagctcacacttcctaacctgactggtggcctttattgttttaactggcccgttggtcactgcagacactgtgaggtcctgtgtgcttgctggcctctggcttccagccagcagtctctggcacagctaggagctcctgactgtggtgggcagccttgctcctggcctctccagtaagcaaagtgtaaagtgatggcctacttggattgtctcagcagtcctggagttctgataggcagtcctgtgggtggctcctgtccctttaacgggttgcatctgctgatttcttctgtgtgtgtttaaacgcctcttttaaatccagaagtgaaaattcttcaccttcgttctgtgggcattcccccccccccccacacacacacagtttgtcacttgccattgaactgtgtctcattttttcccccacatgagaacattctgattcattatgtggtgatgtttgggtgggtctgattctccttggatggtgttggtttcttgtttagttttttttttttttttttttgtcagcttggcagaagctggacttctctgagaagagggaaccacagttgagagaataacacctcataagataagataggtctgtagtcaagtgtctaggggcatttcacattagtggttgatgtgggaagagccagcccacggaggggtgtataagaaagcaggctgagcaagccacgatgagcaaaccagtgagcagcattcctccatggcctctgcctcagttcctgactctagactgctgctgctttgagttcctggcctgccttccctcattggtggactgtaaactgtgagctgaagtaaaggcggccatttatcacaacaataagagagctaagacacgtgaaataggtttccttgtcaggtggaaagaggttatcccaagattgtgttacctgctgaccctcatgagcacactgtgccagaagcatggacaaacacatttgttgtgtcctcgcacagtgccagaatttattcagcaacaataaattcccaacgattagcagtttagtaacatcaggttatcacttaatcctgcttccctcagtgatcaggccgagcaaggcaaatgcagattctttattcccgtctttttgtttgtttgataaccatatttctctgtgtagccctggctgtcctggaacttactttgtagaccagactggcctcagactcagagatctgcctcccaagtgctgagatttaaagcgttcgacaccatgccctgctcttacctgaatcttaattagtaacgttaactgtccaaccacacagcacagagaaaatatgtgtatatggcatgtatatggttatagagggaatacaggttaaagtcgcttgaggtttcagacctgggctcagagaatctgcactgatttcaaaccagaccagtgctgcgagggagccgctgcagtcaggtgttagagagctagacacctccgagaagctggaagctagagtctcccaaggcagaagcatgtctctgctgaacaaaccaggtagcaactgatagtttcgtgtggggctgtccatcatagtgttgggtgtctatcactttaaggagacaaggtgaggatgttacacctaggtctattaattcgtaggcctggcttcctaggcctttttcgtacaactgtgtgccctgacacactcagcttgtatgaattcatccaatggtggctcccctttctgttcccaggagtaaaccgtttatccatctgtttggagtggatggtgcatggcagacagtgtagcttgcaggtccacccagggcctactcatccttttccccaaagtggaatcaaaagctgcttgtaaaacagactctcctaaggcaaggcacagcctggagaccgttttatacaatatggggcagcttagagccaggcacagcctgatcccggcatgacctgtgttgtggtgagcttgctttagtagaatggcttcttcaggagctgctggtggtggatgagcgggggtgagggttctgtgggttgttttcattgggtttgtgtcgcctgttttgtgaggactgtagttgagcaagcaacaactgaccctgcatatctcaggctgtcacacacatgagatgtccttcagctgtcaacggtcccagggtgggacccacatggatcagggcccacttaccccacactctggtcttctgaagtgaaagaatctgtacctttaagtgatacagggacaggtcctcagcaccgagaggtcagatgttttctttttattccattgtagaacttgacatccttcaagtttctggggaaaagtgaagatggcaaaggaagatgccccttcgaccccgcccacagctacacatcagtcatggttggtgagtcctgcgtctgaggctctttcactctctgagtttatggtggcatgtgatgttgccacctgggacactcaggtcttccctcttcagccctgccttccttggcatcatcttggcacgagctcccttcagagaaggtgagcgacttgtggcacagactcctcagtgagagctttcgcgtttcccattcagagggagactcaggccccaccctctgcagcagcatatggcttctggctgtcggtttttgtgcagcacacaacctggatacttgtgtggctctgtgcctcccgctgcggtcctgcatatctgaggctaggggtcacacgctgtcttacagatagttcatgttggaatctctcagccagtgtgaaggttcaagcttcactgtcaatgtataacattcagtgaactgtgagatagttaatactatattacaaaacaggcgtcatgtgtgacactcctgcgcagtcataggctaaagtatgggttctgagtatattaaagtagacgaggctggaccatgctgcctggcagtgtaggtgcctgcacatctttttttacttacagtgctttttacttaggatggcttccctgggtgtcaaatactgaggagtgtacttgccattgctatactgactgtggcaaattctcatttgtgattagctattaccctttaacctgggaaaaaacagttaaatttggtgactgattgttctgatgaaagatgctgatgtaggaagcaggaatgcatgtcagagaagacgaggacccccccccccccgccatcctataaggaattaatgagggtataaatgaattatggtagcctggtatgggtgtgatagcctagcagaggtggaactatgaggcttgcttacagtccagcctgggctaatgtcagaacttgtgttaaacagttgtccctagtctctgacagaggctgaagctctgattggatcttctctactccctctcctccaccacagggggcgagctctactctgggacgtcctataatttcttgggcagtgaacccatcatctctcgaaactcttcccacagtcccttgaggacggagtatgccatcccgtggctgaacggtaagtgtgtgctgccagccttgtgggtctaccattttattcttcctctagctgtccccaggtcacaggagccgggggaggcgggggtggggtgggggtggggtggcgggctgctcatgtcagatcctaggcagtgctctttggaactgctcaaggcccgcaccagagtagctgtcttgctcactgctaatagcattgtttaaatctgattctctgacataccccacccagccccacttccaccccgtcccccaaatgcagtttgggagactttaataaaatgaagctctaatgggaagttgagaatgtagacactgagtttgggtgtcatcttagatgtggagactcttgggtctggccgggtggtgttgaaatgtgtctttactcccagacaagcatatcagggtgtggatgatgggggccctttgtgggtgtcttttttgtggggatgctgaccagtgatgcagggctttttcgaagccccttgatctggagtcagaccctggagtctgagatctgagacagccaatttctccttgggcctccccaggagtctggaaatccttcgggtggctgatttggcccttgtttaaattggcagatactctagcatgccagaccaaccaccagcagagaggcctcacccggcttcctctgtggctatcttggtgaagctgaggagggtggcgggcgtcctctgggcctggagttcacagtgtggcatacatactgtagacgtcctagaagggaagcttccaggctctaaggctgcccttgccagcctgcagcaccccagggagcaggtagagaggtggcttggtagctccgtgtacagaaaccatcctgtgatgccaccccacagagcctagcttcgtctttgctgacgtgatccagaaaagcccagatggtccggagggtgaagatgacaaggtctacttcttttttacggaggtatccgtggagtacgaattcgtcttcaagttgatgatcccgcgagttgccagggtgtgcaaggtgggtgctgtctccctgttcccacccacagtcctgcatgatgccactccaagattcctctctggaagtgtggccatctcctatgggtagagacccctgcggcaaagtttaatgtacagttgaggcacagtaagagaccagcaataagagttttagaggtatgtgcatggtttctcttgagacccaaagtaggattgggaagatggcttagtggttaaaatgcttaccacggaaacaaaaggaccagcgttcagatctccagaacctatagatgctgagcggatcctctgtagaaaagtggagatagggcctgctagtggggctgtcctcatcggcaagctctgagtttgattatgagaccttgcctcaaagaataaggtggatggttcctgacatcaacttctggcctccagatgcacccacacacgaacactcatatagagacacaccgcacatacacacatacatgaaaggaaagaaactcaaagaggaaaaaattagtcagagtgagcacttgtgatattttcagtgtgtcactaatcacaggtaactgaaattgcagaaaatgcaatcacgcacacgggagccgccttatttctttccagcccagagtggagtatagtttgtaactgtctgtgttgtctcagtcgtcagctccctgaaaatgactaggattgagcaggcaaagagggcacaaaaggagctcttagtggatgatcatgtgtttgccctaggatggtctgcggggccagggtctgtggtgggaaggaggcctcccatcacttgtttaactcctgggtcacagctgggaatgctgcaggagccaaagccagtggcacgctgatgtgacacagatggggtggttttgcttgtcattgaatgtgtttggctcttttcgtattctgtgatcctgtcccacatggaagtattgctttggttacataacttgtcttcagtattcttgggctaggccgtggttggggacatatggacgcctgcttctgtggctagtcatctgtcctgcctctaccatgtgctgtctctggaattccagggcgaccagggcggcctgcggactttgcaaaaaaagtggacctccttcctaaaggccaggctgatctgctccaagccagacagtggcctggtcttcaacatacttcaggatgtgtttgtgctgagggccccgggcctcaaggagcctgtgttctatgcggtcttcaccccacagctgtgagttcacttgtgagtcccttggcagttggggcctggtcaccctgacgacctcctgccctcctgacactctcacggattcccctccacaggaacaatgtgggtctgtcagcggtgtgcgcctacacactggccacggtggaggcagtcttctcccgtggaaagtacatgcagagtgccacagtggagcagtctcacaccaagtgggtgcgctacaatggcccagtgcccactccccgacctggagcggtaagcagggtctcgagctctggggagggctcatcttctctggatctcaaggccccccaagcatgagaccacacagatcctagtgcatcccggcagagggttgcatggcaacaggaatctgggtgctgggctgagtagctgccgggcctggggtgaacagtgaagctgttcctttctgatctcctctgtgttgggtagcaggcctcactgcatgctgcccggacgagagagtctaccgccgggctcctttgagaagtggacattgcacaatggcaggcttgcttcatttcccatttcctgcagacaaaaaaaacctgtttgtcagcctgggctgtctcctgaggcagcctgtccactagataacaggaatcatattctttcctcctagatacagtaaattagtaaagaaaattctagggttgcctgcatattgttgccacgtggtggatgggtgtgggtatggaggggcttggctcttgaagctctcccaggatggactgttctgtgagtgtctggcctcgacacctggttattctcataactcataattcaggtgttcagtaaaacatggctagggagctgggaccaaaaaaaaaaaactctttacaacttttttttcttttgtgctacccagaatctggctttctctcctctctctcctctctctctctctctctctctctctctttctctctctctctctctctctctctctctctctctctctctctctctctctctctctctctctttctctgtgtgtgtgtgtctgtataacaatatttaacaagcttcctttggcatactttcttctcatagaaaagctgtgaaatgagtgctttttaatctggaagtttgctaagttttttcattggctactaattcctctactgatcctgagacaattatgtcccgtggctttaaaagcacagctctttgtctctggggaggtcaccttagcccctgttactctttggagaagtgtgaccatggccctccagggcttctcttctgtgtgctcagttgaagctaagtgggcatgtgaccgcggtgcttttaccccacagtgtatcgacagtgaggcccgggcagccaactacaccagctccttgaatctcccagacaaaacactgcagtttgtaaaagaccaccctttgatggatgactcagtgaccccgatagacaacagacccaagctgatcaaaaaagatgtaaactacacccagatagtggtagacaggacccaggccctggatgggactttctacgacgtcatgttcatcagcacaggtgggttccttggtaagattgggaaattcacttttagccatctataggtaggtttggtctctccaggtaccaggaaggtttgtgacagcagaaaaggatttctgaggtatcacagcacctgggattatgagtctctgtggccatcaggcacctggggcactggttactaatgcaagtcccaacctgtcgtacctgggctggagtggagttaaatagtccctgttgtcatgggactagtgggactggcctggtatttcctaattggtagtgggagactctgccccctcctaggtaggagccaggttctgtcctgccccgagctgcctttggagatgcaactctctctcagatgtcttctgggatggggatggaaagttggagcatggcagctgccagagccccaggggctacccttagagcttcccagatgacttgaacattttgccctcgtctgcctgcctgggcccctaacctcccctggaagaccagtaaagtgcaacggccaccttatactgaatgtggctcaggtgtcagggtgtaaccttgttggtgaaggtcattggaatccaccataggacagggttgtcctcttctgagtgccccattgaggggatggcttgagttatccacgagtgtgagtggttgccgccaaggctggagtctctctcctagtttcatttctgttgccgggcgtggtggcgcacacctttaatcccagcactcgggaggcagaggcaggtggatttctgagttcgaggccagcctggtctacaaagtaagttccaggacagccagggctacacagagaaaccctgtcttgaaaaaacaaaaacaaaaacaaaaacaaaaaaattaaccagggtgccaccctgggcctgtccctctagggcctccttgctcacctgtgttctgaccttgcagaccggggagctctgcataaagcagtcatcctcacaaaagaggtgcatgtcatcgaggagacccaactcttccgggactctgaaccggtcctaactctgctgctatcgtcaaagaaggtaatgtgggtttggttggttggttggttggttttaggggtgggggtcaggtccaggcgcttgtctcccttgtagcttctctgtggctaggactggctaggatgggtctctcaaggcttggcagcctctggcccaggtgaacttggcgtacacagcatgggatctgaggcttgggaggaggcatgggagagccaggggccttgattgtactaagccactggagcttttgggaggtccctaacctggggaaatgtctgtgccttgaacctgaaaaaaaaatgcagattgtgctggtgggacatgacattttgctaatttgtaaggagaaataacaggggctggtgagatggctcaatggttaagagcattgactgctcctccagaggtcctgagttcaaatcccagcaaccacatggtggctcataaccatctgtaatgagatctgatgccctcttctggtgtgtctgaaaacaactacagtgtacttacatgtaataaataaataaatcttttttaaaaaaaaaaaaagagaactaacaggtcaccctctagagctcctgccataccgccctgtgcatcgggcagcctttgcagaggcctcagtcacgggggctcagctctgcactgtggctcccacgagccacggaaacacatagatgaccaaacctgccctcgaagccatgctatgtattgcccgaagttttcataaaaagctccagccagatggtagtagtgcaaacctttgatcctggcactcgggaggtggaggcaggtagatctttgtgagttcaaggccagcctggtatacatagtgtgtttcagggcagccagaactatgtagggagaccctgtctcaaaaatgaatgaatgaatgaatgaatgaatgaatgaatgaataggtattttttaagcccctaagtggggtgcagtatggttcatacctctagttccagaccttagaacattggaagcaggaagatcaggagttcaaggctagtcttagccatatagcaaagtcaaggccagcctgagctaagtgagaccccattgcaaaaaataaaacaaggtatataggagtgaatagaaatggcctgggtggggctggagagatggctcagtggttaagagcagtgactgctcttccaaaggtcctgagttcaattcccagcaaccattgtggctcacaaccatctggaatggcatctctgatggatgccctgttcaggtgtatctgaagacagcgacagtgtactctataaataaaataagtcttaaaaaaaaaaaaaagcctggcagtgatggtggcacatgcctttaatcccagcacttgggaggcagaggcagacaggtttctgagttcaaggccaacctggtctacagagtgagttccagggcagccagggctacacagagaaaccctgtctcaaaaaaccaaaatgaaaaaaagaaaagaaatggcctgggagctgggcttggtccactggctggaacttgttccttgtcctctggccttgggaagatgtggacaccacattttacatctaggataaaacaaggaagttcagaacatgggttgtctccaaatcctgactacactgcctgctgtcatgttaccctgggcatcactatatggtcctcttaaggtggtctctgtgtgtgtatgcttttcattaatgtgactgttaagaggacatgtgagcctcctaagtgctgagggctggctttgagcagcacagaacccagggaaagctaggagcaggatcagctgccacctgccctgcttcatgcctgctggccaaaggtgctcccctccccttgctagggctctgctgtacccccctgagaagatgggtccagggccacacttttggcttcaagtgccagtgctagcctcttgcctctacccttgtctctgatgcctggctctgggacactgctgaactgtggcctggtgtgactgtccccgtggactgcacatctgtgggccctgtgtttccaattcagttctctttaagtagctggccacagcagttaccaagggtccatcagtctcacttacccgtgtgctgggcttctgctagcaccaggtacaatgctggtcctggcttgcacccaggaacatggcacgctcctgtcctggaagtcagagcgatgttgataggcgtggtcacattggcaggctggattcagagatgactgataaggatgtgtccttatcacaggtacctactgtctggctcaagacaagactggcatttaaaggttgtgccctgtggattccagctgtagtgctgtgtcacttacagagtccaggagagcagtggggggggggggggtcacattaggagtgggaagcaactggagagggcttttatgtggttttctcaagacacaaatgaaagtctcttcacccaagatagagcaccaaggatagaccagtcgagctcagtgagccagtgagttttggggaggtagctacagggaagaaggaacaggggattatttacaagcccgtgggtggttcggaggcagctgcatccatatatctcccttcacagctggtaggcagctcggcagggcagagtctcctctctaccgcaattgtgtgctgcttatataaccttggggcagcgggcacttgtgaatcttaaacctcgtcaggcttcctaaatttccttcactttgagtcttgtgaggctccctcggcgctccgggaggacgtgtttcgattgggcagacatagaaacagagctgtctcttctgggaagaggagctgctttgggcgtgcagtgtgcttagcccagctacggaagggtggcgtcagatcccaggccctgcagttcctccactggcgtttgaatcctcctgggacaggggacaccctgcttttccaaacaagatttgtgtcttaatgtgcttttctgtcactgcgataaaccactctgaccaaaagcagcttgcaggaggagaaaatttccttcggttcacacttccaggttgtagtcgctgagggaannnnnnnnnnnnnnnnnnnnccctgccctgccctgcatggcatcactcaccccgtgctcagcagaccaacctttccttgaacaggctagctacctttccttgaacacctagcctcgtggccatcaggtatacaatataaggcttgggaagagccaaggttttggcatttggtgcaaaatttggatctatgcccagcagagaagagaggaaacccatctattacgttttcatatttgttatcgttttatttgtaaaatgtcacccatgggctcatgcgggaatggattattaagcttgcccgctggcttctgcttagctgctatcttataaagtcaggggtggcatcactcacactgggttgcacccaccctaattacttagcaaataagaaaatggcccacaggctgggcggtggtggcgcacgcttttaatcccagcacttgggagggagaggcaggaggccagcctggtctacagagtaagttccaggacaaccagggctacacagaaaccttgtctcagaaaagaaaaaagaaaaaaaaagaagaagaaaatgtcccacggacatgtccacaggctaatctgatataggcagttcctcagctgcagttgtctgccccgcaagtgtggcaaggtgacaatgaaaacccatcaggacactgtcatttaggtcttagcggtcgggccttgtggcctattctgagtcagtgagtccttccctccatgcagtgtttgactgtgctgtcttcccaggagctggtggagaagctagcagcccctcccagtgcctgagtcctccttacacttgccatccgtctctcatacacaggggaggaagtttgtctatgcaggctccaactctggagtggtccaagcgcccctggcattctgcgaaaagcacggtagctgtgaagactgtgtgttagcacgggacccctactgtgcctggagcccagccatcaaggcctgtgttaccctgcaccaggaagaggcctccagcaggtatgcctaaggatggggctgtgtgcctatgccccatgcacaagccatagagtaatgtgcgcctgctgtcttctaggggctggattcaggacatgagcggtgacacatcctcatgcctgggtgagtggatctcctttgcttcccacccctgggctggcaaagctcccggggcgtcagttccatggttttcctgtgcggtctgtcttcctttctcctctctgaacagaagtcaagtgtcacgcagcagacctgtgacctctccttgtggtgaacctgtgatctttctctgtccctttggttacagaaagagggctcaaaggcacacagggtgtatcggttcactggaaagcacaccctggcccacaccatgctcctctgttctgcttagctgggccccgtaaacaaaactggagcctgctaggaatgagagcgaaggagcccttgggtatgaccagatagccctagcctaaaaacaatactcaggaacagtgtgggacagtgtcatgcttcaagatgaaaatcctaccctagaaagaagtgccttaaacgctaaggagatggctcagttggtaggatctgagttcgatccccagaacccatgtaacagctgggcattggtggttcatgcttgtgatcctagccccaaggagggtgaggcaggtggatccctggagcttgctagcctcacacagcctagccgacttggcaagtaccagacaaatgagagactccatcacagaaaaagacaaagagggtaactgctatctgaggatgatactcagatttctggcctctttctatataaacacacatgtacgtacacacacacacacacacacacacacacacacacacagagcaaatggcatcagattgccttcaggcatgtgtaaatgtcacacaaatttcatgtgtagctttcagtccccttccaaagatagttgtctcgttttatatatgcaaatatttccaagcccaaagcatttttcatcttccgtatttcagacaaaagacacagttgtggttagttctggtgtcctcttggggcaccccctcctgatggctggccatcaggaaacggctgtgaccagaggtaggcatagaatcttgccagaattctagtctgccttcccagccccgtacccccttctctgactagccacatcagagtaagaagagggtccctggttgctagctggcctgctttagccattagcagaagtatttgtcagctgactgggtgccactgtgagggagctgagccgtgcccagccccttcctcagcctgctgacctttctccagggccagggtgagaacagaaattctcagagctgtcgccagttccttcagtgtatggaagggggacggggtgggggctgctctagggtcatggatgtctttaccttggtcctgaagattgcacctggctccagtgggtggaagtctcatgccgtcctgtgggtattaacctgttttttgaaagcagtcgagcggtcagacggagttgttgacggtgagcacgtttattttgatgttccagataagagtaaagaaagtttcaaccagcattttttcaagcacggcggcacagcggaactcaaatgtttccaaaagtccaacctagcccgggtggtatggaagttccagaatggcgagttgaaggccgcaagtcccaagtacggctttgtgggcaggaagcacctgctcatcttcaacctgtcggacggagacagcggcgtgtaccagtgcctgtcagaggaaagggtgaggaataaaacggtctcccagctgctggccaagcacgttctggaagtgaagatggtacctcggacccccccctcacctacctcagaggatgctcagacagaaggtagtaagatcacatccaaaatgccggttgcatctacccaggggtcctctccccctaccccggctctgtgggcaacctcccccagagccgccaccctacctcccaagtcctcctccggcacatcctgtgaaccaaagatggtcatcaacacggtcccccagctccactcagagaagacggtgtatctcaagtccagtgacaaccgcctgctcatgtctctcctcctcttcatctttgtcctcttcctctgcctcttttcctacaactgctacaagggctacctgcccggacagtgcttaaaattccgctcagccctgctgcttggaaagaaaacacccaagtcagacttctctgacctggagcagagtgtgaaggagacactggtcgagcctgggagcttctcccagcagaacggcgaccaccccaagccagccctggatacgggctatgaaacggagcaggacaccatcaccagcaaagtccccacggatcgtgaggactcgcaacggatcgatgaactctctgcccgggacaaaccgtttgatgtcaagtgtgaactgaagtttgcagattcggatgctgacggggactgaggccagcgtgtcccagcccatgcccctctgtcttcgtggagagtgttgtgttgagcccattcagtagccgagtcttgtcactctgtgccagcctcagtcctgtgtccctttttctcttgggttgagcctgtggctcatcccctttgtccttttgggaagcaagtatctattccagtctcaagtcctgcagttgctggagcgcttacgcacctgagccctttgtgtcctgggggagagatggccacctccgtgggctgcgaagagccaccccttcctcttccgattctcctagcagccactcagagataatttaattccagattggaaacgcccttttagtttatcagattggtaacttacatcctgctgcccagatggcacggacagttttctttcacttaattattattttttttttaaggattttcgctcctattgtgttgatgtcttaggtcattttctttttttctttctctttttttattaccagaggagatgttttaatattcatgagaagaggaacattttctagatttttttgttgttatatattgagatataaaatatggctatgttgcttaagattctcagggatagacttatttttgttaacttcattctttcctgctgttaggaacataggcctaaaattgtctcttgagtttgctcacccttttgttttggtagggtttttttgttgttgctgttattgtttctagtttttaatcttattcattttgaaggatttttctttctgaactttttaaatttttatattttcctgccatacatctacaaagtgggttttgagtgagggcaggtggcccagtggctttgggtggcgactgagctggtcccacgaggggaggagggtttatataccccatgaccctgcggcttcttggcgcctcctgcccatgaggatcacatcctgtctctccttgcttccatctctcatcactgcccttggacttccgccttgactgtccatgaaagacagaaatgggttgggtagttgggctcccaacctcggatggtgaccgcaacatcccgtgtgggcggccggccgctcctgcagcccgactctcctgccagtgtctttcaggatgtcaacgggtggtacgattctggcatttgtttctcgctcaccgtgtgtggaacactcattccatgtagagggtgacgaactctggattcccccccacccccaccccgtgccgtgtagacactcatcttctgcatgacatgatctaccattcggtgtaaacatttgtgtttataagatttactttgtttttatttttctacttggaactgtacacatttgaaaagtacccaaataaaccagaagctttatcgttgactgggccagcctttgccttagtgtggaggctgggggcggtggggtgtcctcctgtccctctgtgacggccctgggtgggggttggtcctgggatcttgtctgttctcatcccatgtgtccggtttcttgctttaccttctccgtcatgggaatggttctgacgacttcttcctcagtgccttcttttgtgtcctctgtctcacagcctcatctcctaagtccttccctcctcctggctcctctctatcctgtctgggccctgactcatcttctcccagaagccctcggccggccttggcctcggggcccaacagccgtaagcaggtcaccttactgccacccttcttgagtgaccaggcgcagaaggtgcaggcgctggggaccttctacctcttctgccaggccacaggtgagttgaggggcctgagtgtccatggctgtcccctcgctctgcccttgctcctagctgtgcctgaggttcagctgtctgtgctgatcccgggatcaactgtcaaccgtgcaacgctgttgctagggctgccgaaggggtcatccagcctctcgccgtaaaggtacaggtgttgggtcttctgagcatgtaggctgctgtgcccaatgttgtatgtcagaaaactggacctacagggcagcagagaaccagatgaggccacgatttgctaacctgggttaggtagggaattcaaggccaaccccaggcaacttatgagaaccctgtcttggagttttaaaataggaattaggatacatccagtggtagaatgtgtgactaatgtgtacaaggtcccagccacagcataaataaatacataaatgcgtgaagtccataaggtggaggttttctccctctgctggagactatcacataaggacatggactcttgaaagatggtagtttacccaaaccattctttagctcagagatacccatagccccatctttccctgtgggctttggcctctgcacagaagtgaggaatagagttgatttcaagacaaagcaaatccggtttatcttaaaattgctttttaattgtcgaagctatggagatcttgaaagtgctatgtgttttgttaaattagctctaggatcccaggggcctgtgttgtctgctgtgaatgcaacatgccgttggcagctggaggccccgtggaggctgtgggaggtgggcagaggttgctgcagacctacgtaccctgacatgtcatcagtgaatacatgggccttgatggcccttttgagttgctgtcttaactctggctgcccaggctgctgaccctggacacctgagcttcagcccccctctccaggtccctgggtctcctggtgtgtgtcacggtgcccagtgattcccattttgtgcttgctgctgtggaccaagccttcatgtcgacacctgttcttgttcctcagtaagatattttaagatagatcatttatttatgcatgtgtacaaatctgtgagcgtataaaggggcagaagagacgccttgaagccagagtcacacatgattgtacatcacctggtgtagatgctgaggactgaacttgggttcaacttggaacctgcgagagaagcaggtgctctcaactgctgagccatctcagcacgtctctaaggggcaagccattacatttaggggagtgttttccagtccccggtattattagcaaggctttcacaggtatgggtcctccggtgtgggagagggtgaatgactggggccttccttaaggaagataagacttcattgttagatgcatagaaactacaacatcgggcatttcaacaagggggaattcgaagccgggagttgtttgctaaggtgatggggaacctaggagtgagacaggaaggtgggcttctccaaagactgctacaggaagccaccagcatgggcagaagcaaaataaaacctcactcacacttgccaggcctctgaggttgggcatgacctgcaagggtagccttgccggcaatgttcctaccgccgcactcctcaggtaccacgagagacaggagatgcgctttttgaactttttagtgacctaagggaacactggaagccagggactgaggagccatggctggggactgtgggggccggaagtgtgcagggtgtgagtggaaactgaagtggaagagtgagttcctctcatgcccctcagagcggactgagcccaggctggggagacagctcactgattaaagtccttactgtgggagtgtaaggactggggttctcatccccagacccccacctaagtgctgggtaggcttggtgacccacctgtaattccatctttagaaagtggtgatggaatccccagagcatgctagctggcaggatgagccatttagcagtgctctgggtttgattgacagaacctgtcacctcaagcctttgcatgcatctacacacacacacacacacacacgcacgcacgcacgcacgcacgcacgcacgcacgcacgcacgcaccaagtctctgtcttgagcagacatgggaccaaacccttactctcccttacctactttctcctgtccttttttccacaaacatttgaccacacccggggcctgtcttttcagtcctgtcctccaccaagacaaggcactttagggaaaggcaccgccagcctggtgatggctgggtgggctttggtggtgtgaacatgccagggcctctgctatctttgagcaggtggcaggttgggtcggagttggcagacaatcttatctgaagcagaggccatgtggttttgaactcaactccctgtaacctttctacaaaaagcagtgtatgtctttgaggtctgctgaggaggccaaagcagctgtcccaggtgagaccccagttggctctcctagcccaatgacatgggcagggcagggctaggtgggcagagcaagttgggagccttgacctgcgtttttctctctcctaaaacagctgtttgtatgatttatgtgagtggcttggggctagctgattaaaggcctagtgcgctgtttttagaacacaagacttaaagagagggtgaacagggactcttcagtcccttggcatgtgtcctggtgtccgctctggctctgctggtgactctgagctatcttgggggagcctcacccctctagagggttgattagaggtcagatagacagcaaggcttgtactcaggactattctgcccactcctgcttccacccaggacctccatgtcctctggattggatgagtgttttcccagtgtatgaggcaattcagacgccctgttctgcatacccaagtgagatgaccagggaagacatgaaagctgccccaagcatggctgtgggggaaggtcaggctgcctacagcctaaagcttgcaggaactcccgtttagttccagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttagttccaggaaaggcagcaggatccggctctgacttttcctccagtctttgtgcccgggtctgcagcccagcactgaggtccggccatacccagccaggtgggtggagggctggagccgctgcactgtctgaccttacactgcagttgcttccccgtgtgctgatatcactgggaggtgcatgtttattctgtcctgctgccagctgccaaaggttggcatatgtacagcacatgccatgccaacacacaccacactgtgacatacactacaccacaccacacataccacatataccaggcaccacacataactcccaccacatactctccacacatagcccccaacaccacacatataattacccactgcacacacaacacatttatcccacatttcacataacccccagtaccacatgccacacgtaccacatcttacatgccacacaccatgcaccacatatcacaccatacatgcttcctttgtgtaccacatatataacatcacacataccacatacacactccataccatatatcatgctacacatacatgtacacactacgtactcagtccataaacactgcacacatcacacaaaccccatgtgtagcacacagccacaccaccaccacatctcacctataccaaatacctacatcacaagtcacccacactacaaattgcccacaccgtaaaagtaccacccaatgccatgtgcgcacaaaccctacaaacttaagacacttacctcaggtgctttacgaacagcataagcaaattgcttttaccaagcggggttcctaagcaagcacctgtacatttttgggtcccctcatttagtccctgtttggggtatggattcggggggccctaagagagctgaggaattggggtagtggggacaatgaaagctgcttcctttccgggcctcctgggttctgggcagcttcaggatctgggctcaaagaaacttttggggctcctttctcctaatgggggcctctgtggtggccaggtgggtggggctgggaaaagggagtccctggtacctccctttctcaaggagggcaggggcacaccagaaagtggtttcccatatccatgacctttaagagtgtcctcaaccattggggcacttcctcattctggttcttcagggggtgggtgtgttaaagatcacatgacccttatagtgagatgcagaactgggtggggtgtgcctagggttcctgctgctccaatttaggaatccatcataaatgcagacaatgatgtcttgagagcatcagcctcatccttgagcagtatctttagtcccccccagagtccagagcccagctccctcattcccagggcctgtttcagttcacagtcctaagaagccactgatggctacatcgtcatctctcaagacttccaggtgcagtcccgattacctgcatgatgaggtgcctgggggcagagacagagaaagggcctcaagcttagcctcccctcacaggtaacagacatgcttgtacttggtctaaattccaggctggccagggccaaataagatgccatctgaactagcagctgtctggactaatggcatgtgactgatgggggaactcatgaaatctgaggctacggtatgagagaagtttctagaagttgagggaagctttgaaagagcccttgtggccagagtgcagacttgtggggactgtgcagcccatggggataggtgggtcagaatccttcccaggaggcttagtagtcactaacttgatgtcaggaagagcccagcccgtgtgcatgactaaatacctgacaaaagcgagtcaaggggaggttttaattatggttcacagtctgagtctatgaggaatgcagcaggggcatgcacctatagtcaggaagcagtgttgctcagtttgtgtttcaacatcccctcctctgggggcatcactgtgtagccttggctggcctggaattttctagactaccacgtcttccagttcccagaaatcctcctgactctgcttcctgaatgctaggattaacggtgtgtgccagccaccatggccaacctcacaggcatgcctagaggcacatctcctaggtgattttagagtgtcttgagctgacaatatctaccatcacatgaaggtatttgaggcaggtggcacaagacagaaacaactgttagcttcagtgaacccctagctaggacatgggtgaaagaactctgggaaacctgtggatgggacgtgcctgggcaactgtgatgcataggtccagttctgggtccgccacccagtgccagatggcacagtactgagggggtggcaccgtccactgcttttaatgctccttctccctctctttgatttctgcactcagaaggaattggatagttaaagaaccaacagagagtaagtacctcttcacctctctcatgttttacagtgatgccacatttaagtttacaggtgctgtggtgtggggtttgtggccaatgtgacctacatgttttcaccccccaccacaaacttgatctacaaacaaacaacaaaagcccggagttagtgtttcatgttcattccttggttgtaatacctcaagagttagttgttccagttggattgtagattgatacccaactgcagaggaatggctaaaacaatatggttccatgaaaggcactgagttgcaaaggaaatgcttggccctaagatctacaggtaacacccaagatcctaccagctctgaatccaaatccacaaagctgctcctgtcctggatctacacaggctctgttgtgtcattgttccttaaactgtttcacagctgtttaagtagtgtcggcatagtattaagtactgtaagaaatgtagaaatgattccaagtctccaggaggaggtacatgtaggttttctgcaaacatgtcatttgatgtcctcagggatcccctgcagatactaagggatgactccagttgtgctccccagttgatggacatctgtatacagatgtgtgtgcgtgcatgtggatgcgttcatatacacctaaatacatggagttgtcggcggctagaattgaaaacacttgagtagaaagcaaatttaagtccgcagggcttgtccactagtctgcagccaggtgggtaggcacaggtgcttccggaacacgagactggcatgttcctgtcttatgtatgtttgtttactttttaattttttaagttaatttattttagagacagaaccttagcatggatctctggctagcctggagttatgagacttactctatagctcaggttggccttgaacttatggtggttaaccctctgtctctgcctgctgagtaccgggactacaggtgtgcttcatcgtgcccactcaattctgtctcagtggcatttttcaattataaaagtaacacttatttatatttgttattcataagctcttggaaatttatttttaaaaattcaagggtctggagagatgcatgggtagttaagagcacttgttcttggaaaggacatgggtttgattcccagcacccgaattgtggctcaggatccctgcagctccagttccagagcatgccatgctgcctcctcatgcaggtggtgcattggtaacaagccagcaaaacacccatacacatacaataaaacccatccccaggctgggaggtattttagtggacaaagcacatgctgtgcggcatgtacgtaatgcctggcaggcagttgcagtagcctacctataatcccagcactcccaaggtgggaaagggagatccttggagcatgctggctagccagtctggctgattcaatgagctcatagtatacttgagaccctgcttcaatatatatatatatacacagtgccaagcaataggcgaagacacatggttgacatccatctccaagccccacatgtatgagttgcattctgttaaccctctggagcctcaccaagcactgtatgacctacatgtttttcagtttgcttttttctgaaatcagtttctctgagagggttctcctgactgtcagtcactgtagtggcttcctaccatttgtatgtgtcgtcgtcgtccccacccccgccccccggacatttcctgattgttactaacagaaacaagcctgtggccctccagttgcattaccgctttggagccgtccctgggatggtccagttgtatttctacttgatccagtgtgagaggaaagcctgggacaacagcacagggggtcattgatgagggaaccagatgatgatgaatagagggttggtgaagtgaggagactccaggcccaaagttataaactaaaaatctcttcaaaagtccagtctgtggggctggcatgctgttggtagaatggtcacttagtatgcatgaagtcctaggttagatcctcagtactccatcaacttgttcaggggtgcaggcctagaaccccagcacgtgggaggtgaaggcaggaggatcacaagcgcaaggtcatctttggctacataaagttcaaggatagcttgggctacactgaggtcctgtcttagaaaagaaaaaatgcaacctgtcacctgtaactgagtagtgctaactccctgcctggtaccattccttccccagggcaagttctcccacccttggccacccacacaccctggcatcatggcggggacaatgccaggtgattttaagagttcccaggttctgccttggtggttgttatttgttgttattttttgttgtttttcctgctcagtgttttgagcccaggtggagattgctatttcttttctccccgtttgaatgtctcccatcaagcgtgcgtgtgtgcgtgtgtgtgtgtgtgtagatggcatgtgaaggtggcaggacctggctggctggtccttcctgtccagctcagcttggtacatcacatacctggtaacagtagctgacaaaatgtagcaccacgaggctggtttaaaccattgggccatcttcagccaagccccaggtagggccagggagtgaaccatttatgagtgtagctgctttgttttgccttctccttggtggatggagggcagcctgcccttgcatggcctgaagctctggggatctagggtgaagtctgagacccagactatacatacccataagtcagcactaacagggaagtgacctgttgccatcacagc

SEQ ID NO: 1176 - DNA, 2769 bp, Mus musculus
gaattcggcacgaggccatccatgtgtgcccgttgctgaaggcctcggtggcccctgcccatgaggatgtgtgcccccgttagggggctgttcttggccctggtggtagtgttgagaaccgcggtggcatttgcacctgtgcctcggctcacctgggaacatggagaggtaggtctggtgcagtttcacaagccaggcatctttaactactcggccttgctgatgagtgaggacaaagacactctgtatgtaggcgcccgggaagcagtctttgcagtgaatgcgctgaacatctctgagaagcaacatgaggtatattggaaggtctctgaagacaaaaaatccaagtgtgcagagaaggggaaatcaaagcagacggaatgcctaaactacattcgagtactacagccactaagcagcacttccctctatgtgtgtgggaccaatgcgttccagcccacctgtgaccacctgaacttgacatccttcaagtttctggggaaaagtgaagatggcaaaggaagatgccccttcgaccccgcccacagctacacatcagtcatggttgggggcgagctctactctgggacgtcctataatttcttgggcagtgaacccatcatctctcgaaactcttcccacagtcccttgaggacggagtatgccatcccgtggctgaacgagcctagcttcgtctttgctgacgtgatccagaaaagcccagatggtccggagggtgaagatgacaaggtctacttcttttttacggaggtatccgtggagtacgaattcgtcttcaagttgatgatcccgcgagttgccagggtgtgcaagggcgaccagggcggcctgcggactttgcaaaaaaagtggacctccttcctaaaggccaggctgatctgctccaagccagacagtggcctggtcttcaacatacttcaggatgtgtttgtgctgagggccccgggcctcaaggagcctgtgttctatgcggtcttcaccccacagctgaacaatgtgggtctgtcagcggtgtgcgcctacacactggccacggtggaggcagtcttctcccgtggaaagtacatgcagagtgccacagtggagcagtctcacaccaagtgggtgcgctacaatggcccagtgcccactccccgacctggagcgtgtatcgacagtgaggcccgggcagccaactacaccagctccttgaatctcccagacaaaacactgcagtttgtaaaagaccaccctttgatggatgactcagtgaccccgatagacaacagacccaagctgatcaaaaaagatgtaaactacacccagatagtggtagacaggacccaggccctggatgggactttctacgacgtcatgttcatcagcacagaccggggagctctgcataaagcagtcatccttacaaaagaggtgcatgtcatcgaggagacccaactcttccgggactttgaaccggtcctaactctgctgctatcgtcaaagaaggggaggaagtttgtctatgcaggctccaactctggagtggtccaagcgcccctggcattctgcgaaaagcacggtagctgtgaagactgtgtgttagcacgggacccctactgtgcctggagcccagccatcaaggcctgtgttaccctgcaccaggaagaggcctccagcaggggctggattcaggacatgagcggtgacacatcctcatgcctggataagagtaaagaaagtttcaaccagcattttttcaagcacggcggcacagcggaactcaaatgtttccaaaagtccaacctagcccgggtggtatggaagttccagaatggcgagttgaaggccgcaagtcccaagtacggctttgtgggcaggaagcacctgctcatcttcaacctgtcggacggagacagcggcgtgtaccagtgcctgtcagaggaaagggtgaggaataaaacggtctcccagctgctggccaagcacgttctggaagtgaagatggtacctcggacccccccctcacctacctcagaggatgttcagacagaaggtagtaagatcacatccaaaatgccggttggatctacccaggggtcctctccccctaccccggctctgtgggcaacctcccccagagccgccaccctacctcccaagtcctcctccggcacatcctgtgaaccaaagatggtcatcaacacggtcccccagctccactcagagaagacggtgtatctcaagtccagtgacaaccgcctgctcatgtctctcctcctcttcatctttgtcctcttcctctgcctcttttcctacaactgctacaagggctacctgcccggacagtgcttaaaattccgctcagccctgctgcttggaaagaaaacacccaagtcagacttctctgacctggagcagagtgtgaaggagacactggtcgagcctgggagcttctcccagcagaacggcgaccaccccaagccagccctggatacgggctatgaaacggagcaggacaccatcaccagcaaagtccccacggatcgtgaggactcgcaacggatcgatgaactctctgcccgggacaaaccgtttgatgtcaagtgtgaactgaagtttgcagattcggatgctgacggggactgaggccagcgtgtcccagcccatgcccctctgtcttcgtggagagtgttgtgttgagcccattcagtagccgagtcttgtcactctgtgccagcctcagtcctgtgtcccctttttctctggttt

SEQ ID NO: 1177 - DNA, 2586 bp, Mus musculus
atgaggatgtgtgcccccgttagggggctgttcttggccctggtggtagtgttgagaaccgcggtggcatttgcacctgtgcctcggctcacctgggaacatggagaggtaggtctggtgcagtttcacaagccaggcatctttaactactcggccttgctgatgagtgaggacaaagacactctgtatgtaggcgcccgggaagcagtctttgcagtgaatgcgctgaacatctctgagaagcaacatgaggtatattggaaggtctctgaagacaaaaaatccaagtgtgcagagaaggggaaatcaaagcagacggaatgcctaaactacattcgagtactacagccactaagcagcacttccctctatgtgtgtgggaccaatgcgttccagcccacctgtgaccacctgaacttgacatccttcaagtttctggggaaaagtgaagatggcaaaggaagatgccccttcgaccccgcccacagctacacatcagtcatggttgggggcgagctctactctgggacgtcctataatttcttgggcagtgaacccatcatctctcgaaactcttcccacagtcccttgaggacggagtatgccatcccgtggctgaacgagcctagcttcgtctttgctgacgtgatccagaaaagcccagatggtccggagggtgaagatgacaaggtctacttcttttttacggaggtatccgtggagtacgaattcgtcttcaagttgatgatcccgcgagttgccagggtgtgcaagggcgaccagggcggcctgcggactttgcaaaaaaagtggacctccttcctaaaggccaggctgatctgctccaagccagacagtggcctggtcttcaacatacttcaggatgtgtttgtgctgagggccccgggcctcaaggagcctgtgttctatgcggtcttcaccccacagctgaacaatgtgggtctgtcagcggtgtgcgcctacacactggccacggtggaggcagtcttctcccgtggaaagtacatgcagagtgccacagtggagcagtctcacaccaagtgggtgcgctacaatggcccagtgcccactccccgacctggagcgtgtatcgacagtgaggcccgggcagccaactacaccagctccttgaatctcccagacaaaacactgcagtttgtaaaagaccaccctttgatggatgactcagtgaccccgatagacaacagacccaagctgatcaaaaaagatgtaaactacacccagatagtggtagacaggacccaggccctggatgggactttctacgacgtcatgttcatcagcacagaccggggagctctgcataaagcagtcatccttacaaaagaggtgcatgtcatcgaggagacccaactcttccgggactttgaaccggtcctaactctgctgctatcgtcaaagaaggggaggaagtttgtctatgcaggctccaactctggagtggtccaagcgcccctggcattctgcgaaaagcacggtagctgtgaagactgtgtgttagcacgggacccctactgtgcctggagcccagccatcaaggcctgtgttaccctgcaccaggaagaggcctccagcaggggctggattcaggacatgagcggtgacacatcctcatgcctggataagagtaaagaaagtttcaaccagcattttttcaagcacggcggcacagcggaactcaaatgtttccaaaagtccaacctagcccgggtggtatggaagttccagaatggcgagttgaaggccgcaagtcccaagtacggctttgtgggcaggaagcacctgctcatcttcaacctgtcggacggagacagcggcgtgtaccagtgcctgtcagaggaaagggtgaggaataaaacggtctcccagctgctggccaagcacgttctggaagtgaagatggtacctcggacccccccctcacctacctcagaggatgttcagacagaaggtagtaagatcacatccaaaatgccggttggatctacccaggggtcctctccccctaccccggctctgtgggcaacctcccccagagccgccaccctacctcccaagtcctcctccggcacatcctgtgaaccaaagatggtcatcaacacggtcccccagctccactcagagaagacggtgtatctcaagtccagtgacaaccgcctgctcatgtctctcctcctcttcatctttgtcctcttcctctgcctcttttcctacaactgctacaagggctacctgcccggacagtgcttaaaattccgctcagccctgctgcttggaaagaaaacacccaagtcagacttctctgacctggagcagagtgtgaaggagacactggtcgagcctgggagcttctcccagcagaacggcgaccaccccaagccagccctggatacgggctatgaaacggagcaggacaccatcaccagcaaagtccccacggatcgtgaggactcgcaacggatcgatgaactctctgcccgggacaaaccgtttgatgtcaagtgtgaactgaagtttgcagattcggatgctgacggggactga

SEQ ID NO: 1178 - DNA, 48244 bp, Homo sapiens
  misc_feature (36673)..(36711): "n" at positions 36673 thru 36711 can be any base
  misc_feature (40035)..(40119): "n" at positions 40035 thru 40119 can be any bas
  misc_feature (42958)..(43306): "n" at positions 42958 thru 43306 can be any base
  misc_feature (47841)..(47909): "n" at positions 47909 can be any base
cctgacccagtcacctcccaaaggctccctctccagaaaccatcacattggtggttaggatttcaacatctgaatttgggggtaatccagacattcagaccatagtatcacctttgaaagacatgacaccaggcatccctttagggccgcagggttaacacagtcctccctgaggggctggccagccacttcccagaacaaccccacactgtgcctgggagccagtgtccagtagggagaccgttggcccccttagaggtggcagcaggtcaacattaggccagtggaagatgattatttttgctagcactaacctgcttgggcccaaggatgcatgcacacaccacacaccctccagaaaagacagtattgtctgtatccaagtctgaagaatagagtgatgtcacacaaatggcatgacagtctgcatctctaccatgctggctgctgcttagaggggtccccactcttcctctgaagggccctgttcgtgccgccactctgcgtgcatcctcatagcgcttgtcctgccgacattgctgatagatggatgcctgtgttcttcactcccaccgccctctgtctctctccctgggtttcccattctgtacatgctgcacccaggggtttgggaagtgggtgagggttagagcatgtctctgagatatcctggctgtggctcgcttgcccctgcagggatgtggcttgagggtgaagtagactggtcctggcagctgccctgctgggtgagtccggcccaacacaggtccagggctaggcatgtccctgcagagctggagtgttggtctccagggatccattttaattctaggaaaactgaagttggaacaataaactgtttattatgcttgtgacctagacagctcctgaaacccattcctgattcctgatgggataaggccattttatcctcagtttgcaaggcagtgacatcagcatcctaactggaggtgggagaggggtttctgggggcagaggacatcccagggtggggatactaaggtggccaggtactggcagggcatggttggtgagggctgcggtgtcttctgtttcccagcacctggctgcctgcttccagctgggagggaagatgtggtgagtgcgtgtcctccactgtcctggttgtagggcctggagagactctaagctttacctgccccatctgggcaaacccctgagataagaaataagccagaacacgctcccccaggcagtagtttgcatgcagtgaggtcaggggtccaggtaatgactgcctatgttagattggccagtccacagctgtcaccagagatcccctttcagtttccctgggatgccagccagggcattttaatgccagtgttgcatcctgttgctggcagaagcactgacaccttccatgtggtagtgactggtgtcccctctgtaatctaccctagctgccagacagctgatcccaggaaggagccgagacacgggtgactggacagtccccagatggcattttggttcatggttcctgccttacaggacacttgccagcagtcactattcacatctaagatgcaacactagatcagaatgtatgttctgcaacagagtgacacatgcacagatgcacatatacacacatgcacacacagatgcgcacatacatgtctgcgtacacatacacagatgcgcacacagatgcatgcacgtatgtgcacatatagctgtgcacacatacatgtatatgcatacacagatacatatgtatggatatatgtacacaggcagacatgcacaggtgcacacatacattatacacacacatacacagatgcccatgcatacacatatgtatacacatgcagagatccaagcagatgcacatgcactcacacaggtgtacatatgtatgcacacagacatacacatgcatgtgcagacatgcagacatacacatgtacacaacacacctgtacagatgtgtacaaatgtacaaacatggataggtgcacatatctatgcgggttcatgtgcacacatacagaaatacagatgcacatgcgtgcacatacacagatgcatacacacagatgtacatgtgtccacatatatatatacatacacgcagacatgtatgcacagtggttgctgggtactcccattttctctgctgtgatctcctgccttgatttgaagacccctgggggtgggagagctgccttctgacaagtactgacaggcaaaagagtgtggggctcagagcccccttggagttccattctgctgacatttaaagtgggctcgtgcaccctcatgaacagccccaattacgtgtaagtaatgagagtgacatttcacaaccctgtctttctaatgggctcctgtgtcaagtcattctttctgaatgcaaagggcagcaatttcacactgtcagggcaaaatgcacatgcatacagctcagctcccagcgggatacctttgcttctcagaaatggcgaagaaagccagcaaaatggcctttttctccttttgttttaatttaactatttagagtgaggtccttaatgtaacacccatcaatgattatggagccactgttctgaaagaactcgcagggccggcagatctgtgtgagttgtggtgtgtgctttgcttaaagcaactttaaaattatatgaaacaatgcattcttgttgaaaaaggaaaaaaaaaccctccagtgtcacaaagaaaatgtgcagccccctccccctccctgggaggagcagtatgtggcatggggtctgtcctgacctttggctactcatgtggactgttttaaaggccatttgagaagagcagcagggcctgatttatgccatcgagaatctggtgtctgctgatgagatcaatacactgcagacctggatataaatccgtgccaggaagcctggtggtcaatcattgttctcagggcagggcctggaagccaggtgggggtgcccgtgccctgctgagctctacatggcagtatctggattggtccaaggtaaaagcaattaagaaaaaggtttcttttcaacataaccagtttgagtaaccgcataaacagcaccagtcctgacagtccttcgtaaccatttaaagccacacaggagaacctgctggcttccacctgggcacctgctgacactcctggaaataccttctctcagccacattcgtttggggatggctttgccatccctgggtttggtcgtggatactattacaagatttgttttcaatctctcttcactggcgattttgttttgtggaactttctactcttggctccttacctttgtcctctccgggtctggccctagtcttctcactgggatgtttgtgtttctcctgttctacctcaactaagtcagggaggcgtttttaggtccttaggccaagtgctatgaaaacaataccacagagggggatggagtgtgggggtcaggggaggcaaagggtgactgtgggatggagccagccaccagcagctcctgggggtagaacagtctggaagagggagcagcaagtgccaaggctgcaaggcagcctgagacgggtggggtgcatcggagggagggggcaggagtggagtggaagaggctggccacattaggtgctggcattctgcattaaatcctgtgccactgcccagcacttcggctttgcggtgaacaatcctatttttacagcgtgtttgagcccccagatctggctgccctagggacccaggctctgcacagagtcagctcactcttcccgtccttgggagcctcccttcagggggtcgtgtcttctgcttctggatccactgggctgctttccccaggctgtgaggaaccagaacatggatgtctttttaaggttaattcattttatgagagtaattaatgcaggtaattttaaagtgaagtagttcttctttaacttgagagaggaagcagcacttgcttgtcttgtccctttgtcccttccctgctgccctgagacactgagtttcaactattttcactattttggtattttccttcaaattagatatgcctacatttcctgactttcccatcttagatgttgtgttatgatggaagacaggattgtgttctctgactcttgtcccctccctttccctctctttcttcccccagacctccagtggagttagttgtaatttttgtaatgggggctatgcaactgggcagtgataagtacactctggttacatttccattcatgggtcactcttgcttccctggggttaataacttcattttctaatctgtgtatctgttctaattcatcttcagactctttgccagagccttaaaatgcatttctgagaacaaagccacagatgcaatcagtaatccactgtgccttctcctgccccgccccattggagcctctgcctgctccccagctccccgctctctctgcctctcctccactcgcttcctaagaaagaagacctgggaagcagctcccttgttttggtggagcaaatcctgcagtagctttctgagaaagaagctgagggaggtaaaacatttgagaacttgtaggtttgaagcagtgttctgtactgcactcatactgattgataatttgactagatggggaattctaggtatgaagtcatcttccctgggattcaaaggcgttgctttgctgcctccagtggggcactcagaggtaatttctttgtggcctgtttctttctggaagcctcatgtaaccctcctttcaggatgatgtgtctggtgtgggcgggttcctttcattcactgtgctcctgggcgctgttattccgaaagctcaggtccttctgttctagttattttctttttattactgctttaataattcctcattttttttcccggagctcctgccagttcatgtgggactcctgaatggatcgtccagttgtctgttcccccttttttcatctctgctacgtgtgtaacttctaggaaacctctttagtttactttccagcctttcatttctttcaccacattttacttttaagcttgcttccattttccaggttgtgtttctttgtgacttcttccaggccctggctcaactctggtctgaaattcaaatcagtcagctctggtggtgtgtgacagggttggtggtaaacacagccactgttaaaaattaaatatgtggacttaaaatgaaacaaattatatttaaaaaggtaaaatactcagaactcattcctttctagtatcgtgtgcattctactgttatctgtgtggttgcagttactcgcctcttgtatctgagatggcagtgccatgtgctgggtgctgctgtgcacctctccccagttcagcggcatcattctgggagctcgaaagcagcatttacaccacagaaatcagcgtgtgctgcaagctgggcaccccccaccttaccccaccgcccacccccactgcccaccccgtggagagccagttgttacagcttgccagcacaccgttggttactgctcacctattaatagattccaaagtcacctccctcctccatttttatccttaaagttcatatccttttagagtcatttcattgggtttccagagagagttgaaataaatctctgtgttctcccatctcctggctctggactcttagcctggcctgaccccagcatgcttattgggatacgcagaggactgattgcagttgggggatctagataggaattagatcccatgtaaaccatatctctccaacagtgatccagcatctttggtatttgacccgaaatgaactgggccttgtgggtcttgcgtctctgctcctagccctccggtgtgggcacttacttccttaacgtgtccaggccatgaaccctcacagaggctgcttttgtgactggcaaggaactcctaggcctgttccttgttgttactgattttaatagactttattttttagatcaactttaggttcatagaaaaattgagaaggtggtacagagatttcccatatgctccttccccacacatgcacagccccctcattttcagaatccccccacagagtggtgcctttgctacagtcggtgaacccacataggtaccttatcacccgacatctgtatctggacattaggattgccagttggtgttgtacattctgtaggctcggacaaatgcatactgacatgtgtccaccgtggtagtatccctgccagcctagtttccctgccctaaaaaccctctctctccccagcccctgggaaccactgatctttttactgtcttcatggttttgcctttcccagaatgtcctatagttgggatcatgcagtatgtacttctacagattggcttctttctctttaatgataagcttttaaagttcctctgtgtcttttcatggcctaatggcttatttatttttaatgctgagtaacgttcccctgtctggatgtagcggtttgtatacccactcgcctgcccctgggctgtctccacggctggcttcctgtgtggttggcacgccttacctctgcaggctccgcatccgtcttcagagcgccttctcccatcccatggcagctcattgctgtttcttttgtgtgtatggacctttgcccagctgggggacatgccacgagagaggttgtttctgctttatccttgctgtgcacagcttggcactggctgggacctgggtctgggtgtggcttggaggagccaatgtcagttcattgggtttcactgggctgggactgcagcacatggaccaggccactggtgtccttgctgcatgcatgacaagaaccctctccaaggccctgcctgccgcaggcctgcctcctcctcctcctcctctagtggcgcgggagccagtgtgaagtctctcacaatgcgagtgtgcagtcctcttctgctttaagggatggggcagcctggccacgttgtcacttctggctctcactggctgtatgatgtttgtcacatggaacgggagaaaggacgcatccttaaaatgccaggggatcattgctccaaaaggaggggtagctggtttttaatgggagcttttctcttgagggactgtggatagcttgtcaccactgttaccatcctttcttatgtctgtcattgcatgcaatgaggactgagaagagcaagggcagcaggaccctggaggggcatgggatgtttgtgggtgccaggccctgggctggttgcttccacgcagccccactccagggcgtgggttctgtggggccaggacttgtttgttccaggcttagcaggagctccattcgtatttgtcagagcaataaacattattattatcagatgctaattgattagttatatattaatatgatttagcagataattctcacaactttgtaggccaagtaggtcaacttctgttttgcaaacaaaaagtgacaccattatggcaaggagctgcaaatgtgcctggaattcagaagatctgaacctataatttattgagtcttcttcattgggagcctatgtagaaaccattactggtttgggagctcaaagtggagcagcttttgggagccactcctaattaccaatcagttatacagaggaaaagcctctcagatgaatgagactgtgcagtgggatttagaccggcaacttcagaacagacacatctggaaatgttctaagtggtgttgacaggcaggagagacagccgttacacagccatgcagaggggccgagccctgtgtgttcaggtgtagccaggacagtgcagtggagggagtgtggatgaggagcagttggatggaggtagagtagggttgtccatggccttgctggccatgatgaaaatgtgggccttattctgagtgatgagaaggtgttgaaacatttcacatggggaaaggatatgatctggatttatgataagagcatgactttggccactgctactttgtggcagtggactggagggaggttgtgtcagtttggaatggtatttgttggtaacaaaaatctgcaagcaagtaatttaaagattttaataattttattagcaagtctgcatagactcatagcctagggtctcataggctcttgtgggtttcacttggccattcttagaatgagacttttatcttcatgttgacagcatggctgccagagctccagccatcacattctagttccaggcagcagcaggaagagaaggactgagggaattgctagctgaatcagcctcctttaaagagctttcctggaattgccatctaataaattccacatacagtttttttggccagaactctcaccagagaagctgggagatatagtgagctgggcacactgccaacccaagtaacctcggaattttgttagcgagggtgcaggaacatggatgctggggcaggaagccagtgatctctaccatggaagcaagaggccaggatgagaggtgagcattgctcagatgagtgatggtggtggagatggacaggaggagacaagccccagatgtgtttgaggctgagcagcagcaccatctatggattgggggtgggggtggggttagaggtagatggggtcggcccctgactgctggtgcttttttttaggtggggacatggactgtaggaattggctggaagcagagtgaggttctgtttcggctgtgtctggctgggtgtggaaggcggcatgtggaggtggtagggaggagtggggttctagagtctggagctcaggggtgtggttgttccatgaccctcacaggactcctggatagaagggggagcaagggactcagggatcccaggttgctgttttgagtgaactgtttacagaagtgtaatgtgaaagtgcccaatcactgggtgcccagctcaggacattctcatagagtgaacccaggggtgcagctggccccagatcaaggtgctagacgcccttgggccagtcctgtggcgggttacgctgtggggcccagcaaaggtacaccaggacagtagccatgcagtcatcagagaatgttggggacatgagagatggggccaggaggcctgtgcatgcctctcccaccaccagccccacaatttcactaagcagcattaagcctgttcttttactaagggctgtttcttactgggcaaatcagagtgagttaccaccatttctatggtgcatagacttctttaagtgagactggaagagctagcagggtcccatttggggcaggaggtcagacactcctgcgtggtgaggcctcacgtgcgtgtgtttctacaggtgtacatccgtgcatgtgtgtgtgtacatatgtgtgcgcatatgttgtgtgtgtgcatgtgtgtgcactcacatgtacatcttagctctctctgcagcctctggtttttctggccgtttcctcgctgagcgttacaaaggcagagtctctaagggaaactgaaacccgagttctcttccttcattttcatctcattaccagctggacacagcagccacacaggaaggaagctgggcagccagccggccatgtgtgtctgccgggtgccccacaccaggtcccctccacgtgtctgtcctgtgttctgggctggtagctggaggagcgggaagcactgactcctgaagaccctggcttcgctttcctgtgtccgttgggctgtccacttctaagactctctttgtcccccgctgccttccgtattcctcagcagatggacccgggtgaggatccagggcaagcagaggggctacagagcagtgagaagcaggtcatcactcaccatgggtcctgccttttctttctcatgtccttccagcatttcttctgaggccctgaagaagtatcaagtgggctttgacattgcggtggtgagagcgacccctcctcacctggagaactgggaaatgtggattctcagggaccgcgctgttcacgagctccaggctgtgctgctggccctggtcctggggcgctgagccgcatctgcaatagcacacttgcccggccacctgctgccgtgagcctttgctgctgaagcccctggggtcgcctctacctgatgaggatgtgcacccccattagggggctgctcatggcccttgcagtgatgtttgggacagcgatggcatttgcacccataccccggatcacctgggagcacagaggtgagtgacgaaacctgcaggggtgctgatggcctgggatggggacctcactgcctgggatgctgaggtgggtggctggggacgggacagggaccccacttcctgggatgctgaggcgggtggctgggaacgggacagggactccacttcctgagatgctgaggtgagtggctgaggacgggatggggaccccacttcctgggatgctgaggcgggtggctggggatgggatggggaccccacttcctggaatgctgaggcgggtggctggggacaggatggggactccacttcctgggatgctgaggcgggtggctgaggacgggatggggaccccacttcctgggatgctgaggtgagtggctgaggacgggacggggaccccacttcctgggatgctgaggtgggtggctggcgatgggatggggaccccaattcctgggatgctgaggcgggtgactggggatgggatggggactccacttcctgggatgctgaggcgggtggctgaggatgggatggggaccccacttcctgggatgctgaggtgagtggctgagaacgggacagggaccccacttcctgggatgctgaggtgggtggctgagaatgggacagggaccccacttcctgggatgctgcggtgggtggctggggacgggatggggaccccacttcctgggatgctgaggtgagtggctgaggtcgggatggggactccacttcctgggatgctgaggcgggtggctggggacgggatggggactccacttcctgggatgctgaggcaggtggctgaggatgctggcatgtgatctgttggattctctgctctgagaacttttgtctgagcagacaggcctactcagctgatctaagggagaggctgtgacaactgtagatactcagcaaggctcgtgcagacctcctgatttggtttctgaatctggggacccctgacaggaagcttccctccctcgtacctagtaatgttcgcggcgtgctgccaaagcacccgccccactgagcgtctgctccaggcgcctgagaagaacagtgaggcatcataaggatgctcgtcctacgtgcagctgagcctcatgccagctactttcctttcctgctgtttagtttttttttagttatttcttctcttggaggatgtgtctggggacccgggtttctgactcagtggattgagagcttacaccctgggtcctgagcaaggtgttgcttgcaggtggctgagagctgtcagcaatataggccattgttgtgctgagagagaggacctgctgcctgtgtgcatctctcttccacatgggaaaattagaacagaaagtatgaacacctgactctctttgttttttctcgaagtcagggtctggctctgttgcccaggctagagtgcagtgggacaatcatagcttactgcagcctcaatctcctggacacaagcagtcgtcccaccttggcctcccaaagtgctggggttacaggcgcccgccaccacacctggcccacctgactcttaaataaagcagactcttggtaatatgtaaaaagccaaggtcaaaatgctcaaattgttgtcaggacagttgaagaaacaggtcctaaaaaaaataatgctgatacatttatattattcttaagcagctattgctcaaatcttcattttcctaagtagctattgatacagtaacctaataagcaaagagacgtcacttgtttctctgtctataagtttgtggtggtgatcactgagaattgcattcgttgatggatatattctccaaaagaaattttgtgaagattttgaagtaaaacattcttttcctgaataagaaaatcctaagtcattgtattcctgtacacctaatctgtggatgacaaggcatgtagaccagagttgggtgggcagagggtgggagccatcacaggaagcatctggcagagcagggtttgggattctgggatctgagggagcaggaagggatgtccgactcacagcttcaaagtgagcacactggctccgggcttgagctctagggctgtgagtggttcccatgagcacacctgatggctacactgtgggtctggcgttgactgaggccacctccactgtagcagtgcctgttgcagcaacacatggccctcgagacatgactgcacccagacgtgctcattgtcactgagacagggacctaggatgtgctcaggtttaaaaatgcttccatcgctcttttcttcctcccactctgaccctgcccttgcatcccacagaggtgcacctggtgcagtttcatgagccagacatctacaactactcagccttgctgctgagcgaggacaaggacaccttgtacataggtgcccgggaggcggtcttcactgtgaacgcactcaacatctccgagaagcagcatgaggtacgtcctgggctcccctgcatgtccacatagcccagcttgagtgggcagcctctcctggccccactgtggggctgggggctgacttacctggagcctccattctgtagctgtgaccatgcagccccatctttgggtgtccaccagcagttcacccggggaccaccctctttgcttttttttttttgaactttttattatgaaaaaatctcaaacatacctatgagcagagacagctatgccatgagccctgtgcccactgcagcttatgcaaggccgggtgttcagtcttgcctacagtaccctccacctcctggggcattgaggcagatcccgacaccacattcttcatctgggtatctcttactggaaagggccccttgtcgtgcaaataatcaaaaatagcttctccaaaatttatatcatcatacattcagccagtgttcatatttcaccgactcttgtggatgatgcttgtttagttggttcaaacgtttagtttgaatcaggttgcaaccacgctgtcccaatccattgcagctggtcaccctgtccattcagtctccgcttctaggagccagcctcggtttccttcctgagaaagctactctgcacagcccatcccatgtcccactcttcacattgctcctgattcctcggtgtctttaaacattttaaaaaatcaaaccgaatttaaaatttgattgtagctcactgcagcctcaaactcctgggctcaagtgatcctcttgcctcagcctcctgagtagctgggactgtaagtatgtgccaccacacccagccccactcatggtgtctttagcatgcacctctgtcttcacatccccagctgggtgtcagatccaggctcatccctctcagggctgtgaggcgggcttctccatggaggcaggtgttcctcctcctcagtctcggtggcctttgaccagcgaagtctagatgctcttctcatcaaagattgcaaaacgcaatgttctgattctacctctccttctctacttgttagctggaaatcgtataaaaggggaagtgcccatcaccagctattttggtccgtagaggtcccatttcctttgggaaatgcagaatcgatgcttggaatctttgcctttatttaccagttttcagaataatgagttaatgagtcagtttcccctctgaagggcaagagtgagttttttgattgatttttagtgtcacaatgaagtcatagatttaaagatatttgctcttctttgacccatcacagtgaaacacctacctcatgctcaaatcgtcgcatccatggtcaacagcagcctgtttgggttggctcctgagacctcgcggtgtggggttagttttcttgctctctggaatctgttccaggttcacgctggacattttctgcccagatctctttttgttttcatctccagggtctagcttatttctcaatttctgtttgacacataaatgagctctgagcattatgctctgaaaacaagtatttggctgggtgctgtggctcacgcatgttatcctaacactgtgggaggtcgaggtaggcggattacttgagctcaagagtttgagaccagcctgggcaacatggcgaaaccctttctctacaaaaactgcaaaaaatagccaggtgtggtggctcaggtcttgggagtctgaggtgcttggaagtctgaagtgggaggatcacttgagcccaggaggtcgaggctgcagtgagctgagatcatgccactgcagtccagcctgggcaacagagcgagaccctgtctcaaaaaaacaaaaacaaagtattcagcactgtgaggcactctgagcagaaagatgtggtggtctcacctcactcagctcttactcttcgcgtgtctgttaaattctcttcctctgagcgccttcctgaccacacaggctcacactcggtcttgggggaattgtggacagtgtgtttgtgctggccccacaggtgttcagtgagagccagacattgctctgttaatgacaccatggtggtccctcggggttggggagaggcttggggacctcttatacttaaaagaaaaaaataaagagacccccgccaagcatcagtgaaaatccctgcaaacgtgatcaagagtctgttgaagtgtacgttcccttgtccttatgcatttcatgcgagttgacgaaatcatctgtactttaaatgctgaaggaagtggctattttaaatgagactctgttccgcttttgtgtgcccctatcaggacttccatttctatgaaatgacactcccttagtactgtgtctgcagcctgggtgctgttcaggaactcacagagttagttagaaacctaaagtggggttcctctcctcatactctccctcctagaagccctgtgtgcttcctaacctctgagtcctgacacctgctacaagccttttggtggagaaaaatacattgttactggtttcttttgcatcagttatggaacatcacagagagagggggcattttggggaaggtgaggcagagatagatatagaaaccttcccttttgtcttatgttgctttctattctgtgggggctttggagggcaaggggctaaggcccccaccccctggaagtttctgatcacgaattgtccctggtttgaaagaagaggtggtaggaacatggatcttactaagatggtgcctgagctgagctggtggtgttagttcatcacttcctcctgctgccaacatgcaagtttaaggaatcgtaaatctccctttctactgatacagtgaatattgtggcttttttttttaaactggactgtagagtcacttttttttttttttttttttttttttttgagacggagtcttactctgttgcccaggcacacgaggctggagtgcagtggtgcgatctcggcttactgcaaccttcgcctcccgggttcaagagattctcctgcctcagcctctcgagtagctgggattacaggcgcccgccaccactcccagataatttttgtatttttagtaaagatggagtttcaccatgttggccaggctggtctggaactcctgacctcaggtgatccgcctgcctcagcctcccaaagtgctgggatcacaggtgtgagccactgcgcccggcctgtagagtcactttgaatggatggaaaaaagcccactttgatgtttgaaaatacttatggtttaggtttttgaaaaataatttaattttctccactttcacgagtttgatttttgctgctgttttatggtgagtgatggaacttttggagctggtcttccagactccactggtttcaggataaggatcacagtgaggatgttcatgaaggccccaggctgctcccctgctctctgaacctcccttgcagtctgagaattgatcatctcaggagaaacctctaggctctaaactctatcatgtgcttttaaaattgtgcatttttatactagtatctctttaaaagaatatgcactgatatggactctatcccaacaggtgtattggaaggtctcagaagacaaaaaagcaaaatgtgcagaaaaggggaaatcaaaacaggtaaatttcttttgcaagctacaaagaatcccattcaagtatttcttggttgttttaatctactgaatgccagcatgcctgcagtgcaggccagccttttctccaggctctgttcattctgctgggcttggttttgttgtgatgcgtcttggagctcatccctctattcctgagtatcaggattgggtttctcaaagcaggtgccaaacatatttggcctttgagaaatacttttttaaagtttatatgaattgaatgtattcagatggcctgaaactttgactacagaacactggtgaatagtgaagcccactggtgaatagtgcagaaattcagggtttgttctgcttccttgcacccagaggccttaggcttggaggagttgctagtcatgcagtttttctcaaccccttcgttggacttgcgacagagatgccccatttattcggcctgctgtgctcaacctcttgcaggagggagcacatgagtgagcaagtgtgggatctggccagctgttttgggtgccagcaggagcaggctttgtgtgagccctgagggtggcacccaggttggggtgcctgtgacccccgcagccccagagggtgcgttacagtgctctcttatctctgctctccatggacagtggtgtgttataagctcagtgggccccttttctcattgtgtgggacagctgtcctctgccagtgagggcaaagggccagtatgacagccttttttgggtacacacactcagggtcctgagctcttgtccggcatccaagaagaatgaggttgcatggacacttaaaggatggtggagtcagagaattttgtttagtgttggaagtggctctcagcggagatgggagcttgagagggaacaggacgagcaaataatcttccctgaagtctggccagctctggccggctcttctccaaagttaagccatttctccaaaatccagccatccctctgaagtcaagtcacctctctctagtccagcaccttctcttctctatcaactgagtctgggctcttataggcacaggatgagggcagggtgggctgtgggtagtttcggaaaaggcaacatctgattgtaaaaagatgttcagaaagaaccaatcgggagacggcgggcaaacagggatagaagttctcactctgggctgcgggttttaggctttttggctcacatgtggggttttgccagggacctgcccctgtctgcctagactttctctggctcctttctctatcactgggacttttggattcttggcacacgtccgtccctttggtccctcaggcccctcagtgtggtactcattcagggagccctgggccgaatactcattcccgtctgcagctctaggttaccctcatcaccctctgagccatcatgtccctacctggcactgggcattcttcctcaatggtggtcaagacaagctgagttaaaggcaaaaaaagaaagaaaacccaaagaagtctatgctaaactttcttagcaaaatgctaaacacttgcactgaagtctttgtctctaaatccaaagttagattaggaaatgagaggaaaagcaggtggtgcagtgtagctccggtttccgggggtgtgcaggtgggttggggtgaatagtgaattacttccaaccagtctaaaaaagagaactctcctaatctgggataatttcagactatagcacatgtaacgcaagtacttttagcctaaaatagtgggttctgaaatggtatctttgttttcctgcttgggcctttctgatgccaagccgggctccaggctctcctagtgcagccactcccatgggggctggactgggaccctgggttgggtagacctagtgtcgctgttcctagttctgtgcaagttggaggcagggtggggtctccagaaacagagaggaaattctgtagggtggacacttctccaggcctggcaacagaacaagtggtccacgtacttagcaagagtaaaatatattgctttcaacagtgggtgtcccagtaagatttgaggtaagcattcattgagttttttttcagtcaccacatctttgctgagtatcaattagggactgaaacaaaatcctgtttggcacctgaacagcatgtggacactgcagagacacaattactcaggccagtttcagctttaggtttgcctaggggtggggttggggtctcagtgaaccttccactgtacgagaacaggccagtgtgtgaagaggagttgcagagggtctagatgacaagacaaggctgagaatgcacacatgcctcgttggcctggggccacctgtgagctggtgttggtgaatgtgggtctgtgcccctgagatgaacggcgtgagcagtttgaatagtggagggcatctgggctggacggttgctaatggtgcatttttcttccctgcagacagagtgcctcaactacatccgggtgctgcagccactcagcgccacttccctttacgtgtgtgggaccaacgcattccagccggcctgtgaccacctggtaaggctgatgggcacctccctgtgctcacgccagcctggtcagcagttaaagtagaagggggctcaaagcagacgtaaagctgtctccaccctaaaaaaaaataggattttctcagagccagctgcagaaaatgggggcagcttgtggcccctctgaaagtcttgcacagctgctgtcaggggcacacagcccacttggctcctctaagtttcggtgtccatggccaagggtgaggcctggggtgcagctcaaggtgctgggagcccttggtgctagtgcagagcatgccatggaggggcgtgctggaaagtacagacagcctgaacatggcattggggatgtgctgggaaggacaggtagcctgaacatgctatggggtgaggggacgtgctggaaaggacagacagcctggcagctctgggcatctgggtcaggtggaaaagtcaggacttgctcctggcttgtgtgttcttggttggtgcatctgtgctctggctgtgggacccacccttctggtcggctgtggtgtgcagcttgctcactgaaccactcctgggtccacccactcaggggcagcaggtcaagtgtgctgagcaccttgagaagcaagtccggcctctgtccctcaccggctcacatccttgactgcccagcctggtatccggcacctccccctgtgtgacggtcctttctatccagataatctgatgagcaatgtgatgatcatcagagagggagaagtagcattttaaataagtccatgtgaacatggaaaatgaagcacattttctactgtgtatccctggattttaatgagtcctgataaatgtaaaatatgccacagtgaaaagcatcatttgctagaaccctaaattaattggaattaaaatattttccaatcttgagtcagagataaatgacaagacaacgtatggcctcattagagacttgatgaggaagcctggtatttgcacacagacgtctggggtgagattcatagtaggggtctacccagctgcctgtaccacagatgctggcaacgaaacctgatagggggtgggggtgctttggggatagtaagaccctcagtcctcaaagacagtcgtttgtatttacttttgtgcagaaagtacggttggaccagaaacattttgcacaacaaaggatttttctggctaaactcaatcagaagcttaaagttctgtcatttaaacttacattctgtagataggttagctgttgaggttagaggatactgtatttggtttaaatttagacctataatttttcctaatttttttttttttttgagacggagtttcactcttgttgcccaggctggagtacagtgatgcgatctcggctcactgcaacctccatctcctgggttcaagcgattctcctgcctcagcctcccgagtagctggattacaggcatgtgccaccacgtctggctaattttgtatttttagtagagatggggtttctccatgttggtcaggctggtcttgaactcctgacctgaggtgatccacccgccttggcctcccaaagtgctggtattacaggcatgagccaccacgccccgtcaatttttcctaatatttttaataaaagttttcacagctgcagaaaagatgtatcacttgtatatcctggcaacctagattgcacaattgggagtgtgtgtgtgcacgtgtctgtgtgcctgtgcatgtctatgtgtccacatgtgtgtctgtgtacatatgtgtgcttgctgaactatgacccgtgactcccaaatgccttcacaggcatctcctaagaatagtaacattttcctatgtaacttcagttttatcattatatctaagaaaacgttcaatcattccccagcatcatccagtctccagtccccgttcagatttccccaacagccccgaaacctcctttcaaggtatgctaaatggtcacatccagtggggttcacattccctaacctaacaggtgaagagctgtgtgctgctttaactggcctttcaagggtgtcagctgcggccttccacgtggtctgagccttcctgctctgcttccgagagcgtgtttccagccagcctcctgcagcagaggtgctgggtgcccttgccccgccgtgggccctgcctgtcttcagcatgcccaggctgttggctgcaaagtggcatccccacgcgtgttctgtgtgctctctggttcccggcaggctcagcccctctctcgtctgtgctgtccagatgggtttcttctgtcacttgctggattttgcctgtttttctcctggatgccctttctcactcgtttgtccacacttctcacatgttcagggatggagacacctcatctgccattctgtaggcatttcccccagtttgtcacatatttaaccttgccgtattatttccccatgtggaactttccagttctctctgtggttggatctgtgcattgttttcctcatgtggctgtgggcactctggccaggtaaagagaggacccccagatggaaacgccagcccctgctctgttttagtacagtgcggttctgtttttagtattcagatggttgatccatctggagtgtgttttggtgggtggagcgacgtagagattctgcctgtttatgtttttctgcttcctatttattgggtcacctagctgcttagaatgccgtctttattgatgttaaaattctgctcatgggcttccgattacatactgagcacgtcctgtgttgggtttatcctggtggctttccagccctagagccatcagcgttgccatttccattttgcagatgagtaaattgagggtctgagatcttgagaagcttggccagggcaacggagcaagggcaccaaggtgctgatgtctagacctgagctgagcaacacaagccctggccctagtgggcgggactcctgtagctccacacctatctgctcggccctgttggtcttccgagaagagcaaatttgtaaaatgaagtggtacagagacacattgttactatagaaattcagccatctgatgatgtgctctctttttattcaattgtagaacttaacatcctttaagtttctggggaaaaatgaagatggcaaaggaagatgtccctttgacccagcacacagctacacatccgtcatggttggtgagtcctgcccctccagttccttcaccgtgaagattacagtggcatgttaattaccaaacaggatatttggatcttctctgaagtgctgtcttccttggctttgtttaaataggagctatccttacaaaaggcacatgtgactgcatagaccctttaacttttgaattcattgtttgcaaggataatagccgccatggtaaacgtcactttgtatccattgctggctcatgtcatttggataatccccgcgtgctgagcagatgctcctgtttgagagtaaggttttgactgagccacatgctgtctgcagtggtctctcacctctgagcaagtggtcatagcctggtgtgtacccactgttgcatctgccagcattttcctggatgtgggaattccttgctcatgtttacttattgccccatgactcttaaaatgcagctgaacatggagcatgaaattatccccatcaaagtgagagcacacctgtggtcctagctactcgggaggctcaggcgggaggacaggagtttgagaccagcctgggaaacagcaagaactcatctcaagccaggctcagtggctcatgcctcgatcacttgaggtcaggagttcaagaccagctggtcaacagggttaaaccccatctctaccaaaaaatgtaaaaattagccagacatggtggcgcgcacctgtagtccaagctgcttgggaggttgaggcaggagaattgcttgaactgggaggtggaggtggcagtgagccaagatcgcaccactgcactccagcctgggtgacagagtgagactctgtctcaaaacaaaacaaaaaaacctcatctcgaaaaagaaagaactagaagacacaggacaccccaaaagttgaggagactgtctttccctttccccaggcagggacttaattgggttataaaggaaaacaccgtgttgaatgtttgtcccagtgttggtgccatagcctgagaggttggttcccttttcctcttttcttctgggcccctgcagatggagaactttattcggggacgtcgtataattttttgggaagtgaacccatcatctcccgaaattcttcccacagtcctctgaggacagaatatgcaatcccttggctgaacggtaaggaagagcagtgcaccttagtgggaggtgcgtgtctcctcatgagtgcacacctgttgatctctccttttctgtctctgagccctgggggcccccgagcttgtgttagcccctgtttgtgggggatacttcccaaactgtccagcaatggccagagtcccagggcaccttgttgggtgttttcactggtaacagagtactgttttaagacagctccccactaaccccccaaaaatggatttgggagactctcataaaattgagaatctgatagtagatggtaaactaagactaatcagatggggacatggtataatttccagaatgatattaaagtgtggcaccaacactggtgtgggacctgcctccgggcccagcctctagtgcccggtcagatgggctctgggtgccttgttgctgccagcagcacatgtccgatgtccgtcttcaatgtgcaggaagaagctggtggctgttcatgggggcttttcttgtgggtgccagccagtagagccttgggttttgaacctcttgaccttagggcagatcccaagaccccagattcagggacagtcggccattcctcagggtggggcaggatctggtggttagagtttgtttatgtgaagcatgtgttgtttaaaccagcaaatgcatgccttacgtaggtctctgatgctggtaccatctggctccctgccttccagtcaggaggcccagcctcagttcttggggtgaacctgggtgggatgcactgcagaaccactgtcgggggcacctctctgaggccgaggaggtcggggtagggcaccatctgggctcagggctgtcatcatcctcagatcctggagtttctgtttggattgtggcatgtgcacactccagacatccttgcagggaagccctcaggcccccaaggtagtgttggccggcctcgtgacctcatgggtgcaggcagtcccccagctctgtgttctgggataatcactgtcctctctctgcagagcctagtttcgtgtttgctgacgtgatccgaaaaagcccagacagccccgacggcgaggatgacagggtctacttcttcttcacggaggtgtctgtggagtatgagtttgtgttcagggtgctgatcccacggatagcaagagtgtgcaaggtgagtgccaggcactctggcttcgcttggcccctgccatggcaatagtgtgcctggatgatgggtggctcctgaccttcgtctcaaatgtcactttccctagcactttattcccttgggcctcagatgcagctctcaatggatcttatttctgggggttgtggggactgagggagtgctggcccccatgtgtgacccattagcctcctcttctcaggaggttctttcttttaatgcaccctcttcaaacctctagcttataaaaagcaaggctttgtggaatgtattcaccagagtctgttggaatttcaccatttggctcttaatctacctaagagtgaaacattaaccgacagcttaagattaagaagagagaaccaatacagaagtttgtcaaaacacaaatctttaagtacattaaaaggggagggtgcctttaaaatgacacactgtaggcacagtgctcagcacaagagaatggcctatgggcttgattacaggaaatctcaaggttgctcagtggcagtttccaggaggtggattgtcaggcctcaggggagctgggggaaaccacatgaaacacagccgccatgtccctggccaggagctcatctcggagcaggtagccattcgtctctcatggaaattggtagatagttcttgcgtggccctttctcatgtagtcatgaccatcaggacatcagagaagcagggttcctttcatgcctatggcgcacaaaagtgggtgcctttgacaccgttcccttaacagccccttgcataaggaagaaggttgggtgatgtgcacacctgagtatccacctggtgctttgctccctgcccaggccttccgtagccagggctcactgaccagatcctccagctgccccccagccgtggctgccatgctcctgtcttgcagaccaggaaaccatcctatcaacagtatcagtgttgggggcaagccagtgccccttgagatggggagggtgctgcagggccagagctcctggcaggcgtgcacagtgctcagaatgctgtcagagcagcactggccaggggactcgagccctcccctgccatcgggaagccaaggatcagacttgccttgaccttgacttattacccagcactgagggtttgcagcaggatcagtgagcagattcagcgatgcacagagcagccacctccacccccgacaagtttctacaagtcttaggcacactgctgtcatcccctctgatcccttttttttccccatacttgtttgaactcctggactagggtggtttgagcttaggccccacagctcctgcctaccacgcaggcacacatgaacccttcacctgctgcccgtgacctgaaagccacatgagacccctgacgaaaaatgtgctagaaattattctttgctaaaacatcaaggaggaaaatgaagtccttttatcaaaaagagaatttgggctcctgtaatcacacagcagagatgaagggggaacattttccctgtgtccaaaataagtaaggctgcttctatttcatattcttctgcactcaggttttgtggtttcagtatttctctccagaccacacacagtcatgtgtagtttataattgtgtcttggtcatcggatccctgaaaagcgtttataaagaacttaggttcaaagcactttagcagatactttgggtagaaaggaagtgaaggatctattcctttaaagggaggaaggttcacacatttgcccaagacaggctgcagggccggtggctgtcccctggaaggaggctgccgccacttgccccacccagagcatgttcattgatgggccctatgtcaggaaagtcacacaatgccaggggccttggcagttggaagtgtgtgagcacggcagcacctctgcggttgcaggactgaatgctgggcacaggcaggcatggacgatcaaatgagctttcagtgagagggcttttgtccgttttgttttgtgtgttaacccaggagcgttctgggatccaagctggaacctggacgtggtgctgcgggccactcacataattgcggcatctgtctcctgttgcccgagctttgtttcagtcaggcacagccgcgctgtgctgggccatggaggggtgcacctctgaccttagtgcttgctcacaggggatccactctcggcccaccacgtcttcttgttggggttttagggggaccagggcggcctgaggaccttgcagaagaaatggacctccttcctgaaagcccgactcatctgctcccggccagacagcggcttggtcttcaatgtgctgcgggatgtcttcgtgctcaggtccccgggcctgaaggtgcctgtgttctatgcactcttcaccccacagctgtaagtgccctgggtggagtccccctccttgctcccttgatgccgccaggtggtcccgtcacctctttcccctccccaggaacaacgtggggctgtcggcagtgtgcgcctacaacctgtccacagccgaggaggtcttctcccacgggaagtacatgcagagcaccacagtggagcagtcccacaccaagtgggtgcgctataatggcccggtacccaagccgcggcctggagcggtgagctggggcactgggggcgggccgtgctttcccttcaaggcccagggcatggaatccagtacaggcactggggcctgctcatgggctgggtacctggccacgccaaggctctctgcattgggacagggacggccgatgagcacagctcatccttcttcccttttgcatgttacgtaacagccattgctacactattgcacaaacaagaaggctggggcagctgttttgcacaattaacattgcataacaattaggtctgtttcattttcagtttcttacagagaaacacatgattccttggcaaaggcctctgcactgtccactagtcaacaggagtcacattttttcctcctaaatatagtgaactttatgtagaaattgggaatttccaggccgattccttccctcacatggggaaatgggtgtgacaggcatgtgcacagccctctgtggggctgtgacctacatggggtgtcctggccctcagagttcactgcagcaccagctccctcccaagggcagctgtccctgacaccatcatggctccttctatgcatagcttcgtaaaatgtgttcactcatggtcacagattttggtttacacacatcagggagctagaacaggaaaaaagaatccctcaggctcttatgctattttaaattgtcctggttttagccatgtttagcattcttttcatgagaaagctgcaaatcagtgttctgttttttaatttcaaaagctcaataagtgtttttcacttacaaatagatacaaattccttccctgagtatgtatcgtgaatgcaattctgtcttgcagatgtgttttataactgtgtcctctgctggctggggagaggccacctttcctcatagtaaagttattcactgctaccctcatttcaaggcatgcattgtgtggtttccaggttttgcagccccccctgcgttggctgcttgtgtggaagcacccgttgcgtggtgggacacgagcacgttaacagcggggattttctccctgcagtgcatcgacagcgaggcacgggccgccaactacaccagctccttgaatttgccagacaagacgctgcagttcgttaaagaccaccctttgatggatgactcggtaaccccaatagacaacaggcccaggttaatcaagaaagatgtgaactacacccagatcgtggtggaccggacccaggccctggatgggactgtctatgatgtcatgtttgtcagcacaggtgggttccgagggcttggcaggcttgacagtgacagcacatctgtgtcctctggtaggaaaactgggaaatccaattattctttcgtgagtagttccattgcctccctcgaggtgacctgggaggtttgtgggagcgtaagaagatttctgagaagtcaccacaccaggtggctttcagatctgggaccaccaggctactggaggtacttgttaaaaataaaaatgcaagtcctggcctgtggctgggctgggctggggcagaggagtactggccgccgaggagttggggcagtgcccacgcagggggcaggtgtgagccacctgggaggaggcgtcagcctggcgtttcctgactgctggcagaggaccacgtccctgcttcctggccgaggagccaggttttagatgtgccctggcatgtggactctgaaataagcacttctggaacagggacaggggccaggagccacggtggctggcagcgcattgtggcctgcccttggagcctcccagccaacctcacatgccccctgtcctcaccgcctgcctagggcacttaccagtgacaccccgagggctggtggagcatgggagccccctcatgtggcacttagcctcaagtgtaatgtcgactgttggtgaggattcttggggtcaaccatggaacagtttattttccttggaaaaaaactggaataacccataacacttgggtttccagttgtctgttttgccaaagccttttcctttttttgtttctaatgcgaaatcatcattgttttctaagtatctgtggagggaatgacttgagagtgaagagtgtgaagtttgccgctgtggtcactgtccttggtttctgtgtctgggttagtgtcactgacctgtagctttggccctgcagaccggggagctctgcacaaagccatcagcctcgagcacgctgttcacatcatcgaggagacccagctcttccaggactttgagccagtccagaccctgctgctgtcttcaaagaaggtaaagtgacgcaggcagctggaccgggggcttctccgctcggtggctttgattctaggtgacaggagagttggcaagctggagtcgggctcctgggcaggcccctctgtctgtctgccctgggtgagccaaccttcagagtttgacacagagccattccgtgagctgtgggatctgaattggggaaggcaggaaggcagacctggggagacgggactttctcttcgaagttgctggaatgtcattgagttgttggtgcagctttacaggctgtggagaggtgggcactgctccatgaagacacctttttatgccctgagcttggggggtgtgcagactgcatctgtgggatatgatagtgatacagctgactcgtcaccgtggaaaatccacaagagaagtggttcgtctcatctgtaaagctgtctccacctgtggctgagactctggtctggcctgcaatactcccaagcagcccttggcaggggtgggtgggcgggcatccacgctggcctttagggggctgcctccctggccctggctcctaacgggacctccaaccaccttgtgggatccaggcccagtcagtcctctcctccctcagctgggagcaacaggcagaggaagagggcccctgtctggccgggtaagatacctacccttggcaggtgcgtatttgcaaacacccctccaggtcttctgtcctcttccctcccctgtatccacaaagcttgggagcctgggtccttttacgtggtcacctcccctctgctaatggagagttctccctcagatctgaaaggaaaagagaatgaaatagcctgagcaagttataagccactgggtactggcatctgttcaccagcctctcggtctccaggacacaaagggagccctggagatttgaagggtcgacgctttagccactgtggggcctcaccccagcctcgttgttgaaagaaggggacccagaagctcttctggggccatcgtgctgttcagtggcctcagccagactgggcaggcacctacaacatctctaaaatgtggacttctcattagaatgaagattgggcccctggtgtggacattcgtgagaatgacactctgttccaagggtcacttagggacccaggctggtggaggcttccagggcacatgggcactgatcctcaaaggcagaagggggtaggaagaggagggccgcacagagggggttacgggtcagtgcccacccgccatctcccagaactcggtcacatggccacaccagggcagctggccacacagggagcctcgcgcccaggaggaggagccagtgggtttggggaagcgcttgctggtcctactggaccacccgacccgcctgtctctgtaggagcctccattcgtggggacgtggcttagttgcctggacaagcggaaatacatcctgcctgccgtggggtcctgtgccttctccttgggcctcagtaggctccaggtgggggtggaaggcccagctccatggccatggcagcaggaagtggctgttcagtggtaaaaagactgtgccgcctgaccccatcaggctctctcacggtgatcagcaaatggagaaacggccagtaccacgccctccccctgtcctacagctggggaggtgcgctgtgcctccaccctcacctcctctcccctgatgacaagcatggggttttgctttttattttggtaaatacacatcagatgaaatttgccgtcttaaccatttttcattgtgcacgtcagtggcattaagaacattcacgttgttttgcagccattaccactgtctgtctgcagggtgcttttcatcttcccaaacagaagctttttacctgtgaaatacaaactcttcattttcccctcctccagccctgggcagccgccattctgctttctgtttctgtctgggtacctcatatgagtggaatcacacagtatttatccatttgtaactggcttatttcacttaacataaagtcctcaaggttcctccctgctgtagcaggggtcagggttttccaaggctacatactcctctgtcgtatgtgaataccgcattttgtgagtcccgcattttgtgtgtgcgttcatcccttgatggacacggttgctcccaccttctggcttctgtgaacagtgctgctgtgaacgtgggtgtgcagatacctcaagtccttgctttccattccttgggcgcacacagcagatgcggtttgctcggccctctctgagcccaccgagtaggctgtgtctgtattttcaccaggactccttgggatgctgagctacagctagcgtggcagagggcaaggaaggcacttagacagctcagttgcctctgatcacgtccaccgtcactccaacctgccctcggggtctgacgcgcacacacagcagcagagacagagatgggagcatgagagctgcctgcaaggggacaatcctcaggcccagggaaggcggagacagggggcgtcgaggggcaggagtgcacaggacaggcttgctctcagcgggcctcactcatgctgccaggtgcctggtcaggctttttttctttgcctttaaaaattttgtcttgaaataattttaaatttacagaagagttttgatgattgcacagaaggatcttgagcgcccccacctagctccacatgtccgatgtctcacatagccagtgtgcatttatctgagccaaggtgctgtcatggtgcagtgcgttacctgaaccccagaccctggaccctcctacctcccgcccaccacattcctggctcagcacctcaggttgcactggacactgcatctcctcggcttctgctctgttcctgcctccctgacctcagcactcctggagaggagtagtctggtgttttgtggtgtgtctggtgtattcttgtgattatcttggggtcgtggttttagggggagcaccaaagagggcgctttctggggatggggcatctgtatgactcgcaccagcgtgatgaccttggtcattctgtccaagtcaccaccgtctttttccatgtcgagtgtgtcggggcatgtagtccacactgggggtgggggagagtgagccccacctcccaggggagtcatgtgggaaacccccacagtcattcatgcttatttgtagggacagacttggaggctacagaaatgccctgttctcccacccactgacatccacattgaccagtgggtcctgcctgcagcagttacagctggctgtcctgacgaccagttcctccttccctgtcccctcttcccttccacagtcatcccttggtctctgtgtggcgtcgtttagtttttaaagcttagtttcatttgggctgcagcccagccccatccgggagaagcggaagctggggctgagtctcccgcagggtgcaggaggtggtctggatccccttgggacaggccttgccccccagagcccaccccaccctccacagctaccctcaagcctctctttggggtgaggagtcaggcgggccccacttggccacccagggcaccctgctctgcactgcatggtgttcacgccacctcgcaggtgccccctgcgggacccaacaggaccagctgtcccttggaagttacccagcttggctttgctgccagagaatgtttccgccacctccacaagccgcgcgatgcccgaactgtgatctgggatgtcatcctcaatccttcccacaaacgtggctcacacatggcctcatctgcccaggtctctgctgctgctgctgctgtgaggccagcggcgggccaggttccctctgctgtgtattatcacagtttccatccttgggggctttccctttctctcgtgggtctgtgtccgcacagctggatgtgtggcctggggcttcctgtattggcatcagggcctgtgatcttccaaccacactctgaagttgactccgagcgtatcctctgaggatgaaggtcgtgtttcatctgactgtaaaccactaagtcatgtgtaaatttgggaatcttgtattgttaaccaaaaggtgtccccaggctgttgaggcagatgccctgggcagaggctagagagcgcgctccacgggccacctccaggtctgttgcacgcccccgagcttcaggtgggtgcactgcatgtggggcaccctccttccagctgagttccgttcaaaagcagtcagcagccctggatgcctgtgtgctgggcactgctggtgccaggtgggctgatgggatggacctgaagctggtgtcactgggaaccaagtgtcccagaaggtgggagagtctcacctgccctctgctgtgggtgtggctgctctggagctcggaggttgacttcccgtctgtgagctcttcccttttacatatagataagtgaaaagcaaaaggcattgttccttttttatgttttgtatcacgatctcctcatcctttgcatgtcgtccgtttggcatccctgttatgttaggcctctgctggatccagaccctcacgagaggctccccgcccacaggtgctcacattctggctcgggggacgaggttgggcttcgaggtggtgtgcttcagcctctggctgcagccccttctcacctatagtgaggccgggaagatgaccgggagtgccaggctcatgcatcctctgctgcagggaggagatctggaggtggggactgaacagcctccccactggctaagagaaacacgtgcagagaagcgctttgctggagggcaggcacctgtgggtgcccagacaggggagagagggatttggacctaaggcccagtgagccctgacatagcacgtggattctgcaggaaggtcacagacctgccttgtttgcctctggttctgagtacctctcctccttactgcaatgtcccctgaaggtacactctggctgcttcccacacactggtgcagaagcagaggccatgctcctggatgcctgcttgcctgatgctagttcttctctgtctcatacacgcagggcaacaggtttgtctatgctggctctaactcgggcgtggtccaggccccgctggccttctgtgggaagcacggcacctgcgaggactgtgtgctggcgcgggacccctactgcgcctggagcccgcccacagcgacctgcgtggctctgcaccagaccgagagccccagcaggtatggggcgggatgcgctgcctggggatgtcccccatgtgtgtgggtgaataacacgtgccggttgttttgcaggggtttgattcaggagatgagcggcgatgcttctgtgtgcccgggtgagtgactcctcgacgtcccatttcctttgggagtggcgaggtcttgtagccatttcacggtgcttcagttctgtggcatttgtgtgtgttttgtttttctttctccactcggaacagaggtcaagtgttctgtagcagactcgtggtcttctctgtctttttttcttgccgaaagagtacttgaagccacttagagtgtatctgcttactgggaagcagtctccttccaaaaccatcctgttttctttctgcttagcttggggctcattaagcaaaacctaagcctgttataaatggggagaaaggagcccatgagtgattaatcctcaggcagtgtaagggctggggtggtgtttcccctggggctcccacctgggattcacccgcctgtggatgtctgaaatagcaccacacccagagggaggggtggcatcaggccagatgccccttccccagcagccaccttccagggtgctaaaggcagacttgaccctcagttctgtgtcttcctgaccctgacaagacagctgtcatcagactaagaaaggtttaggcagctgggcatggtggtacacgcctgtagtcccagctactagggaggctgaggcaggaggattgcttgtgcccaggggttcaaggctcagtgagcttatcatgccactgcactccagcctggggtgacaaagtgagacccagactctaaaaagaaaacaaaagctggccgggcacagtggctcatgcctgtaatcccagcattttgggagtctgaggcaagaggatcacttgagctcaggagttcgagactaccctgggcaacgtggtgagaccctgtctctacaaaaaatacaaaaattagccaggcctggaggtggtcacctgtagtcccagctactctggagactgaggtgggaagatcccttgagctgggggggttgaagctgcagtgagctgtgattgcaccactgcactccagcctgggcaacagagccagaccctgtttcaaaaaaaagaaaaaaaagaaaagtttaggcaggaggagagtgctgagatgcactgaaaggccagtcttccttgcagccattagcagaagcgtctcgtgtctgattcaaagagctgacactaggcacagaactggcctctgctcagcttccccagcctgacgcgttttcttctgggacacgggtgagaaatgggatttctgctgctcagagctgcctccaatttctttgtccccatgggctgtcatccagggctcatctttgctttttggtcacgcatgtctttatctccttagttgttctggaagattccatgttgctacagtgggtgaaactcttgcgtcatcttgtgggtattttaaagaagttgttaaatagcaaatggggattgttgacgctgtgcacgtttattttgatgttccagataaaagtaaaggaagttaccggcagcattttttcaagcacggtggcacagcggaactgaaatgctcccaaaaatccaacctggcccgggtcttttggaagttccagaatggcgtgttgaaggccgagagccccaagtacggtcttatgggcagaaaaaacttgctcatcttcaacttgtcagaaggagacagtggggtgtaccagtgcctgtcagaggagagggttaagaacaaaacggtcttccaagtggtcgccaagcacgtcctggaagtgaaggtggttccaaagcccgtagtggcccccaccttgtcagttgttcagacagaaggtagtaggattgccaccaaagtgttggtggcatccacccaagggtcttctcccccaaccccagccgtgcaggccacctcctccggggccatcacccttcctcccaagcctgcgcccaccggcacatcctgcgaaccaaagatcgtcatcaacacggtcccccagctccactcggagaaaaccatgtatcttaagtccagcgacaaccgcctcctcatgtccctcttcctcttcttctttgttctcttcctctgcctctttttctacaactgctataagggatacctgcccagacagtgcttgaaattccgctcggccctactaattgggaagaagaagcccaagtcagatttctgtgaccgtgagcagagcctgaaggagacgttagtagagccagggagcttctcccagcagaatggggagcaccccaagccagccctggacaccggctatgagaccgagcaagacaccatcaccagcaaagnnnnnnnnnnnnnnnnnnnnnnnnnnnnnnnnnnnnnnngacaagccctttgacgtcaagtgtgagctgaagttcgctgactcagacgcagatggagactgaggccggctgtgcatccccgctggtgcctcggctgcgacgtgtccaggccgtggagagttttgtgtttctcctgttcagtatccgagtctcgtgcagtgctgcgtaggttagcccgcatcgtgcagacaacctcagtcctcttgtctattttctcttgggttgagcctgtgacttggtttctctttgtccttttggaaaaatgacaagcattgcatcccagtcttgtgttccgaagtcagtcggagtacttgaagaaggcccacgggcggcacggagttcctgagccctttctgtagtgggggaaaggtggctggacctctgttggctgagaagagcatcccttcagcttcccctccccgtagcagccactaaaagattatttaattccagattggaaatgacattttagtttatcagattggtaacttatcgcctgttgtccagattggcacgaaccttttcttccacttaattatttttttaggattttgctttgattgtgtttatgtcatgggtcatttttttttagttacagaagcagttgtgttaatatttagaagaagatgtatatcttccagattttgttatatatttggcataaaatacggcttacgttgcttaagattctcagggataaacttccttttgctaaatgcattctttctgcttttagaaatgtagacataaacactccccggagcccactcaccttttttctttttctttttttttttttaactttattccttgagggaagcattgtttttggagagattttctttctgtacttcgttttacttttctttttttttaacttttactctctcgaagaagaggaccttcccacatccacgaggtgggttttgagcaagggaaggtagcctggatgagctgagtggagccaggctggcccagagctgagatgggagtgcggtacaatctggagcccacagctgtcggtcagaacctcctgtgagacagatggaaccttcacaagggcgcctttggttctctgaacatctcctttctcttcttgcttcaattgcatacccactgcctgcccagactttctatccagcctcactgagctgcccactactggaagggaactgggcctcggtggccggggccgcgagctgtgaccacagcaccctcaagcatacggcgctgttcctgccactgtcctgaagatgtgaatgggtggtacgatttcaacactggttaatttcacactccatctccccgctttgtaaatacccatcgggaagagactttttttccatggtgaagagcaataaactctggatgtttgtgcgcgtgtgtggacagtcttatcttccagcatgataggatttgaccattttggtgtaaacatttgtgttttataagatttaccttgtttttatttttctactttgaattgtatacatttggaaagtacccaaataaatgagaagcttctatccttgatttggggaagacattccttagcggaggctgtgcagcctcccgcccctgcatggcccaggcgggacagctgggctcgctcttttctgtccgtttcctgctgtgttttgccctctctggcctgtgacgtgctcctggcgacttcttcctcagtgccctctcttttctgtcctctctgtctcacagcctcgtctcctaagcccctccctcctcctggctcctcttccctgtcctgtctgggccatgtgggggacaggaggctttcctctccctggaccccctggccagcctcgggtgcggggcccgacagcagctcgagggtctccttgctgccgcccttcctgagtgaccaggcacagcacgtgcacgccctggggaacttctacctcttctgccaggccacaggtgagttgggccctctctgtcccctgtgccctgtccatctgtctcctcccacaggtggggggcgggcgggggcatcctccacatccctccacatgttcctttaccttccttatctgtcctggctgcgtccctcgggttgagccgtttcacgctttcattgtgggtccatcccgagggaaactgtagacagtgtgaagccacttctagtgtacaggggtcaaccagtgttttctgtaaagggctagatatttaggccttgtgggctgcaggctgtgtcacagccactaagctctgctgttgtattgtaaaaccagccatagtcaatacacaacgagtggtcagggctgtgtgccagtaaaactttatttataaaaatgcacggtgggccagatttgccccaaaggccccagtttcccaacctgtggtatataggattgcttctcccttaaaaaaaaaaaaaatttcaagagacagggtctccctctgtcaccaaggctggagtgcagtgacacaatcatagctcactgcagcccctgcctcctgggcttaagccatcctcctgcctcagcctccagagccagagtgcttctatttctgctaacaatttggaggttgatatacgtggtatttggaaattttaaaaaattaagagcttccagaatgggagttgttttaatgacttgcttcgtggtatttaaaagcggaaaagattggcgggcataatccccctgctttgggaggccaaggcaggaggattgcttgaagccaggagtttcacagcagcttgagcaacatagcgagacctgatctctacccaaaaatgtgaaaaaaactaaccaggcttggtggcacgtgccttgaggattgtttgagcccaggagtttgaggttacagtaaggtatgatggtgccactgcactccagcctagatcacagaacaagaccctgtctcaaaaatcatcatcattataaaaacagaaaagattgagagactagtgtactcctctgggacctggaggcatttgccctggattggaaaatactcggatgggatatctgctcttgaaagatagtagatgtccagaaccacacttcaaagatgtatcctgtgcttcaggcagtgcgtggtagccctggtggcccctgtgttgtcatctgactgatcagtagatacagaaagaaaggaagtggcctgttagagcctgccccgggggagggatgaagttaatgaagaggaaaagcaaacccaattgctctctttttaaacatgttaaacacactgtcagtagctcctgagagttttaaggtgctgccctctcctgttaaacaagctctgagagccccaggtggcccatgtctgctgaggccagaatgtcccttggcagccagnnnnnnnnnnnnnnnnnnnnnnnnnnnnnnnnnnnnnnnnnnnnnnnnnnnnnnnnnnnnnnnnnnnnnnnnnnnnnnnnnnnnncagccagcactggacaggagaagctgccggtgagcatggagcactgtggagacggagctttgctaggctggcttgtgtggttcctgccctccactgggtgctacggaccaagggctgtgctgagccccctgtggccgctctcacagctgaatggtgctcctcggccagctagtttgccttggtgcaggcatcccagaggacttcatgtctccatggagactgtgtcctgtcgcagcactggggtccttcaggcagactcaggaagctcctcctcggtggggaggctgggaagcgggcgggtctctatgaactggccgtggacccagggctcctttgcgggcagatgcaggcaggctgtatggtcaggcaatgttggttggttatttatttatttatttttgaggcagagtcttgctctgttgcccaggctggagtgcagtggcacgatcttggctcactgcaagcttcgcctcccaggatcaagcgatcctcctgcatcagcccccctagtagctgggattacaggcacacctcaccatgcccagctaatttttgtatttttagtagagacagggtttcgccatcttggccaggctggtctcaaactactgacctcaggggatccacctgccttggcctcccaaagtgctgggattacaggcatgagccaccatgcccggctgctgttacatttttaaatgtgaggctccaggtgtaccccctgtagctaggcaggcatacacacaagcccctggggtcagcagggaatgaaagatgggtgcccagggagaagggacatcactgttacagcaacagaaaccaccccagatatttcaaccacagggcatttaacacagggaattggttacaaaggtgatagaagggctgggaacagtgggaaggtgaggtttccattatcagccatgggcaggaagagtgaagtgtcaaacactcagtctcacttgctgtgccaccgaggctgtggccgtgtgatctgcagcctctccctgcccgccacactgccttcactgctggaggtcctacttgaagccacaaaaatgtttcttccttccaacttcctgtctcctgtcaatgactcccatggccagacctaacagaaagctggcggtcacagatggatatggggaatgtagctgtgggcttgcagcagtgtggccaggagtagtgtgtagagggtaggggagctgagggaggagggcagtcctttgccagtgctcaggatggactgaacagattgagaactgaggcccccagccctccgccacccccttttcacgtggtctttactttctctccagaggcatttggccccatctgggacattctcgttcacttgttccactgaggccacagcctgcgaaggctgtgagacctccccagggagcaccagcttaggagagagtggcttcagccttttcaagggtgggccgaggccagggcatcatgggcatgccgtgaactcagaggggctgtggctgtgaatttcccgagtaggctccagggttctgttggggtctgtagatgcttcctgcgacagaggccacagtgtgacttgcaagtcccagagactttcctgaggagagtgagtgccattttctgccttgtgggccaggaatgagccattccaggtgaggcccagagcctggagattgcaatacagtgcactcaaggcacaggcctaccgcttctgcctgtgtcctcccccagccacccagggcagggctgctttggaacttggctgggtttttctttgctataatggctgttttcgtggtagctgtcacagtggtttgggggctgtctgattaaagggctagcaaagtgtctttagaatatgaaacttaagaggacattcgtggcatcttcagttccccatgctgcgtcctggtgcctgtagctctgctgggtgaccctgtgtcttggggagcgtctcaccccccagagagggctgactgatggaaggtcagctggtcagggttgcacttggggactgggtctgccccagagctggtggaggcccatgtgtcacccaggagatgtccccacctgccccaacacttggccagtgctcagaaagtggccccagggacttggccatccaggagaggtgagggccctctgaggccaaagcgcttcctgaaaggggatcggggtgggtctgcacaggggaaaacatagcctgtggtgtgtgcagaggctgccagggcacaagggcccaacgtggggtgcggtggaggtgatgtggccacgtgggcggagtagggcggagaggcctgtgtcctggggatgcgagagcttgaggcctggtggtggggtggaggcccacccttgtcctgcacccaggggcctcagtgcccatccaagggagggacagggccacacctgtgggcctgtgtcaggagctggggtgggagattggccaccagtgccactctccacctagacacatttcatcccttctccaccacagttctcgcctctaggaagtggaattatcagtggaagatgatacggaaagatccactgatggccctggcacaggccagccttgtccctggggcaggatgggacggtcctgagaaggccctgggacaccctaggggtgtcatagtgggaactatgcctttgcagtgcccaggtgagacagcacatggtgtcaccccaagcatggtaccctgggctcagtgacaagaggggtgggcaggtcaggactgcactgccttggggcccgtgccctgggagccgctagccctatgatgcctgagtacctgggggactgagtgcatcggcagggcctggagcagtgggagtggccgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaccaaacacaaccactcacacatgcaccacacacagcacagcatacaacacacatcacacacacaccaatcataccactgttacacacacaccaccacacatactgcacacaccaaagcacatacacaccacatagacacatgcacgctacccacaccacaccaatcacatccacacatacacaaccatacacacacacacacacattgttgacttaggatcgtttcaactcacagtgggtttattgggatgcagccccgtggcaagtggagcagcatgtgtattgacaaggggaggaaagccgtctggagctggtgaagtaaagttagcatgcagccgagctctgctcgtctgaactgatgaacccaagttcctcatggatcactcagaatacagatgggtgaaaaaataaccccaccacccgtgtgccagcacatagcgcatctggcatacaaacgtaaggatcaatagcgatgaatggcgatgggttgtgtctacatgcagatacaaatcatgcacttgtacattagtgtgcacacacagaaacagatcgatataattttttaaccaaagtgcagtctttaccctgtcagggccctgccttcacctctgccaggactatcttccatgtcaagtttagacccgtgtcattttcaaagctaataatggttcccccatactttaggcagcatttagatatttggatttgggatggccttttatgttttaactacagtgttagaaatcagagcccttggaaccactgggatcagagggcagcagcagaaggcgcccttggtcctctttgaggggcccagggctccggagagggcccccgttcctagcagccacagtggcctgttggcacgcatgtgtgtgttccagctgctctgtgacatttccctttgtttcagactcttgaaaggccacggccgtcgtgggaattagttgaccttgtgtgttgggccacccttgctggacaggacaaggtggtgctatcaactccctgtgctctgaggtccttcgcatgttagatgaggcagcttcaccagaaactatccatgtctcttctgttatctgggataattccacgtgcctttacaacacagctgtctggttacctggggtctggaaatgccctcggtgcctcagtggtgccttcccacaggccccccatgggagccaggcgatgcctacagatgcctcagtggtactttctcaggtccctttgcagagaagaggttcaggattcctgcccacattgataaggcggcttggccagtaagtggcaggcatgaacaggtgcattccagaagcgctggggctggtccagtgccctgagtggtctagagcataccagagtgaaacgttaggctgcgtcggcctggtgactgtcagggagatgaggactcagagaagggagctgtcagaattgctacctatgtggcaggggtctcactctctcctccctcctcttggggcccctggctactctgtgacttcaacagaggacagaaaggatgaccaacaaggcctcagggcatacccccagctgcactgtccttgtccccagaagggtccccagagtctgggagggaggaggggccatggccaggattagaaaagaccgtgccccaaggagagagcacagagatgggccagggaagcagtgggatcctcgggaaaagaggctgggagcaggtgtccgggtgaggcccgggcagcgggtacaggcagggacaagccaggagtcccatcatggaagacatgatggccagcggccagcactgtgtgcagagaatggcccctctggggatgtgcccgctgccccattagttgcaggaaggccacctggatgtgagtttgggagatgggctggccccgaggcagccagccctgaggtcagagtgggccacatgcatggggatgccgggaggacacagaggagtgctgcaggagatggcagtgggggcactttccaggatgggcccgagcaactcagtcactgggtggatgtctcaccacccctccaggccttcctcagggcgaggccactgcccagagggcacctggtttgtcgcagagtagaatcagctccatattttgtaatcacatccacgaagctctgaagccatggtggtcctggcaccagctggctccgttagaggcttggggtgggagtgagcaggtgggaggtgccccagtgacaggctgagtgctggagcccaggctgccaacagcctccccagactcctgagttgatgtaataaacccagccctggtgaataaacctggcccttgcttataccaaggtgatcagtcttctcacgacagtcctagctgtaggagaaagatcattacctacggcatctgccacagcagttaatttgccttcaacttaagctagttgcagtgacaggaagggccagggggaaatatctgtcctcaggacctctaccctagatccttgtaagccacaacaacttcccttctttgagggcgcgaccagtgtcacctggctcgccactgggaagagccaaggcacatccaggttggtggctgctgagccccacagcatcagaccagcctcttgtccccaccccacagaggccaagggggtgatctgggagtagcaccccagcctggccgctctcttgaggtaacagggttggatggttagggagcttggagcactggcccaagcaagaaaccagtggtgttttcaggaggccctgctgggagatggaagacagctccccactgggggcctaggattccaggagctccccagcagtcctccgtgggacatacgtgggtttgcacctgctgccctgtcccgctgagggtgcggtgctgatggggtggccctgcacactgatggtaactctcactttccctctctctcatgcattcagaaagagatggatagtttaaaaacgaatacatggaacgtaagtacttctttaacatctttaatgtcttatgatgatcaagcatgtatttaaatagtatttactgatgcctgttagcggtggtaagcacgtgtctgtttctgctcacaccccaagagtgtagagctttgagggttttgcagtcagtggtcccatgatggggcgttgggtgattaatccaatccagcttaggccacccagattcttagtctcaagggcttggtcatgagaaccttccagaggctcctgtgactcagtgactccagtcccctgggtggttcttggtgcaggtcacatgagggaggagaccgggcttttatagaactcacttcactgtctgttcaaagaaaagtgttacttgatcataacagctcaaaaaaatctgtttcttaaaatgagattttacctggatgcccatcagctgggaaagggaatatctattccccagttgatgggcacctagatgtacatagagacatatgtttgtacatctatgtaatatgtacttatatttgtagatagatacatggaattatctgtggccagagtccaaaacattttgagtgggaaaaaacaaattatagagtgttaagttttgtttttttttaaattctgcacaaaaaccaaacctgttcacaagggcttgtccaccaggccagggccagatgggccgccaggcaaaacagttttggagcaccttctgaatttccttgagtttacagaatgtttccttcaaagtaacacttttataaaaaattattattataaaagcaatgcttgtttgttataagtttggaaactccagggaagtataaagaaaaaatttaaacaatcccaaatttaaccatccagaggtagttaccaccagcatcccggccatttttgggccatgactatctacgttcacacatgtatacatgggtgtgtacatatatgcacacattcctagatattgtttcacttatttttctgtgttgctgaatattcttcgatggcacttcgaatgagtgacttgtggccccctccttggacatttcccaactcctcactgatagaaacagggcttcactgggcccatccttgcctcgggactcattcctaggactgcccagctaaagggtctgagcttggtcaagtccttgggaggagcattctctggtgatcctggacagtggggaattgttgaccaagagaccggacaaagatgagcagatgccacagtcagtaaagcagggaaaatgcattactaaagtcagcttcattaaactggcgatcgcttcttttcaaaagtccagcatgtgccacagaaatggaaagctctctggccactactgtcctgcccagggaggggagcgtgggtccacccacaccatttaatacctgtaactggatgcacctctgcccctacacctgagaacaaggccagtttttgtgtgtgcaggtactttggactcttttggctctggaatttgttttacctgctcagtgttctgaactccttccttttcactactaagcattctccatgaagccacacttcattttgtcattgtgagggtgatgggcatctagggcaaatctaannnnnnnnnnnnnnnnnnnnnnnnnnnnnnnnnnnnnnnnnnnnnnnnnnnnnnnnnnnnnnnnnnnnnaccaattcttacgaggtgtcatggtcaagcagaggccatggccggcactggtctaggtggcccatggcccatttgggggccttggtgggcctcgaggaagggcaggtgctggtcagggagccgggtcgctaggcagcaggtgggtgtcaccccagtccacgctgctggggtgcctggcctgatgcaggctgtgcctgagggagacagaagcagcagagtaggctggccggcctccccagccccaccacaagcaggagcttcagagacagaaggagcacctgcaccccctcacctgccctccagggcctggcctggccctcccagctcaactccag

SEQ ID NO: 1179 - DNA, 4157 bp, Homo sapiens
ctgagccgcatctgcaatagcacacttgcccggccacctgctgccgtgagcctttgctgctgaagcccctggggtcgcctctacctgatgaggatgtgcacccccattagggggctgctcatggcccttgcagtgatgtttgggacagcgatggcatttgcacccataccccggatcacctgggagcacagagaggtgcacctggtgcagtttcatgagccagacatctacaactactcagccttgctgctgagcgaggacaaggacaccttgtacataggtgcccgggaggcggtcttcgctgtgaacgcactcaacatctccgagaagcagcatgaggtgtattggaaggtctcagaagacaaaaaagcaaaatgtgcagaaaaggggaaatcaaaacagacagagtgcctcaactacatccgggtgctgcagccactcagcgccacttccctttacgtgtgtgggaccaacgcattccagccggcctgtgaccacctgaacttaacatcctttaagtttctggggaaaaatgaagatggcaaaggaagatgtccctttgacccagcacacagctacacatccgtcatggttgatggagaactttattcggggacgtcgtataattttttgggaagtgaacccatcatctcccgaaattcttcccacagtcctctgaggacagaatatgcaatcccttggctgaacgagcctagtttcgtgtttgctgacgtgatccgaaaaagcccagacagccccgacggcgaggatgacagggtctacttcttcttcacggaggtgtctgtggagtatgagtttgtgttcagggtgctgatcccacggatagcaagagtgtgcaagggggaccagggcggcctgaggaccttgcagaagaaatggacctccttcctgaaagcccgactcatctgctcccggccagacagcggcttggtcttcaatgtgctgcgggatgtcttcgtgctcaggtccccgggcctgaaggtgcctgtgttctatgcactcttcaccccacagctgaacaacgtggggctgtcggcagtgtgcgcctacaacctgtccacagccgaggaggtcttctcccacgggaagtacatgcagagcaccacagtggagcagtcccacaccaagtgggtgcgctataatggcccggtacccaagccgcggcctggagcgtgcatcgacagcgaggcacgggccgccaactacaccagctccttgaatttgccagacaagacgctgcagttcgttaaagaccaccctttgatggatgactcggtaaccccaatagacaacaggcccaggttaatcaagaaagatgtgaactacacccagatcgtggtggaccggacccaggccctggatgggactgtctatgatgtcatgtttgtcagcacagaccggggagctctgcacaaagccatcagcctcgagcacgctgttcacatcatcgaggagacccagctcttccaggactttgagccagtccagaccctgctgctgtcttcaaagaagggcaacaggtttgtctatgctggctctaactcgggcgtggtccaggccccgctggccttctgtgggaagcacggcacctgcgaggactgtgtgctggcgcgggacccctactgcgcctggagcccgcccacagcgacctgcgtggctctgcaccagaccgagagccccagcaggggtttgattcaggagatgagcggcgatgcttctgtgtgcccggataaaagtaaaggaagttaccggcagcattttttcaagcacggtggcacagcggaactgaaatgctcccaaaaatccaacctggcccgggtcttttggaagttccagaatggcgtgttgaaggccgagagccccaagtacggtcttatgggcagaaaaaacttgctcatcttcaacttgtcagaaggagacagtggggtgtaccagtgcctgtcagaggagagggttaagaacaaaacggtcttccaagtggtcgccaagcacgtcctggaagtgaaggtggttccaaagcccgtagtggcccccaccttgtcagttgttcagacagaaggtagtaggattgccaccaaagtgttggtggcatccacccaagggtcttctcccccaaccccagccgtgcaggccacctcctccggggccatcacccttcctcccaagcctgcgcccaccggcacatcctgcgaaccaaagatcgtcatcaacacggtcccccagctccactcggagaaaaccatgtatcttaagtccagcgacaaccgcctcctcatgtccctcttcctcttcttctttgttctcttcctctgcctctttttctacaactgctataagggatacctgcccagacagtgcttgaaattccgctcggccctactaattgggaagaagaagcccaagtcagatttctgtgaccgtgagcagagcctgaaggagacgttagtagagccagggagcttctcccagcagaatggggagcaccccaagccagccctggacaccggctatgagaccgagcaagacaccatcaccagcaaagtccccacggatagggaggactcacagaggatcgacgacctttctgccagggacaagccctttgacgtcaagtgtgagctgaagttcgctgactcagacgcagatggagactgaggccggctgtgcatccccgctggtgcctcggctgcgacgtgtccaggcgtggagagttttgtgtttctcctgttcagtatccgagtctcgtgcagtgctgcgtaggttagcccgcatcgtgcagacaacctcagtcctcttgtctattttctcttgggttgagcctgtgacttggtttctctttgtccttttggaaaaatgacaagcattgcatcccagtcttgtgttccgaagtcagtcggagtacttgaagaaggcccacgggcggcacggagttcctgagccctttctgtagtgggggaaaggtggctggacctctgttggctgagaagagcatcccttcagcttcccctccccgtagcagccactaaaagattatttaattccagattggaaatgacattttagtttatcagattggtaacttatcgcctgttgtccagattggcacgaaccttttcttccacttaattatttttttaggattttgctttgattgtgtttatgtcatgggtcatttttttttagttacagaagcagttgtgttaatatttagaagaagatgtatatcttccagattttgttatatatttggcataaaatacggcttacgttgcttaagattctcagggataaacttccttttgctaaatgcattctttctgcttttagaaatgtagacataaacactccccggagcccactcaccttttttctttttctttttttttttttaactttattccttgagggaagcattgtttttggagagattttctttctgtacttcgttttacttttctttttttttaacttttactctctcgaagaagaggaccttcccacatccacgaggtgggttttgagcaagggaaggtagcctggatgagctgagtggagccaggctggcccagagctgagatgggagtgcggtacaatctggagcccacagctgtcggtcagaacctcctgtgagacagatggaaccttcacaagggcgcctttggttctctgaacatctcctttctcttcttgcttcaattgcttacccactgcctgcccagactttctatccagcctcactgagctgcccactactggaagggaactgggcctcggtggccggggccgcgagctgtgaccacagcaccctcaagcatacggcgctgttcctgccactgtcctgaagatgtgaatgggtggtacgatttcaacactggttaatttcacactccatctccccgctttgtaaatacccatcgggaagagactttttttccatggtgaagagcaataaactctggatgtttgtgcgcgtgtgtggacagtcttatcttccagcatgataggatttgaccattttggtgtaaacatttgtgttttataagatttaccttgtttttatttttctactttgaattgtatacatttggaaagtacccaaataaatgagaagcttctatccttaaaaaaaaaaaaaa

SEQ ID NO: 1180 - DNA, 2589 bp, Homo sapiens
atgaggatgtgcacccccattagggggctgctcatggcccttgcagtgatgtttgggacagcgatggcatttgcacccataccccggatcacctgggagcacagagaggtgcacctggtgcagtttcatgagccagacatctacaactactcagccttgctgctgagcgaggacaaggacaccttgtacataggtgcccgggaggcggtcttcgctgtgaacgcactcaacatctccgagaagcagcatgaggtgtattggaaggtctcagaagacaaaaaagcaaaatgtgcagaaaaggggaaatcaaaacagacagagtgcctcaactacatccgggtgctgcagccactcagcgccacttccctttacgtgtgtgggaccaacgcattccagccggcctgtgaccacctgaacttaacatcctttaagtttctggggaaaaatgaagatggcaaaggaagatgtccctttgacccagcacacagctacacatccgtcatggttgatggagaactttattcggggacgtcgtataattttttgggaagtgaacccatcatctcccgaaattcttcccacagtcctctgaggacagaatatgcaatcccttggctgaacgagcctagtttcgtgtttgctgacgtgatccgaaaaagcccagacagccccgacggcgaggatgacagggtctacttcttcttcacggaggtgtctgtggagtatgagtttgtgttcagggtgctgatcccacggatagcaagagtgtgcaagggggaccagggcggcctgaggaccttgcagaagaaatggacctccttcctgaaagcccgactcatctgctcccggccagacagcggcttggtcttcaatgtgctgcgggatgtcttcgtgctcaggtccccgggcctgaaggtgcctgtgttctatgcactcttcaccccacagctgaacaacgtggggctgtcggcagtgtgcgcctacaacctgtccacagccgaggaggtcttctcccacgggaagtacatgcagagcaccacagtggagcagtcccacaccaagtgggtgcgctataatggcccggtacccaagccgcggcctggagcgtgcatcgacagcgaggcacgggccgccaactacaccagctccttgaatttgccagacaagacgctgcagttcgttaaagaccaccctttgatggatgactcggtaaccccaatagacaacaggcccaggttaatcaagaaagatgtgaactacacccagatcgtggtggaccggacccaggccctggatgggactgtctatgatgtcatgtttgtcagcacagaccggggagctctgcacaaagccatcagcctcgagcacgctgttcacatcatcgaggagacccagctcttccaggactttgagccagtccagaccctgctgctgtcttcaaagaagggcaacaggtttgtctatgctggctctaactcgggcgtggtccaggccccgctggccttctgtgggaagcacggcacctgcgaggactgtgtgctggcgcgggacccctactgcgcctggagcccgcccacagcgacctgcgtggctctgcaccagaccgagagccccagcaggggtttgattcaggagatgagcggcgatgcttctgtgtgcccggataaaagtaaaggaagttaccggcagcattttttcaagcacggtggcacagcggaactgaaatgctcccaaaaatccaacctggcccgggtcttttggaagttccagaatggcgtgttgaaggccgagagccccaagtacggtcttatgggcagaaaaaacttgctcatcttcaacttgtcagaaggagacagtggggtgtaccagtgcctgtcagaggagagggttaagaacaaaacggtcttccaagtggtcgccaagcacgtcctggaagtgaaggtggttccaaagcccgtagtggcccccaccttgtcagttgttcagacagaaggtagtaggattgccaccaaagtgttggtggcatccacccaagggtcttctcccccaaccccagccgtgcaggccacctcctccggggccatcacccttcctcccaagcctgcgcccaccggcacatcctgcgaaccaaagatcgtcatcaacacggtcccccagctccactcggagaaaaccatgtatcttaagtccagcgacaaccgcctcctcatgtccctcttcctcttcttctttgttctcttcctctgcctctttttctacaactgctataagggatacctgcccagacagtgcttgaaattccgctcggccctactaattgggaagaagaagcccaagtcagatttctgtgaccgtgagcagagcctgaaggagacgttagtagagccagggagcttctcccagcagaatggggagcaccccaagccagccctggacaccggctatgagaccgagcaagacaccatcaccagcaaagtccccacggatagggaggactcacagaggatcgacgacctttctgccagggacaagccctttgacgtcaagtgtgagctgaagttcgctgactcagacgcagatggagactga

SEQ ID NO: 1181 - DNA, 39444 bp, Mus musculus
  misc_feature (4104)..(4533): "n" at positions 4104 thru 4533 can be any base
  misc_feature (7246)..(9732): "n" at positions 7246 thru 9732 can be any base
  misc_feature (15145)..(15421): "n" at positions 15145 thru 15421 can be any base
  misc_feature (22129)..(22148): "n" at positions 22129 thru 22148 can be any base
agggaggcagagcaggtgaatctctgagttcaagcacagcctggtcccgacagccagggctttatagagaaaccctgttacaaaacaaaaacaaatatgtatcaatttagagagggtctaacataactagtgtggttttgctctctcgggatggacaattctgctcttgggtaaagtgagaaactaaaggcagcctagaggaaaatgttttgcactctgtgttccaagctaggatctgggaggaggacggctccatagagagcgtgttagagaaatgtctttgcgaagctgtgtgggttttgttagccaagcagtgcggtgatgggccataagccaaacagtcgtgtcaggacagtaatggatctattcagcaaagcaagtcacactactagaagccctcattgttggtcaccagatatggtgacacacatgtttactcctagcattcaggtgacagaggtaggtagatctctgtgagcctgaggctagcctgctctacatggcgaactccaaggcagccaaggtttttgtaagtaagactctatctcaaaatacaaaataacgcccccacccccaccccaagaaactgttggtcttttatagagaatccttgctcactcaaacagctttcagcataagaatattcaaaattaattggcaagcgctgccaccatgggtgtccctaattacacataccttgtcatatttacgagtgtgatgaacttttagcccgtgtcacatacactgatagccatctccatagtgacatgtatttagatcacattacagtcacgactcatagtttgtttttttaaaatgctcttaaaaattcgactaaaacaaaaataaaataaaataaaacaaaacaaagtcaacgcaagctttcctttcctaaagtctctgctgtgcccgcagtttagacagagtttctgtcttctgactgcgctcactccacaccagccaagtcctggtcccagtgaaccaatgttctgtctaagcagaagacgctggagtagacaagccttcttttcatagactagcaaactacattcctttcagccttaggtctgatggaggaaatcattcacgtcaggaaagaagtaaggctttcaaaacagcacacagaactttactgaacctttaataaaaacataggactaaaaattacattcttttttaaaaattaggacaaattttaatatacatttatcttatgtgtgtgtacgtgtatgtgcgcatatgtatatatgtgtgtgtatgtatatgtctatatacatttatcttgtgtgtgtacgtgtatgtgtgcatatgtatatgtgtgtgtgtgtgtgtgtgtatttctctgtgtatatatgtatgtatgtgtgtgcatgtatggatatgtctgtatgtgtttgtgtgtatgtatgtgtgtaatgtgtgtatgtatgtatatgtctgtatgtatgtgtgtgtatgtgtgtatgtatgtgtatgtctatatgtgttcctgtgtgtgtatgtgtgtttgtgtgtatgtgcatgtgcatgtgtgtgtatgtgcatgctcaaagcaatcatgtggcagtcagaggaaaacttgcaagagttaggctccccttcaactatccaagctctgagggtcagacttgggttgtcaggtttggcaacaagtacctttacttactaagccattgtgctggccctgaatgaggacagatttaaacaaaaagattaactaggcaaactaaatgatacctggaatagtcagatgtccgggcaccttaaattagaagttgaagcaagagaagggactccaaatgtgccttttggtgcctctctctggctcatagcaatcctttgccacatatttattcattgatagggtctcactgtagaccctcttacagagagcaggctagcttcggaccttcagcagttaagaatcctaagtagtgatttaagtgagaaacatccctcataggctcatgtccccaatggctggtgctgtttgggaagtgtttaggaggtacggccttgctgggggaagtccatctctgcggagggatggcctttgagggcttgtagccccaccctactctctcttggctctctctgcttcctgtgtgctattgagatatgattccttctgcttcttactcctgccgccatgtcttcccaaccagtgtggacagccagccctctggaaatgttaagctaaaatataatattttaaattgcctttggtcatgttattttatcacagaaaaaacaaagtagaaattaatacactgatcctcctgcgtctgcctcccaagtgttgggattactggcttgtgtcaccatatcagctcatctttatgaatctctgatttttgttttcagtacaagggttgaagctagggcctcacaagcagtagctatgctctctcccattgggctgtgtttccaactccatattttttgttattgttgttgtttttgttttttgtttttcgaggcagggtttttctgtatagccctggctgtcctggaactcactttgtagaccaggctggccttgaacagaaatccacctgcctctgcctcccgagtgctgggattaaaggcatgcgccaccacgcccagctccaaccccatattattaaccccactgattcaatcattcatcattcatcattcattcattcatttgacttttctataatgttttataagaagctgcatcatttcttccttccaggcctctctctctctcaagccaggctcacaccatagatcttggtggcagaaggtcttgtccaaagactgcgagtcacacctgtagtgaatcccaaagccccttgaagccatgacatcatccagcccaacatctgtatgctgacatctaatcagtcaacatgctgggacatcttcaccaataagtactgtaaaagaacagaaagtcttttaaataaatgtaaaagatggatatttaagggaggaggggcaggagagatagctcagcggttaagagccctgactgctcttccaacagtcctgagtttaattcccagcaaccacatggtggctcacaactatctgtaatgggatccgatgccatcctctggtgtgtctgaagacagcgatggtgtacccacatacatgaaataaatggataaataagtaggctgggatgcagccccggtgatagatgcctgcctactgtgcacgaagccctgggctcattccctcgctacacataaagtctgtggtggtggcgcattcctgaaatctcagcaccagggagctcaccgttgtcctcagctacacggcaagcttgaggctggtctgggcactgtaggagccttgtctgactgaaaagttataaaaataacttttcaattaaataaacatgcagggaaaaaagtcaaaattcttcacttaaacaaagctaccaatggagatggataaactgctcagtgactagaaacatctctcctcttgtataagggcccaagtcgagcacacacacacacacacacacacacacacacacccttgaaaataataatggtatcatggtgacacacacctttaatcccagcagtcgggatgcagaggcaggtgaatatctatgttcaaggcaagcctggctttcacagtgagttccaagataaccagaattacatggtaatagcctgtctcaaaaaaaaaatagcagactttattaatatacatatatatgtatatgtgtatgtgtgtgtgtgtgtgtgtgtgtgtgtgtgtgtgtgtatgtgtgtgtgtgtgtgtgtgtatgtatgtttgtcttcacagtgccctcaatccacatgtacttcacaagaatgtgtgtggtgccgtgcttgccgtgcacagacaggggctgtgctcaccgtgtgcaggggccagccaacctaacaggcaagtttactagcttcaagctgcttccaacagaagtgttcaaactccctttctaacgatgtatttctaagctgtgtgtgtggtggtgcacaccttttttcccagcactctggaggcagaggcagacagatctctgtgagtttgaggccagcctgatctacagattagtacagtgaaactggagtcagtggtggctgtgggtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaggcgctaccatttaaccacccctccagctccttgtccatttggtcttttttttttttttttttttttttttttttgggtttccgagaacagggtttctctgtatagccctggctgtcctggaactcactttgtagaaccaggctggcctcgaactcaaaaatccgcctgcctctgcctccaaagtgctgggattaaaggcgtgcgccaccacgcctggctcatttggtcttttattcactagtctacaatgacttacttattgattgggtcaagcactcattaaaatgctagaattacatgaatgaactaatgaagttaactcgtcgagagtttctcaactaatatgtgttcaatccatggtcctttttcttatttccttcttatagcactgggatcaagcccagggacttgcccatgctagttagatgctaagctacagtctcagcccaaaacactaagctatgttcccaattctttactctgtcagcagcatggattaagagcgctctgcaaggctcttaggagggtttctgtgagtttgagacctgcctgggtatactggggctacatagtgagaccctatagcaaaaaaaagggggggggaatgttaaagggtaaacaacaaaacagaaagcaagtcctgcatgcagcacgctgtaccacgcccagaaaagtagaaggggtgctcttggtttactgaccagaacaaagccacacactaaacggctacatgatgacacatgagagatgacactgactgtaccatatgctgtgactctgactcaccaaaggaacatgactcataatgtcttcatccaattgttcatcagccaggctgctctctctctgtctctgtctgtctctctctctctctctgtctctgtctgtctctctctgtctgtctctctctctctgtctctctctctctctctctctctctctctgtttgtctctctctttctttggtttttcaagacagggtttctctgtgtagccctggctgtcctggaactcactctgtagaccaggctggcctcaaactcagaaatccgcctgcttctgcctgctgggattataggcgtgcaccacaactgcctggttcagtctggtctcttaagaatccagttttgttttgttttgtttttaagatttatttacttattttatgtatgcaaatacaccatcattcttttcagacacaccagaaaaggccatcagatcccattatagatggttgtgagccaccatgtggttgctaggatttgaactcaggacctctggaagagcagttggtggtcttaactgctgagccatctctccagcctccaagaacccagtttcttttcttcaaatgcctcattgcagtttgttattggatagcaatagagagtcagtttctcccttccaacacttcaagcttaaaagatcatatgtacatatgttgatcagcctatcatccccccaaaatataagcagtatatttgaccatggccaaattccatttcaaagtatgtccttcctggttaggcttgcagtagccattcaggaaactagatgaggggtgtacttattacaggccacataggctctatgtagtcataaccagacaagtgactgccgtcatgtttacagaataaagctctagttcagactctcttaactttcaactatgagccgggcgtggtggcatactcctttaatcccagcactcgggaggcagaggcaggcagatttctgagttcgaggccagcctggtctacagagtgagtttcaggacagccagggctacacagagaaaccctgtcttgaaaaaccaaaaaaaaaaaaaaaaaaaaaaaaccaaaaaaacctttcaactatgaaaaccaaactatgatgaaaaccaaaggtgatttttaaagccaactgccatttaataataaataatattcatgcctttatgcgatgcgttagggtttaagcctttaaatagcatagatctgaccagacatgtttaagaaatgtcaacagagcctggtgatggtgctcacctttgacagaggcaggcagatctctgagttcgaggccagcctggtctatagagtttccaggatgtcgagggatacaaaggagaaactctgtctcagaaaacaaacaagagaaaagtgaggggagacaatgactattgtcattcaggcgttattttttttaatcacacggacttacttttgaaatcacataaggtccccaggcttgggaacaaaccgctagtcaggctttgctgggttttagatggactcacaactttctaaatctaaacctactaacaaagaaactacacacttcctctcacaaagtcattttacaaccaaagtctctctctctctctcttcccacttcctccctctcccctctccccttttgagacagttctcattgtgtgacccaggctgtgaactcccaggttcaagcaatactcctgagtagctaggaagacaggtgtgcactgccatgccagctttctgtttgagtactggtttgtttgtttgtttgttttaaagatttatttattatgtatacatcgttctgcctgcatgtatgcctgcaggccagaagagggcgtcaggtcttatcacagatggttgtgagccatcatgtggttgctgggaattgaactcaggacccctggaagagcagtcagtgctcttaaccgctgagccatctctccagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttaaacgctgccccgtttccgcagccgtctgctgggcgagcgggagaccgaccggacacccctgggggaccctctcggatcaccgcgcttctcctgcgggcctccaggtaagggacagctcgccgacgtcgttttgcatttgagagctattgccgaaagacgttttctgtctccttcgtaaatgcatgtatctatttgtcccttttcgtagatgttttataatttcaagtttttatcgtgtgtgttgttgttttttttctacttgtaggccaatgtgcaataccaacatgtctgtgtctaccgagggtgctgcaagcacctcacagattccagcttcggaacaagagactctggttggtatttctgcctcgagtgtgtaaatatagcttgttttaccaggtaatcgaggaaacaaaattgaaacctggattatcgcacagtcgttttaagtatttacctacaaactcttaactttctcgattgcaattgcattagagagtggtcactgcgacctatatttccacagcccttcccctgacgcaggctttagaagtgcacagtgtgtgggtgctgctggttgtgacatgatgttctatcactgttctaaatggtaaaccgaaagtcatagaagcatccgtgctttttgtgaggattttagttatgagaggaatgcataaaatatataaagttccagtctttgctctgtatctctttaagttttctactttatattagcatataaaggtgttctacagcttgtcagtaagttacaaaattacttttaatagctgcataggatttgataatgcgattgaacctcagcctttagaatgtgtgtgtatgcaagtactgtactactgagctgagcgacagtctcaggctcacgactactgggggatgtaaaagttgcccatgtgtttgagtaaagtaagggtgaggaagatagggaactagaatcctacgtcctggtaaccacatttgattgcagactgctcactctgctcagcagaggtcatggccgtcttcgatcctgccagcacgaatattgccagccctcgttttccctttctgatgtaatttcatacatatttgtggagaatacatgtatgcaagttaagtcagttcctacggttactgctctgtggagtaaaatgtattgtttcagtgggcatgtcccagatctccagttaaacagcctgtttgttctgggtttgccaatgtctctctctatttactctcgctcttcctttcctcccccatttttttttttgcatattttagtagcttgcataattttcaagtatagttaacctaagaaatttttttttacaaggactataatctgatgtctgccccattgaaggtatcaaatttgtttattttgataatttttgaattttcttgtaatgctttggaggaattcttccatttcaagattatgcacatatttaaagtattttcatatagcattttaaaaaccttttccgggtagatctttattcagaactctctttgttaagtgtgagattacagtgttgtgtttttatagtagtttttaaaattaactttatcttgtaagctttgataagaaactggctttccattgtagagttttgatttgagttaatttaatatgcaaaaatgtagaacttcttgctttggcagtacgtatgttaaaattgatacactaaggagaaggctagcatgacttctatatgagttacataagaaaattaagcattagtaagtctttttcagctgggcgtggtggcgcatgcctttaatcccagcacttgggaggcagaggcaggcagatctctgagttcgaggccagcctggtctacaaagtgagttccaggacagccaaggctacacagagaaaccctgtctagaaaaaacaaagaaacaaaaagtctttttcaaatcttgtaagagtgaattacttaatctgaaaataaggtcttaatacccttttttaaaaaactgatttctataggctggagagatggctcagaggttaagagcactgactgctcttccagaggttctgagttcaactcccagcaactacatggtggctcacaactgtctgatgccctccctcttctggtgtgcaggtgtacacgcagacagagcactcatacacagaatacataaataacagagtctttaaaacttttttctttatttttgaaattataccatttctcctttccttttccttcttccaaagcctccagtataccccttctctctttcatgacttttttcattaattgttacatgcccagtacatgctacgttcccagatacagcctgctcagtctgaataatgccatttgtgtatgtatgttttcagggctgaccttttggtattggataaccagtttgtgtgctcttctggaataaataactgaaaagtgcattttaaaattgtgctaaaagtagtctttaaaaaaagaaaaagaaaagagtggtgctggagagagggctcagcagttaagtgcatttgctgttgttacagaggacccaggttggatccccagaatggataaggtggctcagccctcttgtaactctagttgcagaggatctgatggcctcttttggcctccaaggacactgtttgcacacggtgcacttaaatacatcaggtgaaataccagtatacataaaataataataaaagtcttcaaattaccaaaaaaatccacagaagtggtggtctgtgtggttatctcaaactaaaacagctgagtttgcagatacagagagcatagtcatgttacatgccttccttcccagtttctaaacactctctcagcttagtcagctcagtgtacttactgtccttgaagcacttaatagtattttaaaaataaactaaatgcctttaaaggtagtggttagtcctatttgtcctcagtactctgccatgaggccacattctagccatgtagacagaggcctggcacagtgagatctgcagccattgcaacaatagagccatacaaaataactgtcctgacagagacagccggccaagcagccaggagggagcacgactgctcttcagaggacctggcttccactctcagtacccacatggtggctcctagccatctggaactccaattccaggggtccagcactgttgtggtatccctggggaccagggacacaagtggtgcatggaagtacatgcaggcaaaacatgcatatgcatggaacagacagaaagccagcaggctctccgtgctgggcatccactagctatagaacacgagtgaacaggagccttgatcatcaaagctgacgtgcaggagtgtctttagagtatctgtggccgatggtaacatactttgatatcagactgacgtggctagagcaagctcagggacatttatcatggtgttccttggtatccgttgtcaggctgccaggctgggctcactagctgctttgtgggtgacaccttgttaggtaggtgacagttgtccagtttttatctttttaaggattcatttcttattttatatataggaatgttttgcctgcatgtgtatatgtgtaccatgtggatgtctggtggctatagaaaccagaagagggtgtcggatcccttggaaccagagttagatagttttgatctatcatataggttctgagaactaaattcagggtctctataagagcaacaagtggtcttaacctctaagcctcagccccatcaactattgtctcactactgggaaagctggattagagtcaaattgtagctggctacttgtttttataaataaagcttaatgttatatatttactcttatagtttatgtagtacttttgcttttaagttggctagacatagaaaaaacactttctggctcttctgatattactggcatgctctttaaagatcatttgtcattagtgagtgtgtgtgtgtgtgtgtgtgtgtgtgtgtgtgtgtgtgtgtgtgtgtgagagagagagagagagagagagagagagaatatctagcctttgcatgtattttaagtgataaataaatgatgcataaaccacatataaagaaaacaatgagttgtagctgagggctgtgattgtactctttgaattgttcattaccttgtgactttggtttctttagcagtcaggaatgtggtatatgatagattggtgataggttttgccctaagatatagtctattctcctacattctataagctccctttcagtagactgacggatttgtacagtatagtaagagactggatctcagctaggttgtgtggtggcaagcagatgatggagctgtaggaaggagtcagtgctcactcacacactcccctgtgtgtgtgtgtgtgtgtgtgtgtgtatttgtagctcctgcctgcagagactacagtggatgttggattgcctaggatgttggtagctgccttttggtggccctaggaatctagaattgggtcccctgcaaagcagcaagtgcttttaatctctcagccatctctccagcatcttgataccgttttgatcagaacaaattgagtttgattatttgacatgacaccaggatttgatgacttcatgataatttcatagtagcttttcccaaagcattttctgtcctaacgcttagtggtgtgcacttgtacttagtgtaaaacccaactttctgaagtgcagctcggtaacaaattgttataagcacggcgtttgctgcctgtattgggcttctttctggccatacataaagggcttgtgctgtagagtatgttcatggtgtaacatcagctctttttcttttcttttacaggttagaccaaaaccattgcttttgaagttgttaaagtccgttggagcgcaaaacgacacttacactatgaaagaggtgagcagaactgaggggtggagagccgatggcttcatggttacatacaggcatctgtggtggtttttcaagtttgagtgagattggccatacagattttgtaatgagcaaggacattaagttttgtgatcatttgaactgtaatttgaagctaaaaattctaatttacatgaatttcttcctcctttcctttctttgagacaaggtcttttttttaaaaagatgtatttatttattatatgtgagtacactgtacctgtcttcagacactccagaagagggcatcagatctcattacagatggttgcgagctaccatgtggttgctgggatttgaacccaagaccttcagaagagcaatcagtactcttaaccagagccatcactagcccctgagacaaagttttactatgtagtcctgactgtcctggaactcactatgtagaccagctggcctcagactcaagagagatccacctgcctctgcctcctgagttctcttttctctttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaagaaagcaaaagaaaaaagaccttatacaactgttgggatgctcagtgggctgattcatagacacaatgttgtattctctgccttaacgtttattagtaaagtattgttttcagctagaggttggtcagttgtagacagaagttttgcatggctgagatataagtgtttctctggctcacttaggttaaggcttgtttacttaaaacactcaagttcttgtggcaggttaggggcttcttctcagctacacatttggaaacgtctcaaagaacactttgttggaggaacccaagtgtcctttctgtcccactgactgtcaatactttgtgatctatagacatgtaaaaattgcctttcagattgattggctcctacttagctagttaaagtctctttaagtgttaagtgatgtttttaaggtcattaactttggattgacctttataaaggttagacaaatgataaacaagtatggatttagtagtaggtagatatgagaaaatcgatgaaggccatcaaaaagatttagtgcttatgctaagctgtgtgcagtaggtcagctgtcctcctgctctctgcggggagttggcttcaggacactgcctgccaagtctcttacttaaaccgtgaaactgtctctgtatggacatcacctcttagacattaagttatccctagagtatctgtaatacacaatgtgtgtagttgttatactgtattctttaaggaatagtgacaaggaaaaacatttctacattcaggatggatgccaggaatattattagacccacagtcaaatggatctgtgggggtgggacttacagattgtttatagtgtctgataccagttttcagttacaagatctttattctaggacacttgagaatgtagtgagctagtgtggtagacagtacgctgggataggtgtcatgtcctgggttagtttctcatctctgtttatgtttttattttcccccctgtggtactgggtgtcagatcaagggagcacattttacctactgaacgacactcgtgaccttgttttcatacaggaataacagttccctggggtgtcaggatggtgagactgtactgacaaacctgtgcactgtaaaatgctgtctagagttacattgttgatgggctcgttttggaatgacaaagtatgttgcttaagctgccataatggagcacatggaatataataatagtgatggttcgggccctggactgtttggtgaagactatattaataactgagaatattccattgggagatgttactcatgatgtcctgtcttcctctgtgatgacctcagagctgtagaagtatacgtttgtgacatgtcactattctaatacattgctgtattttaccttactctttttttttattcaatttttttttaagatttatttatttattacatgtaagtacactgtagttatcttcagacaccccagaagagggcatcagatctcattacagagccaccatgtggttgctgggatttgaactcacaacctttggaagagcaatcagtgttcttaaccactgggccatctctccagtgtccccccccccccttttttttaaacctcttttttctttcctagtatcatatgttagtatctaagtttctgggaaaaattaaaatttataagaaaaaaagaaaaacagaaaatacatttaagtaatgtggagaaacagttacttctattttcatcagtgtggaagtatttaaaagaagcttctacaatacaactgtttggtcttgtacatgattatgggtgtggctgttagtgtaaagtgtaacttgttcagttaagtgtggtattgctgaatgtataatgtatatattctatgtgatttccttagtacttagaaaccatatttgtgtttcagattatattttatattggccagtatattatgactaagaggttatatgacgagaagcagcagcacattgtgtattgttcaaatgatctcctaggagatgtgtttggagtcccgagtttctctgtgaaggagcacaggtaagccttgtgcgtggtgggttataagaacagcgagcggctgtgcatggggctggagagatgctcagtggttaagaggacccaggttcaattcccagcgcccccatggcagcttacaactgttggtactgccagttctataggatctggtgccctcacacagacatacatgcaggtaaacataaaaaacatcttaaagaagtaccagctgggcggtcactgtttctcacctctgtcagagaggaactgaccatggatacaaaatgctaacattgggtgtcattttttgaggccctactgcgattaacagtagtcgtagcatattgtgtgggaacctgaactctggaatcttagttttgattgtgtgtgtgtgtatgtgcatatgccactgtgagtgtgtggcagtcaggagtcagcttgtccttccaccatgtgggtactggggattgaatgcaggttaccaggcttgacctcttttgagacaggtcgagtcgttagtctgtgggtgtgtaaatggatctgacatctctcagctgtaggctctctactcacatgttgttttttttttttttttttcttttcttacaaggaaaatatatgcaatgatctacagaaatttagtggctgtaagtcagcaaggtaggtaattttgaatattataaacatagtataacttaataacagttctttttcatgtaagatcttatgtatcctagtctaaccttaaactatgtagctacggacccttgagccttaaaaaaaaaaaaaaaaccacaaacctttgagtagctttttgttgtgtatgtatctgtatgtctgtgtagggtgggatagatacatggtgtatacctggaagtcaaaaaacagcttggcggaattggtctactttttacatgggttctggtatccagctcagatctgtaggcgtgtgtggcaggcactttgacctcctgaaacatcttaccagtcccctaatcatgttttaaagacttggatgttgtcttagtcagggtttctattcctgcacaaacatcatgaccaagaagcaaattgggaaggaaagggtttattcggcttacacttccatactgctgttgaccaccaaaggatgcaggactggaactcaagcaagtcagaaagcaggagctgatgcagaggccatggagggatgttctttactgacttgcttcccctggcttgctcagcctgctctcttaaagaactaagactaccagcccagggatggcaccacccacaaggggcctttccctcttgatcactatattgagaaaatgccttacagttgtatctcatggaggcatttcctcaactgaagctcctttctctgtgataactccagctgtgtcaagttgacacaaaactagccagtacagatgtatacttcatgttttaaagacttggatgtatacttcttcgtagagtgcagttctggctttaacccttagcactctaaaaaggcaaaatatcactgtgtgctgctttcatttgtgtttgcttctggctctctttattatttttaactctttcattgcctaccaatttttttttaataattatttttgggtgtattagtgttttgcctgcatgtctgtctgtgtaccatctgtgtgcagtgcctttggaggacagaagagcccatcaggtctcctagaacttgttacagacagttaacgactgctgtgtgggctgggaattgaagccagaacttctggtagagtagccagggctcttaaccatgaagctgtgttcccagcctctacttttttgttgttttgagaccagatccccataaattatccaggctcatttggaacccaggcttcctgctccccaagtagctgacgtttgttcatttattcagcactgctgagagttgaacttaggctcacacacccttgcgtttagaaagtactgtactagttagctgccccagccaggctttgactcatctcattctctcttaaaaaattaaagtgacttctttcatttcactttatttgtatgggtgttttttctgtcctgctgtatgcatgtatacatgtgcaccacgcgtgtgcagtgcccagcaaggtcagaggaggagcattgaatctcctaggactggaattagactattgccacctctggaagaccttcaagtgctcttaagcaccagagtcatctctccagcccctctttggaaaaaataattatactgcctggtgtggttacacagacatttaatctcagcaaatgggcggatggacttgtccagccaagtttacataaagagaccctgtctcaaaaaggcaaaaagcaagttttaattatgtgtgcgtccctttatgtgaatatgtgcacatgagtgcaactgatcttagaggccaggagtgtcagcttccctagagctggagttagggagttttgagctgtggtatctaggaactaagagtaatccagccccatgattctccttaaaagtaaaagaaagtacatttattcgtgtttaagagcatccttatgccatgatgtgcattgggaagtcaaattggatgtcttgttaatctctgtcacgaccctgggttatcagggtttcttctgaaggacaggtaatgttaaaagctgcttagtagaagcgtgatcaaacctcagaatgcgttgagatgtttcaggaagtaatataatacctaggtaggaccgtgaaagagtggggtttcatctcttctcttctcttgcccccctttgtattcttgctcttgtttcttgagtggacacttagcatttttaggtaagcatcattttagctctccttggcagttcttttttagtgacttgagcacaggtccttgtgtgtgcttcacaagcatcaactctgatgttgagctacttactgagagaattggttatttttgggatgcaacctttttgagaacctagtaaaggcacttgattttcattctataagtgtgtacatgtggatagtgttttattattattattatggttttttgagacagggtttctctgtatagccctggctgtcctggaactcactgtttagaccaggcttgcctcgaactcagaagtctgcctgcctctgcctcccaagagctgggattaaaggcatgcgccaccatgcccggctatttttttttttttttttaaagaaagagtttctctttttaaagacaggctctcactattagctatggttgggctagaactcattatgtagatcaggcagacctttaactcccagagatccatccacctgcctctgccttctagacttacataccgccatgtctcctattagttgtatttgaatactagtagctgtgggctctgaaaccccgtaatccttaccgttacccttgaacatagctactgtgttcagaagcttgcttggtttctagactgaatcaaccattctcttgcgatcccactattcccttctatattcagaagtcactgtgttgtgtgtacagtgtgttgtaaatggcaccaggatcctccctaaaaaaagaacaaagtaattagtttggtaactgagacctgtggttttcggcttctgcctcatgatgctgaggttactgggacctgctaaggctctttatgtcatgctatacagttatggaatctgatagtattttacattttctctagtagtcactcacttaataaactttgacagattactgacgatttctcttgatgctgtgtttcagtttagttaaaagtaattttgaaaatcctaggtgagcctgtcactcccgttactttattacatctgttttataactatacacagcccaagacagagttcccaggtagcatagcctatctatgtattccctttaaagtttgtattatgccataatacaggacagttcactgcggtcacccagtgtttgaggagctcggcagtgcccagctgtggtctcacggttgatggatgtgctttaggcggtagtctagggtatggattgtgatttttgagtaattttgtccattccagttctggaacttggatgttttgagagcttggtctgtgaaactaagtacaaactacacctgtctatctacataactcttttaaattcattattttttccaagctaaatcgttcacctccctcacctctcttggtgagtggtaccacacattcttcatctagttagactcttgggatcacttccttttccttacagacatctagtcttaaccagtttttatgtcttaatttttctcaagttgattgtcttagttagggtttgcattgctgtgaagagacaacatgaccaaggcaactcctgttattaagaaaaacatttagttggggcttgacttaatacttcagaggattagtccattatcctcaaggcagtaagcatggcagcatgcaggcagatgtggtgctggaggagctgagagttctatacccttatccaaaggtggaaggcaagtaagaggcaggtttcttccacattgggcggggcctgagcaagggagccttagagcccacgcccacagagacacacctcttccaaccaggtcacacctcctctagccaggccacaccctgggccaagcatattcaaaccaccacttaaatactttaactacatgtatatatgtattgtatgccgactaatgccacannnnnnnnnnnnnnnnnnnntatacacacacacacatacacacacagttgtctttgtatttcaaatactgtttgcttgtttctgtgctctgtttgccttcccgtgtggacctcctacatgctaactgaggcctcctccactgaatcactatggcttgacagtctcactgagttgcccaggctggcctgctggagatgattgctgtagtgtaaatcaccgtgcccagttgggagtggtggtgggtttgttgttttttaaattctattttgtcagagtggtttgttgctttttttgttgttgttgttctttttttgtttttttgagacagggtttctctgtgtagccctggctgtcctggaactcactttgtagaccatgctggcctcgaactcagaaattggcctgcctctgcctttgccttccaagtgctgaggttaaaggcgtgtgccaccaccacctggaggtttgttgcttcttatttaggagttttatgattgctctctggggagaatagttctgtgagctaggaaattagctttatttcttgaactaaaaccctttaatagtgagaagttgcaagatggcctcaggcaagattatagaactgcttgaataactgttgagaagaataaccttgtatgtgactcagctgaacacgcatggctctgtgcacagcgaccctgcactttactgtttgagtacagaggagtttattatgttggtgtcagtcacaggaactgtttgcgtgttcatgatttctcacatactaatccttcagtctggagtgtctgtcctatgctaacttcagcgtaggcgattccagaatctgtcctgatagctcttcagagcccctcccccacgtctactaaacatttttgtttcccctgctagtatatcttaaaatttgcttattttgcttcataattcctgttgaatttatatctccagcatgcaaatgactcttgatacaaatggttaatagttgttaaaaggttagattttgtattgggcatgtgttagactggtatatgttgaattcttgatttctttgttttgatccactttttactttctcttacaatcttcagactctggcacatcgctgagtgagagcagacgtcagcctgaaggtgggagtgatctgaaggtaatacttgcataaagttcttactctaacacacttttctctttaaaatatcctgtctgtaagtgtgggtgtgtgtatgtcctccagccaaaagaaagaggtgatgctcacctggagctgagttacaggtggatgtgagctgccccagacatgagtgatggaaaccaaacacaccccagcaagaacagcacatggtcttcttctctgagccaccgctctagcttcatgacacatagttcttgaaaattgggagggttacataaaacagggtgtggaacagccaatgtttaatgtttattttgcaatattttactttcttttatgtacttaggatcctttgcaagcgccaccagaagagaaaccttcatcttctgatttaatttctagactgtctacctcatctagaaggagatccattagtgagacaggtacatagggacattatgtgacatactaaacagttgcttggtgtttccattttgggtcaaatgaccctttgacagaggtctgagacctaagaccactgaaaaccacatggttgcattatgattcatcacattagcaaaactatggctatgaagtagcaatgagaatagttttatgcttgggatcaccactatgaggaactgtattaaagagtcacagtgccgggcgatggtggctctcatctttaatccagcacttgggaggcagaggcaggcggatttctgagttcgaggccagcctggtctacagagtgagttccaggacagccaggggtatacagagaaaccctgtttcgaaaaaccaaaaaaaaagagtcacagtgttaggaaagttaagagctgctaccctagacttctaataaaaggagatgaagttgttctttgttttgggacagggcttctatatagatcaggttgacctttgcatagtctttttcttttttctttttttttttaactttatttatttaatgtatgagtgctctgctgctcttaaccactgagctgtttcaccagcccagccttattcttaaagcttactgttgatggggaaatcgtgtactgttgaatcagtaaaagcactaggaggattaaatgagtaacttgtggaggtaacgtccacaaagaaggttgcaagcttagaagtagagcttatgtgtagctgaacagatccaatgaaacactgctgacttttgaaacattaatggttcacttctctgtttaatataattgaaattaaattttgttgcaaataggtgctgaagatatttcaatctcaaatcagtcccagtacagggagttttaaccccatgtcctttaatctatagaagagaacacagatgagctacctggggagcggcaccggaagcgccgcaggtccctgtcctttgatccgagcctgggtctgtgtgagctgagggagatgtgcagcggcggcagcagcagcagtagcagcagcagcagcgagtccacagagacgccctcgcatcaggtagtgcttgggtttaagaaattatcttactttttaatatggaagtgtcttgtctgccagaatgtacaccacatgcatgcagtgctttgaggccacaggagggtgtggagtcccctggaactggggttagggatggttggagccactgtgtgggtgccaggaaagtgggttgactaccacatctctgccctagttttgagtgctgcagattaaatccagggctctgtgcgcactgggcaagtgttctaccagttaattacatccccaacacccaacagtcagtgagccaacctctctgcggatctctgcctatctagtttcttagaatagaacctgacctgctgtcaaaacagaatatatatatatatatatatatatatatatatatatatatatatatatatgctcttctaaaaatcttccatattaaaaatttgttactttttaaacttaagtgaaaatgcttttaatacaactgtgttttgctttgttttaacttacttatgagaacattagtctcagtagttttaccctttatttacagggaacactatgcctgatagtgtttcaaataatttgttaaaggatcctacaactaattattacatttaataagacaggctagaacttgaaagctcagcggttaagagccctgactgctcttccagaggtcctgagttcaactcccagcaaccacatggtggctcacaaccatctataatgggatctggtgccctcttctggtgtgtctgaagacagcaacagtatacttagatataataataaattaatcttaaaaaaaaaagactacttttatgtcaagctgactgtattttctggaagagaaatgatgtgtctgcagttaagcagcatcttggtagcaaattgagaatgcctgtgtcctgaattctagagcagtgtatttttatcagttgtaagtaagttgatttgcggatgaacttagtgtatgatttgaagttgaatctcttgtttgcatttttgtgagacagggtctcttatttagttctgactcttggctgtcctggaactcactgtatagaccaggctggttttgaacctacagagatcttccagtctctgcctcctgaatgaatgctaggattaaaggcatacaccacatgcctggcctgaagttgaatcttttaatctcagcactcaggaagcagggacagcagagctctctgaggtaatagccaatatagtgtcacatgaggtaatagccaatatagtgtcacatgaggtaatagccaatatagtgtcacatgaggtaatagccaatatagtgtcacatgaggtaatagccaatatagtgtcacatgaggtaatagccaatatagtgtcacatgaggtaatagccaatatagtgtcacatgaggtaatagccaatatagtgtcacatgaggtaatagccaatatagtgtcacatgaggtaatagccaatatagtgtcacatgaggtaatagccaatatagtgtcacatgaggtaatagccaatatagtgtcacatgaggtaatagccaatatagtgtcacatgaggtaatagccaatatagtgtcacatgaggccccaggccaactaaggctgcatcggaaaacccagatgccagcttggtgtttgtgtgtcgtcactagcactccgtcacactagcctgtgagtcagggaggccttcgtcttcctgtgtttaataggataaactcacagtggtgcttcagataatagtgggtgtgcatataatcacacacgtaggaaaggtcattgtggaagatctttttatggtattgtgggaaccttaaccaaagaaagatgagtggggcttagaaactcagattatcttactgagaaaaagttagtgtgtggattgatttaggaaacaagatgtggctggagcatgggtattgaatagggtggagggtgtgtttagctggacatttgaaaatgttaatgcagtcattctgagtgtaacctcggggctaaggggctctgacttttccttcatgaggtaggacttttgagtaaggtagtaaccttgaacccagtctatgtggtctggggctgagaaggaaatagtggctcgggatgaacccgggagctctaaatgaggcccagaggcaatgcatttacattcgctgcattcttcctccataggatcttgacgatggcgtaagtgagcattctggtgattgcctggatcaggattcagtttctgatcagtttagcgtggaatttgaagttgagtctctggactcggaagattacagcctgagtgacgaagggcacgagctctcagatgaggatgatgaggtgggtttctgtgtctgtcagccttttagtaagatgaagaggccatctattcagagtctctggaaagtcttgctttttcatttgttcaagatagaatattgctttgtggatttgaggtgaaattttatagtttctttgcttgatttatttatttagatttatttgttatgtatacagcattctgcctgcatgtatgtctgcaggccagaagagggcactagatatggttactagccaccatgtggttgctgggaattgaactcaggacctttggaagaacagacagtgctcttaacctctgagtcatctctccagccctttgcttgatttattatagtctcacattactaaataaaaaacttagaggagagtttgaacaatgtttttaaactttttttgagttgatggggtgtttttgttttgtttgttttgctttttgagacttggttttttttttttgtttttgtttttgtttttgtttttttttttggtttttcgagacagggtttctctgtgtagccgtggctgtcctggaactcactttgtagaccaggctggcctcgaactcagaaatccacctgcctctgcctcccaagtgctgggattaaaggccttcgccaccacgcccggcgagacttggtttttctgtatggccctagctgtcctggaacttgctttgtagaccaggctggcctcagatctgcctgcctttgcttcccaagtcctggaattaaaggtgtgcgccaccactgctctgctaatgatggatgaacattctcataatggctggaccacaaagttctccatttggtcttcccatttatgtatgtatgtgtgtgtgtgtatttgtttttgagacagggtaccaccgtgtatccctggctgaccctgaactggctatctagaccagcctggcctcaaactcatgggaatcctcttgcctctgcctcctgattgctgggatgaaaggtgtgagcccctacttctgcccctcccttctcagtactgatttgtttttcaccaatgtaaagcatgcaacgaacagtgtccaataggacccgagtatctctttctcgggagcaactctacatttctagttgttttctgtctaataactctaaatttataaaatgtcttcttgagtgttttgtttggttttaagtatctaacaactcttgccattgcgagtaaaggttttcctatcctgcgtttcctgcttgccttgaactgcatttaactttctttcagaactcttcgtccacagttaatggctcaagctgtttgttttaagacttactgagaattctggcttcttggttgaagggttgaattgatgctaatgaatttgtcttactaggtctatcgggtcacagtctatcagacaggagaaagcgatacagactcttttgaaggagatcctgagatttccttagctgtaagtatatagattcttcaaagaaataaaacacaatgttgagatcagaattaggactataggtagttgtgagccaccacgtgtgtgctcagaacctgagccatctctagcctgtcactatttcatataggtcaccttttgtgtgtgtgtgtgtgtgtaggggaaagtacctagagtctactctattagctaatttctggtatatagtattagatatattcctcatgttctttgcctatttatgtaaaatatgaaatgctgaaaattaagctacatggtatacttttaccttagccacattgaagttattagccttgctatgaacactgactgaagagttactgtcttttttattgaaggactattggaagtgtacctcatgcaatgaaatgaatcctccccttccatcacactgcaaaagatgctggacccttcgtgagaactggcttccagacgataaggggaaagataaagtggaaatctctgaaaaagccaaactggaaaactcagctcaggcagaagaaggcttggatgtgcctgatggcaaaaagctgacagagaatgatgctaaagagccatgtgctgaggaggacagcgaggagaaggccgaacagacgcccctgtcccaggagagtgacgactattcccaaccatcgacttccagcagcattgtttatagcagccaagaaagcgtgaaagagttgaaggaggaaacgcaggacaaagacgagagtgtggaatctagcttctccctgaatgccatcgaaccatgtgtgatctgccaggggcggcctaaaaatggctgcattgttcacggcaagactggacacctcatgtcatgtttcacgtgtgcaaagaagctaaaaaaaagaaacaagccctgcccagtgtgcagacagccaatccaaatgattgtgctaacttacttcaactagctgacctgctcacaaaaatagaattttatatttctaactatatgacccccaaattagacaacatgggtattatttttatacattaaagccagaaaactgtcttagtccacataaaattcacttataatttatcctggagagtaaatatggtgaatattttcttcctttttagggaaatttcacttgtttattttatatttgtgttttaagtaatttgcattggctgtttatattttccttatattttaaataatctccgcttggaaggactttggaagtgtatgtgagaagtcctttccatctcctgcagatgatggtggaccttcctcatcaagggctacagaagtacttgatttctgttttttttgttaataataagaacatttaatttatttagtgtctttcatgtaaagagttaaagactatgtgaaggattgtatatttaagttattgaaattctgaaactgtagtaatctaaaatgtgtgagttgtgggctgcagagaagactcagccagtaaaggcacctgctgtgtacacccactgacacacatttgatccttggaacccccaggaagagtgaaccagttccacaaagttgttccctgatcttcaaatggatgcacgcacgcacgcacacacacgcgcgcgtgcgcacacacacacacacacacacacacacacacacacacagttttaaaggcatgaattgcatctggtggtatgtaagtgaaaacacacgccttattttccagcattttcagctttttgtcataggggtgtggcacaagtgttgcagtttgtcccaggttgaaaagcctgaggctggtagaagcgcctttttgcctcagctccgtggttcctggtggttgcctatgtttcaggcctgtacttaggctaggtttagaaaccagcccattcagaaagactgaatcagaacatggataaagtgaactcattctaagatgactcgtctatccatgtagattaatctcctggttcataataggcctcttccctttgattgaagggtcacgtctaagtatagaaaacataaaactgtaaggtagaggaagcgaaggatagctttgtattaatgttgcgttaaagcttcagagacaagaacaagaacactcctcccacgtgacagcatttgaataggaggcggtgggtgcggcagcctgggcagcttcagtcccgatttacaataaagtaccttgtgtgttattagttcttaaatgtttatttagaaatggcattgatgttatttatttgcaaataaatggtttattgaagaattgtgaaagagatttgtcttacacatttttttgtcagtgattttgtttttaaagatttgttcattatatgtgagtacactgtagctgtcttcagacgcaccagaagagggcgtcagatctcattacagatggttgtgacccaccatgtggtggctgggagttgaactcaggacctttggaagagcagtcagtgctcttaaccaccgagccatctcagcagcccccatcagtgatctttttataattcatttttattttatgttcattggtgttatggctatatgtctgtgagggtgacagaaaccctggaactggagttacagacaggtgtgagctgccctgtgggtgctgggaaattgatccattgctctccacctttttaaaatttgtgtgtatgaataattcgtccacatgtatatgtattgtgtgcatacactgccttgaactacatgcatgcagtgcctgaagaggccggaagagggcatcagatccttaggacccgagttccaggctaggagcctaaccctgtcctctgtaagagcagatgctgctcttgaccacacagctgtctacatgccgcctttttttttttttttaaggtttatatattttatgtatatgagtacactgtagctgtacagatggttgtgagccttcatatggttgttgggaattgaattttaggacctctgctggctgcttgctccggctcaaagctttatttattataagtacactgtagctgtcttactataagagggcatcaagtctcactacaggtggttgtgagccaccatgtagttgctgggatttgaactcagaatttctgggagagcagccagtgttcttaaccactcagctatctctccagcccctaatagctacaaatttaaatactttaggcaattttgcctagggatttcccaatatattatattgcaatggattttcttttgagtcggagaaatgtttgcgatttaacttaaagttaagatacttgtgtggaggagatggctcagtgcttgtcttgtgccctgattccatccccagaaaccgtggatatggtggcactcatctgtaaccacagcatgagagatgacaggcagacccacaggcgaatcatctggaagcttgctggtcagctggcttgcagtatgcatcatgacagaaacaagaggctaccacaaggtggaaggccggagactgttaggttttgggtgttgctaaatactggccctggttgcctccaggggctgggaaattctcacttaaacccagatgatgctctgtaatcttgtcccccaagttatccccgattggcgaataaagatgcctgcagcctgtagctgtgtggaagagagacaggtggggtttgggggtctgaggcaggaagaagaaagaggtggagagaggagagtgtaggtgagtctggaagaagtcagtgctcttaatccctgagccatctttctagccccatatagcagtcttttctagtttgtagatttttgttatgtttgcaaacaaaacagtagtggaaagagacaacattcactatatgaatattctttattgataatcagataatgtaaataaaataagctcagaggtagtcatggtccctcccaagcaaacgttgtaatcttagataatctgagaatttatttatttttctgtgtagccctggctgtcttggaactcactgtgtagaccaggcaggctggatttgaactcagagtcccctctgcctctgcctctggagtactgggattaaaggcgtggtccagcactgccaccactcaacctgggcacctttaatagcttctgcttctgtgcttttaatggcaggaatcacttagaagcttgttaaacaaaaacccgcatgaagtctctcgcacagagctgtgggttggcttgtgagcttaaggtttgattaaacggcctgtgagacacagtacagcatcttattagtgatgcaagtctagaacaaactcggtgaagaatctgttgtaggcaccaagaacccgatgctcttcacctaatccagcatcattctctcccgtacctgaggtcaccaggaaggcagaattgagctcacaaaccttcactagatgccccctccgagactgagaatgaaactcctgttgcaataggaaaataagtgtgctatatggctttgtatatttttcctagaaacagatacgtctcaacccagcttcagctcatacattggaaagcagatctgatgttaataccattttagtacaggcagagtctgagaaaactgggactgtttttgcttgtttgaaacgggggtttttctgcgtagccctggcggtcccagaactctgtagaaaagactggccttgaactcacagagatccacctgcctctgctgcctgggtgctaggattttaccatctcaattcaaaaatgggcacgcatgtaaactaggcactttgtgaaagtttccttgaaaaggacgtggtttttggtaaccagcatttccgttttcaggtcacctttagtaaggtatattgctttcaaaacagttacagacccaagtattccttctgctttctctacctggcagagggcaacagaataatttcctggttatgttttgtcttgggggtagttaatggagattagacccaagcctttgcatatgctaagtacactgtcactgagctacacccctcaccctgttttagtgatttttacactgggttttgatatatatttctgatttaagtaatgtaacctgaatatggacacagcggaccaggtctgtaatagctactccagcgtctacggcaggcagatccaaagccagtttggcttactatgagttccaagtgcaggctacacagcttagtgaaatgctgtgtctgaacaaaaagtaacaaaataaagacgtagctgtggctcaatggccctgtgcaaagccctggcacagtctctggtaagacacgggcacttgcaagttgtttcagtaccaagtctccggttaggcccatgagcagctcagcgaacagctcatttcctttcacggaatcttaggaaagggtcaaccagtcagaactcagaacaccagctgatggcgaaccaagtttgctcttacatatcttactggttttgcttttctaagatggctagtccaggctagccttgagctgtgtcgatcttgcctcagcctcccaagcgctgggataatagttcaccaccacacctggcttcgtcttatatatatacttcaaatgtaatatacccagatccctttttgaactattaatacgcgccttctgggatataagttaatgcttatttaaataaaatgatcaagatactcatgctatttccaaatttagaagcggttaaaaagctatgcagactattgatattaaaatatagattaggtttggcaccaagaaagggcaccagggtgcccacgtatctctttagagtctcaagccttcatcgcctgtcaaaccccgcatgttcttacttcctgtgggaaatgcatgtcacttagaaacctgcacctcggagttactgttaatgttcctgtttgatatttatccttttttttttcttttaatttatttacttttgagacagggtctgtctgtgtaaacgaagacatccgcccacctctgccttctgagtgttgggattaaaggtgtgcgccaacacgcccagctttctcttcttctaatgttagaataaagttacttttacaggggacactttacttcgaactgtaagaatttgttttctggtctagaaggcagattggctaacagctaatgcctttccctcaagcctcacagctcacccatttgcatttatctttggattttgttctttgacatacacgtgaaaagtgtgtatgtgtgtgtgtgtgtactagtaagctgaatgttgccaaacataaaacgcatttacacaaaattactcagatccttagcgttctggaaaggtctgtagcggtagctgagacacttccccatccatttatttcctgttttttggctagactctgagaaattatttctcaagcagatccttgtcttaaagagctcatggcgtgctagagaaggccagcacagagcagttccacaccacgatgctgtaaagtcactagtcaaaggaacttctttgaaggatcggccttgaacttgaccacctggaactccatgggcttccccgttgaagacgatgcttggaattcttccttttaaaaaatttatttattttacgtgtatgactacatggttgctgtcttcagacacaccagaaggcagcctcggatcccattacagatggctgtgagccaccatgtggtggctgggaattgacctcaggacctctggaagagcagtcagtgctcttaaccccccatggaatggagttttactgagcaggaaacaagacgtgacacaatcagaatccagacctgggaccgagagcacttactgtgttgtgtttagggagcaggagagctttgggcagcccagctccccaggttctgtgtggaagacggacttggcgaaaatacccatgagcagcagctgggtcagcggcggagggacgctaactggcctggagaggctgtatacagcagcttccagtgactggatatgggaatcgaacagccttgcatggcgtctcaacagtcaaccggatgaactgcagttcctaggcatcgtagtcaggtgggtgtgtctggtgagcagctggagttgcatctgaggctcaggcaagggactggggttatacaggaggggtcatcttcgtaggactgtggcatcaggtgcagggggcaagggcaaaggcacgggagacagaggccactgcatctgtacccacatcagacatgtttgtccattttctctcatttggccttagaccattggcaagagtaaatgctcttagtcccgttatctagaaatttcttcctttggggagaaccacttatagacaatatcagctctctacaaataacacgaaaggtcgtaacacagcaagtgaccagaaagtgcccgtccttgcggctctgatccacgtggctctccgtagacaaattgtttttcttgtagggatatctgttttgcttctgaactttcttacaagtgtttgggactccttcggggtggcgtttgtgtgggcagcatgagctaagcagtgacctccactttatccagactgaagatggatttggtcgttacaggtcgctctaggccaggtttggaaacatccggttttcttcttaaggaaaacagtggagtctgtcccaatcgcagtcccacaggagggagggttgccataaccgggagtaaccaatccctgattcccggaagtcgagtttcacaccttgctttatttaaaaaatacgtacaaaagagtcatgaaaaacacgcccagactaggctttgtggcagccgagtggcttggcatgaatttgtacagcggaatcatcgggcacgaaggattggatacggagatggaatccggctgccatcgcagcgggaggtgaaaatcctttttaagagcactgaagggctgggatttccctggaatagtaagcttcgtgaggtaggagtcgtgtccagggactgtaacctgagaaggaacaagaaacaattacttgagtgatttcagatgggtgtgaggtccacgcagaagacagatctccacccctttgagcggtgcatgcgtggcttgaaagcggtccacgcctccggggctatagcgcccggaaagttgccagtgtttcttgatgtaggcctttggtgcaaatgctaccaagaattacaaaatgaagtaagaacagagagggggttcagcatctagtgaaggaaaagactaaatggaggaagccacgactgattctgccacggtcattttcagtgtgccggggtaaaggtgctttttttggaccaagcctagagtatccttattggatatcaagattgtgagtagattcttccttcaacttactcccattctccttgccactgacctaaggtgtataactctacttcactccccacccctcctttttaaaaagaaagaaagaaacaaaacaaaaccaaacccaaaaccttgcacaagagcggtttttttgcctgcacgtgtctaccacttgcatgcagtgcttacagaggccagaagagggcaacagatttcctagaactggagtcgcggatggtcagttgtgagccacccggtggattccagaacttcaacccagaccttcggagcccttctaccactttcttttaaaacttttaattgtgccaggcggtggtggcgcatgcctttaagcccagcacttgggaggctgagacaggcggatttctgagatcgaggccagcctggcctacaaagtgagttccaggacagccaggactatacagagaaaccctgttttgaaaaaacaaacaaacaaacaaaacccccaaaaccaaaaccaaaaccaaacaactttcaattgttttaaaaactagttttgttcttgtgaatcttcaggtaggttgcgattgctcttggagttgctacatagaccaggttgacctcaaactcactgggtccacctgcctctgggcagtgctggcattcagggcttccttttgagcactttatatattctagaaactcatctcttaatggagaagtcatttgcagatctttttccccaggtctgaagacacagggacaatctgctcttggctcctttgccatgcttcctggttcgtttttctttgtctatcttaattttgtgcctttggggctctatctaaaaaaaacccatcgctttacataaatggcttgaagtgtttccattgttttcaagcacgcacacacacacacacacacacacacacacacacacacacacacacaatttatacctaggagaagctcaaacatctgcatctgcagctgtggccaggagaagtgaatggtaggtctggagccacccggtagctctgttcctggagctgggggacccagctggcaccacctgtctaagttcctgattgacaggtaggactgaggggctgtcttgctacagtgccaatgctgtggttggcagggactcccctagatctcgtgggggcagactgagacagcagcggggcttgtggcatgccacatggtagcagggggggggggctgtcttttcttcagtaaaatgtgctctggaccaaggcttcagccagagtccaagatggctgacagctcctatgccaagatggtgtttggcagtggctatggaagggcaaggaaaatgacaaagaaaagccactttcagaagagctctctagattggatttaaagcttgggattcctcattcatggttccctgccacactggtgcttgctggcatctcccatcgtcctcagttcacaggcaggcctgggtgccagggctgaagctgctgagtgtttctctctttcctctggggtcatttccaggcacacctttgtgcatcttcctaattccccctctttcgctcctaccatgtggtgtctgcttagctgccctgacttctctggcagggctacctgtaaggcaccttggcttacactggcttcctcctgggctgattgattaggttatccgtgtgtgtgtgtgtgtgtgtgtgtgtgtgtgtgtgtgtgtgtgtgtacgcgttagaatagccgtcttgagctggggatggttcactgggtgaaagcgcttgcccagcaagcccgacatgattcagtctctagaatgtatgctggaaggagcaaactgccctcaaagctgcttaccaacttctccaagtgtgctatagcccacagatgcgtacataattgagaaaacatggtaggtgcttggttaggaaaacatatgactttcctcccggagacagtgtttctctgtatagccctggctgtcctggaactaactctgtagaccaggctggccttgaactcagatctgcctgcctccgcctcccgagtgctggggtcaaaggcacatgccactgagatgccaaagctttgaaattcagactccattttagaaaacctgacctaagtgtgaactcaggtagaccaacaggctggtatctaatagcattagtttccaagttgccccccaacagaacctgagcctagctcccgtctctagtctaatccccaacaagagcagagtttccaggttacaccctcaacaggaccagtgtctccaggctatttccccaacaaatctgcacccccaagttacaagcctaccctctgcctaacgaccaccaatgcagaggggagcagaagttaagtctatgatagactcccagcaccagccaatcatgttaaaggccacaggagctttccaatgagatgcttgcacatgtactccctgcttgctgcttactataaagccttgacccatagacattctgggctccccaccaccaccaccaaaactgtcctgccctgcgtaatggtggtgcgttgggggatgggcgggagggttgttcgaacagaataaagaccctggtgagttgcaccagattggctcctgtgtgtgttttgggggatcactaacatttccctggcgcaacaccatcactgcgagactatatgtgattccccctcattggtttgtttctgccttccactcctctcctattgcaggcctgatgttaaccttgccttccaagccttgctg

SEQ ID NO: 1182 - DNA, 1710 bp, Mus musculus
gaggagccgccgccttctcgtcgctcgagctctggacgaccatggtcgctcaggccccgtccgcggggcctccgcgctccccgtgaagggtcggaagatgcgcgggaagtagcagccgtctgctgggcgagcgggagaccgaccggacacccctgggggaccctctcggatcaccgcgcttctcctgcggcctccaggccaatgtgcaataccaacatgtctgtgtctaccgagggtgctgcaagcacctcacagattccagcttcggaacaagagactctggttagaccaaaaccattgcttttgaagttgttaaagtccgttggagcgcaaaacgacacttacactatgaaagagattatattttatattggccagtatattatgactaagaggttatatgacgagaagcagcagcacattgtgtattgttcaaatgatctcctaggagatgtgtttggagtcccgagtttctctgtgaaggagcacaggaaaatatatgcaatgatctacagaaatttagtggctgtaagtcagcaagactctggcacatcgctgagtgagagcagacgtcagcctgaaggtgggagtgatctgaaggatcctttgcaagcgccaccagaagagaaaccttcatcttctgatttaatttctagactgtctacctcatctagaaggagatccattagtgagacagaagagaacacagatgagctacctggggagcggcaccggaagcgccgcaggtccctgtcctttgatccgagcctgggtctgtgtgagctgagggagatgtgcagcggcggcacgagcagcagtagcagcagcagcagcgagtccacagagacgccctcgcatcaggatcttgacgatggcgtaagtgagcattctggtgattgcctggatcaggattcagtttctgatcagtttagcgtggaatttgaagttgagtctctggactcggaagattacagcctgagtgacgaagggcacgagctctcagatgaggatgatgaggtctatcgggtcacagtctatcagacaggagaaagcgatacagactcttttgaaggagatcctgagatttccttagctgactattggaagtgtacctcatgcaatgaaatgaatcctccccttccatcacactgcaaaagatgctggacccttcgtgagaactggcttccagacgataaggggaaagataaagtggaaatctctgaaaaagccaaactggaaaactcagctcaggcagaagaaggcttggatgtgcctgatggcaaaaagctgacagagaatgatgctaaagagccatgtgctgaggaggacagcgaggagaaggccgaacagacgcccctgtcccaggagagtgacgactattcccaaccatcgacttccagcagcattgtttatagcagccaagaaagcgtgaaagagttgaaggaggaaacgcagcacaaagacgagagtgtggaatctagcttctccctgaatgccatcgaaccatgtgtgatctgccaggggcggcctaaaaatggctgcattgttcacggcaagactggacacctcatgtcatgtttcacgtgtgcaaagaagctaaaaaaaagaaacaagccctgcccagtgtgcagacagccaatccaaatgattgtgctaagttacttcaactagctgacctgctcacaaaaatagaattttatatttctaact

SEQ ID NO: 1183 - DNA, 1470 bp, Mus musculus
atgtgcaataccaacatgtctgtgtctaccgagggtgctgcaagcacctcacagattccagcttcggaacaagagactctggttagaccaaaaccattgcttttgaagttgttaaagtccgttggagcgcaaaacgacacttacactatgaaagagattatattttatattggccagtatattatgactaagaggttatatgacgagaagcagcagcacattgtgtattgttcaaatgatctcctaggagatgtgtttggagtcccgagtttctctgtgaaggagcacaggaaaatatatgcaatgatctacagaaatttagtggctgtaagtcagcaagactctggcacatcgctgagtgagagcagacgtcagcctgaaggtgggagtgatctgaaggatcctttgcaagcgccaccagaagagaaaccttcatcttctgatttaatttctagactgtctacctcatctagaaggagatccattagtgagacagaagagaacacagatgagctacctggggagcggcaccggaagcgccgcaggtccctgtcctttgatccgagcctgggtctgtgtgagctgagggagatgtgcagcggcggcacgagcagcagtagcagcagcagcagcgagtccacagagacgccctcgcatcaggatcttgacgatggcgtaagtgagcattctggtgattgcctggatcaggattcagtttctgatcagtttagcgtggaatttgaagttgagtctctggactcggaagattacagcctgagtgacgaagggcacgagctctcagatgaggatgatgaggtctatcgggtcacagtctatcagacaggagaaagcgatacagactcttttgaaggagatcctgagatttccttagctgactattggaagtgtacctcatgcaatgaaatgaatcctccccttccatcacactgcaaaagatgctggacccttcgtgagaactggcttccagacgataaggggaaagataaagtggaaatctctgaaaaagccaaactggaaaactcagctcaggcagaagaaggcttggatgtgcctgatggcaaaaagctgacagagaatgatgctaaagagccatgtgctgaggaggacagcgaggagaaggccgaacagacgcccctgtcccaggagagtgacgactattcccaaccatcgacttccagcagcattgtttatagcagccaagaaagcgtgaaagagttgaaggaggaaacgcagcacaaagacgagagtgtggaatctagcttctccctgaatgccatcgaaccatgtgtgatctgccaggggcggcctaaaaatggctgcattgttcacggcaagactggacacctcatgtcatgtttcacgtgtgcaaagaagctaaaaaaaagaaacaagccctgcccagtgtgcagacagccaatccaaatgattgtgctaagttacttcaactag

SEQ ID NO: 1184 - DNA, 52242 bp, Homo sapiens
  misc_feature (51242)..(51261): "n" at positions 51242 thru 51261 can be any base
cgagtagctgggattacaggcacctgccaccacgcctggctaatttttgtatttctagtagaaacggggtttcaccatgttggccaggctggtctcgaactcctgacctcagatgatccgcccgcctcggcctctcaaagtgctgggattactggcgtgagccaccgcacttggcagttcttttttttcttttttctttgagatggagtctcgctgtgtcgccgaggctggagtgcagtggcgcgatctgggctcactgcaagctccgcctcctgggttcatgccattctcctgcctcagcctccagagtagctgggactacaggcgcccactaccacacctggctaatttttttgtatttttttagtagagacggagtttcaccatgttagccaggatggtctcgatctcctgacctcgtgatccacccgcctcagcctcccaaagtgctgggatgacaggtatgagccaccacgcccggccagttcttttagtttttaaagcagtctcatttcagttattaatattgacttcttcattttgaaacttcaaataatatttgattcaaagctttcctcctcttaccagagcaggctggacctgtggccctggtgacctggaattggaaatgggggtgtgggatgtagggcataggtcttcttgtcacatcccattctgtcttcccaattattacttgtggtactcagaattccaagaatgactcccagtgaccttgcctatggatgatcccctcccctttaagcgtgggaggaacctgtgaatatgaggagatattactcccatcattctgttacattacatggcaaaagggagatgatctgggttggcctcatcaaatcacatgagcctttgaagtcagagtttttttctggctgatagcaggagagtaagtcaggttcaaagcacaagggtgattcaacaccctgttgctggcttgaagatggaggggagtgtgtagcaaggaatgcaggaagccttcaggagctgagagtggtcctcactgctagcaagaaaaaggggactaccgtcctacaaccacaaggaactgaatttggctgacaatttgaataagctagaaagcaggttcttccctagatccttaagagcccaagctggcccacaccttgatttaggctttatgacacctggagcagaggaaccaggtgagcctacctggatttctgatatatggactgtgagctaataatttgtgttgctttaagctactacatttatggtaatttgttacacagccatagaaaaccacacatgactcctgccatcccgataccagttggggtggcaaggaggaaggagaggaaaattacatttctttacataattgcccttcaaaattagttgcccttttattagcaggacataactgtggttcattgtatgaacaacctcaactagatcatgggaaacatttctgtccctttctgttggttgtcccagtttctctgattattaccaattgaccaccagttctcttcatctggcaggtgtccaaatgatatttctccagaaagactcgtggcatggtcctggtaggaagttgagtaggggtatatgaatgaagctcaacttctttctccctagtccagcacattctaccaatagatattctatgtcttttgcttccagggttctattacccaggtagtggccattttaggagttaccagcagaactgcttatactccttccatcttctccaggaaccacttaatctgggggaaactccagcaacctttccaccccaaagagtggggatgctgttcaacttcactacctttcttctgccagctgaatggctctgtaactttcagactagatacgatcacagatctcagatttaggtcagctgggagattataaactcttcgttccacgaaaagatgacctctattattcctggtccttccttaaaactcttaaacgtggccgggtgcagtggcgcacgcctataatcccagcactttgggaggctgaggcgggtggatcacctgaggtcaggagttcacgaccagcctgactaacatgatgaaacatgtctctactaaatacaaaaaattagctgggtgtggtggcacatgcctgtaatctgagctacttcggaggctgagacaggagaatcacttgtatctgggaggcggaggttgcactgagccgagatcaagccattgcactccagcctgggcaataagagcaaaactccgtctcaaaaagaaaaaaaaaactctcaatggtaaaagttatcaaaccagttcagcctgtattgcccttgtgggaaccagagtctcaggccaagaattgggccttatttgaacttagctttagagaattgagcgttcttaacagggcaatattcctactaaaatctctgaaatatttgttatcttctaagagcaggaactcaattatgctcccatatcattgtgtaatatttttcctcttaaaaattcagttcataaatgtccaaaaaaagagatctattgtaactaagtagaattttatctgagtaaaacaaggaaggtcaatattggaaatctatcaatataatctcaccacatagacagattaaaggagaaaagccacagggtcatttctaggtgcataaaaaagcagtgtataaaactgaacactgattcatacttttttataagctcaaaaaaccaggaatagaaggaaacttttatgtaataaagagcatctacctaaaatttacagcaaacatcacattttaaaagcatttttactaatgtcatgaataagatgaggatgcccactatcattgctactattccattccaatggttgtaagaaaatgaaaaagaggtttaaggaagagacaagttagtgatttttgcatatgatattattaacatagaaaatccaagagcatctactgaaaaactaatagtactgtataacaaaacaaaatacagcctgtaatcccagcactttgggaggccaaggtgggtggatcacgaggtcaggagttcgagaccagcctggccaagatggcgaaaccccatctctagtaaaaatataaaaattagccaggtgtggtggcacgcacctgtagtgccagatactcaggaggctaaggcagaagaatcctttgaaccagggaggcagacactgcagtgagccgagattgtgccactgcactcccgtctgggtgacagagtgagactccgtctcaaaaaaaacccaaaaaacaaaaaacaaaaacagaaagaacaaaaaagcagtattgctggctggctataagatcaaaacacaaaaatgagtaattgtttcatatgttagcaataaccaaatagaaaataaaatgttacggctgggcatggtggctcacgcctgtaatcccagcactttgggaggccgaggtgggcggatcacgaggtcagaagatcgagaccatcctggctaacacggtgaaaccttgtctctactaaaaatacaaaaaaaaaatagccgggcgtggtggcaggcgcctgtagtcccagctactccggaggctgaggcaggagaatggcatgaacccgggaggcggagcttacagtgagccaagatcgcaccactgcactccagcctgggtgacagagcgaaactccacctcaaaaaaaaagaaaagaaaattttaaaaggtgtaatttaaaaacagcaataaaacttataaagcacttcagaaaaaagccagccaaacatacaacagctttaaggaggaaacaataaagcattattaaaggatgttaagagagacctaaaaatggagtgatatatcatgttcttatctgggaagaattcatactgaaaataagtcaaattagtctaacaatccaatgcaatgaaaagcaaaatcccaagaggattctttttgtgaattagacaaactggttctaaaagttaacatccaggaagagccaaaacaatactgaaaaagataaagagagcttttcctgttacatattgaaacttactctaaggtttactattctgttgcccagcaagtcctcttataggtatgcagcctactgtccgtgttgtttatggattcataaatttacagtgaatgtataaaacacagacttagtggacaggcatcaaattgatcattatcaagagaagggaggggaatgggataaagaataacagtgaaattttaattttttaagcaatgtttcattaaaaaaatttatttaggccaggctcagtggctcacacctgtaatcctagcattttgggaggccaaggcaggtggattgcttgaggtcgggagtttgagaccagcctggccaacatggtaaaaccccatctctactaaaaatactaaagattagccaggcatagtggtacaatcttggctcactgcactcagtgtgggcgacagagcaagactctgtttcaaaaataaataaataaataataaaaaaaatatgtttgatgcaggaatgacaaatgtgaattctgggtagtggtttctttttttctttttttgttcttcagagcagaagaacttgaggcggtggtttcttttgttgaatattaattgttctgtgaatgtttctgtatgtttcagtcaaacaaaaagttgattaattttcaaagtaaaaacaaaaagtctttgtattcactacttgctgggattttgctttttattttttactttatttatttatttattttttgagatggagtctcactctcactctgtctcccaggctggagcgcagtggcatgatctctgcctcccaggtttaagcaattctcctgcctcagcctctggagtagctgggattacaggcgtgcaccaccatacccggctaattttttgtattttagtagagacagggtttcaccatgctggcccaggctggtctcgaactcctggcctcaggtgatccactcgcctcaccctgccaaagtggtgggattacaggcatgagccaccatgcccggcctattttttacttttttattttccaggacagagtcttgctctgccgcccaggctcgagtgcagtggcgcgatctcggctcactgcaacatctgcctcccaggttcaagagattctgctgcctcagcctcccgagcagctgagattacaggcttgcaccaccatgcccgcctaatttttgtatttttagcagggacggggttttacatgctggtctcaaactcctgaccttcagtgatctgcctgtcttggcctcccaaagtactgggattacaggcgtgagccactgcgtccggcccggattttgccttttaaataacactattcagttccagatgtttggaaagacataaggaatttgaactacttctgtaattttagatggtctcataaatattgtgaaactcagcattctaaacacggtttctgagctaaatcttgtttagttttcaccatgctttaaagattagttgtggccaggcacagtggctcacgcctgtaatcccagcattttgggagggtgagacgggtggatcacctgaggccaggagttcgagaccagcctggccaacatagtgaaatcccgtctctactaaaaatacaaaaattagccgggtatggtggcacaagcttgtaatcccagctactcgggaggctgaggcaggagaatcacttgaacccaggaggtggaggctgcaatgagctgagatcgtgccactgcactccaacctgggtgacagagtgagactccgtctcaaaaaaaaaaaaaaaagaaagacaaaagattagttatgactaataaatacaagtacgaagtggcccttgggtcaagataagtctgttgtagacttttttttttccccttgagacatggtctcactctgtcacataggctggagtgcagtggcaggatcacaccacaacctatccgggctcaagccatcctcccagctctggctcccaagtagctaggactataggtgagtgccaccacgcctggctaatttttttttgcaatttatagagacagggtttcgccatgttgctcaggctggtctcaaactcttggcctcaatagatcctccagccttggcctcccacagtgctgggattacaggtgtgagccttgtttgcagagtttaggtcccagagaatataaagacactcaaagtatctcaacctcttggaacacctcttgggcatcaagaacaacgctactagaaataagcagtttgcctctagagaaacttcaagtaagcacaacaaagggcaaagtgacacaagataactgtggaatgcaagcaaacagcagcagctggtctgtatttttttaaatggcaaagtcacaaacaacagcaactgcttttagagtgagcaggtagtttgctttcttttttttcaaatggaactcactttttaagtgatgacatgcacttgggggtgggtaggtgtgagttcatttgtgttttgaaatcccaaattaatgagcatgataaaccgctattgctggccctgtctgactctctactctgagtaattggtgggttccccccaaccttctcctaaccctcaccctttttccctttccattgacttgggacagtccttgtcaaagtgccaatcacagtgggaaggaggagaaggggggaggtcacagtgcatgggattcaaggtcacagtgggcggagcaacggggatcaccaggcaagtaagtcaagttcccgctgctcaagtccagctgtctgccacggtagtgcaacccttggcggacgacccaggacgcgttgacgcggcagtcgcgccatctcttcttgcctgcatttatctgcgctgtttgaagccgtgtgacccatcaggacccagaggctgtctgatcacattattgggctgtctgctgtcttcgggttaggagatcctggttggcctgaagggaagaagatcagaggaagacctatcgaggatgggtttctcctgcttctcctcgggttggcgctgcccaggatccgcttcctggcctcggtgtactcggcttcccactgtgccagggacttgactggaagggcgggcctgctagcggacttggggctgctgaccacaccgttgctggtgggcctcttgaggatgcggacctgtggagggggtcccgggggaaaattatcatcctgaatcacaatgggcactttgggagatttgaatttcctgctttctgtgtgatcttcagttttttttccagacgtctatttccccgctgtctgccgtctcctcccagctctcagcaacctcctcatattccatcttactcgccactttccagatcgcttgctttcttatttccacattttctctgacttttgcagtattcaatattattacctgattctgatttttcagacatcactatatggtccttggctttttggtcgttcctctcattcctttgctgtttcaagctctgttcccagcctaagctttttaccaccgaattctgttctgtgacccataacttaaaactaacccaacttttcattccctccagactttttttggtaagcagtatcatcatgctttaggtggacactgagtcatactgctgtggtagtgctggtacacgtagttttgaataccaggttcttgagtgaatcctttttacttctctctctctcccccacccccgcttctcccttctgccttcatttctgacccttcttttctggttccattagaaaaggactaatcttatcagttctgcctttttttttctgctctaataattttgtcaagataattttttcaaagcacaaggccaatgagaagggggaaagtcggtccagaaggcagccggcccgactattctgagtttgaatctactcttggtggtcctgttaaaatacagtttgaagcaaatcacttgtttttatgcttctaatgtctactctgtcgaaagcccaaatttccttgcttggcatttaaggagactccaagttcttaaaacttcttcttgactttcatgcaagtcaaacggatttatttattgtatctcaaacagtcctcttatattttcctttctgtattttttgataattttcttgtgcctggaatattctctgcttttatttaagtctcaccatctttcaagacacaaaatatgtgtgatctctgaggcctttgtgaactgcctccagcatttactaagcaattaattctgtctctgaacttttatagcacaaacccattcgttcacttgatatttaacaaatatcaacctctatcacttatctcttttttttttttttttcttctgagatggagtcttgctctgtcacccaggctggactgcagtggcgcgatctccgctcactgcaacctctgcctcccgagatcaagcgattcttctgcctcagcctcccaagtggctaggattacaggcgcccgccacggggcccggctaatttttgtatttttagtagagacaaggtttcaccatcttggccaggctggtctcgaactcctaacctcgtgatccacccacctcagcctcccaaagtgctgggattacaagcgtgagccaccgtgcgcagcctatcacttatcttttcatgcttacattttctcactgcttgagattttctttcatccagggtcaagcactgagtctattagaaaccccactgtatatgatctgatgaagatgagattatctttttaaaagccacatattaaatctcttaagttaataatattggcaatcaacttaaatcaactgagtgaccactatgtttaaggaagtttcctttctggtaggctgggaagcgggagaagggaaggatataactttataaaaaaaaaaaagctgcagaagggaaggatataactttataaaaaaaggtccttgttcacaaggagctaatcacttactggccagagaagaaacgtgttccttctttgcaatggctgtgtttttgggtttagctaactcaattctttatgtcctcaatttatgagaccgcatcaaaaacgtttttgccacatctctgtgggaaagtaggtgagtcagaatgagtgcataatatataagtatatattttaatgataatgaatgtgtagattaacaaacccaaactttgtttttgtttttttgagagtcttgccctgtcgcccaggctggagtgcaatggcatgatcttggctcactgcagcctctgcctcccgggttcacaggattgtcctgcctcagcctccggagtagagtagctgggattacaggtgaccgccaccacgcccgactaatttttgtagtttttagtagagacggcgtttcccatgttggccaggttggtcttgaactcctgacctcaagtgatccacccgcctcggcctacccaaagtgatgggattacaagcgtgagccaccgcgcccagccaaacccaaacattctaaaagcgcagagtaaccgctcccctccccgccaacggtaaccagcatcttcgttctccaaccagaacagctgtatgcaccggtgtataagcctgccttaagtgctatttttaatcttttttaaaaacaggccttaaaataactcatttgggtacaactccagcggctggtggagtgggcttaatatattaaacagctgttaattttggtttctttttggtaacagcgacacggagatccgcatttgtcgcagtttccaccgcgggcgggaagtgtaaacacaagaaatacaaacatagcgcaacggctaaaggagtgtcacagcgccaaaccttgctggctccgcgccaggccgagccccaccctctcagctcgcggccaacacccccaccccgcctcacagcccgccgcgcccgcggggcgacaccccccactccatcatcccggaggtggtgcggccgagccccggacccaattggcggaagcggggccggttgtgtgcgcgcgcacaaatgcccggatgcgccgcgacgacccgcgcgctcccctcgggcggtagggggcgcgcaccgaggcaccgcggcgagcttggctgcttctggggcctgtgtggccctgtgtgtcggaaagatggagcaagaagccgagcccgaggggcggccgcgacccctctgaccgagatcctgctgctttcgcagccaggagcaccgtccctccccggattagtgcgtacgagcgcccagtgccctggcccggagagtggaatgatccccgaggcccagggcgtcgtgcttccgcgcgccccgtgaaggaaactggggagtcttgagggacccccgactccaagcgcgaaaaccccggatggtgaggagcaggtactggcccggcagcgagcggtcacttttgggtctgggctctgacggtgtcccctctatcgctggttcccagcctctgcccgttcgcagcctttgtgcggttcgtggctgggggctcggggcgcggggcgcggggcatggggcacgtggctttgcggaggttttgttggactggggctaggcagtcgccgccagggaggagggcgggatttcggacggctctcgcggcggtgggggtgggggtggttcggaggtctccgcgggagttcagggtaaaggtcacgggggccgggggctgcggggccgcttcggcgcgggaggtccggatgatcgcaggtgcctgtcgggtcactagtgtgaacgctgcgcgtagtctgggcgggattgggccggttcagtgggcaggttgactcagcttttcctcttgagctggtcaagttcagacacgttccgaaactgcagtaaaaggagttaagtcctgacttgtctccagctggggctatttaaaccatgcattttcccagctgtgttcagtggcgattggagggtagacctgtgggcacggacgcacgccactttttctctgctgatccaggtaagcaccgacttgcttgtagctttagttttaactgttgtttatgttctttatatatgatgtattttccacagatgtttcatgatttccagttttcatcgtgtcttttttttccttgtaggcaaatgtgcaataccaacatgtctgtacctactgatggtgctgtaaccacctcacagattccagcttcggaacaagagaccctggttagtatttttgtctcgtgtaacttttaagaataatttattttatgaagtgataaactaaatttcgtatacctcaattgtagcatggctctgtaaataaaattgtatgtgcatagcttaaagtgtgctacctctggcgtaactgcgtggagttaaaaactgttaagaactggtcagtatttttttagccatttgccacatttgctttaaaaattagttccattacattgttaagcgtggttgaagttacgtttgttacgtgactgatttttttttcctttttgacctcccagtatttaatttttaaaaatggtttctaaaagtcaaaaaaattattcgtgcttgttttaaagatttttgtcattagagaaattttaaagtaaaacctgaaaattccaggctttttgctccatgtttccttttagattttttgtgtgcgtacccacatatatttacatttgaatttaaatctatgttattgtcctgtttgttgtactaacaagatgaaactgtagttgttctgtgacttgcatccttgtcaataaataaagtctacagaattctttttaatggctgcatagtattccacagcatgagtataccattttaaaaattatttatgcctttactgataggtttttaaaaattgcctcctgtttttgagtattacagatagtgccgctttgtacatgcatcccgtgtgactatttctgtaagaaagattttatagaattataggctggcctcggtggctcacccctgtaatcccatcactttgggaggccaaggcggaccgatcacctgagatgaggagttcaagactagcctggccaacatggtgaaaacctgtctctactaaaaatacaaaaattagtcgggcatggtggcgcgcgcctataatcccctgctgaggaggctggggcaggagaatcgcttgaacccaggaggcagaggttgcggtgagccaagattgcgccatttcactccagcctgggcgataagagcgaaactccgtctaaaaaaaaaaaaaagaaaagaaaaagattttagagaattagaactcctgagttctcaattttactatttgattgctactggtaacttgctcaccaaaaggctctaacagtttcactcctgccaatactgaatatcaccaatctttaattattattattatttttttttttgaggcggagtcttgctctgtctcccaggctggagtgcagtggcacaatctcggctcactgcaatctccgttccccgggttcacgccattcccctgcctcagcctcccgagtagctgggactacaggcgcccaccaccacgcccggctaattttttgtatttttagtagagacggggtttcaccatgttagccaggatgatcttgatcccctgacctggtgatccgcccgcctcggcctcccaaagtgctgggattacaggcgtgagtcactgcgcctggcctcttttattattattactatttttttgataaaaggtactgtaccattgtttaaattcatttttctctagtttcttggtgaggctgggcacctttcctttttgtttttgtttttgttttttttgagacagagtttcactcctgttgcccaggctggagtgcaatggcgagatcttgtctcattgcaacctctgcctcacgggttcaagcgattctcttgcctcagcctctggagtagctgggattacaggcatgcgccaccacgctcagctaattttgtatttttagtagagatggggtttttccatgttggtcaggctggtcttgaactcccaacttcaggtgatctgcctgcctcggcctcccaaagtgctgggattacaggcgtgaatcactgcaccaggcctccattttgttaagtcatttatttcttctgggacttgcctagtcttatctgtccattttccttttagttttttaaaatttttcttagtaattggagtagctctatgtgtttcaagtatatttaacttttgttgtttactaatgtagcatttaattttatgttgtcttttccccattgagaacaattctgtgaagtaaaatttgttggcttttgaatttcatatcatgctttggaagaactctcctgtcccaagatcttgcaaatatattcctatattttcttctagatttaaattttttaaatatttagatcttcacctgtaatttaccttcttgttcttcaatgtaagattacaaatgctattatcttttatagctgttttctcattaatacatgtcttttaagtcactaatatactgatggctttccattacagatttttttttttttttttttttgagactgagtcttggtctgttgcccaggctggagtgcagtggcatgatctcggctcactgcaacctctgcttcctgggttcaagcaattctgccgcagcctcccgagtagctgggattacaggcacccacctccacacccggataatttttgtacttttagtagagatagggtttcaccatgttgtccaggctggtcttgaacttctgacctcctgatctgcctgtcttggcctcccaaagtgctgggattaaaggcatgagccactgcgcctggcccacacctgggtaatttttgtatatttaatagagacggagtttcactgtgttggccaggctggtctcacactcctgacctcaggtgatctgcctgcctcggcctcccaaagtgctgggattacagacctgagccactgcacctggcttccattacagatttttactttgaattattttatctaatttgaagctaatatagcatataataaaaattcaggagaaaaaaggttatttttaaatcttttttgagagagtccattctttagcctgaaagtaaagtgcatatgtaagcacagttaaaaaaaaaaaagtgatcagaaaaattaataattcaattctatatgtattttaaatttttcaattgttaaataatatttgttttattgattagctggaaataggcaatttttaaaaatctgtttttaaggcatccccaatgggggtgctgtcagattttaaagttagacagaggaccggggcatattaaagagaggtgcagaggtaccagtttgtgtggtagtggcaagctgtaaagatacttgagttttgcagattttgataaaccaaaaggaagggagaaagtgcatagtatattacattcccctcccccatgacaattatttttctcaagaccatttgtaaaacctctagataaggggcaggcaaatgttagcctgtcagccaactttggcctgttacctgtttttgttttagtttttaaattttttttgtagaggtggagtctctcagtgtggcccaggctggtcttgaacacctagcctcaagcaaacctctagcactgtctcccaaagtgctggggttataggcaagagccacctctcccagccagctgcctttctttctgtaaggaaaattttactggaatgcaaccatgcccgttggtttacatagtagccatgctttttacttggatagaaccatttgtatgaaaagcttaaaatacttacagtctggctctttacagaaaaaaattgacccctaatctagttggcaggctccttgcatacaggtcatatgtcttatttgtaatttcttttgcagtacctaccactgtccagtgcatagtagaagctcaataaatgtttgtcaagtagatatttgaaatgtagactaactaagaggcagcatgatatagtaggaagaaaatgctgagttgtagttgagggacctgggttgttatctctgatctgttcttaattacccttgtcagcttgggttagttagttaggttctctagccttcaggaacctaatctttagaaagagaagattgataacaggacccactctaaagatttattcatttctctttgattctctaagttagcttgcaataagctcgttggatcagtacggtaagctcattggatctcagtaatttatggttgtttgtaaggcagtaagcaggtaatataaatagctgaaggaaaaagtaatctttgctcttttggattggatactatctgtgatcacaactgatacttgatgattccatgatacttgcataatgattagatcctccccagcattttttccaaatcccctttattgaacttgatggatatgtttgctgcagggcctatagttctgggataattttggaagtataatagcagttcttttctctttataggttagaccaaagccattgcttttgaagttattaaagtctgttggtgcacaaaaagacacttatactatgaaagaggtaagctgaatcaagagataagtagtatctcactagttacatgtagccatacttaaagttttcaagaccatgtggagaaattggccatatagaaggatttttcattaagcagcaacatttaattttgtggtcgtttggactatattttaaagctgaaaattctaattatactcgagtttcatttctcagctaggaactcagataaatggaagccccgtaagggtgcttgaccattttatgctgtcaaccctttggtagactccttcccagaatcatgtttttaaatgtatgaaataaaatgtatagaattacaaaggaaacatactaaaatacggttaccaaaatagtaaactagtttgtgatatgtgtgcttttgttattaacataataaatactaagatttagaagaagatataataaatataatgtttttttgttttttgagacgaagtctcgctctgtcacccaagctggagtgcagtggcacgatctcagctcactgcaacctccgcctcctagattcaagcccttcttctgccttacccttccaagtagctgggattataggcacctgccaccacgcctggctaattttttgtctttttagtagagatggggtttctccatgttggccaggctggtcttgaactcctagtctcaggtgatccacttgccttggcctcccaaaatgctgggattataggcatgagccaccatgcctggccaataaatattatcttgatatagtgaggaatataagtcatattttgaaatgtttgccataagtacagtatgataggaaaacacctctgatttttgttggtgatgaaatcacaggtattaatactgttgtgatttgttgcctacatttataatcgaaggaaaagctaaattctagttagaagtttgtgaaaataagaatagaattttttttttcccatccaaattaatggaccccctgaattctatccaaggacttcttgggcatccctggatcccaggttaagaacttctgcactagagatacatgagtacagtatactgatctttctgggatagaggtgagctgattcatgaccatatattctatctaatggttccagcattttaatgcattccccacctttaaatttgtgcacagaagcatgattttcagtgacagattgagccaccttaggcagaatttcagtgtgattgaaatatgcctgttctctgtctctcccacttagtttatgggactcagattacttaaaacatttaagtttctttcttacaacggtatagtggggcaggaagagcttccatttttctttttcctctccagctatacttttagaaacttccttaaaggatgtttggtagaataaatctaagttctcttcctttttcctttcccactgctggacagcaatctgtccaatccacagtcacataagaatattcctttaaggccgatgcctgcttagccagttaaatccaaagacagtgtttgtaggaaagggccaggttaaatggtatttttaaggctaatttgggattgaccttattatcattggataatcagttaaggaaacaaaaaagtatggatttagcagtagatagaaatgagaaaattggccaaggccatcataaagacttagaatgcttatgctaaactatgtaacagtagtgtatgtattgtctgatatagttctcagttataggatctttgttctggggcacacaggaaggtagtgaaagctagtatgggtagtaaaaagagcgttggattaagagtcagaagagctggggccagtttcttcttcttttttttttttttttttttttttatgtgacagtttctcactctcttgcccaggctggagtgcagtggcatgatcactgctcgctgcagcctggacctcgtgggctcaggtgatcctcccacctcagtgtctgcagtagctaggactacaggcttgtaccactatgcctggctaatttttgtatttttttgtagagatggagtttcactatgttgcccaggctggtctggaactcctgggctcaagggatctgcttacctcggcctcctaaagtgctagatttacaggtgtgagccactgtgcccaacgcaatttcttcatttctaatacagtgataataatcttatgaaatatcagaatgagataatacttataaaagtacattgtaaactgtaaaatgccatatgtatttaggtagttgttaataggtttatatctggatatcttaaaaatgtattgccaacttcttgtcttaatgcagcacagggaatataatttaacttttattaatggttcaaagtcattattttgattatttatcataatatggagtaaattgataccttagagggtttatttcattctcagaattctctcaaactgttttgtagctgtcattgattgattgtttttctgtcttcctcctctggtgacctcagaggctattgaggtttatagtatttatgactatttactaagtggctccagaccactgccatattttagttgatttttgtttctgcaacttttttggctatcagttttttattttgctgccttttcccttcctaatatgttagtatctaagtatctgggcagagttaaagtctacaaggaaaaaaacctcacattttaaggtttgcttaagtaaatagagaagcagttatttctgcttctgtcaaattaaatggaaaaggcttaaaagtagctttttttttttttttttttttttttttgagatgaagtctcactctgttgcttaagccggagtgcagtggcgcaatctcggctcactgcagcctccacctcctgggttcaagcaattctcctgcctcagcctccctaatagctgggattacaggtgtctgccaccatgcctggctaacttttgtatttttagtagagatgggaccaggatggtctttatctcctgacctcgtgatccatccgcttcggcctcccgaagtactgggattacaggtgtgagccactgcgcccagccaaaagtagcttctaagtacaaaatggttgttctacatagttgtggatatggttcctggttgtttacccctattcagataaataggatattattaaatgtatttacaactaacatttagttttctttaatgctcagaaatcatatttgtatttcaggttcttttttatcttggccagtatattatgactaaacgattatatgatgagaagcaacaacatattgtatattgttcaaatgatcttctaggagatttgtttggcgtgccaagcttctctgtgaaagagcacaggtaattcttcagtttagtccattgtaaaaagccatctgggctaacatttcagttcacctctaccctcattcacttttgtcagagaaaaactgttgaaacatattaaagacatgctgaaacttaattttttagctctgcggcatattatttgagaacctgagctctggcatcttataaaccagtgtttgaaacctagcccaatcatttactagttttgtgactagataaattaacctttttaaacctgcttccccatttataaaatagggataattaaatacttcatgtggaggttaaagctcttgaagagagacgttgtataaaaaagcatagttttgggcacatacaaagcattcaagtattagctgtagctattataactttttattccagaaacagtataccaccacgtggtaaaggcttacatttgagccttagttattttggagatcattttcattgtcacctatcattatggcacttaaccagcagaatttaacccaggtaatatttctagaaataggcctggtgcggtggctcacacctgtaatcccagcactttgagaggccaaggcgggtggatcacctgaggttgggagttggagaccagcctgaccaacatggagaaaccctgtctctactaaaaatacaaaattagctgggtgtggtggtgcatgcctgtaattccagctactcgggaggctgaggcagtagaatcacttgaaccaggcaggtggaggttgtggttgaggtgagccgagattgcgccactgcactccagcctgggcaacgagcaaaactgcatctgaaaaaaaaatttttttaatatatatttttctaaaattattcttttttttgtttgtttgttttgagagggagtcttgctctatggcccaggctggagtgcagtggcatgatcttggctcactgcaacctccgtctcctgggttcaagtgattctcctgcctcggcttcccgagtagctgggattacaggtgcctgctgccatgcctaatttttgtatttttagtagagacagggtttcacgatgttgaccaggctggtcttgagctcctaaccttcggtaatccacctgccatggcctcccaaagtgctgggattacagatgtgagcaaccacacccggcctacatttggaattctttgtcacatttggtttagcacaggcaatccgtgttgagccttagcattcattacattaataaatggaatgaatacgttcacctgagacaattaactagcttctgctagtatttaatgctcagtagtatagctgaaaagatgataattaaatgggattttattttattaaaaaacataacttcctcagctgagcaagggattttataactttaaaacaaccttattattgtaaacatagtatatattattattgaacattaggagatgacagaaaactaagaaaagtaaaggaaaaaaaaggactgtagtttgttaacaaaaggtatttttaccagtcatttgtgtattatgtgcaactgtgtgttttaacctagttatgaatatagtactatatttaaatttcatctagcttcttaatttgtattataatttgtatattatatattataatatacatataatataattatatatattacaaatatatgtataattattattttttattgatgagtcacttctgtttaatatccatatatgttgtcattttatacgtggccttggtatatatggtttaattttataaattttaaaaataactatattggtatattggtgatttctttacctattgaatattgaatcttctattttttttcttttttttttgagatgaagtcttgctctgttgcccaggctgcaacctctgcctcctgggttcaagcgattctcttgcctcagcctcctgagtagctgggattacaggtgcacactactatgagcagctaattttttgtatttttagtagagatggggttttgccatgttggccaggctggtctcgaactcctgacttcaagtgatctgcctgtcttggcctcccaaagtgctgggattacagacgtgagccactgtgcctggtctgaatattgaatcttcggataatgtttggaagtatgatttccttggacttgaattctaaatgttgagagataagaaataggagaaattactgacttgaaaaggatatgaattaaaaatattgtgggtttaggttgctgtatccttattcccaaggatgaaaaaagatagttgggattcatatttcctcttaatattgagtgagaaacaatattttgtgacaaacactctcttaaatccttagtttaaaaacaaaaggaaaaatccattgtgacatcaacgaatactggggtaaatgaattatcctcctgttaggatataaacttcatgagggcatatacatttctgtttcattctttgttttcccccgtgtctggtacatagtaccagtgactggtacgtggtaggttttcagtctgtatttattgaatgaatgagtactgctttatctgttaataagtttcttttttttcttccctgagtcggagttttgctcttgttgcccaggctggagtgcaatggcgtgatcttggctcaccgcaacctctgcctcccgggtttaagtgattatcccgcctcagtctcctgagtagctgggattacaggcatgcgccaccatgcccagctaattttatatttttagtagagatggggtttctccatgttggtcaggctggtcttgagctccaggcctcgggtgatctgccggactcggccttccgaagtgctgggattacaggtgtctgtgagccactgcgcccggcctctgttaatacgttttaagatcaagaaaggaagttgaagcttgatgaaagtcaagattataatcaaattcctatttaatggattttgcgtaactcaatagtttttttggcagtttgtatttaatggattttgcataactcaatgcttttttttggcagtttgctactaagcacagagctaaaaacattcctgtttgaaaataagtatgttcaacctcttcctgcttgcatactcattttttgggggtcttctggtaaagtccaaacaaagcacatttcaggaattggtagtgtgaaatctttcagctagagagactttagtaattattaaaagtagctgtacataatcattgtgctactaattattgtgcttttaagtgcctacaagcttgccaatgataaatttggttttgaatgtgtgcagtagttcatactaagtatgtatgtagaagtctggttagatccagcttaatacaaatttttattctaaaatgtacatctcttgttattttttttttttctgtctacaaggaaaatatataccatgatctacaggaacttggtagtagtcaatcagcagggtaagttaattttgagcatcatggataaataccataaaaacgttttaaagacatttttgtttatgtgcatatgttttataattgtgattctctttaaaagttgctttaattaaatattgtaataaaagtatgataaatttattagaagtacatatgaactaaaaccacatactgaggttctaatgtaaagttaaatatcctgttagatcaatttagacttgggatatcagagttaggatttattttgaaaggtctgtaatttcaaaagctcctgtttaggagtgatctaccttgaaaatgtattgaaaggctttgggaaataatattgttacctaggtaggaccatgtgtaaggatgaaggatgagtctttttctttggttatagacaaaattttgtttaccaatttgtggaagtggaattttatgttcctacttccgtttcttaactggttatttttgggtcacatctctctttaataagctgataaaagcattgggttcttgttccagaaagatgcacatgtatatatacatgggtaagtcaataagtgttttacaacctactttccatgagaaaagccctgatttatgtgcttgctgacttccatagtataatactctcatttgaaggctaaaaacatggagttgggaagagatgtacacagtttgctttttttttttttttttttttgagaaggaatcttgctctgtcactcaggctggagtgtagtggcatgatctcgactcactgcaacctccgcctcccaggttcaagcaattcttctgcctcagcctcccgagtagatgggactacaggcgtatgccaccacgcccggctaatttttgtatttttagtagagagggggtttcagcatgttggccaggctggtctcgaactcctgaccttgtgatctgcctgcctcggccttccaaagtcctgggattacaggtatgagccactgcacccggtctcacagtttgcttttgagtgctgcttagagctgtctctaatacactacactgctcctaaagcccatcctcgaactacagttaagaaatgctcttaggccaggtgtgatggctcatgcctataattccagcactttaggaggctaaggcaggaggatcacttgagccgaggagttcaagaccagcctgggcagcatggcaaaatcctaactctgcaaaaactacaaaaatcagcttggtatagtggtgcatgcctgtagtcctagctactcaggaggctgaggcaggaggattttttgaggctgggaggtcaggactgtagtgaactgtgatcatgccatccagtccaggtgacagagcaagacctcatctcttaaaaaagacaaaaacaaaacaaaacaaaaaaacacctctcaggagcttgtttagttcctagaatgaattgaccactcccttgtacttcctctattccatattcagattttattgtaaaattgctttgttttacttgtgggtttttttgtttgtttttgagatgggctctcactctgtcaccctgcttgaagtgcagtggtaatcttggctcactgcatcctccacctccagggctcaaatgatcctccccctcagcctcccaagttgctgggactacagatgtgctccaccacgcctggctaatttttctgtatgtttggtagagacggtgttgctatgttgcccaggctagtcttgacctgagctcaagagatattctcacctcggcctcccaaagtttaggggttacaggcatgagccactgcgtctggctgttgcacttgtttatatttttgttacctgtgtcctattcaggtttgcattgtgcatcacacactatagtgttttattaatatggtatttaataaatgtgttgaattgaatacttattcttccaaagttaggatttaaagcccagaaaagtatctccattttatcccaaaataaaagtagttattaggctgatgatttggcattttattgttttaaagctctttttttttttgagctttagattgtatcctttttatttcctttttttttaattattatactttaagttttagggtacatgtgtacaatgtgcaggttggttacatatgtatacctgttgttttaaagctctttaagaaattgtgtgatagctaaatatacaattgtagtatttgtagtagtagtttgagttttctgaagtatgtaaccctgatgtattcattccttcatttgtttaaataaactttggcacattactagaaaaattgtattattgagatggaaacttacaaattacttatttgcagtctgagtttggtttagatatcagtagaattaacttcagaactcctattccatgttctcaactttgtcacttttttttttttgagatggagtctcactctgtcacccaggctggagtgcagtggtgcgatctcggatcactgcaacctctgcttcccgggtttaagtgattctccttcctcagcctcccgagtaggtgggattacaggtgcctgccaccacgtccggttaatttttgtatttttagtagagaaagggtttcaccatgttgaccaggctggtctcaaactcctgacctcaggtgatcctcccaccttggcctcccaaagtgctgggattacaagtgtgagccactgcacccacccagcctagggcttcctttttattacatcttttttgtagcatctgtttatactaatccaaaattcctggacaatataacctattatgtacaacttaagaaaattagtgtaatgccttacccatagtataaagagaaaattaatctatgataatgcataatttcaaaatgttaatgtccaggcatgagttcactgttaagatgaaaatgtttccaaggggggtagtaaagggtatttgatgataattgtctgtatatcccaactctgaaactttgacttttgagctcaaagtctgtatatccaactacaaatgaaacctatgtgcctgaataactcagtttgttatcttcccatccaatctgtttatctttctaaagtttctcttttagtgaatggtaccactcatttattcacccaagttggaatcttggaatcatcttaactcctttcttccttgccttctatatcaaataccaggtcttgttggtttttacctatttaatttctctggaatttgttttccatgccttagtttaggctttaatagtttttagtttgtattattgcaattgtctaatactggttttcctgcctctgccctctttttcttatgttttgctagagtgatttgtcactcttctgcttaaaattaccatttaggggttcattattgctctctggatgtaatattttctgtgagctagaaatcagtttcatttcttggacaaaaatcctttttaatggtgagtggctgcaacatcgcattaaggaagattctgaagtatctgcggggaagaatgcagtgataagggaatgacagcatgagtcctgctttggctagaccacaggatcctttacagtctgaacctgcctacattccagtaataatgaactgcttgtggtgtcctgcaacaggaactgttgttagtttgcttttggatactttttcacatggcgttttcttggtctggaatggcctttcctagccctattttcatattgtcctacaaaatatttcctgattctttgtttctcagacactccctgtccctaccaaaataatgactctcctgtctctctgctaatttatctaacagtcttttaatgtcttgattatactttactcttctacattaaagttgaattattttatttacatctgcaacatttagtatgaggatgccacctggaaaatacatgtttaatgtttattgaaaggttaaattgcataagggtttgtgttagactgatagcatatctactgagtagcgccccgccgccccccgcccaccaccaagtttctgatcctttttcttttctctcagaatcatcggactcaggtacatctgtgagtgagaacaggtgtcaccttgaaggtgggagtgatcaaaaggtaatctaagtaaatttctcattctaatgtaatattatttgcaaattggaaaggttatttacaacaagttagcttactggttatgttaagtttgttgtattttatttttttcctaaatgcttaggaccttgtacaagagcttcaggaagagaaaccttcatcttcacatttggtttctagaccatctacctcatctagaaggagagcaattagtgagacaggtatatatgaatatttatttgacgcattcacacagctttttgatattctttctctaatgaaattagtgcttttagacttaattaaattgttccctttttttggttgagatgaattaacctctgagtttttttcattcgtgattttatttgatttacaaattgcttatttagcaatatttttctggctgactacagcaggcacagtttactgtgccccactggagtttatagttagccaactctctgttaagatagtaggaggtggctggggtgtggtggctcacgcctggctcacgcctgtaatcccggcactttgggaggccgaggctggcggatcacgaggtcaggagttcgagaccagcctgaccaacgtggtgaaaccccatctctactaaaaaaaatacaaaaagtagctgggcctggtggcgcacacttgtaatccagctactcaggaggttgaggaaggagaatcacttcaacccgggaggtagaagttacagtgagccgaaattgcgccactgcactccagcctgggtaaccgtgtgagacttcgtctaaaaagaaagataataggagacaggcatataaactctattttcaccattattcttagtcaccttaacagttaaatttttaaattgttatttttaataaatggtagtacatacctatgagttttaaaacagaaagtaaatagcattttagaaatgaagagataagggccgggcgcagtggctcacgcctgtaatcccagcactttgggaggccgaggcgggtggatcatgaggtcaggagatcgagaccatcctgtctaacatggtgaaaccccatctctactaaaaatacaaaaaattagctggatgtggtggcgggtgcctgtagtcccagctactcgggaggctgaggcaggagaatggcatgaactggggaggcagagcttacagtgagccgagatcacgccactgcactccgcctgggcgacacagtgagactgtctaaaaaaaagagagagagagaaaatagttgacagagagaaaatagttgagaacagttagtagacgtagtagacgagaaggctgttgcctgaggaagtcgcagtaactaagaccgtatgattcagatgaaagagaatgtcagatcagtgaaacagaataaatgaacccagaccagaatctcgtacatgcgggcagaagacaggaagggcagaggtgtctagggcagaggtggaactagaacaaatggtagttacttggggaaaaggtgaagttagatctgtaccttatgccaaaatgaatttcaaatgagtttaaaagttaaatgaaaaatagaatacaacatatttgaaagatagtcactttaaatttgactgttaatatctgtattacataaaaagtcttcccaaatcaataaggaaaacattaaaacttcaaatagcaaaaagggcagacagttcacaaaaatttctcacagtaaatacgaatgactaataaatatggggagagggtgaattttggtgatttttagctttacagatagtaaaaaatgccaaaagggtgtccttttgatctatcaaattagtaaaaataaaatttttactcatccttactcatcagtgctaataacttgtgtattagcactgataaactgttggtctgtaaattggtaaaagtgggtaaaaattgattaaatttttcggattataaaaaagcttagatggcctggtgcggtggctcacacctgtaatcccagcactttggaaggccgaagcgggtggatctcttgaggttaagagttcgagaccaacctggccaacatggtgaaaccccatctctattaaaaatacaaaaattagccaggtgtggtggcaggcgcctgtaatcccagctacttgggaggctgaggcaggagaatcgcttgaacctgggatgtggaggttgcagtgaaccaaggtcgcaccactgcactccagcctggggtacagagtgagactccatctcaaaaaaaaaaaaaaaagaaaagaaaaaaaagtcttagagttcttaacattatcctagtaactccatttctagtaatctatcctaaggatgtaataaaaaattcaaagatttatatgtagagatactaattacagcattatttataattgcagcccggccaagatcacctttttaaaaatagggaacacaaacatgattaagaactcacgtgcagaacttgtgatctcgataaaacgtaaaaatcccggccaggtccagtggctcacgcctgtaatcccagcaccttgggaggccgaggagggaggatcacgaggtcaggagattgagaccatcctggctaacacggtgaaaccccgtctctactaaaaatacaaaaaaaattagccgggcacagtggtgggcacctgtagtcccagctattcaggaggctgaggcaggagaattgcttgaacccaggaggtggaggttgcagtgtgccgagattgtgccattatactccagcctgggggacaagagtgagactttgtctcaagaaaatgataaaaaaagtcctttcagaaatctgtgatactatctcattttaatttttgtcattctcatgggtgaaaaatgatatcatttcactttgcatttctttgatccctaggaggtaagagtttttttttctattactcaagtacatgactcaagatttttcatatgtttattagtcatttgtatttcttctgtgacttgctttttcctgtttccttaaaagaaaatacagtctatcttgatttggtaggactttgtataatatgtatactatgggtaatttttactatatatgttgcagatattatcttcgaatttgacctttgccttttaacttttgtttggtattttattttgtcatgtaaaccttgacatggtctaatcttgatagtctttttattgaggactttgcagtattatgaaatacttctccaccccagcattataagaatattttgttataggtacttgaatggttttgttctttatatttagatctttaatccacctggaattcatttttatgtctagtataaggtagtattctcatttatgtctaacggatttgtctaacattctgacccattcagagataatttattatttaaaatgaaatggaaactttttactggttttgatttctgtttaaaatatagggtactgaagagccgggcttagtggcttaggcctgtaatcccagcactttgggaggctgaggcaggaggatcacttaaggccaggagtttgagaccagtgtggccaacatggtgaaaccctgtctctaccaaaaatacaaaaattatccaggcatggtggtgtgcacctttaatcccagctacttggaagctgaagtcacaagaatcacttgaacctgggaggcagaggttgcaatgagctgagaatgtaccactgcactccagcctgggtggtcgagtgtgactctgtctcaaaagaaaaagtgtagggtactgaagaaattgaaacattaagaataccatatgagtaaattaaacactttggctcttttcggaaaaaaacagatgagctcttatattttaaagtttggttttgacagaaaaaaattcctagattttttggttaataaaaactttattagatagattaaattgtgatgtatggagataaagttctgaaagaagaatagaaagctttttaaaaatagtattctcagcctaggcaacatggtgaaaccctgtctatgcaaaaaatacaaaatggtgcattcctatggtaccgttcctatggtaccagctactcgggaggctgaggttgaggtgggaggatcacttgagcccatgaggcagaggttgcagtgagccgagattgtgcctctgtactccagcctgggtgacagagcaagaccctttctcagacaataaataaataaacaaataaataaatacacacagatagtgttctgctgtaacagttggacagattcaataaaacagtgttaacttttgaactaattttattgaaactaagtttctgtacaaataggtactcaaaacagctcaattttctaaatcacagtacagcaatttattttttttccttacatatccagaagaaaattcagatgaattatctggtgaacgacaaagaaaacgccacaaatctgatagtatttccctttcctttgatgaaagcctggctctgtgtgtaataagggagatatgttgtgaaagaagcagtagcagtgaatctacagggacgccatcgaatccggtaatgttctcattttaagtaaggcaagactcttactgttcaaagtctagtcctggcagtcctaataaggatacggatagaatgtacatgtgtcttacgagattgatagaaaacacagtgctaaattttactttaaaataaaactactatattgatctccaccttcaacccaaggtattgtgagaaatgtggaaaatagtggagtaacaccggtattggtaaaattagtagtagtattagtaattatcaatgtcactgtatgtattagagaatatttgtggaccactgcaccaatagtacagtcaaataaattggagtatagagttgtttgagaatttgagagttacactttttaaaaaaggaacaaaaccaaaaatttggttcagttaaatattttagcattttaaggcaaatttgactatttagagtaaaaatatattttattacagccatcagcaaaaaagtcagcatagtctgaacttaacatttgccaaataggtctagacatcaggtaagttctatttacttatgctgtaaaatacaggtttatactgggctgggtgcggtggctcatgcctgtaatcagtactttcggaggctgaggcgggtggatcacctgaggtcaggagttcaagaccagcatggccaacaagatgaaaccatgtctttactgaaaatacaaaaattagccaggcgtggtggcgcatgcttgcagtcccagctacttgggggcctgaggcaggagaatcgctcgaacccaggagttggaggttgcagtgagctgagattgtgccactgcactctagcctgggtgacagagcgagactccatctcaaaaaaaaaaaaaaaaaatgcaggtttattattgcatggatgacgggagagtatcagtactttctcattactaatacagacttccaaaatattagtgagcagcatttcttaagagatgtcactgaaagaagtttggtaaaaaatttttttgttaacaagaatgcttgacaaatggaatattttgttttgtatgtctttaatcaagcttgtccaacccatgccctgtgggccatatgccaggatggctttgaatgtggcccaacacaaattcataaactttcttaaaatattatgatttttttttttacaattttttttctgctcatcagctattgttagtgtattttatgtgtggcccaagacaattcttccaatgtcgcccacggaaaccaaaggattggatacattttttggtaatatggcagtgtctcatggccattattctgggtattagtaatcattgtatagtactctagaagatgtaggaagtggaaccaattgtgatagtaatcctagtcttttacctattcttgttacttcctgtattatctttttttctcttccaaagcagtgattgtatgaacgcatacctgccctctagagttactgtacctaacggagctgttacttatgtagaccgctagatggcatgatgagctcctgctcagtctgagagcaggttcttcatttgtagatatttaagtttataccaaattccatacagttgagatggcactgcagatacagtggtagtcaaggtagatatggttcttgccttcattgggagatagatcattaatgacaaaaatgaaaacatttaataaatccagtggaaaaaataggctcttgagcggaaatatatgtgataaaattgaatccaattaaaacttgatgagtatccaacctacaagtttggttaaaaagagaattattataccctatttatttatttattgagattgagtctctctgtctcccaggctggagtgcagtggtgcaatcttggctcactgcaacctccacctccccggttcaggcgattctcatgtctcagcctcctgagtagctgggattacaggctcccatcaccacacctggctaatttttgtatttttagtagagatggggtttcactatgttggccaggctggtcttgagctcctgacctcaagtgatctgcctgccttggcctcccaaagtgttgggattacagatgtgagccacctgcccggacccctatttaatgtatagtttttgttaaagttatatcagaattctagctgaatgatatttagagtccttgttcctgctttgtacctgggacactgccttgttactgatatggctttgaggagtagaggaacaccaggttttttgttttgagttgaattagataaaacgacacggacacacgtggagtggttttaaggagcagagcgtttaataggcaagaagggagaaggcagaaggaagaagctcccccttacacagacagagggaggggggctctaaagctgaaagaggagaccttacattctgacaatactagccagttttatgtgacggctggagggggtggtgtcttatttgcatagggctcagaggattggtttgaccaggcatgtcatttagccctcaagaaaactggccctcccaccccagtcctttaatacacaaatgcaggatgccatgacattttacacacggggttatgtgggggcggccatgctgttaggtacctgatggagcaagggcaagaggacaacggtgggaatcgccatgttgggtggaccctcttgcatttgcatcttaaaggttgccagcctttaagagccagggcttttatgctagacaagaaatttttctggagctacgaaaaaccttccaaggaccacttttcctctccatttgcctaaaataatttcttaataactcgtgtggagtagaggggtatttctttttttctttttgttagtcctgtcctgcattctcttaaaaaatcctatctataaaaaatctcagccgggcgtggtggctcatgcctgtaatcccagcactttggaaggcccaggcgggcggatcacctgaggtcaggagttcaggaccagcctcgccaacatgttgtgaaaacccatctctactaaaaataccaaaaattagctgggcatagtggcgggcacctgtaatctagctactcaggaggctgagacaggagaatcgcttgaacccgggaggcggaggttgcagtgagctgagatcacgccattgcactgcagcctgggcaacgagaacgaaattccatctcaaacaacaacaacaaaatctcgtttttcaggttaagtccctagttgtgaaagcttttggtagggccagtttttttttcttcttcgttttaatttccctcatttgagaatgttgtagtcatcattgggtgtcatcattcaccagtttgtgaagggagttaaaggaaagtgcattcctctcccatcttttctttctttggggtttaataaattgtgggaaactaagactgtgttctagactgtacaccatgcagtttatattatgatcttctgtcatctttgcagcctcagattccatttttagctaagactggggttttaaataacttgtttaaggttcctacaactaattgtcacaattggaattcaaacaattctaggtatttttgactacaaagatctaagatctttgcagagcaagcctatctgatgcttaaaaaaatatatattttttaaatttttgagacagtctctcactccgttgcccaggcgggagtgcagcgcatgatcatggcttactgcaacctcaacctcctgggttcaagcaatccttcctcctcagccttgagagttagctgggactacaggtgtgcaccaccacacctggctaattttttttactttttttttttcagagatgagatcttggcctgttgcccaggctggtctcaaaccgctgggcttatgtgattctcctgctttggctcccagagtattgggattacaggcatgagccaccacctccagcctgatgctttttaaatatatagtatttaggtctggtgcagtggctcatgcttgtaatcccagcactttgggaggctgaggcgggcggatcacaaggtcaggagatcgagaccatcctggctaacacggcgaaaccccgtctctactaaaaatacaaaaaattagccgggcgtggtggcgggcacctatagtcccagccactggggaggctgaggcaggagaatggcgtgaacccaggaggtggagcttgcagtgagccgagatggtgccactgcactccagcctgggtgacagagcgagactctgtctccaaaaaaaaaaaaaaaaaaaaaaaatatatatatatatatatttatatttaaataatgtataaatatataatatataattataaatctattatatattaatgtatattatatattacattgttatatatatttatataattatatatttatataaatataaatatatatatttatataaatataaaaatataattatataaatataaaaatatatatttatgtaaatataaatgggcaggcacctgtatatattatatatattactatttatataaatataaatatatattttaaatatttattttatatattttaaaaatatatatatagagagataatttaatagtttctggggcattcttttgcgaacattagccaaaactttaaaaaccactcccaatattgcattttttcatggtattttttatagtatttttatagtatcctaggacaggagttggcaaactttctgtaaagagccacatagttaattatttgggctctgccgggccatggtttctgtcacagctactcagccccgctcttgtaatgcaggagcaactgtagacaacaagtcaacaaataggcatggctgtgttcaataaaactttatttataaaagtcgatgggtgatgggccacagtttgcagacccctaccgtagagtatgttttctgagatttaatgtttcttgtgatttacccccttattctaaaattagtgcactaaagactttagttagttgaagtatttggtttgttgggttactttgttagtgttaattgtatcctaacttgacttgtgattctaatctgattggtagtagagcccttgttaggaatttgagctgcaacttgatgaatgttgcttttactctccttcctaacattactctaaaaaagtcttttgatgtcagaggctgtaaaataatatactttgtttctgtttttaaaactgatacagatatggaaatcatttaatctaagctccttttctagatgaagtagctacagcctttagaagttaaatgatatgggctgggcgaggtggctcacaggtgtaatcccagcattttgggaggccgaggtggcggatcactagaggtcaggatttcgagaccagcccagccaacatgacgaaaccccgtctccactaaaaacataaaaattagccgggtgtggtagtggacacctgtaatctcagctacttgggaggctgaggcaggagaatagcttgaaccccggaggcggaggttgcagtgagctgagatcatgccactgcatttcatcttgggtgacagagcaagactcttgtctcaaaaaaaaaaagggccgggcatggtggctcacacctgtaatcctaacactttgggaggccaaggcggttgaattgcttgaggtcaggagttcaagaccagcctggccaacatggtgaagccctgcctctactaaaaatacaaaaattagccaggcatggtggcatgcgcctgtagtcccagctacttgggaggctgaggcaggagaattgcttgaacttgggaggtgtaggttgcagtgagctgagatcaggccactgcactccagcctgggtgatggagcaagattccatctcaaaataaataaaataagttaaatgatgttgtttaaggttaaattagctacttagtggcaagtgtagaataagccatatcccgacttctagactttttccaattgtagccttctgcttatatatgctcctacccttagccactgacagcaaatattattgccctgaaggtcttactaggttcttatacaatttattgaagtcctgaaacgaagaatcagatgagcagctacagaattttttttaattgtctaaaggctctttaaaagaaaatctcaaagtttattaaaaaacataagtatctatgactcgagacatttttctaagaaaaaaaacccataagtattacaagtgttgtgtcttgttacgtgtattctaccaatttggacatagaaagatgagtgacaggttttagctcaaagtatatataattcagatgagaaacatgcctgcaaaattatgttttgcataatttatgtgtgagactatataattcattattatacaagtagtaaggataattaaaggtggaagagccttttcagttatggtattgacaaaggcttagtcaaagaaggatgaataggattttgaaactgaaattattctagttagagggggaaagtgtggaagttgaaatgccaagattagttgaggaagcaatctagatctggcgggattatccatatttagtaagggaggaggggtgtctagttgaagacagacgaagatgttaatacagtcacactgtaggtactttcgatgccaagaggctttggtgtttttcctttatgcagtggggttttgaacagggaaaataatgtagtaataaccttgaaaccttaatctagtttcagtatgcaggatggatctgaggaggaaatgtgcgtggcaaccggctccgggatggctggctggggggcctagtcttctgcccgccgatctccctcgggaagtcccggatcagagcagcaggcccatcccccaactgttacaccctgctggcagcagcagaggcacagggatgagttaggaaacagatacagaggtcaagaggtgatgtttattaagttatatatttttttcttgttttaggatcttgatgctggtgtaagtgaacattcaggtgattggttggatcaggattcagtttcagatcagtttagtgtagaatttgaagttgaatctctcgactcagaagattatagccttagtgaagaaggacaagaactctcagatgaagatgatgaggtagtattttttttcccctctaattatattggaaaattattaaatattttctatgttcattgactttgagattgaaataatattattcagatttcacttgaaatctttacctcttgatttgtttaaactaacacattggtttgtggacttgaggatttcatagttctttatcatctgatttatattattatattactactaattgccaagaagtcaatagacctcaatgaacatgcttattataatggtctgttcacttttaaaaacatataattcaactactgttttaatattaacttactttctataaaagtaaaacatgcatacagttaaagtcaagtagtacccttagagatctgtttcccagaagtgactgcctttaacatttctagctatttccctattatttaatatctccatattatttatttatgaagtaaaaccacctagctgaatgttttgttttattcatcctaaacatcctttgtattgacttttaccattgtgggtaaggatttctctctcctccattttttccccctttacactcacttactctatttgatattgtctaaggctttctcatatattgtagtacatgatatttgtttaggacttattactaggaagccttctgattgaaggaaatagggcgatgaattgatgctaatgaatgtgttttattaggtatatcaagttactgtgtatcaggcaggggagagtgatacagattcatttgaagaagatcctgaaatttccttagctgtaagtatacatctacttttttaagaaataaaaatttcattaaggtcaagattaggagactatatctagcttctttctgaaatgaactgatttttataaagttaaaatgtttttgtaaagtctgaataatttaaagcatttttcttttatttgttgtgatgagacctgtagctataatttttatttttaggtgctggaatttgaacttttttttttttttttttaaacagggtcttacccttctcccaagctggagtgcagtggtgcaatctcagtgcactgcagcctccacctcccaggttcaagtgattctcgtgcctcagtctcctgagtagctggaattacaggcatgcaccactataccccactaatttttttatttttagtagagatggggtttcaccatgttggccaggctggtcatgaactcctgacctcaagtgatctgcccaccttggtctctcaaagtgctgggattacaagcatgagtcactgcccagctgaatttgtacattttgatgttattttggaaaatttcagtgtatctccagtatactcatcacccagctttaactattaccaacattttgccaaccttgtcaaacgtaaacttttttttttttcaattgagatagggtcctgccctgtcttccaggctggagtgcagtgatgtgatcatggctcactgcagcccccacctcccaggctcaagtgatcctcccacctcagcctcctgagtagctggaataacaggtgcatgccatcacaccccagctaatttttgtattttttgtagaaatgtcaccatgttgcccaggatggtcttgaactcctgggctcaagtgatccacctgcctcagtctcccaaagtgcaaggattacaggtgtgagccatcacacccagccaaatgtaaacatttttattactgatttgtattatagaatgtggtaggatttgccattaaagaaattaacacttaaatgtttacatctcatgcatacttcactgagttcctgaggtattataggtttttttaaaactattgtgctttagtttttgttcttaatattgcctttattatatttgaataggaaataaattccattttttctgagttatagacagttactaattattcaagtgcaaaaaaggatgaaaattcaagagtttccaaaatttttactgtattagaaaataaataactaattgaatcatttgatgtcaagttgagtaaaatattttagatacttttaattttttaaatctattttaagactcaaattattttagatattcatcttggaatttattggactttttgatgcacttttactcccatattgcaagacctttttctttggttttatgagctgtgaaaaacccccttctataacttgaaaaaagaagaatgaatagtctatctttattgctcctgtcttaacatcatttgtgaggcaatctcaaaatggttacggaaatacctcttacttaagagttttcacttgttaaatgtcctcaggcaagaaccatgcttcagctaaggcaagaagataggttatgtaaaaaggctggggatgtgggagagtttgttatccaaattgcatggtggaaaggtttgtgggataaaacgttgggaaaaggaagaagcattgagcagttacaaagatgagaacacaggaaaggatagacaggtaaaggaaaggatattacggttagtgaccaaggatgataggttttagcagcaatacttgctgtgaaaaatgttttagcatttctcttgtggatggagttagggaatactcagttaagccatggttttagagtacttctaaggtagttctagtcactggtggattaggaagtctttctcgaggaggcaggtttcatctagattgatgggatggactcttggaatagcgcctagggttgagcctttaagggagtggatataggctgcatgacagagtaaaagatcccatagacttgcttcaactaaaggaagcaactgcatttgtatcctgaaacagataactttataggtacatgattaatatcacatcacagttaatatatttttagtttagaatttttcaggatggtaagggtgaaaaaaatgggtgtacttactctactttaggagagactgttacatattgacctttaaaaatctgttttgtgtataattgagacatataacgtgatgttttgacacacatgtaaatagtgaaatgatcactacagtcaagcaaattaatgtaatccattatcttgaatagttaacctttcttgtgtgtatggttaaaatacctaaaatctattcttttagtaaatttccagtataccaatatataactaactatagtcctcatgctgtttacagtgactattttatataaaacatgaaacactgaatattgagccctatgatatactttaccttagacatagcaaagttgctagcattcctgtgactgagcagttaaagggttacagaaactgactgtgtgtcttatttcattgaaggactattggaaatgcacttcatgcaatgaaatgaatcccccccttccatcacattgcaacagatgttgggcccttcgtgagaattggcttcctgaagataaagggaaagataaaggggaaatctctgagaaagccaaactggaaaactcaacacaagctgaagagggctttgatgttcctgattgtaaaaaaactatagtgaatgattccagagagtcatgtgttgaggaaaatgatgataaaattacacaagcttcacaatcacaagaaagtgaagactattctcagccatcaacttctagtagcattatttatagcagccaagaagatgtgaaagagtttgaaagggaagaaacccaagacaaagaagagagtgtggaatctagtttgccccttaatgccattgaaccttgtgtgatttgtcaaggtcgacctaaaaatggttgcattgtccatggcaaaacaggacatcttatggcctgctttacatgtgcaaagaagctaaagaaaaggaataagccctgcccagtatgtagacaaccaattcaaatgattgtgctaacttatttcccctagttgacctgtctataagagaattatatatttctaactatataaccctaggaatttagacaacctgaaatttattcacatatatcaaagtgagaaaatgcctcaattcacatagatttcttctctttagtataattgacctactttggtagtggaatagtgaatacttactataatttgacttgaatatgtagctcatcctttacaccaactcctaattttaaataatttctactctgtcttaaatgagaagtacttggtttttttttttcttaaatatgtatatgacatttaaatgtaacttattattttttttgagaccgagtcttgctctgttacccaggctggagtgcagtggcgtgatcttggctcactgcaagctctgcctcccgggttcgcaccattctcctgcctcagcctcccaattagcttggcctacagtcatctgccaccacacctggctaattttttgtacttttagtagagacagggtttcaccgtgttagccaggatggtctcgatctcctgacctcgtgatccgcccacctcggcctcccaaagtgctgggattacaggcatgagccaccgcgtccggcctaaatgtcacttagtacctttgatataaagagaaaatgtgtgaaagatttagttttttgtttttttgtttgtttgtttgtttgtttgttttgagatgagtctctctgtcgcccaggctggagtgcagtgtcatgatctagcagtctccgcttcccgggttcaagccattctcctggctcagcctctggagcagctgggattacaggcatgcaccaccatgcccagctaatttttgtatttttagtagagatagggtttcaccatgttggccaggctggtcacgaactcctgacctcaagtgaggtcacccgcctcggcctcccgaagtgctgggattgcagatgtgagccaccatgtccagccaagaattagtatttaaattttagatactcttttttttttttttttttttttttttgagacagagtcttgctccatcacccatgctagagtgcagtggagtgatctcggctcactgcaacttccgccttctgggttcaagctattctcctgcctcagccttccaagtaactgggattacaggcatgtaccaccataccagctgatttttttgtatttttagtaaagacagggtttcaccatgttagccaggctgatcttgaactcctaaactcaagtgatctactcacctcagcctcccaaaatgctgggattacagatgtgaggcacctggcctcagatttttgatactcttaaaccttctgatccttagtttctctctccaaaatactctttctaggttaaaaaaaaaaaggctcttatatttggtgctatgtaaatgaaaatgttttttaggttttcttgatttaacaatagagacagggtctccctgtgttgcccaggctggtctcgaactcctgggctcaagagatcctcctgtcttggcctcgcaaagtgctaagtaggattacaggcgttagccaccacacccggctgtaaaaatgtacttattctccagcctcttttgtataaaccatagtaagggatgggagtaatgatgttatctgtgaaaatagccaccatttacccgtaagacaaaacttgttaaagcctcctgagtctaacctagattacatcaggccctttttcacacacaaaaaaatcctttatgggatttaatggaatctgttgtttccccctaagttgaaaaacaactctaagacactttaaagtaccttcttggcctgggttacatggttcccagcctaggtttcagacttttgcttaaggccagttttagaaacccgtgaattcagaaaagttaattcagaaatttgataaacagaattgttatttaaaaactaactggaaagattgttaagttctttctgaattattcagaaattatgcatcattttccttcaagaatgacagggtcagcatgtggaattccaagatacctcttgacttcctctcaagctccgtgtttggtcagtggaggcccatccgagctcagcactgagaagtgttagtttctttgggacccatctaccctgaccacatcatgatgttcatctgcagctgttgcaaggtgttcagattgtataaacataaatgtcacaaaaactttaaaagaagtgcaattctcaaaaggttaggtggactaaagcattctgtaaagcaactgctaataatgagcttacagtggatttgaatttgaaaaatatagtaacaagcctgtcaaatatctgcaagaactatggaataaaactactgatgcagtgaagacagttgaaaagatcaaacaaatgccaagctatatttataatgaacaaattcaagaaaaaggactacggaaagttcaggacatcaaagaagtcaggcaaaactcatcttgacccctgttgcaggcaaaggaacgcagctggaagaaaagatgatataacagttaacaggatgcagacatggcagaggtttcctaaaaatctcattatctataaccatttctatatttacatttgaaaatctcctttggagacttagaacctctaaattattgacttattttttatataaggtcactccgatgaaaggtgattacaaaatcatctacattgctgtctacaaaacagataatatggatgtttgatcgcatctcattgttaactctttactgatatgtttgtaaatacagaagtgaaatgtggacataaaatagttacgctatttggttaatggtactagacaacatgtaattaatgacattcaaaaatttatggctagtgatatatataaagtaaaattttctttgcagtaaaatatgccctttattatagaagggaggatataaggaaccaacagtttgtatgaaaatagctcaaataatatcttttattttgattttaatatttcttattttggtttattagtgtcttagaacaaaatggccttatataatgaagcctagttatgctggactgttttgatctcttttaattgttctgacagatagttggggatgagagccgaataaggtttgcctgaaataactgacactatataatttctgctttggcaaatactaagttctaacttgtcattcctggtagaacaagctttatttttcgagcctagcaatgatctagaagcagatgttatctcagtgccttttgcaatttgttgtgtgggtttttttttttttaaagccacacaataattttggaaaacaatgtatgggtagaacatgtgtctgttaattgcacacaaaaccacttttaatgggtacagagttaaatttgaaggaataagttctagctgaagtattatgaactccaaataatgctttgaggacctccaaaggtaaaagtactaatccctttggccatttattgagagagagagagagagagagtagggtgactatagttaatgtattgaatgttcttgctacaaataaatgatatttgagctgatgggtgtgctaattacactgatttgatcaatacccattgtatgtgaaacagtacatacaccatatttacaattatgtatttaacatttaaaatttctaatataagtatctctcaaactgtggattaacttcttgatttatatttaaatatgaatcttaagcaaaacagtgaaaataaccatcttgatttagtgtttttctcccatatgtgaattgtatatacttaggtgaagacaataaaatcaactgaactgtaagcttagaataggactgaggtaattctgcacagcaactttactaatggtacattgttgcttcaaaactctctctctctctctctgtctgtctcaataaatggccaaagggattagtagtttacctgtggaggtcctccaagcattatttggagttgataatacttcagctacaaccaagcagaatctcttttttttggaggtcctcgaagcattatttggagttgataatacttcagcttcaatttggagttgataatatttcagctagaacctagtagaatctgtttttttcctttggaggtcctcaaagcattattggagttcataatactgaagctagaaccaagcagaatctgtttttttctgaggagtatcggtagcataaatgtgattataaacatagtacacttgatatatggaggcagtgacagctatttttacaaaatttaaatctgcaaatggattcaacatgtttatgggttattaaaatggcctgatttcttaggttctttatagtacacgtgttgaaaatatatgattaagaattgtttcaagaatgcaattatttgatcttaaatttttatgagttgttaaaatagaaattatttgaatatcatatatttgggtaacaaaaggcacaagtctgaatgtgtttctttttctggaatggccatgcctgcccactctagaaatacaaatatcacttgggcagcttgaagcagtggagcctcaatgagaccacctgaagaatgtggtcccagttagtagagtaagaaaggctggttctcccttttttttttgggtccctggccagcctggcctaagtgttcgtgattggtctataagggaggtacctggcacagggaggggagtttgggttagccaccgtaccacttgtcagcgtgaaaagtaagattgtactggcctgtttagttttcggcctcttctttgaaagttccaccaagctgggaacctcttgattgtgaggcacaaatgtaagtacatcagaaaaaaacaaaaaaactggctttaaagcaggagcttgtgggcccctaagccagacggggactagcttttggcattatataattaagattttttaaatccttaataagggttttattttatttttatttattttttgagacggagtcttgctctgtggctcaggctggagtacagtggtgcaatcttggctcactgcaacctctgcctcctggctgtgttcaagtggttctgcttcagcctcccaagtagctggggttagagcaccctgtcaccacgccccgctaatttttgtatttctagcagagatgaagtttcactatgttggccaggctgggctcaaactcctgacctcaagtgatctgcccgccttggccccccaaagtgctgtgattacaggcgtgagccgccacgcccagcctaataagggttttaaagataattagtgtgtaggtctgtaggcttatgatggtaaccacaagttgttaatggcattgtgaaaagtttttagttgcgctttatgggtggatgctgaattacattttgatttgatacttataaaaagaaaaagtatttcttcagcttaaaaaattgtttaaaagtttgtgatcatattgtctaccatgtagccagctttcaattatatgtaagagggactttttgacatttacaaataatactttgaggtagatatctgaaagcaccagcacttggaaggtgttcagaagtaacaaattataaaatgagctaacaaacgaaaggcaaaataaaaccgtaaagcaagcagatgggaggcgtgttcagtaacttattcataatgcatctgaaatgattgctgtactcaaatatttaacgttagagtaatagtattttgaatgaaaaccatagttgattgtctttagagagaggagtggtactgaaacatacttgaattcgtattgctttcctttaaagctctcctttaaagactttaaaaaaaattcgataggcattttcatgtttcagtcctacaatcccacatctctgctgccttcagaatgctacaacttagatgtccagccaacagcttaaagccaatttataaaaatagcatctttcctaattccaaaatttcaccttttgtttgttttgttttgagatgcggtcttgctctgtcgcccaggctggaatgcagtgctgcaaacatgactcactacagcctcaacctcctgggctcaagcaatcctcccacctcagcctcccaagtagctggggaccacaggtgcaagccaccaggtccagctaaccttccccccacctcccccgaccccgctgccacccgccctgagacagagtcttgctctttcacccagactggagtgcagtggtgcaatctcggctcattgcaacctccacctcccaggttcaagcaattctgcctcagcctcctgagtagctggaattataggtgctcgccaaccacacctggctaattttttttgtatttttagtagagatggggtttcagcatgttgtccaggctggtctcgaactcctgacctcatgatccgcccacctcggcctcccaaagtactgggattacaggcgtgagccaccgtgcccggcctaatttttgtattttttgtagagacagtttcaccatgttgcccaggctggtctcaaactcctggggtcaagtgatctgcccgtcttggcttcccaaagtgctgagattacaggtgtaagccaccacgccaagcccaaaatttcaccttttaaatttattccatttattttgtaggtgaatttcatttatttctcagggttaaattttagcgcttttgcctgtgtctatttttggttcacacctccccagcccactgtcctgtattaagtaggccttccttcaagatcacagtaatatctccctaaatggatttcactacgtttggtcctatttttggttcagttatagtttacagataccatcatgttgcttccctgatttaaatattgggggaaaaacttgctttttggattttatctctgatgttctactggattattttagacttttagaacactatgaaatgggtgcttgcttttcacttttcaaaccttttttgcttaaacaaagttcataagcttattgtagtgggaagttcaaagtcacagatctggtacttactcgcctagtgaccttagagacaataaatctatagagcctagtatggggtctggcaggtagtaagcacttttaatgaatggaagtttaatattctgtttgcatccactcgaccataatcaccccaaatccagcttaggtagccttgaattaacccctactccaccttgaagttttttatttgttttttgctgagacagggtctcattctgtcacccaggctggagtatagtggcgcaaacatgactcactgcagcctcctgagtagctgggaacacaggcctgttgccaccatgcctggctaatatatatattatatataatatacatatattacatatatatatataatacatatgtgtttatgtatgtatgtgtgtgtacattatatatatatatatactttttttagaggcagagtcctgctatgttgcccaggctggccttgaactcctgggctcaagcaatcctcgtgtcttgaccttgacctctcaaaatgctgggattacaggtgcgagccactgcatctggtgaattaagccttttttatacactcaactctgaggtattctgttcataccaatatgttcctttgtatcttcttgccatagcaggttgtaacatccttttgtatctcctttctttttttttttttttttttgagacggagtcccgctgtttagcccaggccggattgcagtggcgcaatctcggctcactgcaagctccgcctcccaggttcacgccattctcctgcctcagcctcccgagtagctgggactacaggcgcccgccaccgcgcctggctaattttttgtatttttagtagagacggggtttcaccgtgttagccaagatggtctcgatctcctgaccttgtgatccgcccgcctcggcctcccaaagtgctgggattacaggcgtgagccaccgcgcccagccgtatctcctttcaaatgtcaaataaatacattgtgtatacagtagtaaaggatgttgattggcattgaaagcaactatcaagttcttgttgatttagaagacaaaaagacaattttaaaataacatcctgggccaggctctgtgactcacgcctgtaatctcaacactttgggaggccaaggaaggaggatcacttgaggccaggagtttgagatcagcctgggcaacataatgacaccctgtatccaaaaaattgtggtggcatgcatgggagactgaggtgggaggatcacttgagcccaggagtccaatgttacaatgagctatgattgcgccactacactctgcttaggagacagatggagacttgtctcttaaaaaaataaaaaataacagtatgttcattaaacattaatctcactgattgtgattttttgtttgtttttttgagatggcgtctcgctctgttgcccagggtggagtgcaatggcgtgatcttggctcactgcagcctccacctcctgggttcaagtgattctcctgctttagcctcccaagtagctgtgttatttcagctaattttttcatttttagtggagatggggttttgccatgttggccaggctggtctcgaattcctgacctcatgtggtccacctgcctcggcctcccaaagtgctgggattacaggcattgagccactgtgcctggcctgattatgattttttaaagtccccccccaaattattgtttgtgcaataaatggcaaaaaagaagcattctaagaaaaaagtagtcttaaaagttgatatggtgtcagaattgtaagagagagggtcttggctgaaaagcctttttagaaaaaattgctccctacaaaaaaggccttttctaccttttctcacatttgtttctttttataggaggcatctgagaagaccaaatctcttcaaagttaagctttttgtttttttgggggggacgaagtctcgttctgtcacccaggctggagtgtagtggcatgatctcggctcactgcaacctctgcctcctgggttcaagcaattctcctgcctcagcctcccgagtagctggaaattcaggcgcctgccaccatgcccagctaatttttgtatttttaatagaggcagggtttcactatattggccaggctggtctcgaactcctgacctcatgatccgcctgcctctgcctcccaaagtgttgggattacaggcatgagccaccgcacccagcccaaagttaagcattttttaaccacaaggtgggaggtggaagtatctcgttggaagactaaaggtgtccactaacggtagacccttttttttttttttttgagatggagtcttactctgttgcccaggctggagtgcaatggcgcgatctcagctcactgcaagctccgcctcccaggttcaagtgattcttctgcctcagcctcctgagtagctgggattacaggtgcatgccaccatgcctggctatttttcatatttttagtagagatatggttttgccatgttggccaggctggtcttgaactcctgatttcaggtgatctatgtgtcttggcctcccaaagtgctgggattacaggcatgagccattgcacccggcctcaaaattatttctaatgtgtgcaaagatatctgataaaaactacatgactnnnnnnnnnnnnnnnnnnnngctggagtgtagtggcatgatctcggctcactgcaacctttgcctcctgggttcaagcaattctcctgcctcagcctcccgagtagctggaaattcaggcgcctgccaccatgcccagctaatttttgtatttttaatagaggcagggtttcactatattggccaggctggtctcgaactcctgacctcatgatccgcctgcctctgcctcccaaagtgttgggattacaggcatgagccaccgcacccagcccaaagttaagcattttttaaccacaaggtgggaggtggaagtatctcgttggaagactaaaggtgtccactaacggtagacccttttttttttttttttgagatggagtttcactgtcgcccagactagactgaagtggcgcgatctcggctcactgcaacctctgccccccaggttcaagtgattctcctgcctcagcctctagagtagctaggattacaggggtccaccaccacacctggctagtttttgtattttcagtagagacggggtttcaccatgttggccaggctggtctcgaactcctgacctcaggtgacccacctgctttggcctcccaaagtgctgggattacaggtgtgagccactgcgcctggccgtttttttttttgttgttgttgttgtttgttcgtttgtttgttttgagacagtctctcactccaggttggagtgcagtggcactatctcagctcactgcaaactctgcctcccaaggtcaaatgattctcctgcctcagcctcccagtagttggaattacaggcgcatgccaccatgcatggctaattttttgtatttttagtagagacggggtttcaccatgctagccttgaactcctgaccttgtgatctgcctgcctcggcctcccaaagtgctgggattacagacatgagccaccatgctagccttgaactcctgacctcgtgatctgcctgcctcggcctccca

SEQ ID NO: 1185 - DNA, 2372 bp, Homo sapiens
gcaccgcgcgagcttggctgcttctggggcctgtgtggccctgtgtgtcggaaagatggagcaagaagccgagcccgaggggcggccgcgacccctctgaccgagatcctgctgctttcgcagccaggagcaccgtccctccccggattagtgcgtacgagcgcccagtgccctggcccggagagtggaatgatccccgaggcccagggcgtcgtgcttccgcagtagtcagtccccgtgaaggaaactggggagtcttgagggacccccgactccaagcgcgaaaaccccggatggtgaggagcaggcaaatgtgcaataccaacatgtctgtacctactgatggtgctgtaaccacctcacagattccagcttcggaacaagagaccctggttagaccaaagccattgcttttgaagttattaaagtctgttggtgcacaaaaagacacttatactatgaaagaggttcttttttatcttggccagtatattatgactaaacgattatatgatgagaagcaacaacatattgtatattgttcaaatgatcttctaggagatttgtttggcgtgccaagcttctctgtgaaagagcacaggaaaatatataccatgatctacaggaacttggtagtagtcaatcagcaggaatcatcggactcaggtacatctgtgagtgagaacaggtgtcaccttgaaggtgggagtgatcaaaaggaccttgtacaagagcttcaggaagagaaaccttcatcttcacatttggtttctagaccatctacctcatctagaaggagagcaattagtgagacagaagaaaattcagatgaattatctggtgaacgacaaagaaaacgccacaaatctgatagtatttccctttcctttgatgaaagcctggctctgtgtgtaataagggagatatgttgtgaaagaagcagtagcagtgaatctacagggacgccatcgaatccggatcttgatgctggtgtaagtgaacattcaggtgattggttggatcaggattcagtttcagatcagtttagtgtagaatttgaagttgaatctctcgactcagaagattatagccttagtgaagaaggacaagaactctcagatgaagatgatgaggtatatcaagttactgtgtatcaggcaggggagagtgatacagattcatttgaagaagatcctgaaatttccttagctgactattggaaatgcacttcatgcaatgaaatgaatcccccccttccatcacattgcaacagatgttgggcccttcgtgagaattggcttcctgaagataaagggaaagataaaggggaaatctctgagaaagccaaactggaaaactcaacacaagctgaagagggctttgatgttcctgattgtaaaaaaactatagtgaatgattccagagagtcatgtgttgaggaaaatgatgataaaattacacaagcttcacaatcacaagaaagtgaagactattctcagccatcaacttctagtagcattatttatagcagccaagaagatgtgaaagagtttgaaagggaagaaacccaagacaaagaagagagtgtggaatctagtttgccccttaatgccattgaaccttgtgtgatttgtcaaggtcgacctaaaaatggttgcattgtccatggcaaaacaggacatcttatggcctgctttacatgtgcaaagaagctaaagaaaaggaataagccctgcccagtatgtagacaaccaattcaaatgattgtgctaacttatttcccctagttgacctgtctataagagaattatatatttctaactatataaccctaggaatttagacaacctgaaatttattcacatatatcaaagtgagaaaatgcctcaattcacatagatttcttctctttagtataattgacctactttggtagtggaatagtgaatacttactataatttgacttgaatatgtagctcatcctttacaccaactcctaattttaaataatttctactctgtcttaaatgagaagtacttggttttttttttcttaaatatgtatatgacatttaaatgtaacttattattttttttgagaccgagtcttgctctgttacccaggctggagtgcagtgggtgatcttggctcactgcaagctctgccctccccgggttcgcaccattctcctgcctcagcctcccaattagcttggcctacagtcatctgccaccacacctggctaattttttgtacttttagtagagacagggtttcaccgtgttagccaggatggtctcgatctcctgacctcgtgatccgcccacctcggcctcccaaagtgctgggattacaggcatgagccaccg

SEQ ID NO: 1186 - DNA, 1476 bp, Homo sapiens
atgtgcaataccaacatgtctgtacctactgatggtgctgtaaccacctcacagattccagcttcggaacaagagaccctggttagaccaaagccattgcttttgaagttattaaagtctgttggtgcacaaaaagacacttatactatgaaagaggttcttttttatcttggccagtatattatgactaaacgattatatgatgagaagcaacaacatattgtatattgttcaaatgatcttctaggagatttgtttggcgtgccaagcttctctgtgaaagagcacaggaaaatatataccatgatctacaggaacttggtagtagtcaatcagcaggaatcatcggactcaggtacatctgtgagtgagaacaggtgtcaccttgaaggtgggagtgatcaaaaggaccttgtacaagagcttcaggaagagaaaccttcatcttcacatttggtttctagaccatctacctcatctagaaggagagcaattagtgagacagaagaaaattcagatgaattatctggtgaacgacaaagaaaacgccacaaatctgatagtatttccctttcctttgatgaaagcctggctctgtgtgtaataagggagatatgttgtgaaagaagcagtagcagtgaatctacagggacgccatcgaatccggatcttgatgctggtgtaagtgaacattcaggtgattggttggatcaggattcagtttcagatcagtttagtgtagaatttgaagttgaatctctcgactcagaagattatagccttagtgaagaaggacaagaactctcagatgaagatgatgaggtatatcaagttactgtgtatcaggcaggggagagtgatacagattcatttgaagaagatcctgaaatttccttagctgactattggaaatgcacttcatgcaatgaaatgaatcccccccttccatcacattgcaacagatgttgggcccttcgtgagaattggcttcctgaagataaagggaaagataaaggggaaatctctgagaaagccaaactggaaaactcaacacaagctgaagagggctttgatgttcctgattgtaaaaaaactatagtgaatgattccagagagtcatgtgttgaggaaaatgatgataaaattacacaagcttcacaatcacaagaaagtgaagactattctcagccatcaacttctagtagcattatttatagcagccaagaagatgtgaaagagtttgaaagggaagaaacccaagacaaagaagagagtgtggaatctagtttgccccttaatgccattgaaccttgtgtgatttgtcaaggtcgacctaaaaatggttgcattgtccatggcaaaacaggacatcttatggcctgctttacatgtgcaaagaagctaaagaaaaggaataagccctgcccagtatgtagacaaccaattcaaatgattgtgctaacttatttcccctag

SEQ ID NO: 1187 - DNA, 96592 bp, Mus musculus
  misc_feature (22474)..(22493): "n" at positions 22474 thru 22493 can be any base
  misc_feature (30734)..(30753): "n" at positions 30734 thru 20753 can be any base
  misc_feature (47597)..(48214): "n" at positions 47597 thru 48214 can be any base
  misc_feature (51244)..(51460): "n" at positions 51244 thru 51460 can be any base
  misc_feature (78053)..(78072): "n" at positions 78053 thru 78072 can be any base
  misc_feature (81276)..(81392): "n" at positions 81276 thru 81392 can be any base
  misc_feature (85644)..(85778): "n" at positions 85644 thru 85778 can be any base
tcagaatttgactgtcctaaagaaccttcttccgctgtgcgagtctgggcaggcagaacattcaggagaaaccacagggaaacaggtctgtttttaaaatttccttttcatgctctgtttcccttttacctcctctcctgttctttccatatctactgtcattttgctacccagaaaacctagtgattcctcccagctgacagggctgagcttgtgtttccacggagtccaggttcatggcaggcctgttgaatatggccctggaatgacgtgctttcctgctctttatttatcagagcctatgactcatagggcctagtggactacgcttccaaaaagcattagtttttgttattttccagttagcatacaaactgtttcagaatgacagtctcagacagacagccaaacagacagacagagagataattttactttgtttaattttacccttgtccctcttcacccttcctgctaatcttccttcacacaaacaattcctcttctgtttccatgtcatatagatatgtacactccccccacacacacataccccacacacactcacacagaccccttttactttcatatcaaccattcttttctattggggaaggtagggtaggtatgccccacggtgagcacatagaagtcaggagatcactctccagagttctctcctgccaccctgtgggatccagggttcaaacctaggtcatcaggcctggaccaaagggcctcttaccactgacccatctcaccagccttattcaggttttttccccttcaatctgcatatgatagaaaacttgtagtatttcttgttcaaaatctggcttctttgatttatttgcctctctagttccatctagcatacaaactatttcagaatgacactcttaggtagatagatagatagatagatagatagatagatagatagatagatgcatacatacatacatacatacatacatacatacatagatacagatagacagagacatttcattttctacacttaaatacatctctgctatgtctatgcaccacatttgctctattcagtcatctgctaatagacacccatgctggttccatatccctactactataaatagtgctacatgaacatgaatgtacaagtcatctgtctaaaatgctgcctcagattgcttcaggtatatacttaggaatggtacagtttggtcatatagtcattcttttttgtttctgatgaacctccatgctaacttctatatggctactctggttacatactctacagtagcgtatgaacatctgttcccctacatatctgctccagaacttattggatttttttttgaggttgttttcagccattgtgtatacagtgggatggaatctcagttctgtttgttggttggtctgttgtttagagacagggtcttccatagcttagtgtacagtatgtagactgtggaccaggctagtctcaaactctccctgatgttcctgcttatttttcctaattgttatgatcacacatgtatgccaacaaacctggcttcattgcagctttctgaagttttatttttagatttatttgttttatttttatatgtttgcctatatgtgtgtacatgtacatgtgtgggccacatatgtgtgtggtccttgcagaggtcagaagagggtgtcagatctcctggaactggagttacagatggttgtgaaccatatctgaaaactatacccgaatcttccacaagagtatgtatgctcataactgctaagacacctccacaacctcaatgtagcttcaatttacattttcctatggctaatgttcctatgaacaattttatattttatatgtatttattggctaattcacttcttttgagaactgccttttttaatttatctgtccattcattgattgactttgtcttttgtaattttgagtcagggttaaagtttttgaattctttctatattctagatatataaagattaatagttggcaggaatttttctcccaaagatcctgaacgttaatgctttccctcaaggttcactttagctgtcttgcttaaagcttgataaaaaaactaaagtcctttccaatcagacacgtgtgagcaagttttccctgagccacaagctgcagtgcaggaaactatctggatcaaaaacgtgttctcgtgatttccattaagggattgtctcttgttccctgtcccctaagcgagtgctgataacagtcctccataccttagcacgtaagtcaatcattaacaatgggctgtacttttcactgggttgtaaagaataagaagtcagagctacagaaatctcctttcttgaggtaggcagtggaaggaagagtgtcacttgcctgtaaacctcataaccaatatgtagcaggctgcagcccaacacgcaggggacgtgtccgaacagaggagagtcacaggtaaggaatacgggtccatttctgtttctctatccattctgattctctcttctcacctttccaatctgtggactaaaaatgaacagggtcaaggtgtgattacagtatcagtggtagaaagaggtttctatggactgacctgtgttttaacaagagatgggcattagatgttagttaattcacaatctccgtctgactccttcaagactgatttcttacaaacatctgacttcttcaagactcggagttccagagagaaaatgtatgtcagttacaggagcaaagatcagcgcaacagcagtggtcacatgacaggccagtccttggggaggataaagatgaattagtgtggacttgggaacatctccagatcctactcaaaggcaaaaggaggttagatggtaaatttgaaagaattgctacaaactgcgccaaaggaaaggaattatgcttatttctctttttttgacagactttgggggttttttggtgttttgtttggtttggtttggtttggtttggtttggtttggtttggtttggttggttgtttttttgcaatgatttgttttaaaataaatttgtcttctttagaaagcttccagatactcactttcctttctcaacgactttcttctgctattacatgtggcattcttgtgacacatttatgacgacgaaccaacgttagcatgctatctacttaagctcttacactatctacattaacattgagtatttgtctcagatatttttatgggttttaagaaatgcataatgacacatcactgacttgtacaaaatagtcccatgatcctaaaagtcccatgttctacctagttctctttccccactcccctaccaagcccctcaaaaccactcaccatttttcctgactccatggctttacccggtctaaagggtcgcctggttgcaatgaagtagaacgtggtcttttcggattggtttgaattagtagtgtgcttttgagttttttctgcatctttctgtggctcagtagcacatccctctttgtcgctgagtaacatatgactatgtgactaaactacagcaaatgtatccagttgggcaaatgttttagcatggtagaaagtggaaacgataaaggtggggggagtttagaaagtggcagtactataaacgtgatagaagcaagaagaacacgaagtagaaaaactagctagaaagctaaacacagatgcctcagttgaaataaaaatttttttaaaagctctggttctagggtggcgccagctcttttctaagcatatagattatgctgggagacacattaccttcaacccaagagcctacacatggtaggcaccccataacatttttgaagcccccaaactccaagactttttccaaaaagaggcttccccaagacaccagcttattggctcagaagccatatcagggaagctgtagctgcttggtcagatgagcctttgcatgccataggataagaaaatattcccttgataacctttgtttgaccgtggcttatggaagctatgagtataagcaaagaactcatgtttcaacctaatcacagaagtagcccaaacaatttccatgtaacaacaacaaaggctatgagaagatgagccagctatgccttcaaatgttcaccacattctagagcagagaacagtcatgtaccattatcagtagcccatgcaatgatgtaggagcccagtccaaggtgatgcagcttacagtatggctgtgtagttgtccagggaaactgatgggccagctggggcttgcagaacctaaagagacctgcaagtagcaatttgctaactcagtggggctaccatgcaaaaaaagctgatcacccaggctagtcaatgtattggttcaaaatcatcaactgcttaaaaccaggttctctgccagagcatagcattgctattccttaatgcccagattcctttcttactgtgtgatgaaatggggaattagccagacatgaagataggaccttgtgattcagagcttttcatgtcctctactaagttaacttacacactcagcacaggctaaaaaatacctgaggattttctacacaagacaaatctgggaactgctttgcccaaaggctattctgtagagtggagctcatccaaagacttacaacttactgcttgtctcggtttatgcttacacaacaagagggcttgaccatcattgtagacagtttagaatggatggtggatttggaggcatcggaataagcaatgtgtagctctctatcccactcaaagctcctggatgggaatacttgaagaaggagatgtctatgtgaagactgattctgtgagcacatctgccgacctagagatcttcaagccacagggcaatagaaacatctcaagcaacttccgtgtaatgagaaatgagcagaggagaatcagactctgattccaacacagcatcagctggggaagcagctgcctctatgcatcagcttctagccacttctgcttgtctggcttgtctctagagcatatcctgaacataaagtgcctgagacaggaacaagcagtacctaggctaaagccacaatgacacagaacttaccttgcttgtgcaaagcaccagactcactttcagaacctggggcaagtctagatccccaattttgaaaagcattttgatgatttcatatatctataggatggatttttttgtcattttcatgtgagcacatgtgtctcccccttctcctgctggaatttttctcaactggtgtcccatgttctctttttctgtgtgtatggtgccagataattgactccaaatttttctgggagaaatgtgcatctatatctcaagactttgttttcaaggaactaaccaaataggatgtccatcttacttccttgtttatttgtattttcttttatgtctagaagaaattagtcatgaaaaatctaagaccaagtccaacatttggtagtaggggagaggaagagaaggcaaggtactgtgtcctgggaatgtgactgattttccagacaaaccttctcgtcttcttgtccacattttctcgtgatttgtttcagaacccttcctgacctcactcttttgaccttatttcatgctcttctctccacctgcctgatagtactcagctgcagacacaggacacatttatgcatctctcatcagtatagggctcaggattatcccccaagggatatggcgtgggtgcaaagatgagagcacaaggcagagaatgtcacgagatggacacaatctcttccatagaagccctcatttttagggatattaaaggacagacactatggcagaaaattgtacaatgtccttggcattataaagttaaactctgggccctttgaccatccatatgttctctccatgtaggttaatcaaccacaaattatataacaggataggggttggaaatacaaaggtggatgaagtagcccttgttcccaaagagctaatgggtgagactggctcatgggtccatgatggtggcaaaaagtacggtgacctgggaccacatcacagaaacttgtaatgaggtcagctcaagaggccctgggatcacattgtgatatacgatagagctcctaagtaccaaactgaaagatgaagctgagaggaagatgtctgcggagagcattacactggaaagagaagccccagagagcagagaacagaagcacagaagtaatacagtggtagctggaagactgcaggtcaaataaaggaaattgtgatgtttgtcctggggagaagtgatacctgaaacagaaacagggctagcccctctggatggacttaagccatgcaagaagatagagactaaggaaaaccatcagagcattgcagatagatgaggcatgaagggagatttgcatttgaggaaggaaaagtctggatggaatgtgaagaatagtttaaaggagacaaaacagaagacttggaaaacacgtgggaggctgttgacatgaggtggcttagaaacagtgttcctaggaagtctcgttctacacctgtcacctcagggttcctgatgacccgtgagcaagactttctagaaagagccggttcattaatcacgtcacttctgtggtattaataaagcaactatcatggctttattttgtatcgacaacactatcatgtaaatattccttactgataagggccagtctccctcagcatttgtcagccactaggctcagggagccagctaccttgcatttcttcactgcctctgtaaagagaagttttctctttgattatgagtagatacacaactgccttgatgcttgttctagcacagcggaagaggataactaccagggaaactcgccaatcacaaggaaatccgagtgtttctctcgtaccccagtgttgtcagttaggtttcatttcaaagtcaagattgttcaagccaaagtacaattggttttaaatgctgtctttaaagaaggaatatgttagagaaaattgcttgacactcattagtgtgaagcatgagggcagcacttcatggctgtgactcagtctaaaaatttcatcatctctactagtttgccagggtggccatagcgaagcctagccaactgggggatctcaaatgacagaaagatattgcagttgggaggccaggaaacagaaatcaaggtgatcaaggtagcaaaagtggctgtcttctgaagtcagtgaggaagaatctgttccttgtctttctcttcactactaatgggaatcggttgcactccttggctcatagaacacccttgcctcttttttaatgctgacatggttctctctctctactctctctctctctctctctctctctctctctctctctgtgtgtgaggggagatttatctttgtcagtatgaacccatatgtctagaccgagccatcccattttaataagttagactgaagcaaagcccatcataatgggctcctctcagctgcgtccctctgcgatgaccttttttccaaataagatccaattctgagatgtcaagtgttcttatgtttcaacataagaatttgttgtacattgacagatacaattcagtccaaataccacctaatatgatttcaaaattaaataagttatcttctatttaaaaaaaataaaaccttgaagatcctccagtttctgagttcttcttctgtttctttcttgagagacttgaagttcttctcatacagatttttcacttctttggatagagttaccctaagatattttatattatttgtgaatattatgaagggtgttgtttccctaatttctttctcagcctgtttatcctttgcgtagatgaaagctactggttggtttgagttaattttatatccagccactttgctgaagttgtttatcagctggagaagctctcaggttgaatttctggagtcgtttatgtatactatcatatcatctccaaatagtgataccttgacttctttgccaatttgtatccacttgatctccttttgttgtcttatagttctagctagaactttgagtactatattgaatagatagggagagagtgggcagccttgtcttgtccctagttttagtgggattgcttcaagtatctctccatttaacttgatattggctattggtttgctgtgtattgcttttattatatttaagtatgaaccttgaatacctgatacttccaccacttttaacatgaaagggtgttgtattttgtcaaatgccttttcagcatccaataagatgtcgatgtgattttttttctttcagtttatttatatagtggattgtattaatggattttcatagtgaaacaaccttccatgcctgggatgaagcctacttgatcatggtgaatgtggttgatcgctttgatctgttcttggatttgttttgtaagaattttattgagtatttttgcctcaatgttcatagggaaattattctgaagttctctttttttggttgggtctttgtatagtttaggtattagagtaattttggcttcataaaatgaattaggcagtattcttaatgtttctattttatggaatagtttgaggagtgctggtattagctcttcttctgcactaaagccatctggccctgggctcttttattggggtggggggatttttaattacttctatttacttaggggatatgggtctctttagataatttacctgctcttgatttaactttggttcatgattctagttttgttgattcttttatctctttgtttctatttggttgactcagccctgagtttgactatttcctgtcatcaactcctttggggtgtgtttgcttctttgttgttgttgttgttctaggactttcaggtgtactgttatgttgctagaggagaatctgtccaatttctttaccagggcacttagtttttttcagcactgctttcattgtgtcccataagtttaggtatgctgtgtcatcattttcatagaattccaggaagtctttaatatctttctttatttcttccctgaccaagttaccattgagtagagagttgttcagtttccaggtgtatgtgggttttctgttgtttttgttgttactaaagtctatccttagtctgtggtgatctgatgggatgcatgggactatttcaatcttcttataaaggttgaggtttgttttgtgactaattatatggccaattttgaagagggttccatgaggtgctgagaagaaattgtattcttttgttttcgagtgaaatgttctgtatatatctgttaaatccatttggttcataacctctattaatttcattgtgtctctgtttagtttctgtttcagtgacctgtccattagtgagagtggagtgttgaagtctcccactattattgtgaggggttcaatgtatgttttgagctttagtaaagtttcttttatgaatgtgggtgccaggataggagagtatgatgagatacaactgattttcagttgtcactgagagtttgtagtttgggtgagctagggcaaaatctatgaagtgaaggcattatgtcctcctgaagaacccagagaatgagtttttcaacatttgagccttgttcctatgggcctggataggaccaccatagtgagtcttagaatgtcatttcaacgtgccctggatgggatgaacacatgctgcctaggggagtagctgacgtgcatcaaagtgtttactcgacccagatcacatcagaatcaacccttgtaaaaataaataaggtatgttgattttttgtgcagatggttaaacaaatctgatggggcaaaatgagttctaggaataagggatatcagagggcaaagctgctgaagatagcaagagctgcacctggacaattttggggcatagtccctggcagctgtgagtggctgttctaggggactgcagtgccaagagaagaatacttgcctgccaaagagagaagctgactcaagggggcaaagtcaagctgagctgaattctagggaaacgtagaagagcaatcatccagagaggggctctgatagagctccctggccactgtctgctcttttcagaagtctggactccctgacctccaaggcctcctcaaggtatggagttctctccctcttggatgtttctatctcctttcactgatgctcagggagacttgtgacttgagctggaaaatactgctctgggagggaagaacggtctgttgtcctaaagcagtgtgaccttggaaatgtagctaaacttttctggactcgatgtctttctttgttttctgagattcttggagttctggaaatcatgggctcttctgggtgaaatggatcttagaaacctagcccagttttgtggctgaagaaactaatgctgaattgagagatttcattattgtcaggaaactaatctattaaaggcagggtacataaaacttgaagatcttccttctcaccaagaaccaattccacaaaggcccttggtgtcagaagcctacatttgttcctcctgagaatcctctgaagtacagtcttctacctgcctcagacttgtgcaaactggtttccccaatggcttcctgctgctgaataaaaagtcagaaccttacatgtcagacacatttcctgccacctccatttaccctcctgcagttccctctttctaactggcttcaagctgagtagaagcaaggatctgattgttgtgagtgggcaggttcatcagagggtacagatagaccaacaaaaagacttattccaagcaatatccagtttcccaaaggaaactcctatccaatggatgaaagatattattatgtaaggattgttttatgatttgatatgaatttaaatgatccgttgtgaaatagaatgcagggatatggcagcacaggttggatgggagctaactggatgttctgcagtgattggattctcctggatcaatatcctcctcctcccgccctccctgtcttatctttggcttagagagccaggtgcatccaagtacaggattcctgatcagcatcagcacctctcaaaatctaagagaaaagttggctcctctgggtaaactgaagccttagcaaggtactgatgcctcctctgggtgactatgttacaccttccaaagtgatttggcttttatgtcccagttagatggtttggtgtcagcagcatattgtagcttacattgaggataagttaagttattggtcccaccccccactttttttttttttttttttttttgaaacaaggtctctcactgaacctggaccaatttgccaagagtaccaaatcaagccataagcagtctcctgtttccgcatccccagccctaggatcaaaggcatgtgctactaacacctgggcttatagatggatgctgcagatgtagaactcaggtccttttgcttagtgcagcagacacattacagacaaatctgtctccccagccctcattttgttcattcaaatatcatccaaatttatctgtgatagtataaatgagtgagttgccattccccttctcacactaagcctttgaaattcaggatgaatttcatactaacagtgtgcccttcaataatacagatatatttccgatggagtctgctgccatccaggataacacatttgtgcaggaatatgtgctttgagccctgtggtgtctaaggtgtatctttcaacccagatctttgacgtgttagagagcagtgacatggttggagtcacgcattctgtttcagggattctgagcagaaacgagccaggaaatagtgaccgttccctggctaaccattcctccccagaagcatcaatgttccagtcccaggcagctttccagactgccctaatcccttgacatgcctccaatgctagttcccagcagtaagcatgtaagacacctgccttcccttggtagagttccagtgttaattattaacaaacaaatccacggtgcaccacagcaagatgtcactgtaaggctaccaagtttcctagaacatgtccaaaaggactttgttcccactgggttcctagtctgagtccagaccagtgtatacacaaacaatgggggtggtatttttattagaagaacttcaagctaccaatcctggagaacacacttggaagctttctctaggaaaatgtctgttcctatttgaccctcaaccagacaggtgtctgggaagaagaaaatcacactacctaagagggaactgcagtaaccatccatcacctctggcatatttatagataaattcacctattgtatgcagcaactgtaatggaggataagctttcaggagatttgatttactaatgacatagacacaaaggagtggcattcacacaccctggatattagagtggaggggatgtgggaactttgtcccattctagaatatgcatgaggcctctgaagtacagacaaggatggagcccagagtgcaaaactaacaagaagaggggcagattgcttcctacccaaggagagctggatatccaaagctcacttctgtaaagcctttctaggagttccttcaaattttgtttatgtgaaacaaagcttttcctaatgatgtaatgtggctttggcctaagtcacatcaaagtactgtcatcttaaactaggggttaattgtcgggtagttactatctgtatggccctggcacactcgacagctactccatttccgcaagtgcagagccctgtgactcactggggacgggcatgagcgttcttgccttactaggaagattgaataagcacagtcaaggtgcttagccatctattacagcagcaccataagtcctgcctttgttcaggtagcatcatggcctgaagacaggtccaggtagggtcattctcccaggcagagacaatatccaggtgtctatgtaatgatacgggtaccaggatcttgccaaatctgaccatcctagtccacccagactgttggtatggttttatcttctaacttaaaacaaatgctcttttggaggaaaaacttttaattagctgataatctgatgattatcaggacttcaatgtcatcaccagcactaaaagaccaaagtcttatgagcaagggcatacaaacatacatgtcttaggactcagtccatatagtcagatggccagttgttatctagattttaacactcttggcttacttgtctattacaaatactatggaattcaggtcatttggagactgccatctttcagttcagaaaaattattttgaaaatccttcagttcagaagaaattgaggttcttcaaaacccatgtttcttgctgtttgcagccactaattattccataaccctgaggttgcaacactgttcagtaatgggctgtgaacctaaaacaaagttatcatatgctaatatgaatgtctatggccaatcccaggccaagtaatccacttattccctgtggcttttcctccaatatcaatgcaagaggagtagggaacacacctgcatcctgaagaccctgtttgctatggcctggagctccttggacctggtgaaattaaatgaaaacaatatgatgatatcctctagagggagacctgggtctgaaatcaggatgctctctggtcataggaggcatggtgtgggcttgtaagcttgagtagaggacatgaagcttaagaccagggccttttattacaagccttttattggtgatgtacctctaacaaggtacatttggcaactaaaagtgtgtccagggaaaagctgctaagaatcagactgaggagcctagaaactctgaggagaagttagggtgcttcccccagagaaactggatgccaatctattgtttgaaagccagtcctatagaacaggtcttctttgttccaaataataaaaacaggagctaggtcaaggaaactgttgcaagttattctcttacttctacacgcatcatgcatgctgtcacacacacacacacacacacacacacacacacatatatatatatatatatatatatatatatatatatatatatatatatatatatgcacacacatgcatacacatacaaatgtgtatgtgcatgcacatgtacaaacaaatgaataaataggcaaataattgtaaagaaaatagttgaagtcagagcagtgaattgaatgaagattccaagacagagaccctgggtcctttaagctgcctgctctctaaggtgatgcttttcttggcatatgatggagaacaggggtaccagccatggaattgatggggcactaaagagcctgttagagagatgctaagaggctcatttgtggattttaagtgatgaacaaacaaagtgggtttatggttttggtgttctgcaaactgtgattttcgacttaggccatcccacatattaaaaataaaactaaaaataaaatcaggctccatgggctttacccatcccatcttagcatgtctgttattgttgtccttgctccattcacgtttagccaggcatgttggtgagcctttaagtacaacttctgaaattactagcaagcacaatctcacagcaaactccctgatcctctgcctctgacaatctttctgcctctcttccacaatgatccctgagccttgggtataggagtggtcttgtagattgggactgggatcctccatccatttggattggttgtggtttgctgggagggtttcactgtctgttgcatagaaaggtttcttcaatgaggggaaaactcaggggtgagcacgacacttctctgtgagtgtaaggactctagttaggaactatgccagcttagcaaagtgctgcttgcagtttctccatgacgtcactggcccttcctagttggctgggttcccaataccaggtgtgattttcctcttgtcaagtgggtcttaggtccaattagagaactgttggttactactaaggtatgtgtgccagtactactgaaccctttgtattaccatgacatattggttataatgataaccatatgtgttatatgtgtgtaatatacatgcaatatatatgctatttatgtgtagtatatatatatatttatgtgtattatatatatatttatgtgtttcacatatatgtatgtgtgagtgtatgtgtgtgtgtatgtgtgtgtgtgttccagttcatggctgtcatagacctactggctgcttctctcctttggaagcttgcatggtgcattctctaaccatgaaatctaatcctcaaggaacaggctttcaggtcaattcccgtttgggagcctctgtcactgcgtctgaactacttggtgtcttcagcattaagaacagaatgctaggaaggtgtgttgtaagtagtttgtggtattttgttttgttttgttttgttttgttgctaagccaatgggtcacaataagcagaatggtgatgtggctaagaacatgggctgtggaggctaaggccataaggttcaaatgccaagtcttctcttattggagtctgagaatgtggggcagttacataatttacttatgactgtgctttggtgtggagatagaaatgataatgtttgcccctgctgttatcactaggttttaatcacaactatctttgactcacaatgaacactcagtacatgctggaaatgattctcatagaaggaatattaccttttatttcttaagccaatgtgagaacttaaaaggcaccagcttgcaaacacagagactatgtctcttttgcattgtgttctaatgaaaggaaaattaaatgcacatacatttttattataattaggacacagttcaaaagtgataagccctgttggtctagggaatgactactcctatgacataaaggaaaatgaaatcaagtccagtatagatttttggccatgaagctcagagagtaagtaagatttctggaattcctatcattctatgtggctctatggcttattccccaagagaggcaaacaattaaggccctgtgcagaggtgcttccaccctggtgtacacagtgaagtagtaacagctgatggacgacctcattagccctcccctaagcctttctgtctcatcatgagtctcagctatgtgaccacgggaaacaggagagaaaaagatacaatggggaccacgtgtctctccttaagtactgcttatgatattgaggttgggggtctctgagccatttattcctcctctggttctttggaccacttgggcattggactctacacccctggcagatcaaggcacattctgtggctcttgggagccttcctgatcctatatggaatgacttagatcaatgggaggacagcagcagactcctgcagtcagtcaaagtggtttccactcctaggaggaacacaccagtttgtttctgtgtgaaatacagaaatatgacagctttgtcgcaacgctaagcaaaccattgtgtggcagaacaagcttctttttcacgtcagaggttgacacactggccccacagacaacaccaactgttccctttggaaacagaatggtggcaagaatgagcagttatgtggacatcatcattctggatcatctctaagatcaacattattttagaatgctgacaatgatatgttttgtgggcatgctccaggggaggattcagtacatggaaaatacatgctaatcatccacacataactgagggaatcataaagagtggatgatgccctgagggaatgtgtattatttacagagatatctccatgtcaagacccaatgcatcagatccatgggaaatcggcaaagccttctctggtctgagtatgactgttgacagtgtgtgcaagcacgggtgttcactaacaatttaccagtttgtgcaaaagctagcaactgcagcttcctccctgcaggtgtgtactgcctgagatagctcaaccttctttggagactagctaaccaaccccctgtctcgtagataacaaaaccccttacgtttcagactgcctcagtaactgatctcctccatgcaaagaagcatagcccatccaaacgcagctacacgtgtctgtgtctgtcctttcttcattccctcactgctcagtcaggtcacctccaagctgcacatggaacacagaacatccccatcaccttgggcccaagcgtctggcatatgcttccaatcttcaagttttgagtggagagaaaatgtgggctggaatctacaaatgtgagctggaagccattcctcatgataaccctcgctctttcttgcctttttcttttctgtgttttttttcttcatttattgcttatgacactagcaacgcaacctattggaataaaaatgtgtgcttcccagaacattgtctaacttacttctcaaagaaagggaccatttctgttgatagtaagacttggcttgaaagggccagttaaccctggccccagtttgtcttgatcaacatctctaaggcgtcctatatttgatctagcacctacagaaagagtagctacgctcagaagaaaaaaatatctctacaaaagattcacttgtatgaaatattttatacactaatctagctgaatcggtctctttctggtagaaaatacagtatccaaatatatagggagtaattatgataggtaagcctgataaagaagacctcagatcatgtgtgaccagataagcctagcaattgtctgaagacttcaaactaccccttaggactactgaaaggatgcctgaagaaaaacatctagaaacaagttttgtgtggaccaaacaaggagcaacagagaatttttgcacacagggagtctatgtaactgccccagtcatttctcctaaatctttttctgctagaaagacctttggtctggtcccactcatcattttaaaaagacttacaggattgaaatgattttagcctcttctttcttccttctttacagaaatgagttctgagacgagaagacttgggtggttaagtctgatgctgttaaatatatcaggggttgaaaagggcttagaagtgtaacattcagctgggcatggtggcacacgcctttaatcccagcactccggggggcagaagcaggcagatttctgagttcgaggccagcctggtctacaaagtgagttctaggacagccagggctatacagagaaaccctgtctcgaaaaaccaaaaagaacccaaacaaacaaacaaacaaacaaaaatgtaacattctgattgatggcatgtcccttgaaatgtttctgagctttactatgcattaaataacttgaaatgaatgcaagcatgcacagtgcttctttctgtcttactgaatttaaggatgccaaacaattctctcatttttcctttgctggaaggtgtggctcaccattctattagacaaaattgtagctgacctctaatacctaattagtgcaaaacaatgctacaattattgggcatgactttgacacgttttggctgctaatgcaaccactcctagttaaatagattggcaatgaagtttcaatgcaaactttgtcaatgaggccagcctactactagatatccaaccatatagacaggtaatggctgaacagatcttcattcctacaaaacctcaagaattatccattttgcaacttaagtatatgctgttcattacttttgtacaagcttgctctctctctctccctccaccccccccctctctctctctctctctctctcgtgtgtgtgtgtgtgtgtgtgtgtgttttaatggcttacgaatccacataggattcttgtacatattcattttggttatttattcccccttaattaatcccccttcatctccatgtctctccctgccctgctggacctaaccctcttctttgctatattctcttacccactgtccttcttttacatctttatttcaatcatgtggacccgtttctcattacctaggctttatccatactcacttctacttagagacacatgtttaacagtgaaaggataagattgccatctgaaaaagggtgtggggatatggcgtgtttatttttctgagtctaatttcttgagttctttgtatatattggacattagccctctatcagatgtaggattggtaacaatcttttcccaatctgttggttgtcattttgtcctatgacagtgtcctttgccttacagaagctttgcaattttatgaagtcctgtttgtcaattattgatcttagagcataaggcatttatgtgcatgtgtttgtgtgtatgtgtttggaagcaatgcttctcccatttcttggagacttttttttttttttggagagcagttgcctagatgttcatcagcaggtgaatagaaaatgtggtgcatacctacagtaggatttattcaacaataaagataagcaaaattacaaattttataggaaaattgatggaacatctctctctgtctctgtctctctctctctctccctggtggtgggcatataaaatgcagtagccacttcagaaaacggtctgacagacatcactcaagagcctcagacaaaaggttgtcatgtgagcaagggagtccactattgcctatatatttctctacgttggtaacagatatagtatgtaaaagtgtttgtagcagtactataacactatgcataggtaaaaaacagctcaatgtctatcaacaaataaggaaaaaaaatgtgctaagtaatatgatggaatagtactcaactgcagaaaagaatgaagtagatgacatagtgatgcagtgtagaacacagataaggatcaacagtattatgctaggctaaaagtcacttatttgttgtctataggatagaacctgaataggtaaatccaaagagagaaatgctagagtagtgtttccaggggctgagagaagactaaactgagtgtagatggattatatgtcttctgctgctgctccttccatgtctggctgacgacagatgttttgacaatggatgagaagctgatgaataatttttttaaaaaaatactgaactttacgttttaaaagggtaactgttatatgagtactctcaattttaaaggaaaaaaagcaatgtttaaaagtgggccaatgttggaagtcaactgtgagaagttaagagcagattcacaaataagcactggaattgggccttgatttgggggaatattaagaatataactagaagacgttgtaagaaaagtttggatgagtcagaaaatagggagaccggctagagagatgtctcagtgtttaagagcactgattgttcttccaaaggtcctgagttcaaggtcccagcaaccacatggtgcctcacgaccatctgtaatgagaaccaatgccctcttctggtgtttctgaaaagagtgacagtgtacttgcataaaataaataaataaataaatctatttaagaaaatagggggacaattgtgtgttagcaaaatacagtagagactagactaaggttcattaaaacacaggccaataaagatgaggccacatgtatgtgttcaggacacatatactgtaatacgtaaaatacattaaaaagttcagacttcttcaggctcgtgaaaaacacactgtgaatgctttaaccctcattgtctgatcgtaacccattcctagtcatctccctttcctttccagctagtttgcatcttacgtccgcgtgtgtacatgtgcagcttctatataggccgccacagctgattcctgtttgtccttttcccaattttttatttggtattttcttcatttacatttcaaatactatcccgaaagtcccctgtacccttccctccccctcctctacccatctactcccacttcttggccctggtgttcacctgtactggggcatataaagtttgcaagaccaaggggcctctcttcccaatgatggccaactaggccatcttctgctgcatatgcagctagtacttggatggaaggccacaactgactcttaaagactgtatgtaacaccaaatattagagcaattgtcttcacttagtagcatttctgagggtttaagtccctttcatttggattctcagtttccatgtgcaatgaatttttttacaggtgagcaagaaaagtatggaaggaagcctaagaaaggccgcaatgagactttaaaaaatgatgccaattttagaacgcatcttctctttcagacttggaaaattaacttttattactgccctatgcaaactaaatttaaaataagctttggattataccccgtgcgtatgagcggacgttatgacattgattgacaacgtcagatctaccctcaaccctctgagagtatgattcacacatacctgggatcagaaaagaagtgttttccagactaggcaagtcactagagctctggtggtactcagggtagatttcttccccataattcctagctaaagatgaaagatacagacaaatgacccatcctaggagaatttacaagggtagtggtaagcaggtaggtttcagaacagctcatgaaacaattctgcagcaggagtcaaggagtcccaaagaagtggcctatatgggacagcaaggagagactcaaaaaaaaaaaaaaaggaggaaaaaaaaaccctatgtggggctcagcagtgaagagcactgagtgctctttcagagatcctgagttcaattcccagcaaccacatggtggctcacaaccatctgtaatgagatctgatgccctcttctggtgtgtctgaagacagctacagtatactcatatacataaatcttttaaaaaaaaagtcctatgtaaaaggcataatggtagatgttgcaagaaagcagtgtgtgtattggtatctggcaggaggctcaggaatgttcacatcacagtcgttaggaaaggaaagcaagggaccccttattgtaggatatatggacaatttaatcatggggtttttttcccccaataataaaattttcagcaggaaaaaaaaataacagtaaacagtaagctacgtgtaacataaggatgaaagatttcaaaacccgtcttttacaaaatgcacagcaacagcttcttttgtgacagcatcatcagtccccgtggtttgcagccggatgtaacaagcccttttgaagagctaagagggcagaaagtttctgttgccaaatatataagagaagcaggaagcacttagcctcggaccaggaagggcatccttgcaggagaccctgcaggtctgtgcagttcattgcccaatgcttcccttaaataaagagccacagacttcaggagtgtgttcccccctgagtgattctgcaagagttgtttgccctccagcactgggctgtgctgaaagagtttagtttcccagggaacaagatctgggtctaaggcaaggcaagcagcatcctatgcccaaaccagtaactccgttttctcagcctgccaatcacattggagcttccagaccatcannnnnnnnnnnnnnnnnnnngcctcaagtctccagtccccatcatgatagtgagacccagaggaaagggaacacctgttgccaccattttgaagggacagtggtgacccataaagagggtgctctaaaggagacaggacaattcaaggacttggataaaatatcaaactgacagtggtgagcaactgtcaggttctaggaccagtttaatcctgactgggcagaggataggggccatccacacaacccctggagggagcgttctatagaaccggctgccttggtcagcttagggcaaccagcattaaggcagcaggaggagggatataacccaggctcacctctcccaacccctacacagggttccttcctgccaaggctctctacacctttagtttacagtggaaatcagaaggcagtaggactcaggtgcagaccatataattcagaacaggaaacaggaaatgtggaagaaggaggggctaagggagagcacaaacattggccagctgcagcccggccccaattgggactgcagacttgggtagatggatggttgccacatcctgctctgagccttttgagtgactctgagatagagcgcctctgtggagttccacagagcaggcacacaggctgaaatcatgaggtttgtattttacctccttgccggtttgcaagtcttgaaagctcactcctctaagctgatggcagccctcatgcaaagcaatctgattgctgtgtctggggttcaatacacacacacacacacacacacacacacacacacacactcaggtgcacgtgcatacacacaaagacagaacagtttgcttgcaacattgtcatagcttagtgaacagtatagcattgttctggctcaagaagccctggttcttcaaagctcctacttagatgaaattatttgcatcacaaacaaaaattgttttgcattttttagataatgaaggatcgtttaaatatataaattaagggctatttagaaaaaataggtgtctttgtgagactggcttaattcacttaccatgatcatattcagttatggtcattttaaatacaaatcatgtgtgttccaatgacgtgagattacagtgaactatctagggaaactaacaggagtggagtagggacaggagaggaagagaaacgatgggtgatgggcacatatgctcaaaaccataatgtactggggctggagagatagctcagcggttaagagcactgactgctcttccagaggttctgagttcaattcccagcaaacacatggtggcccacaaccatctgtaatgggatcggatgcccgcttctggtgtgtctgaagacagtgacagtgtactcacatacataaaataaatgcatctttttttaaaaaatcattatatacttgcatggaaatgaccctatgtaaccgagtttcatttagttgtttttcaattgttagagaaagactaaattttctctaagatagccatatgaagacagttgatcactctatgtcccagaagcccatctggaacttagcattttgagcaaaccataaatttgatgaaatacctcctattcaaggcggcaagcattcatttgcctcacatttctaagtctgcccctgtgactgccttagctccttcttcccaaattctccagttacctggcccttaggggtggtagcgaaatctccttcctgacagcttccttggccaggtgcttctgtgtggagtcagtgcccaggccgccagctgttcaagtgtttgggcatatgcacacacaggaacgacttgggcaacaccctttgccttgtttcgggatgttcttcttgcagacccttgcccagacatagggagtgcctgtgaagtgctccagaataaatcggaatgtcccactgaagccagacaccgtggtcttcatgttaatgtgtaagtagagtagtgatcatttatttattctttgattcccttttgcagagtttttattgccctgtctgagatattggagttttctgctacagtaaatttagcaggatttctccaaggtgactttagcgccagtgaaggacttattgtgcctcttcaagtggttctatcactctgcttgtgctaggggtaaaatgaggtgccaggtggattcaggacaagcagacacaagcaagctaggaaacctggcactcgatcccctctgcggtgcttaggcaagccttctcggctactgaattttgaactttcacaagaacagatcggctgtttgttcaatggtttattactcctgccacaacaacgcatggcatgaggttggcgcggcctgtttatttctttgtgtatatggatatgtgtttgtgggtgtacatgaatgggtggtatgtgtacacacgtgtgcatggggagacatgcccagggctatttaaatcttctgcccttttccttcacttccctcctgttccttcttaagaacaagcattgcttcaccttttcacttaaatttctcctctagaaaaaactgttatcattcaactcaacatgttttccactgaaacttcttccatattaatttttaggttttcatgttctcgttttattcgtacttattggccgctattttcaaattaatagagtccaatgtcatatttctgtatattgcatccctgttgcccatctatgcttctcctccagactatttcttcctgtgcttattcgcttagtgaaagtacattgccaggctagaaaggtggtttgttggctaacagtgttctctgcacaagcctgggaacccgagcttggttcctcatatccaagaaaggagaaaagcaactctgaaagttgtcctctaactttttcatgtgcaccgtagcccatgtgcacccacacccacaaatacacaccacacacacatacacaaaataataataataataattttaaatatatcaactgacttacaaacatttgtttttttttcccgatgacatttgtgatgttaacgcataatttgattctaatttagttgtaagcatattctattttgactctttgaagttttttgaaattcagtatctagctgtggtggtgagctttccacatcaacttatcataaccaagaatcactgggaaagaatatttcagttggaaaaattatttggatcagagtgatctgtggtcaggtccacgagaaaatgtcttggttgctaattggtgttgggggactcactgtgagtagcaccattcactcatcaggggacagtgagctgtccaaggcaagagaaaacgagaagacctcaagcaagcaggccgcatggctatttgttcatgcctgcttgtgactgtagacattatgtgatgagctgccttgagagtctgcttcagtttctcctcagtgacagacggtaacctggaattgtaagacaataaactctttcctcccataagctgctgcttcttggatgctttcttgctacaacagaaattaaaccaaggcatcagcttatattctgcctgagtgcgtatcccaggtgcccagaagtgttggctgttgtactctgcacatttcaatggagtatcagtcaggttatgatgtccttcctaattttttagcaaatgtggtttattttatttttttcaatttttattattaacttttattaattattccattcatttacctctcaaatgatatcccccttcttggttacccctccccagccccatccaccttctgtttattttaattaattaattaattaattaattaaccagtacagaaaaagtccactgaaaaatccatgtcctgggccccaaaatacaaataaaatcaaaaggagtagagtcctgctgctcacatttcttcgtgagtagttataacttccctgagatttttttataccagggtttgtttcctcctggtttctcctcagtgacgtcatcctgaggttagtggttactgtcactgtctctatcctcatcttgactccataatattcttcctctttcgatccagaccctcagggtttaagagtagcttcaagctgagaaaaggtcaattttctccaaaaaagcttccatctcccactgaaaatggccatctcagagtgaagtacactcattctgaaatgtcagggccaattggatggtcatcagaaagcttggcctggttgatatctttatcagcacaaacctgaaaatgcacagtcctccaaagggcggcctctttgtgctcatccgaaagtgatggaaggaaggcaatacaaaaggggctgaactctggtcaccagaagtcagaaaccatgcaaacaaccagtaatgaatagtgaattctagaattcaaattagcagatgttttaaagagacaagctttcaattttcattttaaacatgagcaaaacctgtgttctgaaagaaaagatttagagaagagaaaaagcaaaaagaatatctaacatattgcatgacccaccactcccacaatgtgctcctggtaaacttgaatcacatcttttctccatcccgataattctctaactctcaaggagaggcctgagttaactctctgaaattccatatcttaggcactggatcttcgtgattatcaggatgtgctgtctttatcactttgaagtgaagacaactgctgtcctgatcaatgactttgaatttaacttattctttttccgtcttgctccctaaagcctttggtggacagttttgttccttggttcttgggcttccccttcctaagagttttgtttgcatgtctattcagatgctaaaatattgtgttaacatccatggtgattattttaatgtttgttctttcagtttgggcagtttggcatttgggaattatacgtactttgacactattaaattagatgaatatagaattgtatccttatgatgaataaaccttttataattactaaactcatggtttataaataacaaaactccctgcatcttttgtctttatctgatattaggtgtagctgcatcagctttcttttggctaatgttttgatggtgatatctttttgtattgctttattttcagtctcctactttcttttggattatttaatccatttacagttaatgtacttactggattttaaattttacatctccctctcacaatttcttttacttctataacttatattcttttatattcttcttgactttttaaaaatgttaatcaatgccaatgttttactattctctttgttctatttactgtcccgttaatactgtctactgtgattctccaagtcattacccaaggattatatgttctttctttgacctgttacagtttactttaagttagtctttcttttattttgtatccaccctgggaattcctcctggggaatgatgttatgctagggtacaagctaccattgagtcaccaccctaccctgttaattataatgaataatgtaactaactagcttgcaacagcttaatgtcattgcaaatatttctcagctttccattattattattatatactttcatatatatatatatatatatatgttacaagattgttaaagttacaagatattgttgtattaaatgatcaatgaatgttaaaatttaccaaatatttactctggtttttttttcttattttatttatgtgagtaaattgtagctgtgttcagacacacctaaagaggatagcagattttattacagatggctgtgagccaccatgtgattactgggaattgaactgaggacttctggcacagcagtcagtgctcttaaccactgagccatctctccagccctactctgattatttttattccttctggtgttagtatcatccttctgtgatcatgctttttacttttttatttttcatttagaatcatgttttctgagttttggtaatggcactccactgtgggaatgtgaaatttgggtcattgccatctaaaactcagtcactttggcagcatggctcagttgaatggcctcaaatcccaggacacttatttcattatgtatctgtctctgctccaacaattgtccagagatactgaccagtaacaaatctcccaagacaaaaaagaagaaaaaaaccacccaggccattatcaaaatcacctcacttcattgtttttttcctccaggatcttaactgctcagatcaaatggaccatttaaagagctagaaatgatagatagatagatagatagatagatagatagatagatagatagatagatagatgataataggtagatagatgataggtatagatagataaaagattaatatttgatagataaatagataaaagataggtaggtaggtagagaggtagatagatgataggtaggtaggtaggtaggtagatagatagatagatagatagatagatagatgataggtaggtaggtagagagatagatagatagatgataggtaggtagatagataggtagatagatagatagatagatagatagatagatagatagaagtagttggtggtagcagtgatgataagaagataaaaaagcaactttatgttgccttagaagtagaatttgtcttcccatataaaactatatacaacactgaatctattataaaacatccttgaacattatgtcatgtggacagacaatactctgtatacacaaaaggcaatacattctttatcatctatttaatggtcagtattagtaaccaagtttaatcacaaccttctagataatactactgagatgccaatgactgctttcaatatataagcctgaattatgaacgctctataatgcagccattactttttgaaatttttaatatttttattggatattttctttatttatatttcaaatgttttcccctttccaggtctcccctttggaaactccctatcctaccctccctccccctgcctctatgagggtgctcctccacccacctacccacataccgactccaaccttcccatcctggtattcccttacactggggcatggaagactctcaggcccaagaagggcctctgccacatatgcgactggagcaatgggtcactccatgtgtactctttggttggtggtccagtcccagggagctccaggggttctggccagttgaccctgctgccccccccactccacggggttgcaaaccccccccccccctcagctccttcagtcccttctccaactcctccatctgggacactgcactcagtccaattattgactgtgagcatccgcctctatatttgtcagggtctggcagagcctctcaggagacatatcaggctcctatcagcaagcacttcttggcttcggcaatagtgactgggtttggtggctgcatatgggatggagccccaggtggggcagtctctggatggcctttccttcaatctctgctccaccctttgtctccaaatttcctccggtaatttgttctcccttctaagaagcactgaagcatccacactttgattttccttcttgggcttcatatggtctgttcattttaccttgggtattccaaacttttgggctaatatccacttatcaatgagtacacactatgtgtgttcttttgtggctgagttaccttactcaggatgatattttcaaattccatcaatttgcctgggaatttcatgaagtcattgtttttaatagctagataatattctattgtgtaaatgtaccatattttctgtatccattacttttatgtatcacaacttggatttttttacaggtttaatttaaggatctttaaaaataagatggggttaagattgcaagcctataatcacatgtatctgggaagctgaagctagacagttggaagttcaagaattcctgggatacataattagctcaaggtcagccagagcaactgactgataccttatctcatataaaaagttaaaaagaggtgtggacatgtatatctgtgattgaatgtttcatatcctaggtgcactttccagtactaagaaagagaaagaaagagagaaagaaagaaagagagagagagagggagggaaggatggagggaggaaggaaggaaggaaggaaggaaggaaggaaggaagggagagagaagaagaagaagaagaagaagaagaagaagaaggaggaggaggaggaggaggaggaggaggaggaggaggatgatgaggatgatgaggataacaacaacaacaacaagaacaagaaggaggaggagaaggaggggggaagaggaggnnnnnnnnnnnnnnnnnnnncttatgtctgtacatacgaaatactaaagctttatctaatatttttcttcaagattacaacaagaacattgaacactaatacagagaacatctgcagtgatgtgatttgaggaaaatgaacccaaaggctcacttatccaggcactttgaatcactttcttaactctggccacttaatgaatgtggggaaaaggaaagaagttgagaaaatttgagataagactgttggaaagcaatatgttctatagttattgtcatgaattattttccccaagagtttcttttatggatattgtcctcatataacccaggctcatcacacagggcagtttatccaaagcagagctaactgtggttggaaattttgcaaatattgtaaagtcttgagaagcctaaaacacatacagaacaatgtggaattaacttctgtgaggcaggaccataaagccttgaacaacaattcatatttatttagagaaactaggctaaagcaaagcaaacaaacaaaagaattgactgagggaagtccaaagcgtattttgttccacctcctacctcagccttggtaaacagagctctaaatttctatttacaatgattacataaatattatatggtgacatttctgactgtgaaccaccatacactcaagtatgtaaagaaagtgtacacacaggaatcaatgtgttccaagaagatgcttgaataattgtctaacaaaatttatcccaggagacagactatgccaagttatagtacgaaagttatagtatctgcattgtacaatagcacaggagagagcaatgttactacaccccaagtttttcttttatggtaataataatttgttctttaacatttaaatcatttatgagttgtagattcaaagcatacattgtgatttctcttctgtgttcattacaggacaacactgtcctatttttgtctcctctgttgttattatgtttacataaaaatctttcaagacaaaatagttatgttctacatactctcttgcccttagcttccgtaacttttgccataagaattagtcttttctgcccacactgtagttataccaacatgtgactttgagtaccataactgaacttgaggcatactatattttcaaagggcattatacatttttcagcacagggtattagcccattgggatacagtgaaaaaaaagtctttaaaaacttgctacaggtttgagttgcaatgtatgctttgaatctacaactcataaagaatctaaatgctaaagaacaaattattattaccataaaagaaaaacttttggggtgaagtaatgttgctctctcctgtgctattgtataatgcagagaacttgtaagaaagtgagccacttggtagttcaagaaggatgttagagagaatcttaattatatagctatgtgagtccagaagtgtgtaattagtatattattccatatgtgctcttgagcttttaatttcaagaactgtatgttggaatgattttgccagaggcaagttaatgactgaaggaaggaaggaaggaaggaaggagggaaggaaggaaggaaggaaggaaggaaggaaggaaggggaagaaaggaagatgtgacttactagaagttgatagtagaattctcactggactctaagagtttaaatttattacaggttcttcctcctagcctcatgctcttagaaataagactcagattcaaaatatattttcatatactttggccatgtggctaggctcttctctgactaaaatcataacttaaaaccaacccattgattttcatctacatactgccacataccacatgttacttgtgctatgtgcctgtctcctcacatcttcctgggtggaactcttgtctggctctatcccagaattctttctcctcccagatgtcccacctcccatttcctgcctaagccataggccataagccttttaattgacaggtgatgcacccatacagtacacaagatagtctctctacagctaagttttgacattgtttcctaatgtagaaattattaggagctaatttctgaaaagttttaaaaagttatgtagactgtccattaactaacgtttcagaaaattgtacacagagaactcttatttccttttgcctagtaaattacctctctacataagagcgttaaaccagatatgtatgtcattgataatcactatattttttccgctctttacatccattccattagaaaactttatggctttttggctccattttcaccagtcttactgcctctaatcctaatacctttttgaatggagaactgttagatcttacaggcagttcaaatatccagaaatgagaccaaagtggactataggatgatttccagaagttagatagaaaccaggattccttagaaatttgtaaagccagttcctatttaccaaaaggattcacttctcttgtccctggcacaacggacatagagctccaccgacatgtgcctgtggttgcatttcaaagcccatgccatcctccaggctccttcagcccctactgaaatatacttgttacacatttcaaaggctatgccaacctccccagacatccatcctccttatacctatttgttctcttttcaacatgaatgattttccccttaccctggctattttccctatactttccctctatctcctgctctcctctttactctctcactctatgggctattctacattctctcatagatgcactggccatgtccagtctgctttgattctctctactctctctgattcacaataaaaaccttctcctcacctgtaccatggagaggacatttcaattgtttccttactgtttcccttgcaaaaggaagatcaccccaaaatttggtgccaattcttctactagtaagcaatccataaatattcaattagtgcgtatatagacaaatggacttctcctccaaattaataaaacttaaaatataacaagttaagaaggcatgtaacatgaggagctgtaaagaattcagatagccttctttggtattttaatggaaatctgtgactcaatttacatgtggaagttctagtacacacatgcttcatttagttaaatacgtatacaggtggaagttactatatctcttgccctttgccttgcaaattccactcaatcaatgccaagaactgaactaagaagacatgttcacctctctttcccttcacgttcaatgtgactcagttgtgaccctgaaaggacagtacattccatctgtctcacacctgcctggtgtctgggatccatctctgggattgacagcatctgtgtcctctgatttctactctttagaaaaaaaaaatcaatgcccacatcatattggtaacctttcaaaaagctcaagaagagtgacaagaaagcaaaattgctcccagggagcttcaattgctggtgaaaggctgatccaataagacctcctggcagaaagcacagacattccaggtcattccaaatgcctgtgacaatatgtcagtacactgtctgactgcgtgtgtagtagtgactcttaacatggttatttactaaccacgtgttgccatggaaacaaggtaaagcaacatgctcttgagacacagagacttagcatgttagagaggtggtgcctaaatcccattctacagccagtaggctgttcacacaggcagaccacacccctctaggcctcctattcttccttgggacatgagaaccctgtagccactcatcctcaagacatggtatccgctctcctcttgtatttgagaagcataacattctgaggctaaagggcggagccagccatcttcttgaccggttgggcttacaattatgtacttgacaatctccaacatgtttgaatcagagaggaatacagtaaaattcattcatatgatgctctggtactcctgcttattgaaatagaaaaaacagacatacatacttagactctcaacgtttgcaggaaaagaagttgaaaatatgttcaagagttcagatggcttctttgattcgtggtaagtttgagttctatggatttgggttactcgaactctgattggtctctggagtacatgtagacgttaagatgctatatgctctgagagaacagtgagctgagagggaagcctataaagtagtgacactcagatatagaaacattttcatatgatagtagtaatggtgccagcacttcttccaccaatgtcactgacaagcttcttgttactggaaggagaaaaagtcatcagaccttatgaaaaaaaggtgctaggaatacatgcgcagggattttcttatgtgcaagattcactgagctctttcttatgaccatataacccatctacataaaaatattattaggtgctaaatccacagcaactcaagctttggagccttggaaaattggctttaggaaaagagatcacctggcaagctccatgtctccctttctcacaggatttttggaataggattagggtcaacagtgatttttaagtctcacaaagaaaacaaaaatcgatttcttgcaaaactatcgctgtgcaagtttggttttccagcatagatccgggctgccaagaatgctggctccagctaggtcttcattagccaagtcaggggatagtcagggcattcatccaggtgacctgagccaaccccacccactcagaaaaccaagacaagtttgcctggtagagcaaggggcctcactggctgcaggctgtgactccatgtgtcgtgactgacaccacaaccaggtatgtcatgagaaaaactttgacaagctggatggcagctcgtcgttccttggatttcttccttaactttgctttctgtggctaacaactgccattgaatataaggttatgtaggaagaattttaagtatgccttaagaagttaggattgtgtccttttgtaaaaatgataaccctacagaggtccctttcatagcattaacctgtggtcgtgtaaatgggtactcagccttagagcccatctctttagaaagcaaatcattatgcaatcagacaactttaaagttggaatgaagttaccactatctcaattaggagtaaggggagagtatagtctgtaggagttatgcgacttttgagggtaacacaggtagctgggcatgcaaccaagcatacaatactggctgcgctctcattcaacgtatcaagagtcttctctgatatgtgacacaagcaaatagaaaactcatagcctccaaagaaagatcttagattcatcaggtatgtttgtatgcatatgtgtgcatgtgtgtgtgtgtgtggagagagagagagagagagagagagagacagagagacagagagacagagagacagagagacaaagacattgaggcagaaagagagagatagatgaagcagaaagagagatagagatatagagacacagaaacagagagagacagagagacaaagacaaaggaaatagtaataccttgggtttctggctatatagtctctctctctcaatttcttgtcattgtagcctgaaaacatctaaaaatcacaggaacagggatgactgtgcctcagcaaaactgttaataaatataaaaatgtgaatttacagcagtttcatgtgctatgaaaatttattatgttttgaggggttcttttctacaacataaaacccattcttggctcttagtggaccggattttgcctaggacaatagtttatctggcatagggtaatagaaccagcccaggagagaatgagctgtggactctgtcctccactcgggctctctgaccttgtagctgactccacaagcccccttttccttttcaagggttctgtcaccctacactgtgaaattagtcactgtgtgtctcttcccaaaacattccttatttcttaaagtcagtataattacaaggcttgtttagagcacggtcataaacgtcatagtgaggactggagcaaatgttgctttgaacataactctgtgacttcaactaggtggctatggtaaaaaaggaagtacttccgtttgcccataaacaactgtcttaaggaatttgctacattccttgagtcagctggatctctggacaggcctggttgtttagcttactaacagccaatctttctttccgactggccctgagtatgtgtgtcagtaggacagaaggccctctgggtgagagcaagcaaatgaagaccactgttttaactcagatacaggcggtgggggtaagtctcagccaagacagaaacgcttttccctcagctgtggtgtgagtgtttcctttgcaaactttgttgaaatgttattgatgttgtgatagtgttggtagatttagtgtctaactggtggtgaactgggtcatgaggtctcttgccttatgattgtctgcagtgtggagaatgggtaagttagcatgggaggagttcgccaagaaagggaaggctctctctacatcctttctctggcccctaccctctctgtgtcacataggtttaccttcctttctacaccagatgacacaaagtttgaaaaacttcagaaccattagacaagtaaaaactttcccagtctcccccaggtttctataatagttgataaaattggctatgacttgttttgtttatgttggtgttgtgtttggcatatgttttggttccttgaccctcagacccaaagagagaggtggttttctcaaggccaggataaaggcacaaagactttggctcagagccaccacagaagaactgtgagagagtcccaggagccataatccaggcgtcttccatatatgaagtctccaaaatcaactaatattgcttacactaatattgataccattcaacatgacaacttcttaaaatcactgacagtgatgcagtgtggggcctattaaatatagttatcaaaactttgagttgcaagtggcagaaaccaaatgcaagatgagacatataaggaaacggccacatcagctttaactttggaaccagccataagcatgccactgcttacgcatctcttccctctctgcttttctttgcgttgacatcatgcatcatgtggagagacacacaagctctagccttctgaggcgcttagaatcctgatagctcacagtctcaaaaaggaagagattttatctccacatctatctcagtagacaagattttctgtccttgtttcagacattgctcactgtcagacccaccaatggaatggaaaagaccctttttggggtggatttttagattcccagtgatcagcatggagcaaacaatgggaagttgtgtgtgaaggaagggggggggtagatgcaaggctaaaagcagtgcctgcaccaactgattcctgtatctaataaaaatgtggcttttaaaaacagtaagcatcgtagaacccaccccatgagtgttgaggtgattctggataattctttcctctctcattcctgagccgtcagtcttccctggtgaagacctgaaatagtacaaaagacgatgaatgggttgatactattgtgagagtttggtataaaactcagctctctttttgctcgctacactctttgatttctaccttttgtttctaccaagaatgatataccaaggagacatttactagctgtgaattcctggactgtggagttcacagcacccaaagctgtaggaaaaaaaaatgtattctttagaaactacctagtcctaagtattctgtaaagagagcactaagcaggctgcagtggctgtggctcctgcagagtcttacttccacacagtgacaggggtatgtgcattcatcgtcccctgctcttagaagttggaatgcaaatcccttgaagccagggccagagtcactgttccacaggggactgccttccctcacaatacaggaccatcacttttagcacaacccacaggtcttctgaatactcaaaagcatgaagctaacagacagagccttatatggtgctaaggacagagtcaagtacagtgttagttagacacctataatcccaacacagacacctgaggcttttcctttagaagagatgggaagccaggggtgtggaaaattaaggttttgttcctgctcccttctccactcctcctcctccctcttcttttggtgtttttgctggatactgtgttccatgatgcagtttaaactacccctaaattcaaaatcctcttgcttcagccttcaaagtactagggctattgtcatatactgccattcgccagcctgtcagttcagctgtttgacttttaactggcacataccattatatgtattcattgagtacacatgttatttggaaaggtatagactatagaataactggctctacagtgtattgcctcagttctgtggtaagaatgtcttatattaattgccactgtggttataccatgaacatattcccctcttacaactgaaatcttgttccctgtaatcaacattttcctaccaaccccatagcctggcctgcacactcttagtcctcttgctctatacgagtagtagttttaggttctacatagaaatgaggtcatgtatttgtcttccagtgtctggcttatttcacataacactctggagtcattcttgttatccaagtctttctgtaactgaaaagtatctcactgggcctgtgtaccacatttttattagccatgcagccatgatgaataatcaagctacatttttgatacagcaaatattattgcaaccaacatgggatatctctttgccatattgactttatttatttttttatacacaactagtagtgagatagctgggtgatgtgatgtgtctacttttaggtgtctgaggaaactccatagtgtttttcctagtggttgtactaatttacatttctaccagcaatgtgcaagagtcccttttctcttgtatccttggcaacacttataaattttatcttttcagagtagtggttctagcaatgaggttgtatctcattggcattttgacttccagtttctcaataaacatgatgttaacatttttaaatgcacataataggcacgattgtttttttcttttgagaaatgggcattctattatttatccattttgagccatacccttgttattagattgctttgttctgtatgtattttgagcattaagccctcctctgatgtataattagtaattagaattccttctatcctttcattgttcactggcacattttgaagagatgtgctgtgacctagtgctggctttgaaagcatcaccctgcctgttctattggagacatacagtcttcagaggcacacagagagacaggagagcaatgaggagcttggtgtgatctccagggtaaagacctccatttaggccaggttggtgctctagataaaggtaagaggaagctgcattcgctcatctcatttaaagacagaggaagcaggtttcgccagtttgaactgccaagttgtatggaaagagatgagaaaagtcaaggataccatcaaggctttttgttctgagaaactggagtaaaaataaacatttgtagtttactttgttcttgactcacatgaaagggaagtatatttctgtgacagttaaaataagtacatgggtactttgaagtatggttttaaaactgtcttaaactaaagccatgaacttttattgttctgcctatgcaagcaatgtaaaaaaaatgcatgcatatgtatttttcagaatactaagatatataataatataatacacacacacacacacacacatatatatatagactgtttgcaaaacaatgaattcttttctgtatcattttataaatgattatgtgtccaggaatcagagtaaagctttttggagatgcatgtagcaagggttccttattaatttcataatttaacacattgagctaattggtttgctcacaagggccatagctgttagtcactgtacctttattcaagaggagagcagctaaagctggatggtgcagtaagatgaaccttggtcctgcagtctgtgcatggaactgacccctctcagcatcagactctccagccattcctttcattactttggacctcggtcccacatcttataagtgaaggtaacagaagccagtgtcacagatgcaaaaacagcgtctgcactccaggtgtccccgattactaatgacctccactgggagcagtttagttaaacaaatatttggttccagctgtattctaatttatgtacttgttcatgttcttctttgctataaatgattgctgaccttattaactatggcccttgtgagtgaagattgaaaccaatgagcttaatgtgttaaaactgtgaaattaataaggaacttttgttacatgtgtctccaaaaagctttattctgtttcctgggcacacaacgatctgagcatcagaaatgagcagaataaagctagacactgtaaatctatcattgctcctgagaaaacttaattaaaaatatactccaatgtctttttcatatttgaaaggtacaacctcagattattaatttattatggtattttactttgagacaggatcttatgtagcccaggttggcctggaactcattatgtagccaagagtgatcctgattcacctaccaccaactcacacttgctaggattataggcatatgtctccatgatccatagcagatcctttaaaataatggcaatgaataaataagtatataagcagtgaagaaacaggatgacagtgtgagactagataaccagataaccctaaactctagacactggtatgtctgtgtaccctaaattatttaggcttgtggtgcaagacgtcagaatccttctttcctcagatgagaacattgatgtcttcatgtctaacgtgtctgtttgcattcaatgagattatgaatatctccctgggaactgttggctctattagtagggaatatatattcacatgttttattttaaacattgctgttcagttttggaagactgtagctatttgaagctatccatgcactctattagaagtgggaatttatttttaattatcaattaagaagtcatccattgtatgtgactggctttgaacaaaaaataataataattaaagcacacacacactgtgtagacagacattgttacaatgccagtaaagggaacaaccacagcacatatggcatgaatgttgcttgagacctgagtataatccttaggtcttgagcagaatgagacagctgacttcctgtagccggaagaagaatgagtgcttgctgtgtacaatgctcaggaagggctgacagagacacaggcgagcagcggaggtggggaagacaattacaaaggaagcaacgaaatctgaacaaatcagagactctctagaagataacccaggtctctgtacgaataatcagtctgtcaaccacttcctctacctgctctctctatatatttttattagatattttctttatttatatttcaaatgctaccccaaaaaattccctataccctcccccccccctgccctgctcccctacccacccactcccacttcttggccctggcattcccctgtactgaggcatataaagtttgcaagaccaaggggcctctcttccgagtgatggccgactaggccatcttctgctacatatgcagctagagacaggagctcttgaattggaggactctctgctaattgtcttgtctatacctgatagccacccttcactaagcactctctgaaagtcagactttatatacacaatcttctcctctcacctttagtactatgtcgttatctccatattcaaatgaaggaaactaaagccaaacatttttcctaaaagacaaacagcaagtttatggaagacgtgtaacctaaggctgggattttccaggagcagctcccatgccttcttcaagaccctggcttgcctccattagcaaatgtacacatcacgtgagcatgtagaccccaactggcttctccactgtgtgccccgtcaccttaggagtgagaaagtaatgatacttgcaaacaaagcatccacgtgttacattatctcccacacacactacaaaccacacacactacaaatacttaaaaccagccctcaggcttaattaacaagaagtaaactatacaattttccaaatgatatctggactcatgtacagtgagctcatatattcatttattcccagagctgtataacttcaaaattaaactaattaattccttgtattgtcaagcaaaacattgacaattttttcctgtgaccgcctgttcctagcatgcttgttcttaaatgtgtaatgatataaagtcttaggtgattgtttttgagttgcgttgactttcatgctaattatctgagtgatggacaatgtgttccatctcctaactcacatggcctaatagacgtgtcaatctaacacagtcatggcatgagtgccagctgtttttgaaacatcgatctgtcatctcacaagatgagcctcccaattttccttagtgtacttagtcatgtgtaactaggtcttaaagtaccctaagtttccttgaggcacagacacatgcaattattttcatcgtaagtcttgcctggatgaaataattgaacatgaaaagttgctgcaccccagtgaatccagtttataaaagcgtgtgtgatgaatgagatagggcagattcgagtgatcgttatggagaaaaggccattcagattaagcaaactgactccttcagtgtgtgggtgccacagaaggcattcataccagaaagctggaaatagtaatttttccaccttcccttgatgtttatgatttgtgcatttctccaaaacatcttcctattaggatgaactcagtcacaggatgatagcaaactgcgtgcaccaatgtgtccatgtctctggctactttataacaaaccaccctggacttcatggtgcaaagcaatgatcattttattatactcatgaattatgtaggtcaggaaatcagacacagcccagcagtgactcctctgtctgttgtgtaatgtctagggtctcagctgtgaacagtcaaagacttgggaactcgaatcactcttagtgtctgtcgaggatgatgtcaagaagctgggcttcttggcaaaggcttttttgaacgtatgctttctgcagggctcgcctctgaggcctctgaactctgaagaggaccatgcaagatcacgtgagatcttagagcagatgcacctgaagcatcgtgcacgtgcacataagcgggccttctctagtctaattttggcatccttgcagcaatggttcacctggatcagggaagcacttgacttacttcttaatgggtgaagaacaagaacatgttactagaagtttattcaaattgactggccgtgattactggtcagcaacagctgctgtggaactgttgcaggggcaaaggcagtgtttagggtcacatagtaatttaaatatcacctctcaggtaggacctacatcacttctgcctgcattttaaggcttgtggagccacgcctagattcatcacgcaagggtggtgtcaactgtgtactcagaaggaaaagagaactaccaatattgatgaatggtgatggttatgaccacttaaaaatactgcctccatgatgaaatgtggatgtttctttcaaagctagtttttgtaattatttgaatcagttcatacgtgtcttctgccatccaccaaatatgcttgatgggcaatgcacgtaacataagatgctggatccgggtgtgtatacagcccccatgaaaggcaggaaatcacttgaaatttcggtgtatggccttttcaattatttctgtctttatctcccgcagtcatttactatagtttgcacaccctactgttagtcaaaaccctgatgtcatagtcatcacatcggtacccttttgtaatctgtgatattgtatagagtgtgtagctataattaatatggaattgcaggtagatactattaattgaagtgtcccgattaatttaattatttcttaaatcatttcaaacaagagttatcttacatcaaactctgatagatagaatggttcgttcttactttcatttaaaatgtatatagatattaaaagtacaagtagtggataaatccaggtataaagcagcttatttttcgaaagcagagcctgtggctatacttcaacaataaaaagagctaaaaccagtgtgagacctgctggggaccagtttatatttttgtctataatgagaaaatcatagtaacaaattgtcaaacaatcctgatgccctatgagaaacaatggagaaaaggcaagctctgggacaggctcagaggtgacagggtggatttaatttacttgtagtttgacatcagggatgcatctgtgcatctgtacatgtaacaactttaaatgcccacccttcctttccaccttgctacatctggtactgtagaacactgcatactagctggcctggggactctgaggattcccctgtctctgtatcccatcttgctgtagtaatgctaggattacagactaggaatgtaatcgtgtgtgtttttatgtttggcttctcatgggtcctaggatccattcttcagagttgtaaagcaagggctttgaacattgagccatctcccagccttggggaaatgtcttcacaggtagctctggctatgtagaaaattgctggcaagcttagttaatacaggcactaaattgtgctgcagaatgctccagtgaaactctctatggataacttggtaaaagatcaaggcacttcagttaaacaatttacctaattacctatttaaaggcatctaaaaagagatagaaccaaatgaacccattggaagcatagactagaaatgcagtaatatcatgaacatgtgtttaaataaatgtgtacatggcaaaagccatacagcagcatggctaagcttcttcatcaacatgtattcaaaattatgagaaaacctatctcaaaagttacatgagacaactacttgtccagttttctgtcctggcacatctatgttgaataaaacctgtcagtataggcttatgatcagagtcgtaaatttgctaaaacaggtacctcttccctaggtctgtcaaacatggtcaatcagttacagcttagggcttaaatctcatctaaggctgagtcagaagaagttaacataggttctatcaaaaccacacacaatgctggagataaacattgtaacaatgactttgcctactatgataatgaaatgtcaggtcttttgaggtctcagtcagatgtaaaacagactagatactgattgtgctaacagaaatttactgaggaactcagcatttgtctctcaggaatcttagctacattgtggcagacaatgattatcaggttcatttacttagtgctttgcggtccaaagcacacacctctcatagcccaatgctatatttcttgtaccctcccagaactttgaaggctgtcatggtcactgttctatagtagtgaagagacaatgtgaccaaggcaactattatatgaaagaaatcatttaattgggagcttgcatacagctttataagtttaatccatgattatcatggtgggaagcatggcagcaggcatagcaggcatggtactgaagaagaagttaagaataagtgggcctagcatggacttttgaaacctcaaagcctccctcaagtgacatacttccttcaacaaggccatatcttctaatccttgaagtcttttcaaagagttccactctgtgttgactaagcattcaagtatacgagccaatggaagccattcctattcaaaccaccacaaaggctaatcctctctcaaaaacaaaaaagattatgtatatgtgtacattttcataaatatgtcttacatatttaaaactctgcatgtagatataattctaagacttcctaaacatgcagagggtctataatacactttggctagcttgtgttcaaatgacattttgttgttgttgtttaaagctaggaattgccttcttggaaatatcaaatccctacagaactattaatgaaaaataactatctcttttaaagtaatttttttaaaaaaaaaagcttctcttagaaaagaaagggaactttttctggggtgcatctgtaaaattttcttcagtcctcaaaacagtcctttaccaatgaaaactccagacagcaaaagataaggttgagctcacaggactggtcaaccatagggattctatcacaactctgtgctgcctgcatcaaagccccaagaccctccagcctctcccctcagcctcagttcttgcgcgcgcccgactggccagcagtaacgacgctgtaacaggatccttctgcacacgtttattgggagagcttgattgcagaggcgaagagaccctgagcccagaactggtgctgcttttataggcctaggagaggcgtgtctcatacccggattggttatgcactacgcctcatttgcatgttcctcatctgattggctactctctctctctctctctctctctctctctctctctgtacctcacagagcctcattatcatacctcatttgcatgtctcacatctgattggttatactctcaaagcctcattattatgcccaggccaggcagtgtctttgcaaaaaactttactgcatatgtacacattggttgtttgtccaaacttatgcgtggtggccagcagtagtcagtgccactctgcaacggcacatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatatgtttgcgtgcagcttctacctcatttaaaacttgctaagaccacatgtatctgatctacatatattccctgttatatcacagatgctaggtgtgatatagcacacagttgataccatcccttctcaatagttactgctagccaattcccattgaatgcctatggcaattgactattttgttaatagagttggactctgtcaatcagttgaaaaagtcacttcgtaacttttccactatgctaaaggtcatggcaaagttgtaccaggacttatgaaggttctttgttagtctgttcacagtagcagcactagagaaaatcttatgcagttgttatgaacagttgtacttaaaaatcaaagaaaaactagattaatttgaggaagtctctcttcaccaacagagtttaaatgccctccacattaagtggatgtttttaagttttccatgcaagaattcaagtttctaactctcactggacaagctgtcttattcccaactcttccttaggatcttctttttgattatattaccataaatgtttattcaacatgtgtgatactcatgactacttaccattgagagagtaagtggcagcctagccagtccagggcagccatgtttccttacactgatgagcgatgcccttaatcacctaaattccaaaactattacacttcccatgcagcattgagcatcaaaccattccttataataatacctcagaggtctgggccctttagctccctcagtgacaaagcaatgacactaagcactgtacaggaccgatctggctttcaaactaaaaacaactatagacagtagaaacaatggccatcatcacttttctttcctcttaggtgaaggaaccagaggctgataaaacttaaacccctacaatagaaattaaataaaacaaatttagtgagtcactatggcccaggaaaggcaataagtggttaaaaggtaaactgctgtcacgatgctttcattacacagagattttagggacatgacatgaattttggcacagaaaatcgtgtgtaaatatcacgtgggctatggtgaaaggcttaactatttattttcctacctcagtattaattacctgagtcacatatataagaatgggtgaataaatagatagatagatagatagatagatagatagatagatagatagatagatgagttcttttttgtatagtttataaagaagttcctaactaaaaacaagttccaaagtactgtgctcttttatggactttcaatcagtctgtaaagcttttgtagggcctatcatgagccaggctcggggcagttaggaaaatgcaaatttaataaaggctttggccattaggagcgtgtgtgtctttctaagttacgtctatgcaacaacaatgctgtctgtacagtagagtagagggctcagagaaagcaatggaaattcacagaaagaggtgaaagcccttgtaattcatataccccagagaggaacttaaagagtgtgtttagtaggaataggcacctgccaaagaatctatgaaccccaagatatccaaacttcttatagtcctggaaggagtttcttctgagttggctcagttgtgcactgaccgctgtttcctgctacatcttctcagagcaaataggaaaggaaaaatgcttctgctctgtattgtatgctcctttcattaaatcaccctcgggacaactgagtgttccagaaataggtgttggttaaaaaaaaaaaaaaaaaaaaaaaaaccaaaaaaacaggtatttctgtgcaatcagaaagtgcctctgctttgttaccagcataaagcattcatgaaatcaattttcagcacccactggatagggctgatgtgcgaactagctttgcgtagcccatcgtcttctttccgagatgatttgacaggactggcattttatcatgaatacaaagaggatgagcatattctcctaatatattcattacttccctctccgaactggtaaataatatacatatggtaatttgagagacatagtgttccccattgctcctttttattcctggaactctggctgtctttgtaaatgctgcaaaaatcaaaggcaaaattacctcaaaatttgattttggagtccttctagtctcactttctggtgcccacacaagagctattgcttattttctgttctgacctgtattattcaatagcatcaccccttctgcttgcaatcttattgtagaaccttctagagtgactcaaagaagccatctatttattcattaacaagcacctattaagtacctactctgtcccagacactgtgctaaatgttcaaaagaataaggaccatggaagcctatggcccaggcccattcttgttttctcgagttttgtaatcatttctcacacaattataaaaatccatggcatcgtagaaagataggaaagactgtggagtggatgccgtaaacagaactaaatgaataatgaatgacaagctgagaaaatgtgagtgtttgccagagcatgtgagtctaattagcaggcataaactgatatgctaaaccaaaacgtgatgagattttagatccaaaagagccatttttatagactggacctgaaagaattggatttttagatgggagtatgaaggcagatctgaagggcagttttcttagaactaagtgaaaacgagatgttttactctgcacggacttgattgacttgccatggcttgaacgatcagaatacaagtcaattgtgatcagtaatttcttcacttgtatacttaaaagtgttcattgacctactgcgttagatgaattggtctttgctgaaagcaaaggaaattaaaggtctgctcttcttgaatttgtgttcagatgaatggacaatgggagtaaatcagtgtatggaagccccagctagataggcaccgagacgtaggctgcaaagaagacaaatgggtggaagatgtctctataaatatacatggttgttagggcaaactgaccatgcacattggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcccattccacatcaaatgtgttccatggctgcaatcaagtccatgctcaacagtacatgaagatatgacagtctggtttccatttatataattgttttgttgccttctttattcttactggatgaggtcttattgtgctgtcctgattgacctgaactctgggtttcaacagtcctgataccctcagccttcagagcaaggtgcctcccagttctgccttattttactctctctctctctctctctctctctctctctctctctctctctctctctctttactaactatgaattcacaccaacagtttctagaatctcttttaaagcatacctgataatgatgctgatattggttaaaataatgtaacaaatgcttcttttattactttatatgaattacctgtcatttaatgctctgagatggtgtggggatatagggcgctgttatcgttccattttatagatgagaaaactgagtacacagagataaagtaactcacttatttccataaagcaagtaagtggtgccactagagtataaaatcaaacaacatagttagaaacactatccttatctgtctttagtgtttatttcttcacagctccatcatcttcatagacacacacacaccctacttaaaacctgcatgtccataatttccacaagcaagcaccttgagctgaaacattcggggctgttttaaagtaaattttgctattattcctttggcagaatttaaattgtgaaggagattttcaagtgatttcctctcaggcttcatttagaggcattgaataaagtaatagcacctttgagaatgcaccttgacatcttagtgttgggcacctgtaatgatagcaacgtgggagtctgaagcaggaggatttcgagtggccaggcaggggaaagagagaggggggagagaggaagagagagaagaaagattcctactctggcagactaactgtttctttaactatcactattaaatacactaaattattcttcagctcctccttcactgtggatccatgcctttaaaacaagcaccgttgtcccctttgcctgtgcatcctgagtctctatacacctttagcattctgacccaggattctcaattgattgccactaaaaccccagatatgggtacaaatctgagcaaattgatctcaatatgcattagcataattagaattatctagggatgtcagatcatcttaagcacctacaaagtcctattttgaacacttaagtataattagcatttgtgaaaggtctctggttttcaagtgtcttgcaagactcttgtttttttttttttttttttagtaagcttctaaaagctgcttgtctttaggtgttcagtgaacgggaaagataaacatttgaggcttgcccttttcctctttctgactaaatgcgggtcataaagtagagccacggatacagcaagccccatcacacagatgaacacagatagcccttgccctcatggaagggatcatgtagagtcctctctattccaaaagaacttcacaatctccataactacgtttggcatttcacatctgtcttgtgcttttgtgacatgtggattagcagacagtgcctcgggctctcatgatgaatgtagggtaatacagcagcccagagccatggcacctaagtatgacttggatgtgatcccacttggatatgatccctaagggacaggataaggacactagatcaaatttggatcaaagaagaattggaaatcaaagagttgagaataacacccagccctgcatctgcatctgtttaattagtcttttctccatccattttaaatgtgtcaaaaatgtgtaaagatccattcaaatagaaaaatagtaatttttcatggagtgagggcaggaaataaatgtcagattcccagtagtaaataaatataatttttagacatataattagctttcctcaatctcagtgtcttcatcctaaaagggcttacttttggtaaaggggaaataaacctgaattgttcagttggagtccagtgaaagagcagcaggcaaaagaacatcacagctgctacagatcccactttctcaggaatgaacagctcctttgaatggtgtctacgttatccaaaatgccacaaaacaattgatgataaaactggtggatggacatatagtctgaatgtttctcaaagctcttagtactcaaagaacttaagaaaaggggaataaggaggtttgcctagagtagagtgtttcgggcagaataaagaacccctttatcttcatttattaagttgaacagaacaaataagaagctatccatctctataaaaaatcaaatacagttagttccttaatgagttgcgtcttttgctcctaactgtaatacatacaatagtgtattatttccttttacccagatagatttcctgaaaccataatattcagaggcagagaactaaaggttaatttaaaaaaaaaaaaccctcaggggtaaattattactattagaggagaaagttatatttttaaagcttatagtattatttttccaaattaatttttaaaatagtattttcatgtattcttgaaatgtaagtatattctagattacgtaaataattgataatggactaccaagaaaaaagtatacatgtaatattcaatatacaaattagcttcagtaaatctctcttttgagtcattatttccactaaaatgtctcttacattgaaattattctatgaaatatgaaatttagaatataatggacaccttcttttgttacttaatcatgacgtaacgctttgtctccttttcatatttgaagtgcagaaacgcctttaacatcctaggaaagccatgtggatgtcatgatctggctttctttgttcggataatatactagattattttctttcttctgaacatcttaaactcctagatgagtttttccttcaattttaaatgcttttgaagcaggactcattttgtttcgagcatttcttggaattacatagagttgagtaaatatgaatatgccagcatccttctaaatggactacctttaaactgtttcaaaagtaaaccatgcatcaaaagtcaactcggaagacctgtgttctctcatacccctacacctaccctgccccctgtgggttttttttttcttggtaataacaataagtgtcttagttaggatttctattgctataacaagaacactatgaccaaaagcaacttgggaatgaaagggtagcaataagattacaggtctacatatcacaatatatcactgtaggaagtcagggcaggaactcaaacagtgcaggaacctagaagaatacgctgatgcaggagccatagagaagtgctgctcagtggcatgctccccatggcttgttctacctgccttcttagaacacctaggaccatcagcccagccatcacaccatccacatgggctaggccctcccacatcaatcactaatcaagaaaatgcactacacaaacttgctcatgagcctagctcctgtagacattttctcaattgagaattcatcttcccaaatgaaaatgactctagcttgtgtcaggctgttataaaactcaccagcacatacagcgacccaaaacttcataggtactttgaaataagtgaatctccaatcatgctgctatccttttaagaatttgtaactatccctgcaaactgttgtgggctatgtcatggtctctaaatgccaccctcttacatcctaagcagaatgaagcatgaaataggaactaaggtgtggcacaatgcagacaactttcctctgggctctccttacaggacacttctcagccatgaatcttactggcctctacctttcacataaccagggaaaccaaaacatacatccattttttaatcttgtcctcttccccacacattctcaatcttttctcactgttcctccctcacaaaagagcaagcataggaacaaatgagaaagtttctgactgccattgactctgggaaaatattagtcttgtgctgattgttgcagtgatgtacatataacatgaaatttactatcttaatcatttcaagtgcatggttaagtacaatcacaccattatgacaatccccagtatatttaaatttttatcacacagaactgaaacaccttatctctatgctacactaaccagtcctttcaaaaaattccaagtcgtaagtctaagattaggcaagacatagcctttgtgctcttaaacacttttccaaaatatattcattttaaatttgtatgtataaaaatgaatagctattttagcatacagaattaaatcagtcattttaatgattctactgattggcttccaggagcatctgtgtgtcttctcattaaagtaaccaatgcattacaactgtcattgctctgtgactcttcttctcttgctttgctatttaatgtttctttgaagtcaaagagtagctcttcatgatatgcatccaagtgtgcacttaaatcatagaacttattcttagcaaggaagtatgtagtgaagcacctggtcaaatgggaagacagccttgagaaagacaatgtttttcctgctgaatttctaggaatagccaacaaagtgggagtcctgataggtgagaccagcagtgtgctctttcataacctctttcaattactctcaactcttctttatttttggatcctatgtaaaattttctataaagaaaagaggttatactatgttttgaaacaaaacatcttggatctcgaggaacgttttgtctcattattgagattcattggaagcctgtcattgaatgaaaagatatcattgaaaacatgtggcctttaaaccaaccaccgactctctccaagcctcttttctttatgactagaatgagaataacggtgtatatctgcatcttctaacacctgagaagatttaaaagcagtgagcagtgtgctgccagcctcctcaccctgctgcctaacaaggtccctcccacatgagcagagcaatccaggaagcaggtgacagaggatgaggtagtccagagcagagacaggaatataacagaaactggatctatctggctctggatactagatctaggttggacgtaatgacattgggagctgtgactgatgggttctcaaccagatgccacctttctcagtgtctagaggagtggtatctaacaatgactaagatggtttcccaagagaatttgatactgaaatctcactccctctccctctccttctcccttttccatcccttttcttctccctctccccatcatcctcctccctcttcctccaccttcctttccattcctagtgatcaaattcagagccatccacatgttcgaatattagttaggcgcgctttctagcactgcggtacatcatcagccctggaaagacttattgccatgaatgaatcgttactggcatgtacgtgatcaaggcagagccaccatggtccatgggttctgttaaatacctcactctgaacatgacaaaacctcgatataacaacattaacagcttaacacgtcactcgtgctgaccttgagaaactctacttttagagactttctgacataggtgcctctccccatcattgatttcctcttcgtctggtaacctggaaattcttcaggttacttttgttctggttctcttctttgttcctttgtccctctcttcatcccttcttcataactttttcctttcactgacttcactaagacaagattcttttgttttcttcactaactagtaaattgcttctttcccaactcttactcttaaaagcaacagaatagagctctctaagggaaaataacataaagcttgaaaccacataaaactgcatttgtatttgtgtagacatgcatggattgttctttaggccagtagattcagagacaaaaacaaacaaaaaccatcccccagtgttacagatagttagggggactggactgtgtaacatcaatcccaagaaataccttaagtaagtactcccaggttctttagaatgaaaaatctaggaggtgtcttagttctattgctgagaagagacactataaccaaggcaagtcttatttaaaaaaaaaaagcatttaattggggctggctcacagtttcagaggtttagtccatccattatcatcatgacagaaagcactcaggcagacacgatactggagaagtaactcagagttctacatctagatcctgcatgcagcagggagagagacacaggacctggcttgggcttttaaaacgccaaaccacaccctcagtgattaattttctccaaccaggctatacctactccaaccaggccacacctactccaacaaggccacacctactccaacaaagccacatgtcctaatgctactccctaagcattcaagcatatgatcctatgggagatgttcttatccaaaccatcagagatggtatcagatgccctataaaggagtagggctttcaggccaaacttactttgaaaggttctcaaatgattatgagacacaacgggtttgggcaacataaacaggttgtttttataaatttcaaccactggcttgctatcttatcactcaaccttttaccaatgagcagatttcaaccaaaacaacatttttttttgattagttgagtgaaatctcaattcattgcatctcaatttattgtcagactttaaatcaagtgggcaattatttattcccatcaaggcagccttttgctatcctgtagccaaaataataaatactggttgttagttttatattcaaccttgttcctcagtgttttaaattattctgatacagctttggatggagagtgaataaaaagaggcatggtctctggagccccagatcttctcataaagacccaagaataaagtggtctaaacaacccttacacacttgctcactcactcaacaactctttggaaaactcacccaatcccagctccgtctcttgatttactctttattctcatgactgaagaactcagctgtttatgttttaataaaaaatggtttaaaagaccaagcagaatccaatggggactgtttctgagatatccagcttactggcatattctaatgtctacttggcaataactgaaagtgtggcctttgtattccaagtaactctgtctttgagtagtttgcagatttatcacttgttggtctacagcctttaagttagggatcatatccaaagctgcctggttttataggaaaagcctagttgtttccaaaagcaaggccaattaatagagcattcgagatatttgagatctatttccatggaggaaatgatcttaaagtgaagttaattaggagtgcagagagccagagatgataaattcagaattgcataatagatttgtatactaaaggggcctgtgtcatctccagtcctaaagagaccggctgctgaagaatgagactcagaaaaatgggtgggttatatcgcctccagctttccatgtcacatgcacatgtcacatggcctttcatgacctatattaaagttctccagagaaagagaaccagtgggttattctgtaaatatgtgtgtaggtttatatatgcatgtatatataaatgaagggagatttttttatggcaagggattgaagtgatgatattaagtttaaattcaatctggagacctaggaatgacaatgatgtaactcattctacatctcaactgagagattcctggtggtataacttttacttagaggccaaaacctaaggtacagagtagagactgggggagtctagtgacctgaaaaccaagagctctcatgtccagagtcaggacaaaatgaatctcacatccaccagacttttagtttttctgttctgactcttaaaggattggatagtactcacctaaaacaacaacaaaaaagaaaaaagaagagaaaagaaaacaggaaaaaccattctccttttgagtcaaactctattctcttccagtaatactgtcagagatacatcagaaatagtatcttaccagctatcaaagtaccttttaccctagtcaagcagactaggctacacaaaattgaagcctttatgtccctgtccatagaagacaggcttagctggataatacccaagtcctctattatagcatcttgccagctatcaaagtgcctcttagcctatcaagcagtctgggccatgcaaaaatcacgaagcctcagtatccccatctgcaggagacaggcttagctgaataacacctaagttctcaattatataccagtgctctatgaatgcaaaaataaggcttggaacactctgccttgaccagtttaagcatcaacagaagctgatcgctggacatgccttcaatcacaacttacacattaacttattaaatttactagctaattccaatttgttttctattttgaatggcaaaaattttcaactgggtctctacttgattttatcaagaaattgatggttctgtttggtataaaagtattttggttctttttccagaatatggtcatcattactagagatataaattgagctaaataggagtaaagtatcatgtctgtgatttcatttaaaaataaagataaaataaaatgtggctagatcacataagatgctgtttgggctggcaacatttctcattaaaaactatattctgaaaaaaggtatcagggacctaggggagacagatatgggtaacattgactgttctgggcgtggaggttcaatttatttatttgccttttcaccctctgtagtgtgtgtgtgagtgagtgtgtgtgtgtgtgtgtgtgtgtgtgtgtgtgtgtgtgtgtgtgtgtgttagtgaagtggaatcaatttcctgaagccttgagagatttaaatctcttcactgagagtgtctcttcaactgcatgcaagcatgaatgaatattaagggtaaggtactatgactgccctcttggttcatctttccattgctactgcacaagtcccagaattttgaatatcgttgggtcaccatttgtcctataggcttctgtaacctccttaatcatttgtatataatctagtgtgtgttcattacacagattcaaagcttatgttggagtgtatctgtagatagattgggctttctcatattcttccctctaccctccttgttttatatcctcacaacatcttttcttttcctttttttgtttgtttcttgtttgtacatatgaatttaaaactgtgaatttatctgtctttctatatctggcttgttttgcttgacaccatgacctgtgtttccatccattttcctgaaaatgataatacttaaatttttatggctgaattaaactccattgtggatttattctatgcttttatcaatttacctattgaaaagtacttatactgcttttataactcggctattccttaatcatttttctaattctttctaatagacatcctattaaataaaactgaacaaggtattgtaccaatgaactcagaacacatttactggctttacatagaacattacaacttttcctttggaaggaaaatagatgctgccctcgagtagggtgcacactatgttcatatcaattaacattggtgaaaacattacaattcaattggtccatcagtaagtcagagttgtctatagaacacatgtttataaccctatatcccgctctgatagaaataaccggttagcttcttaaggttgatatagtaaagttgccacaattaggtggcttaaaaaaacagaaacttattttctccaggttccagagtcgaacaacttagaatctaggtttatttggtactgtgctccaattgaaaccctagatagaacccattcttgtttctcctgaacttttcatgagaaccaactgccttgtcatttctcagctgaaagctgcatcctccaatcttcatcttcatatgtgatctctcctgtgtctatgacttataagcacaccatgagattaagggcacaccctatttcaggatgacttcatctctactcattacactttttccaaacaaggctgtgttctgaacatagaagggcttcaccatctctttttggaagaagcaactcaaaccacgaggccatccaaacaaatgacactgtgagatggattccatttgaatcttttatcatagctatagttcctaattttacaaaaatgaagggctaaagtttacttcctgccatgcctgggaaataatattcagacaacatgttccaggacaatgtctaggatctttagaaacacatactctgtgctatatggctgttctacagaagccacctgagagtcacaatagagacatcggatgtaagcttcttctgaaaagaattaatgatgcttctatagcttgcccttgttataccacgcccactcctacctaaagtccttccactccatctgaatcactgaaagctttaaatctaactgtgttgatgctgcagcaggaaagccacaaaccaaatcaggacaaaccaacaacccaatcagaagtattttatacaattattatgttggaggttgtggtcttttcttacttgagtttttctgcaatgagggagaaatagtgaggaccttttgtatctctaggtaaatattaaatctgccagaagagccagttacccaacaggtagtcagctcacaggtcagtgctcattggaagatgttcagagccagaaaccaatcccagcagggatcctatgcaaatctagcaagaccttggctttcatcttctatttcctgaaacaagcacccaagtgttaactggcttgtgaaataccttgggtaagtctcttgtgtgtttaagattctggctgatttacatctgccaaaaaggggtatttgttatttcttgatgaggcccaggccctctgcactaacatgtatgttttcgattttcattcccaacctgatgcttgacactctacatgctttctagggtgaatgaaagaaactgagaatcaggtttctctgtcattagcacagaatcagctaagaaagaactaggataaagatggaagaaggggaaatgaatatcataagactaaggaaaaacctttaatatgaattacaatgattaaggattagcattagaaagtatgtgggtttgacaaagctactggaatctttttagactttagagctctcacctttcttgaagtcacttgagtttgccatcttgagatcttgactattatgtaaaacctctaactgtgttaggtcaaacaagagtgtaagaggtgtgagaaggttgcatgattgcttgtgactcttttgttgccagctaatgtatgagtgtggaaccagagcagagaatagaatgaatggaacaatcaccatatttgctgaataaatgtctttgtccattttttgttgccattcctgtactttatgaagcaaattagttcacttcctacaagtctggacatgggaagtccaaagctgaaaggcagcatatggtgagaactatcccactagtaaagatgccctgagaacccccaagccccaagtcagcacaggacagcatatgtcagaacaaccacgctgacttgtgtgtctcttcctcagattacgaatccactactcattatgcagacatccctctcatacctcatcgactcttaattattcccaaaggtccaagctccaatcaacactaacaggtggtttgtgggttatgagaggacaaacacgggaagaacctagtgaggcatttcaaccccaaggatgaagttggccatcaccctggtttcttcaataaactgagcaaatgagtaacagtaagaaaggaatagtaccctgatgcctaaagtctcaacaccagcatctagaaaggagtgcacacgaccccaccccttatcttccttgccagtttctgctttttattcagtaaccattgaccctgccaccattcatcaccagaagtcacagagttgcaaggttatgtcctcagtcaactcagctttgatttgtccccttgggtcctcacttagtaaagaaaagagaacaaggcaatactggtaataaccaaaactgaggcagatatggtttggcttgagaggtggacttgataagaggagaaccatttatcacttggatgccaacttctcatttgtcaaatgtttgatgggtttagtcatgaagtctccaggccaggaggactacatgttaaatagcttcttacttattgtcatctattcaaaacaggtcggctaagcatggacaatgggtgttacgatatcttcaagtaagctgtagactgacaggctagttcattttttactatctattgttataaattcatggatttttggggggacattctcattgtgcccatcaaatgccttgatcccactcatgctcatgctactctgctacccaccgcagcctcttttcttggtctgtattgtcttccctaatgcagccttttagaaaataccttcattgtgataaagtgtacatgcttaaagctcatgtttaaaatgtatacttcagtgggttttatgtagatacagagttataaaactgtcataacaatctaattttagcacatatcaccaagttaaaatgtgtatgttagcaggcatagctcatccccctactctctccactcccgttagcatacaatactcagtctgtggcaatctctaagtcactttgctttgctattgcaattttttcataagttcctaccactgcctagatcataaaatatttcccctatatttttctacagtaaattgaacattgaagttacatattaaagtcttgatccattttgaattgattttttttttttttcgagacagggtttctctctgtagccctggctgtcctggaactcactctgtagaccaggctggccttgaaatccgcctgcctctgcctcccaagtgctgggattaaaggcatgcgccaccactgccctgttttgaattgattttttgcaaaatgggagatacagatttaatttcattcttcacaatgtaaataccagttttgccagcacaatttattaggaaggctgtctttttattgccagctttgtcaaagattagatgactggagctgtgtgggttgatctcaggtccttaatttcactggtctataggcttgttcagtactttgctatgatatcaatagcaaaagtaaattctattagtgtttatgaagagtgagtgtttatgaagagtgagtgtttgcaatattccttaatggtaacagcatgaataagattccgatgtctatatctgtggttttcaactatcttaatcgacggcacttaaatgatcctttgcttcccattgtaataaaacatatctaaaatgtacagatgagtttggttttgtttatgtgggatccaactcctgactttgtgtgctcagctgacgtgtctgtaacggaatgttctgccagtctccagtgctgtctaccaggaccagctagccacctaatgctgtctgtaattttaacttcatcttctcacaggctgagtataaatgaggagacacagtaggagatatacggagcaaagaggcttttaaaggtcttaggattcttccagaatcactattcaggatggtcttccttaagaatggcaaaaccctgcatgtttatcatttgtatgtggacagttcaaagttcaggaggcctcttgtggatgtttcttgtcttcggagtattaaataatacttaactgtcttctgttctcatcatcgaatgaatatgactttgttcttatttcctaggactatgctgtcagtgattatgaataagatcattaatgtgtattcgttacttcagtttcttgtgtattgtgtaccaaaaagaaagaacaacaacccaaaaagttggttagaattagagactactgccttgtcataaagatgtacatgctatatttatacaactttcagatggagcccctctgttggcccatgctgactacatataacacatcaggttcgtcagcatcttattcctgggatacaactacaacaacatgctcaaagaaaaagaaaccttggtttttttgttttttgggtttctttctttttttcataaaagtgattgagtgagttgtatcattaagcaatgatgtcactagaactcataaggggaaatcagaaaggcgaacctggaaacgtctcgaagtaaaaaccaggaacccccagcacagtgagtgcacggactcattgctgtcagctgaggaattgctcttgtgtccctgctactggagctctgacttggtgatgtaagatggccatccccctcaccactcatccatcagcagcacttttaaatttaccttggaaacaaaagagcaaactgaagtacagtgcgtgtcatatgatgagttcaactacctcttcgaaaggcaacatcagagagtgagatcaacaactagactaagaaggagaagtcactgttgttgacacaagctattaatttactgctctgaaatgatcgttaactgttttgctccaagagagagaaatctgttcaagggacagagagaaatattgtttagatggtccctaatgagacagaagtagtagggaaatagaaatggatttccccactagcactgctccctaaacaggctcccttattaaccagcataaaggatggaaacattttggctacataaccctacataatcctaacccttggatactaagacgagaaagtatttactctctgatacttccaggtaaagaggggatgttctcagttcagatcaccagaaccataacggttctcttagttaattagaagagtatgttctctcctggtgtacggcatttagtgacttccaacttttaaaaatgtaactttttataaacctcctcgcgaggatttaaagaacaggacacaggtgacatttaagaatgattttaatactgcaatcaatgaggaattaattttcttcgaggtgagagtttcctgcgtctggaaacggaatctagtccttcacacccactaagcttgcactggagcacagacctgtagtctcagcctcacatatttaaaaaaaaaaaaaaacaattccggattttatgtggaggtccttgatccacttggacttaagctttgtacaaagaaataagaatggattgatttgcattcttctacatgctaaccaccagttgaaaatgctatctttttttccactggatagttttagcttctttgtcaaagatcacgtgaccaaagtgtgtgggttcattttggggtcttcaattctattccattgatctacctgcctatctctgcaccagtaccatgcagtttttatcactattgctctgtaatacagcttaaggtcagggatggtgattccccagaagtttttttattgttgagaatagtttttgctatcctgggttttttgttattccaattaatttgcaaattgctctgtctaactctatgaagaattgagttagaattttaatgtgtgagtctcagcctcacaaattttttaaaaaacaattcctagagttttctagaatatatatatatatatttatcacttagatgctaggtttttttctttttttttcttttttttattagatatttatttcatttacatttccaatgctatcccaaaagtcccccacccgctcccccacccacccacttccacttcttggccctggcaagtctgttttgttctttctggtttttctgctctcttcatattagtagcatggccctggtttgcgaatgctccacacttgacctgagaagtggacttacactggtctcttagctaaaataaacagaaagccattccgttcgggtccactgctggtggtcacctcattaccatgcccaaaccatggccactccagttaagatgatcactggccaacttccaaagaaccacatttgtgctgcagttattcattggactggaacaacctcctccccgccccacccccacccccacctctctctctctctctctctctctacctctctctctctctctctgattttaaattgtttgtatagctactttcttgcttacaaaatccaactctgaattgtaatattccatgttggtcaatcaaggctccctgttttgtttgtttgtttgtttgttttatatcatcagtagtactctctatttattttatatcattctcaaaaatatttaaagtaactcgcttccaatatgtctgtaataaccaataccagaactgtaaataggttatgacaataagaaaacatataacccttttggtatttccctgttacagagcacatacatccctccattagagtcactaccctttgagaataccaacctttctagatgctcctggtaaagctagcatgtgggaaacattgctcaaaaatgccagggtacctctgataaaacacaggctggtaagactttcttgagtagcagtgtgatagtctacctgtgttctcaactttggtttccaaagaaattcccatcataatctagtgaaactcctagcagtggagggtatggagcctgaagttgcctcttcctctagccaggtagaactcccagtgaagggattaggataacccacccacaaaaccttgggcccaaaatttatcctgcctataagaagtgcagggacaaagatggagcagagactgagggaattctcaaccaacgactggctggcttgaaatccattccgtgggcaaaaaccaatccctgatactactaatggtcagaacctgttatgcttgcagacaggaacctagcatggctgtcctctgaaaggctccacctagtgctgactgaaacggatgcagagacccagagccaaaagttagaactgaggaatcttatggaagagttgggggagaaactaagggcctcgaagggaataggaactccacaggaagacaacagagtcaactaacctggaccctcaggggctcccagagaattaatcaccaaccaatgagcaagcttgggttgcacctaggtcccctgaacatccttagcaggtgtgcagcttggtcttcatgagagtcttccatcaactaaaacaggggctgtctttgtctctgttgcctatctgttgatcctgtttccctagctggctgccttgtatggcctcattggaggagagaatgtgccttgtcctgaaatggtttgatgtgtcaggtgggcctcactgttctcagaggagaaggggacagaggaaggaggggaggagctgtgtgaggaaggtcagggagaaagggctgggatcagaatgtaaagggaataaataaataaattagtggaaaaatgtttatcaagaatagtgtacacagccacaattaaaaaaaaaaagagccatgaatttaaaaaagcaatggggttatgtgatagggattgaaggaaggaaaagggaggaagaaatgtaatcatagtataattataaaatgctctaaaatttatttaaatgtaaaaaaaacagtaggggaaatcaaaagtgtcaaaagcagaaggagagatgggcatgttgtcatgaatccatacaaagaataggagacatatgaattcaagaatttaggttggatgtgagtagttggaaagaaccatgaattttccccagcagattattgcaaaaatatccaaacattggagcaaaagttctaagtgcagattaaattgtaagtttctccaatattctagaaccagagtattccaaatactgccttcttatgagttctgtttatccaacccaagtaagatccgtgcatctttgcaaagttcttgtcacatctatagtgacaatgagcatacttttatcagaatggcccttatcttcctgggttgccataatgattagaaagttattctgctcagttaaaaatttattctagttctggccagtaacagaaaagtagaaagtccagcaagatgtttcattaaagtttactcaacccaagttggctgccacataatttccactggtttgagaagacagtaatttgggtggatccttgaaagctcaaattttggataattaattctcagggtgtctgtgttggaaagcaaagggtagagtctaacaagaagcaactaggtcatcactcatgaaagctttcttagaaaagcaagttctgcctgcattattgtccactctctggtgtgagccctctcctctttcttgttttctctgatatgcagtaagttgaacttcctctttctacctttgggtgataaagccatagggctctcaccagctgtgagaaagagtattttatccttggacttcccagtctctagaactataaaatataaggcagggggtccactctgttctctcaggcctttgaatatattttcttggtggccatggccattttgaatgaactcaggacaacacatagagttcttgagaagaacatgttgtcttcctacctttggctcccccttgtcttctatgttttcttcatcttttccttttcctctgacaagttgcatctagctctcataattctttaatataacattttaattttaaaaactgtttggaagaactcatacattagtcctgtatttacatctcctttctctccctcaatccttcctccatctgaggtccattacctcttcttctataattatagttacacaaaattgtgtttgtatacaacctcctgagttcgtttagtgtttcttttatgtacatatgtttaggtcttggtagttgggattggataacctattacagaacaccttgctggggaagtctgactttccctacacagccattgactgtgtatagttcttcatctagagatggagccttgtgaaatttttcctacccacattggcatgtagactgaccttgtcattatctagaccttatttagatagccacactgttgatgtttcatgagagcagcatccctggcatgtctagaagatactatctagcagcaggtattttggtcttctggctcatacaatcattccatctcatctgcaataatcaaacctcaggtctaaagattgtattgtagatgtgccagttggggctgaacacctcacagtcactcatcactgaattttgaccaactgtggatccctgtaatagcctcttggatggcatctttgatgagggttgagagctagctacacttgtctgtgagtataaaacaacacaaaccattgtcatgacccttggttgccttgattgcctccaagaacttgaaggtaagaccctacttcttaagtccaaacatacttcagatgaggatatggtggcatcaagctgggactgacctgaatgccccatttctgaggacaaactctcatagtactagaagtaatatgcaaattgctaaggaagaaaagaaataaatattccttcccagctagaaggcctataaaccacagcaatgaccagcctgccaagggacctacagtggggtaatagtgaaactattatcttggagtcatcaacagccatctaattagacttaaagtccacttactagaaggaaactcatacctgatactggaagcctaatgaacacatggctagacctcataagagaacctactatgattttttttctaaatcaataaattatataattattttctaagtgaataattactttattagttctttaagaatatcaaacatgcacaccatatatcatgtcattcctccctcttccccttaacactgtggttctcaacctgagggtcaaatgactctttcaaaggggtcacctaagaccactggaaaatgtgactatttactgtatgaaccataacagaagcaaaattacaattgttaagtaacaacagaaataactttatgattgggggtcacaacaacaggaggaattgttttaaggttcacagcattaggaaggttgagacccactgtcttaaccctcacagttctactcatccactccccatccactttcaacttcaagttcaccttttacttttataacccaactaatgcaatttctgccgcccatgtactcaaggggagagaccatacactgaagcatgctccacctatcaaaggccacacctttaataaaaaccggctgtccttgaccccgcagccagaaactatgaatagctcttcaggctgtgatgggagttcatgaaccctgctctttgctggaatgctgaccagctggatcttaaagcacatctctgagctgctgggagctcaggagtggggtggtcatgtcttctccagaaggcactgtttttctctggtcttccttgacctctggcccttacaatccttctttgctggttcctggaactgggagaagcatatagctgctgcttttaaaactctaaaaggcaagaaaattcagttaaaaacaatggagaactttggttgaagccaggataggtttatttctgcctctacagaatcataaaacatcatacacctgacaggagtgggaatgtgtaattgaagacggcgagtaactatttatcataagctaaaatttaatataaagctactcaatgctttaatatcccatcctaaagggctaagcactatgtagtgctagatccttgagtagagaacaataaacagagaagacagttgacgtacatgagaatcctcagatattacccaaatacgtttcagataatcaataactgttggctgagtgaatatgtacatgaacaaatgagcaacctactagagctcattttccatgatgactttttacagtttttctccaatatgttacgtacattttaatcattttttaaaattaactctctattaagaagcttggtacttatgaagattagacaaaatcgtgtgttcaagtgctcatgctcagaaatagcgtctggcagtcaacaaatgttaactagtgattttcttcttttttctagttattctttaaaaataggattatgctgatgccctcaggctcactaatctcaaagtcatttccctaatccactaatgaaaagagatctggagttgcaatcagttcctactctgtgcctttaactaggccacccacaccaaccccttggtgctggcaccaataaaatatatgcaaaatcctaaatattttttcacttcttcctctgtactgtttagttagccccaaactttgggccaaatctaccatgtccagtcagcacttgtctactccctgttggacctgatgtctgaactgaatttacctcatttgattctgttctttctccttctctcttaatcagcccagtgaaggttttgtaatttccttttggttccaacaaggctcactccattaacccaagttttgggatttgcctctgccacatatggatcaaaatttccaaactgcagttggcatgagtgttgaaacttatccctcaaaactaggagataggtctgatgttctttgtgtttctgtatttcaggaacagaaggggggaaaaagaatttcaccaagctcagatttccttcttttatttctctgttagtgctctatgtgactggctgccccactgaatctgttggctctgcctcagtctgtggttctcagacccagctactcaccaagattatgccacaaatgatttcttggatgcatgtatgtgttcttccttcaagggcttgtgttttcaggttgctatgagtgactagacctgttgccagaatgcatgaatcctctctgattttctgagtatatccgaaaatttattgagctaatatcaatagataaggcacagctttggtaaattcatcagttacaatgacaccagcagctctggatagacaagaaatacttgctgtctttttcacctctgactagtgggagcttgccatgcagaatctcgtctgttagttacataaagaccaaaactgtgagctctgtgctcctgaaaagataaaattctggacttgcttgcttcatgacacactatgcagaccgtgtctccttttatattgagaggcaaaatattgaacataggactccatgtggaacctaataaaggcactaacaaaattacactttccactctgtgttttatgccatactcctaacattgtggccaaactggtcttcaacgcttttactcaatttactcaagtgtgtgggtgggggtggggggggtcattgtttcctgaatggttgaattttaaaaacaaatttactcaatgtattttatcatatttctccctccccattcctcccaataaccctctttcctaaccaacctacttcacttttttcttgcttaaaaaaaaaaaaaaaaaggtacattttgtgtggtccacctcttcctgagcatggggccttccctggactgtggtcgatatgcccagtgtcattgcattcatcgaaaagaagtgatgtttcctttccctcaatgactgtcatttgcaaatattgttttcgtgtgggtggtacactgtacccatttttctttccccatacactgattttgtcctgttcgaacttgaggtcttgtgcgtgctagcaccatctctgtgaatagccatgagcatcagtcctgttatgtctgagaaacgctgtttccttgaagtcgcccaccacctctggcttttaaattctgcctctacatcaattcctgagccttgaggagagaggtgttatgcagagattccatttaggactgagtgctttaatatttctcactttctgcaggttgtccacttgcgggtctctgagttaattgccatctactgaaagaagttctctgatgagagttctgtaatacagtgagctgtggatataacagtcatttattttgttagaggagttattctgttgctatgttcatttaggctttcccctaggcccatcatctagtcacagcttttgaacctcattaacagtgctgacatgtgttccatctcatagagtaacccagaaaccttaccaaacgagtagttggttacgccaatagcacctatgctactattgcatcactgagtgtatcttgaagacagattgctactacagctctcagggaacatagctggatgagacttaaaactgcttttcttctccagtagcttgtattatatcatcacccagcacgatgaatgctagtcgtaataggtcaaacttctagttgagtaccaggttggtttctccatgttcaataccataagtgtgtggtgtcttcagtaataatctcttagcatcatattgtggtaggtactcaatatcattggcaatactttgtaatatttaagggtggtctgtggaactgtttttgccaatgactcaaaaagatataaccactcccaggtataggttttatggtaacatatgatgtccagttgagacattgtctcccccatcctatgataactccatttaaattccatttatatacgcatatattttaggaagcatctacaggaataggcttctgtatggcttttcaaaagacctttagggtaagttgtcccttcccatggtcccttctctactctgtccacctatcaccctctccatttaatcctcctattctaatttcccttttattgtgtggtaacaatatagttatttcccattcatggtccctagaagatcacctcctccttcatcctagctctctactttctgtttaaccttggttattctgatattgaaacacatatatctaaaagctaacactggcatatgagggaaaacattcaatatttgtctttctgagtctcagttccatcactctgggtgattgtttctagggccatccatttgcctgcagatttaataatttcatttttcttgaaagccagataaaattttattgtataaatgtacctcatttacattatccaatttaccagacggtagacttcaaggccttttccaatttctggccattatgaatagaacagctatgagcagggggcccttttgtatatgaacaagagttttatagatggatcttgagatagatcaatttttggcttttgaaggaacttccgtactgacttccatggtggctatataaatttgcactccttccacaatgaataagtgttcttctttctccacatccttgccagcatctgctgccgtttgttttatttatcttgcccatcttgactggaataagatgaattctcaaagtagtttttatctgcatttctctagtgattaaatatattggaaaatcttgtttctcactcagttgtgtattatcttttgagaactctacttctgtatcccatgttttaattgggatatttgctttattaatgttgagggtttttttttttttacttctttgtatattgtagatacttatcctctgtaagatagataattagtaaagattttttcctattctgtagctgatgctttactcaaataatgttgtctagcatgtagaaactttttaacttcatgaggttccacctattaactgttggttttaaaccttgtgctatccagatccagggccagaaagtcttttcctgtgtcaatgagttcaagcctattccttaagttctcttctgtcattttcactgtattttgtcttatgttgacgcctttggtccatttggagctgagttttgtgcagagcaatagatatagatataggtctgtttttttttcttcagcatgtagtttgtatgcagtttgactagatgctgtctttttccagtgtgtgtttttaggcttctttgtaaaaaaaaaaaaataagaagaaagagggaaaagaaaaagaaaagcttttcatggtgtgtatatttattcgtgcattttcaatgtctctgattttatgccaatgctatgctatttttattgctgtagttctgtaattaatatgaaatctagagaacctacaaaaaatgaacatatatgtgcatgacataccaaacttaaatcaagattaataaaacaacttaaacagactcataacccttagtgaaatgcaagagtaattaaaaatctcccacgtaaatgaactccaatgccaaatggattcagtgtagaattctaccagaccttcaatgaagaactaacaccaatactcctcaaattattccatgaaacagaaactgagggaaatttctcaatgctgtttctatcaggatcatacagtcacagataagcttgtcttttaagagagagcaatgaatgagactatgcagtgttattgtgggcagggctgagaaataagaaatctgtcacaactcatcaacgtgaaaaagaaatgaacaagaatgaatttctctggggctcagtgaaaggctgaaccatggaggaataatatggctggagagacagaccaccactaaaactaagtcacaggaaaggtagttgtggaaggaaagagggcccttgcatgcccatttcccattctctacctcatgccccatgcctctacctctgcctccatctccagaaggttgattcttccagaagtcactcttctgaaaggcaagagagcctagcagtcagaaccatcaaacccagaacagaaaaagaataagcatggaatcaaggattgaccgggattaagtggcatgccagtcatctgatacatattgaatgaataatagaggtgcaaatgatgagagcccaagacccagcatgcagtaaaggctttagcggctgctgaaactacaattcccttgctgtctctgtgctccgagtctctcgtcagtactgtgtggtatttcagactgtccacttcagtgcagcctctgacctgtgtcttgttgcctctgtgactttctccaccctcagctaatacctcttcatttccaacaagaatagagagtgttgatgggaacagggaggagcatgggttgttccgaacagagttaggacattatcaaagagagctcaaataatttccagaacctaaaacacattctagaatatttaagagattctttttctttatcttttttcttttttaaagaaaatttggtgccactgcaccctatggagaaaatttggtgacttacttctaggaagcttgccccagacatctgtgtcataagctgtgagttcaccagacgcctcgttaccaaacgtcttgtggatgaacatcttttctattcaaatagctttcatcctattatgggctttgattgaagacacaatccagctatctagtcagagcagcaatgttgacactgcagtgactgtgcatgagtgtttcagagttatgaggacactggtggccaccatgggcctcctgctggtcaccttctcctccttagctgcattagcaagaacatccagcactagcttcctcaagggatcattcctagtactctggaatctgaatgctaagaaattatttgaaagcctttttggctggttccactagccagttggctctcagatggaattgtgaaactaaattggacaatagctatgaatttatgttcataaataaaagacattttaggggaggggatgtcttgcttccttttttgcgtgtgtatgtgatccatgtgcatatatgtgtatatggcccttgtttatgcatgtagaggctaaagattnnnnnnnnnnnnnnnnnnnntttaagtaaatcctcctaatctagctatatttggctggcctaggtggccagcttgctacaggggtcctgtctctacagcccatgtttgctgggatctgggatcataggtaggccaccatggttccccaggatgtacatgagtgctggagatctgaaatccagtctcacagtcacatggcaggtgctttatccactaaacagtcatcctagccctaaaaaccaggtttataaggcagtttatgccatatagacacctggtttgcattcaaatgttgaaagagttcctttctatctaagatcagcatctccaactcttatctactttgcatctcttaaaccctaaccaatgggaaacaagagtctggaatttcatccaaaagcctagagtcagaaatgctagatgggataagattgaggctgtgacacctggtgtaagtacatcccagaagacaaaagccctcatccgacattttactgagtcttccacttctcactctaaaaagccttctcctgccaaaggatgtttgaaccactgatgaaggatctaacttgagcttcacataaaagtgagtctcactcagacaagttcatatctgtattcctcagtaaatcccacctagggcctccaatatattccttatactttaattccagttgggacagctggtgaaagtgatctatgcactatagattagatactgaattaatattaatttcatgacacacacacatatatacatatatatattacatatatatgtcaatggttttgtatacacacacacaaacacacacacacacacacacacatatatatgatgaatgccccattcttaggagaataaactcaaataattagggacaaaaaagaggcatcgtaactatgacttactctctgatgacctggggaaaatgtaatttttgttacataaaagatataggatggtgaataacatattaataattcgtgtgtttgtgtgcaatacgtgggatttatttttacaacttttttttccaagattgacatgacttcataatgaagttgcaaaaacaagtaagtccagcttttctaatgctcatctatgctctgcaacacaggaagctagaaatgctctctcctgatttgtcctgtttgagttaaaatgagtcatcttctctttcagctaaagaacgcttctctgtggaggtgagcatcgcagatgttttgcacatgaaccctgaaggtaaggagggttttaccgagtgcccacataattgcctcccattgtccctctcatacagacaagggcagggacgtggctatcttgattctcaaagagcatcatctcaaaccatcaatactcacacagagcagtccactatcctcaaaagggggggggggatcttcaatctctgtttcagaaaacctgatgctcgtctccttttcttgtttttctcaaaagcttttcatggttgaaatcccctagctgtgcaattagatttttatttcctctttatacttgtctgtacttgggaggatttttttgacaatgtctgggttacttttataatcagaaagagaaagattgcatcttcttttattttttcaaccagctcaataccaattctgctatcacttcctgagacatctctcggcctctttaatattgtcactacttgggcctgatccgtgccagcctatatgacaatacttatatgtggtgggctctcagttttcctcacctactaataccaagggagccctgggagccagaacctgccagcaaataggtcatggagaaatcacccacacaaagattgcctctgcatataccacagtcaaagatctaggctacttaagaagatagcagattgcttttggtctttgagacctttccttcctgctcttcaagagaaagtgaaaaactcattaagatagaaaactgactattattattagctgaagaaaaatctaagtgaaacgttcctaagatttctttgagccaccttgtgatggatgaatagtgattctcctttaagggccatctttcactccagtgaaggctggcctgtcccatggatcaaagatgctcaaagattgtcaagaccttctgagtcaaagatctttttgtcacaaagactgctctctggtagtatattcagcaacattggaatagaataccactccaaacccagcttcaacaaccaacagtgtctagatgttgcttaaggtcctgggaaggacaaaaccacccaccctgggtagtgacagtaatgtgttcagacactgcctgatgtctcctaagtgaaacaaaaatcccttctatcaaaaaagcacttctctaagttacctaagccctgccaagaccttctgtttttttcatttaagtggattgaaattcatagtgtacagagtggaaacaggaaatgtctacaaaaagaatgccataaacactttgggtataagaaatctctgtggcattaatgtcattttctagacaatccattaacataaggactggtgcgtcaatccagcaagagttctatgcatttcttcctactttcttggcttctaacccttgagttcacatggtacttgaaggatagagacagattgagagtcaaaacattatgctaagttctttagtaatcttttgccatgtggattaggaagcatagacaactggagtctgaactatgttgcaaacacaagagaaatttgcctgcaaattacttttttttttacttttatgtgtacttatttattaaccacatgtttgtgtaaaaacgttacctctgactgacttttcaaatcttttaaacatcgaggcatagatccttaactaaaattcatcttttccactccaaacagtacacagcaggtgaagttttggtaacagagagatgttccagtggttggaacaggagattgaggctccaatatcacatcccagtacacacacatagatatctactgtgcttgctcatctctaagtacccttggggcctttcatccctctggttgaccttcttccctagcatctaccctagtctcatgtcctccaccctttacccaacctgggatgtggtatgcaaagattatactcatgccagtggatatctgtgaaaacacaggcagaaacttgaaggcagttaagacaagtcaagacacacagcaacacagctcttcttcaacatgagaagaacatctagaaacaaatgttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctccagcttttcaattatgatccactagttgtaatcacttcagagcatggcaaagcaaagcaccgccctacctggcaccatacatccttttacaagaactctggcatcgtccaggctctgcccattccatgtcttctgcagctcctgtccatacacttgtgactttaaatcttgacagatctgtgagatataaagacacagaataatccaagagcactgtggaggagttgtcattcactaggtgtcttttgatgctcatctaaaggtcttcacccattatctttgtatacatcacatgtttctgccaccatccaattcttgccacttgggcttctactttgactaaaatatggtatcattcaaaatctgtgtgctaatcttggcatatagacatgtagctcgctgatacatttcttgcttagtatgtgtgatactctgggctcactctccaacagaagacagaacagaaagacttggagtgttgcctatgagggttaataccttagcttatgcatcatatttgcttatgagttggactttcttgtccacctgggaagactttgaacttggaactcaatggagacttagttttgtttttgtttttgttttgttttgttttgttttgtagtagagaagctgagtgcactgaccctcattcactatgccactagccccaaataccaatttaaatataagcctgttgaaattaaatattaaaaattcagttcctcacttatattgaatccactcccaatgttctatagctgcacatgcttagtggtcatgttattgggcagggaatatcaagaatacttccattacaacataagtttctataagaacaagctgaccatcccagtgaggagctctgggaaagtgataaagctcaaacagacaggctcagcagtgagggagagagatgacagaacaggattctaaaaagaaagtgaaaggaccagtcaacgtacttcaactaggtcaacaattatatcactgatacccaaccatgaacaaatgtacaactactctaccacaaaacactaggaaacaaagaagtaaccatctttgagatggtctttgagacccattttctcccctgtctagtctttggagtctgtgaactcattgtgaaacaagaaacttttcttctgaatccagaggcaagaagatcctaagctgtgctcacacattgaagccaatgaactcccagtcaatcgagaaagcaacactctggtagccatatacaaaagcctatttagagctaggattattcaaaccaaagaaaacaatacaaggcaaaggtaccatctctctggggacttttgactctataacaagtccaaggaacacaggggtttccaggacaattattgtccctgtaatggagcagatagtgtggtcatggcctcctgctgacagcagtggcttatccttacctagcacattgtcaacaaatagattacttccacaaagtcactcatcttagtctctcctcacagagtcaccgagggaagaagagcagatgtggccctctgtactttacatacaaaagagtgaaggcacagaaagagaatgagacaagccatagttagcaaggttggtgaaattcaggaccaacaatagaaaacagccacctaacctgtctgcagttcacaactcctctctctggagatacaagtcacttagcacctgttcaggtccctaagtctgtcatctccaaggctatgacctcctcatagataatgctgcaaactcagcttgtcactccatccctgtacagagtccccagcaagctcactgatggtacctcatctactcaaactgctgtaagaggggacagaagcaattgttactaattctgttgctgcccttctcagaagaccccttctttcaagcaaaaacatacctagtaattgcagaaaaaaatcagtgtttgtctcagtgtatacactaggtctaccgtctatcttcctggcaaaagtcaggtggaaaatgctaccccccaaaatactctgtctgccttgagatactcttaatcatggcagattttatttctctagaaaactgagttagaatgtttccattcatatgactttcaatagcctgtaaccaaatatgatatattctcacacttgaatgaactcatcattcatgatgtctaatagtcatttgcattcttggctacatgaaagattggattcgatattttcctttagcatgcaaagatatgcagagtagatatagcctttatgtctgataaactgtaaacacaaaatccaccactgactaaaacagtgaagaggaagtaagatctaaggctgtttagataaaataatattgaagatggcaacaaaaattaaaatgctcactttaaatgtttcccaactagctgacacatccagcattgtttggcttggaaacttgacaaagagcaaagagtgaacgaataaagggcagatacacatacagaaaagccaagttagccaggctatgcacactctaaaagaacagcactgtactggctggttttatgtgtcaacttgacagctggagttatcacagagaaaggagcttcagtagaggaactgcctccatgagatccaactgtaaggcattttagtgatcaagggggaaaggccccttgtgggtgggaccatctctgggcttgttagttttgggtagtcttggttctataagagagcaggctgagcaagccagtaatgaacacccctccatggcctctgcatcagctcctgcttcctgacctgcttgagttccagccctgacttccttggtgacaaacagcagtatggaagtgtaagccgaataaaccctttcctccccaacttgcttcttggtcatgatatttgtgcaggaatagaaaccctgactaagacaggcaccaactccacagcaccctggaacctcagcgtgttgactctgtagagcacaggagggagaatgtgcctaatctcagtaggaagtcttactagctatgcaatctcagggcaaaaacttccaggaggagaaattgtgttgctagtttttgcccacactggtcagttggactgcttgaacacactttcaacatttgcatttgaaccagaggaaagctttaccatccctctaaggctccaactaggcgtgcaatctttgccattcccatgcatctgaggagttggtctttgacatggctgtaaacatgtcaaacaatacatattcactcagaatttcatctgttcttgacacactcaagacttacgtgtggctcttcatacctagcaatgcaccccttgccttccattacagcagaaccccagtgtttctcagtcggcatcaacctttctcttcatctaagccattacacgttacagttagactactgagctagctatgtcaagttttgctatctgcccaaggcaaatgggccacgctctggagattctacttcctcccagggctgagtaagtccagactctaagcttcttctgcatctttttgtggcatgaccccagagaggatacttggagcagcaagccatagcatgcctggctaaaggtggattaaacactgggcatgtagcactttcctaagaaattctgggaaaatcagttttaggtttgatttagcaggtcatgataacttcaaggaaccagcgtcaggatgaacggtagaaggggggctcctctccctctttctttcagcagagagggaattttctgctatgccttcatcactagaatttagtgggatggccattcctaaggctgcagtctggacaaaaaaaaaaaaaagattacaatggccctgattagcatagcctgttacttcctcatcccctggggctggatgcctgatgcctgactggactctgcataaaaacaaagggagaagtagttgttggagaagaaacttatggtatctgccaggctcattgggtggataggactgtgtcaaagacaagacaaggacgtttgttctcaccagagaggcaccctccacagggaagcagcgtcatctcctcaacaaggtcagatcatttatgacaataggcatgacacctacagagcatttttttcctacacttgtcatttatgtgctttactggagactctttgagagatggtatgtgtacactaaaggagttctttctgacaaaatttattttatgtcctgttcttacatctaactatacatagctagatgaaaagatgggtggatgaatgcatggatggatgagtgagtgggtgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatggatggatggatggttgggtggatgggtgggtggatgggtggatggatgggtggatggctggctgggtggatggctgggtggatggctgggtgaatggctgggtggatggctgggtggatgagttgatgagtagatgggtggttggatgggtgtatggatgggtggatggatggatggatgactggatgggtggattgatgggtgtgtggatgggtaggtggatggatgaatagttgaacatttaaatcactaacatgggtcaatctacctgttttctaacctgccccactacactcacagctggatctttatatattcactcctttccattcccacccaacaagtctacaatgaaagtattcactctattccctgaactagccttgggtctggttgttacctctctgactggttggtaccttttctgcccagaaggttgcttctgaagaagaacaagatggaaaagggagaaggggaaagcaagtaattatcttggtagatatagttgcccagatgtttgaatgcagaagtaagtctgaaagaacatcttgttcatgagtgataaagtgtgactcagaaaagtagagacaggttgtgctcctaaggggagcacagagaggagggttgactttgggactggttctgagcattatgaggtgggagagatgtgtaggctttctgtgttcctggcccagtctgtgaacctacaattactactatcctttagacttccagctcctagtgctttgtattacaagtctgttgagccagaggaaaatttacacagagaatctcacaccaggagccctgctgaagtttcttctgaataagatggcctggtccttctcggggcccctgaagaagatattttctgcaaaactgccattcacctacttgtcagaagctgaatggcaaataatgggttcctggatgttttaaatgcactcagacacagtaatgcaattagggaaagtaggaggaagtctcgaaaacaactgagcagccagtgggcatgagagctgttgaaatccttcactctagcttgagagataggtacatgttcagctacaaaaatggttcatggaggttggttctcagccactgctttactcattgccagagacacagaggtccgatactctatggtagcctctgttcacaccactgaatgtcaggttttccttagcgagctggttttgttgcattaatgatggtgttcaaatctgcctcctcagttgcaatagcagtcactttttatttcgttacattagaaaagtagtcattacccactttagaataatattccctcccagagggattcaccatttctgtgttagcatgaatctgtttcgtatccactgtctgagcacccgtgcaaagacatttgtgagacattaggatcaggcatgtctacttcctgtatctaattattcctgcacttcacctctggaagtcattgaaattttaatcacattatgtcaaggcttaaataatattccactgttgtctatgctatgatctggttaagcagccctttaggatctggtgtttagattgttttctaataatttgggctttataaataacactacagaggtggactctctttattctaatgttttgtgcacctaggttcactcaggttaaagttctgaagtgtattttctgattcaatgtgtatccgtattcttgagacttaacatatgagaaaagttaaaccaatgtacactcaaaccacaaatccaaatgtatttatacactcagtaataccattctgaaacctccagggttgaaaaaaaaaaaaaaaaaaaaaaaaaaagagtaaaaataaaatattttatatgaaaatattttgaaaattaaaattccattaaaataaacattgtcatactatctatttttaaatgacacaagtagaagatgtcagcttctttgatgaaatattgtggtgttaatagcctttttaaagtcccaaatccttgctaacttacctctctacattcggcagacactcagacactcaacacaggttatttcctcagaaccatttactgaatacccatagagtatagagctttgttttaaatttgaggattaacacacacatacacaaagaattaatcaatgagcttctagtctagcctgaagagctactagagtggggaattgcataaagataagtcaaaatcattatcaggactaccctgtacaacagctttgtgagacctaaagtgtctgctggatgggagatgggacagagaatcaggaggtatctggtctttccattggatgaccatgaacctatctttgctgcttctaaaaatactcatattttctagtagccagagttctggatggaaagagagacatcattttgggcaaagacttattttaacagtctatatggtaggattaataagatcccaatgttaagtatcatctaccattgctctagaaatcaatagagctttgtggtgaattaaatacaaaaggaggggctgactatacaactgtttggaaccatagtaggacgcagagattttagggaagtgtgagggaaaataaggaggggggggggcgcaaatattgccactgttggaagaacaagacaaggaattttgccaagtatctaacgtgtggtggccagagaacccttcagctttgtcaaactacaaaatccttgctctttttaatgcttggagtgacaagggtctgagtgtagtttccagatgggtgcctggtgagaacgaaggccacctactggaagctgtgacacttcaatactcacccttcattctgttcatgtgtaagctctaccatggactcagaacagtggtgctgaagctggaaacccttcccttgaactgtgcagggtataaactgcccatgacctgcttctcttctcattttaatctgatggatacccaggttcccatgtgcttggcacatgagcctacagttttaaagaacaagtggggagtgtaatgccatcttttagaccataaagggcatgcagaggttttttcccaaacacccaggtatgtgtgagccctgccacttaaggacacctaagaaaagcatctcaggctattatagtttcaaataaattgaccattgatagaactaagagtatcatcaaagcgaccaatttttctcccaaatcacattggtttgataatattaaatcaatttctgtttctaaaactcagctgacagcctttggactacactggtgcctgccaggctatggactgaaatccttatgggtgattcccaagtagagtctttgtggaaaacaggaaaattgaactaacctttgagtattgacatcccaaactattatccctttcatagtttcagagagtagtcgttataaggcatggtgctgattagatgttatggaaacaggcagtcattttattcttataaagcaaagagtaacaatgatttgctggggattgcctggtcattgttatggtagaaaagtgtgtagatgtttacctaggcctgttctacttcattgacctgggaaaactactagtcaaatggaaagtggggccccgatttgcttgataaatagcagtgtaatggaggacctaagaaatacagagatacagagaagtattccttccataacttagagccacacttgagttttacgacattaagcatgctctgttttttttctaattgatagtttcttttgacatgtttttatttactctttgaatttttcatataatatattttgatcacattccctctcccatatcctcccaaccaatctatctatctatatatctatctatctatctacctatctacctatctacctatctatccatctatccatctatctctatctctatctctatctctatctctctcaaaataaaaaataaaaaaacaaaaatcaaatccagttttccttggccaacaactctttgacaggggacctgttttgttgcttttaccttacaccactacttaaagctcagctaagcagctcaactctctggaacacaaatgagatccagaaagcaaaccaaatagacattttgatgaagtacatgtaatgaaagccatttatctataagacaggtggaaaattcctttggtcctccctcacaacttattgtcatcatttaaatgacttcaactttctaaatttttattttcatgttagctttccaactttgcagatcaaaagcagcgatggaatgaaatggatctgtttaggcctactagaagagagttagtagcaaaaacagctattaactattaaattaaaatttttagggagcaaaaacaatgaaggatagaaaggtcgggagaagaaaaaaagacagctaacaagaaaatagctaggcactgaggatccttgtgtcctaggtatctgatttaagggtctttggtctgtatttactctcggtatagcatcctgtgaccatgccactcactataactgatatgttcacaaatgatatcagtgttctgattaagaagtcatagaagtaaataatatttacatttgtatccaattcattaaaatattttttatctgagaacatgctttacatagctagatacatagctaccctgtgatgtgttttcattgaaaaatacacattttttaaaaatcattttatttcatttgaagattgtacactcgaagttttgtttgctgctgaaattccacacattccttcaattttcaataattatatttcttatgtaatttggctattagccagatgccctggagccaaatctcattgtatgttttagtacatctgttggcgccaaatctcattgtatgttttagtacatttgttgctgagttcagtttaatgcacatgaaatggtattggaggaatgcacaagaccttagtcacttgaagtgcatcttaataggaagaaagaattccctgattcaagggtacatgttattgctcctctccttacccccgtggatctgagactgtgagaaggggtgaaaatattatgttctttatggttttctataagtgagtcagtccgagtttgtaacttagtggtagattgctcacttcaaaatcctgacgctctaggttcaaaccctggcactacaaagaagggagaaaatggtaaagcaaccagtcattcagcaagtgttactgcaccggtgaatgtgtgcaaagtgacaacgcgaatggtatagaagctgaacaaaatgactttgataatagtgttcacagtgacactgaatcagcacaccagacatcaaaggtttacttactcataggtactacttgattgaatactgtagttatcacccaaagtaagcagtaatagccagccatttccagattattcatagattagtcaggctaagtaaaaccaagcatttccgatactcagtctctagctacaaagcttactaactggattgttacttctcagccctataaagttcagtaggttctgagtggaattctagagcttcccttctgttccatgatctcttgggtccacaaactactacaggccaggagagagaaaggaatgtgcagacaaggatgtggaggggcagagtgtatttatggaaagagctttaaaggtcaagactagaccaaaaaaaaaaaaaaaaatgtagcctttctccccattctccaatgccacagctcaatcatctgaccccatgtaaccataaaaggaacagttagaagaactttagctgtagagagaaaggaagaatagacccaaactgtggcaggttctggatccttttccttctcttgtgagggactctcaatatcctcactgaagtggtaaagaaaagtacaacttagaaagaagagataattttgacatattcttggggtgaatttcttgttggacttactagttttctcagatgtaggtacagctcatcctcagtgctctaaagatattcccatcagacacctggctattttcccattgatgctcaaaggaggccatgggttactcaaggccacacagtcactgtgaaaagggaagaactggacctccctcacactcctcaggcttagagatgaacctggaccagattttctcaagtctttggtttcctttcagtgcattttggagtttttggattcaaaaactccaaaaatctcaaacaggcagccagggagtcagtaaaccgataattaatcttttttattttcgttttcaattttccatttacttccaagcttgtttcaagaaattaagaaacacacaaaaatagataagcttgttaccaacagtaatttgtgtgtgctcatgttttaaaaggaatctaaggttcttttctgtttaattaaaccgcatgcacacatacacatacagctctgtaaaacagaattttcttctaacaatctggcaaaacatatgtctcctcctactacagtggcctcttggtagtgacagcttgccatagaaacaaactacagtgagatttctgtgacttgaaacaacattcatttttttaaaaaaactctttttataagaggcagcaggctgactctggtgctgctgagattatctgggctcctctgggctctggagaactttttgccttcttgttttgccacccaattgaggatttattatcttatactaaatagctccataacttagaaaagaaaacctcagccacgtcctgtgactgtttctggatggatggatgcagccaaagtatcacccagtcaccaccacctttcaaatggatgagtctaaagtaactggattgcagtgtgttccctttccaacataatgactcagtatgccttataattatacatgcttccccatgactcggaataagaaaatatttggggacaataatccacttagcctgtcccaccaccacctgaccttcattcatcgaagtctcaaatgtggcatttctcagagaaagcagcctctctttctctttttctctgtttacctctaaatggagctctctaaattcagctccaatgtcagtcacagaattacatttttcaaatgtcccttcctgggccctacatccagagacatatgacattaggagatagtgtatacagaaaagtctctaaagacaaggcccagggaatgtctactactataaaagaagaactactattggcctcacacagtacccagcattagagccacctttgggaagttggtttgagcatagagacccttatcaaaacaagggaaaacagccttggagaagtcacagtctgtggtagcaaggtcaccttacctgttccctgctctcataccaggtacattttgtatgtctaagatggggctccttaaaggtaggatcagtggtcctctgtagatatataaagtagaaagcatgcgataaatatacaaattctggtgttcaactcctaagatcttcttcacccactagctatgtgatcttgggcagttcatagaacatgtctgagctgcagcacccttatctgtgagatgagaataataagggagatagggtcctagtggcctttaattaataaagatactgaggaagccatataaagcacaaagattacaagttcaaagcttgccttggacacagggtaagttggagatcaacatagtcaacttggcaggactatctcaaatatagttggaaagtggagtggagttatacctagtaataaagggctttcttagcatgtgaagccctaggttaaaaccttactaccagggggaggaggaagagaaaaagaagaaggggaaggtaggggaagaggtatagggagagagaggaggagcagaaaaaagaagaggaagagacagaaaaggaggaaggtagggttgggttcagactcaaccccactcttgtatattatgtatacataacctatacacatcttcctgtacactttaaatcattccaagattatttatgatgcctaatataagctaaatgatacattcagttatcatactaccctatttagagaatgacaaagagtcatatttggttacaatgcaaatgctttccaaatgcattcagtctggagttgatgaaactacagatgcagaagctgtggatgtggagcgcccaaccatcttccgaagctcaggggacacagtataggaatggaaactctcccacactgggagtgtgaatcgtggtttgaaagccactgcagcctgtggagctagctgtgaaacattctatccaaaacatgttgcctttgcactgttatttattgatggatgatctcatgagtaactggttcctctggacctcaggccaacatggattttctaacatctgtccaaactctgccctggacagggagaattaacatttacccaattcctattctttcctttaagccaaaaaaaaaaagctgattaaaaacaaagctctgcagtaaaaagaggcagcagggactctaagttgagtgagttagtgtaataggagatgggtgtgatgcctccacctttgggtaagcatctacatgttaaaatcaccctagtgcagaagtgaatacagcactgaactgtaatttgctacatctagctttgaagatagaactccctgggacactactctgatgttggaccaacctgtgccagctcccatttggaccgcactgtctctgctagttaactctacatcttacagaatgcagctgtctgcatacacagcacatggccgtacacagcacagcttcctctcaggaacctcttcagtttttgaaacaggaagagaatggggtatgcaaactcagaagtgaatgttttaaagtgtctccatagctattgctagtagctttcacacaaccatgatgatctagctaaaccactgagcagttatccaaatggcagccaacttaggatggtgcacagggaggacagatcttctggaaattttaattgaggataaattaccaccctgtggtgtaagcatctttgcgctagattcattttaataaaagaaatgcagatcccttattcctagctggagttattgctctgaaagccaacgtacaacaatcttaatcttcagcatggtgtgaaacagctaatcccttctgttcttctcttccccctgggaagattatgtcttttgttttcaaaattaaatgctagcattctgtattggaaagaaaagtcagactcctgagaatcaaggggcacatgtgaggttcttacccagttatttcaccctctggccatttagtactgggggcaattgaggtgatccagtgagcagaggagcccaaaggatgtacctagcagtgcataacacttaatagataaatttatttaatattagtttacaaattatggaggcttttttacatttgggagacagaaatgttagaaatggatttaggttagtggaagaatgtatggctggcagtacactcagtgcttatagtaaagaaccattgttggtgagctttatgtgtgcagggctttcttatgagggtcttgagtgctaccagagggagagtctggtttttaccctgataagttctctgttctctgccacattgccctacaacgttaaatgtacaggtagcaagcgctaagtggattcagtgagtttggtttggtttggtttggtttggtttggtttggtttggtttggtttggtttggtttggtttggtttggtttggtttttaaaaaagcacatgaattgaaaggaatagtgttagggagggttggtgataaattggtggggaggaaaagggggcatctttgatcaaaatgtattgtatatgtatatgaaattctcaaacagcttttaaagttgtccaaaaaccaaaaacaaccctaacagtagaattaatgtagaaattacagtatcacattcagcaaaatataaatgaaataaaacaaaaataaattatgtgaaactacatacaacaaccagaatgtatcatacaacaaggtagaatgacagaaactggatacgcacattcattaaatgcttatgatgcgattctattacaggaagttgggaagtactgttgggcatggggtagagatcaggaggaggcactggttggatttctgggctactctttgtgatcttttgcaacttaggtggaagcatagagctattcacttgatgataacttattgcaaaatacctaagatttattcttcttcaagtaagtcttaaattgtctttgtccatcaaagacaaggtttataagagctaaaaagatccttagacattctgccgagcttactgggaacaattctagggttaaggagactgagtcaaatagagagaccacagtgacaaaagaaaaaaaaaagcagcatggagaagaaaactggaagtatctcctagcaccaaaggatggaaacaaatcccacatcatgggagagttaagccttccttcagacttttataattgataatctcagtggtgggtgggccaaagcatgcagagaagtataagcagaaaggactacatcagaaaagctaacatcaggcagtgatctggtgagagttcagatctgtcctatttacctcttgaaggtaatactgtctcctattatttgggatgctttccacaatgtggatgggagggaatactgtaggccattggaccctgcctagttttccatctaggaaggagtcattctaggttcccaaaagaatgagccggactatagattgcaaactcagctgttgacctcaatggaagagggttggtttaatggaggacagcaataaagaggggcttctggaaggagtgggtctaagtaggaccactgttgatgcacaaggcatacctaggggaaaatggttagttttcttggcat

SEQ ID NO: 1188 - DNA, 1831 bp, Mus musculus
atgtcatctgcacttgcttacatgctgcttgtcctcagcatcagcctcctgaatggacagtcaccacctggaaaacctgaaatccacaaatgtcgttcccctgacaaggaaacattcacctgctggtggaatcctgggtcagatggaggactccccaccaattattcattgacatacagcaaagaaggagagaaaaacacctatgaatgtccagactacaaaaccagtggccccaattcctgtttctttagcaagcagtacacttccatatggaaaatatacatcatcacagtaaatgccacgaacgaaatgggaagcagtacctcggatccactttatgtggatgtgacttacattgttgaaccagagcctcctcggaacctgactttagaagtgaaacaactaaaagacaaaaaaacatatctgtgggtaaaatggttgccacctaccataactgatgtaaaaactggttggtttacaatggaatatgaaattcgattaaagtctgaagaagcagatgagtgggagatccacttcacaggtcatcaaacacaatttaaggtttttgacttatatccaggacaaaagtatcttgtccagactcgctgcaagccagaccatggatactggagtagatggggccaggagaaatctattgaaataccaaatgacttcaccttgaaagacacaactgtgtggatcattgtggccgttctctctgctgtcatctgtttgattatggtctgggcagtggctttgaagggttatagcatgatgacctgcatctttccaccagttccggggccaaaaataaaaggatttgatactcatctgctagagaagggcaagtctgaagaactgctgagtgccttggggtgccaagactttccccccacttctgactgtgaggacttgctggtggagttcttggaagtggatgacaatgaggacgagcggctaatgccatcccattccaaagagtatccgggtcaaggtgttaaacccacacacctagatcctgacagtgactctggtcatggaagctatgacagccattctcttttgtctgaaaagtgtgaggagccccaggcctacccccctgcgttccacatccctgagatcactgagaagccagagaatcctgaggcaaatattcctcccaccccaaatccccaaaataacacccccaattgtcatacagatacatccaaatctacaacatggcctttaccacctggccaacacacgcgcagatctccttaccacagcattgccgatgtgtgcaagctagctggaagtcctggagatacactggactctttcttggacaaagcagaggaaaatgttctaaagttgtctgaagatgctggagaggaagaagtggctgtgcaagaaggggccaaaagcttcccttctgacaaacaaaacacatcttggccaccactccaggagaaaggccccattgtctatgctaaacccccagattacgtggagattcacaaagtcaacaaagacggagtgctatcattactccccaagcagagagaaaaccaccagacagaaaaccctggggttcctgaaaccagtaaggagtatgccaaggtatctggggtcacggataacaacatcctggtgttagtgccagactcacgagcccagaacacagcgttgttcgaggaatcagccaagaaggttccaccatcgcttgaacagaaccaatctgagaaagatctggccagctttactgcaacctcaagcaactgcagactccaactgggcaggctggattacctggatcctacgtgcttcatgcactcctttcactgagagc

SEQ ID NO: 1189 - DNA, 1827 bp, Mus musculus
atgtcatctgcacttgcttacatgctgcttgtcctcagcatcagcctcctgaatggacagtcaccacctggaaaacctgaaatccacaaatgtcgttcccctgacaaggaaacattcacctgctggtggaatcctgggtcagatggaggactccccaccaattattcattgacatacagcaaagaaggagagaaaaacacctatgaatgtccagactacaaaaccagtggccccaattcctgtttctttagcaagcagtacacttccatatggaaaatatacatcatcacagtaaatgccacgaacgaaatgggaagcagtacctcggatccactttatgtggatgtgacttacattgttgaaccagagcctcctcggaacctgactttagaagtgaaacaactaaaagacaaaaaaacatatctgtgggtaaaatggttgccacctaccataactgatgtaaaaactggttggtttacaatggaatatgaaattcgattaaagtctgaagaagcagatgagtgggagatccacttcacaggtcatcaaacacaatttaaggtttttgacttatatccaggacaaaagtatcttgtccagactcgctgcaagccagaccatggatactggagtagatggggccaggagaaatctattgaaataccaaatgacttcaccttgaaagacacaactgtgtggatcattgtggccgttctctctgctgtcatctgtttgattatggtctgggcagtggctttgaagggttatagcatgatgacctgcatctttccaccagttccggggccaaaaataaaaggatttgatactcatctgctagagaagggcaagtctgaagaactgctgagtgccttggggtgccaagactttccccccacttctgactgtgaggacttgctggtggagttcttggaagtggatgacaatgaggacgagcggctaatgccatcccattccaaagagtatccgggtcaaggtgttaaacccacacacctagatcctgacagtgactctggtcatggaagctatgacagccattctcttttgtctgaaaagtgtgaggagccccaggcctacccccctgcgttccacatccctgagatcactgagaagccagagaatcctgaggcaaatattcctcccaccccaaatccccaaaataacacccccaattgtcatacagatacatccaaatctacaacatggcctttaccacctggccaacacacgcgcagatctccttaccacagcattgccgatgtgtgcaagctagctggaagtcctggagatacactggactctttcttggacaaagcagaggaaaatgttctaaagttgtctgaagatgctggagaggaagaagtggctgtgcaagaaggggccaaaagcttcccttctgacaaacaaaacacatcttggccaccactccaggagaaaggccccattgtctatgctaaacccccagattacgtggagattcacaaagtcaacaaagacggagtgctatcattactccccaagcagagagaaaaccaccagacagaaaaccctggggttcctgaaaccagtaaggagtatgccaaggtatctggggtcacggataacaacatcctggtgttagtgccagactcacgagcccagaacacagcgttgttcgaggaatcagccaagaaggttccaccatcgcttgaacagaaccaatctgagaaagatctggccagctttactgcaacctcaagcaactgcagactccaactgggcaggctggattacctggatcctacgtgcttcatgcactcctttcactga

SEQ ID NO: 1190 - DNA, 96599 bp, Homo sapiens
cttccccagggacacatattgaataggcctgcaatggggccttggaatttgcattttaatggccacctcatgttattctgatgcacagctatgtttgagaattatggctctaaagcaaagctctccaagaaagaagtacatacctaggtatacaagatgatccagtgagttgaagtatgaaaataatatagtagttatttggggtattttttctaagaaagaaactaatctttactggtatttagattgacaatagtgccttcactgagttctcaaattagctcaacacaagttctggaaactacacaagataatctccagaatcaaaaagagttcagcaaacacacgggggttgccatggtacctccactgcttgattgccatttatgtgctacaggttttcatcaatgcagtttattttataaaagcaagacctttagaatatgcaacttgacaaaatagggagtgagtatgaaaatgtctggtaccacacagaagtttcttgtttaattcatgacgaagtagtaaaaaagttgttggatttaaaaatgagttgtccatttccttttacaaaacgataattgttcccaaagtgtaaatctcaaatgcatgatgctgagtgaaagaatgctacatactgtacaattctacttacatggcagcctggaaaagggaaactataaggatagagaacagattaatggttgccaggggacagggtagggacagggtttggctacgcagaagcatgagcgtattttgaggggccgggctgcggggcggtggggtgtgcgggagtaatgaaaccattctacatctacattgtgatggttatgtgactttttgcatttgtcaaagctcctagagatatacactaatgagtatgaattttatagcaagttacaccctaaaaacattcacttaaaaaaaagtaagttttgctgaacaaaaagaaaatttctaccacctttcatgcagtatatttttcagccataataggtgtaaaactaaaaactgaaaataaactaaacttagaaccagatctgcatatcactgtgtctcaaagtgttaagccaacatcttttttttttaaaaaaagcatacttaatcacattattctcattaaaattttgataattaataatttcagaactaaatggtttataccattaaaaataaaattatttatttattattttaaataattttgacttttattttagattcgggagtacgtgtgcaggtttgttacatggatgtattgcatgacactgaggtttggggtatgaatgatcacgtcatccaatgagcgcagtaccgaataggtagttttcagtccttgccccgctccttcccttcccttctagaattcctcattgtctattgttcctatctttacgtccatgcatactcaaagtttagctcccacttataatagagaacatgaggtatttggttttctgttcctgcattaatttgcttaggataatggcctccagctgcatccatcttactgccaagtacatgatttggggtttttatggctgtgtagtattccatggtcaaatttttgtttcatcttatttcattcttttaaaatttctactttcattcatttataatacagtagtacatatatataatttatgactaaaaatacatatgtatttggaaaggcatgctaaaaatgattttactgctaagatgataaacagaaaactttggaggtcacttctctagaaaataactcttcaaaatttaatgtacgtaggaactacctagggatcttgttaaaatataaagtctgatgcagcaggaagtctctcaccagatcaaatgctggcaccttgatcttggacttcccagtctccaggactgtgagaaataaatttatgttctttataaattaaagaaaaaatacaaagtctgattcacaaagtagggatggggtctgagatcttgcatttctaataagattatgattaatctaataagttgaaatcatttgttttggtttaaactaattaccaagtcaattcattctaataccttccgggttcactcatagactaggcctagggttaaaatgataattagtatgatgccagtgcacctggccctaagactatactttgaatagcaggactcagaccacagtagcccgaagacatctatgcagctattatagagactaacaactgctgcatttgattcagcagactcagttttccctctttgggtttgggagacatgaattcttatcagtcaataggccagctctcttagcatcttcccatggagcaaatgattcccattcccatgctcataaaagctgattttacttaggtcactgcttatccaccagcgtgggtttccttagaaggaaggacacattgtctaataatagcagtgccttatatttacacatggtttataattaaccaaatgtcaactcatatcagcctcacaatgacctttggaggtagaacaaagcagatgtattataaacccatttgcaagtgctacatgacagaagcaagcacagtgctttctttcagagttggagtgatcaggcaaagctttaagaagaaagtaccatggagtctgaagatcaagaatgggtaaggtttttagatgaagggtgggaaataacattccaagaagagaggatggattcaaacacactgtagatatgtattgagctactactactctaaagcccaatgaaatcagcaggagtaaagatgttctaactttattctgtgggaagtagatgccattaaaaatttttaattcagggactaatgtaatcaagtttaccatgaaagcatttgagtttgatgtaggcaagactggtgaagatgagtccagccaggggggctattgaagaggaagaagtaaaaaatgatgaaggcacaaattgaggcaataacagtggaagggacaaaaatatttaaggacttcattccttttttttttttttattatactttaagttttagggtacatgtgcacattgtgcaggttagttacatatgtatacatgtgccatgctggtgcgctgcacccactaactcgtcatctagcattaagtatatctcccgatgctatccctcccccctccccccaccccacaacagtccccagagtgtgatattccccttcctgtgtccatgtgatctcattgttcagttcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatgtgccacattttcttaatccagaaggacttcattcctaattggatgtagagtgtaacagagagaacactgacagttgaagccataaaaaaaaaataataagcttttatatctcaaggcccataaacaagtgcatgccctttgacctagttgggcctcacctggtgttttagacaaaggaaattaattcccaaaggcaacttttttttctacacttcccataagtatgtttattacagcattatttataagagtaaaaatttgggaacaatctaaatgttcataatatagaatgattacataaattattgtgcaaaaagattataatgataagattacattaaaaaattgaaggatacttttaaaaagatataaatagatatatttcctggatgggaagaattaatgccctaacaatatcaatttttctcaaattaatatataaatgtaatgtaatgccaaaaaaagattttgaattgaacaaattgaccctaaaattttatgaaaaaataaatatagtggacttatcaagacaatttcaaaaggaaagtgacagtgtgctttgcactaacaggtattgtactgtttttacagttacagtaaacaaaagtctatatttttggcatataaataggcatctcaaagaaacagagtagtgtcccgaattcatataaatatatatcaaaatgtaacacatgatatgtgacactagaaatcagtggagaaattatgaatttttctataaggggtaaaattaaaaataaaattcaggagaaaattaactgtctaccttatgtaatagttaaagatctattaaaaaaaaaacaatttaacagagttaattgcaaagaagcaatacaaaaaacccaaaagctgtaacagaaaataattgacagatttgagtacatgaaaattaaaaacttttgtgcaatgaaacagtccataaacaatatcaaaggaagcctgacaggcacaaatgtttgctatacattgaacaaagtgttagtatgtttaataataaaagagatgccaaaaattaattttaaaaaatatggaggccaggcacggtggctcacgcctgtaatcccagcactttgggaggctgaggttggtggatcatgaggtcaggagattgagaccatcctggctaacacggtgaaaccccgtctctactaaaaatacaaaaaattagccgggtgtggtggcaggcgcctgtagtcccagctactcaggaggctgaggcaggagaatagcgtgaacctgggaggcagagcttgcagtgagccgagattgcaccactgcactccagcctgggcaacagtgcaagattccatctgagaaaaaaaatatatatatatacgggccaggtgtggtggctcacaactgtaatcccagcactttgggaggccgaggtgggcgaatcaggaggtcaggagttcaagaccagccaggccaacatgtgaaaccctgtctctattaaaaacagaaagaaatgctggtcgtggtggtgggcacctgtaatcccagctgctcaggaggctgaggcaggaaaattgcttgaacctggaaagtggagattgcagtgaaccgagatcatgccactgcactccagcccaggtgacagtgcaagactccatctcaaaagaaaaacaggcataagattgaacagccacaacataagagaaaaagtcaaaatataataagcacatgaactcaaccttgaaggcaatcagaacactgtgaattagaacaacaatgagctatcatattttgcttatcagactagcaagataagattgataaagtccagtgctagcaaaaatgtgagtaaacatccttggtaagagtggacactgaaacatttgtggataaaaattggaggtatatatgaaaatttaaaatgttcctaccctgtggctcagtaatctcatttctagggctttctccaacaacatatttggagagcaatttggtagctatcaaaattttaatgttcattctctttgagccaaccaagtcatttattttttattttatttatttatttatttatctatttatttttttgagacacagtctcaatctgttgcccatgctggagtgccatggcactatctcggctccctgcaacctctgcctcccaggttcaagcgatcctctggcctcagcctccctagcagctgggactacaggcgtgcaccaccactcctggctaatttttgtatttttagtagagagagggtttcaccatgttgggcaagctggtgtggaactcctgacctcaggtgatctgcctgccttggccttccaaagtgttgggattacaggcagacgcgagccaacctgcctgccaatcaggccattctaagtatctatcctaaagtccatgcaaagacaatcctagcagcacttcttaaaataaaaagctggaattactaaagacctaacaatggaagaatggtagaatatattacaaactatgtaaccattaaaaaaaaatggagtaaatctatacatagttacctggaatatgtgatttcattaagtttaaaaaagaaaagtcacagaaattattgcattttgaatttttaaaatatttgcatgtgcatacagagacatgactatatacacatgtaaaaaaggaggcaaccaccaatacgtcaatggtggttacctctgagacaggattagatgaaggaaggaggatgtgtgatttggaagtactatattttactgtatagataaagatgtagatttctttttaacagtgctaggatttggggtagttttttaatctttggatatttttagcagttttctattttttttctaaagaaagaaacatagttctcccacatatggacatgccattcttctgaggatgcttaagttgaccccaggaggagccctagctgctgttccccattagaggccccttttcagcaggaagtagccagaaagagtccttgcccaaaaccccctaacagcagttagtgtgatatcgccacagggaggaatgtggcatgagttatcaagaaattattttaggcagatagagagtaaaaggggtccttgggaagttttcattttttaaagtatctccagaaaagtttcttgtaaaaccccggcttttagagccaggcgggcaacctttgatatgcaaacctaggccattagaaactgggttcacccaaacatgccgattccagggaccttcttgcccttgccccacatgttcctggcaacatggccgcccccacatatccctatttgtgtagaacatcatggcgccccgcatttgcatattaaaaggctagagtgggagggccagctctttcatgggctacgtgaattacgtgcctagtcaaaccaatcccctgagccctaggcaaatcaaacaccgcctcctccagcctctgcttatatacctggctggtatccgcagcaagtggggacttactcttttggctttggagcgcccccctccctctgtctctgtacagggaagcttcttctttcttccttctccctttccttcttgacccttcttgcctattaacctctccactccttaaaaccaaaaaaaaaaaaaaaaaaaagaaatgtggttctcaaagaagacaaatgaagtagcaatgataaaactccttccctatttgagaaggaggagagagaaaaggagccacggcagaaaccaacagaggaatgccacagacagaggggaggctcccgccagaggatggcagaggcctggaagccaaggcgtgagaacttcaagaggaggaagtgaaccgaagcccagtgctgcagagaggcctggagggccctcccagagagcagccagtgagtggtagtgatgaaagccaggtgcaaagaattcaagggagccattttccaccctgcctgtgcatttttgtaaaaacagagaagtcagagccccattctaaacctcctgcattagaagctctgcaagtgacacccagacacagtacattttaaacactcaggtgattcttgttcacagccaaggttgagaaccagtgagttaaggcactgagagggaagtaagtaaggaaagctggtgtgcgtaagtcattctttcactaagtttggcaggtaaagaaatgagtgaattaaactgtaaagccatcaaaagggtcaaagaagatgtagaagttgtaggttgagataaagaagcctatggggcagaaaagattaaatatgcaagaaaggtagaggaaaggggaaggaaagaaaggaacttgatgtttctagactttgttagatggcacacattttacatatgccatcaccattattattcatttgactggatttttgaggcacatgctactgtgtccaatttacagtgagaaaccaagaatagcaaggacctaacccagtgccagtgctgggctcttcctctgcatcaggctgagaagcaaggtcttggaggaagtaaacggatatggagtccaggactcaggtagggagtcagcttgcaaaggacgaacacgtccgctaagacagagatgcagaaatgaactagaggaggacatcagtaaagaagctgtgaagctggagcacatcagtgcatagagagaaggagatagtcaaagaaccactgtggggcagaaaaggaaaatatagtggctcactgcggatttcatcatctcaggaaagctggggcaaggtaactcactgacaatgagtacccgtggctttgtgacagtgcctgtgtgctacacaacagagcagaaagccagccctgcccttcttaccagtgaggtatggattagccacgcaacgaccagtctgtaagccaggagtacagacgagccaagctgcctgcagctgagtgggaaccacaaggaggaaaagccaagtccctgccttctaagagctgacagtctggagttacccagagtgatcttctatttcactaactgttaaaatagtctgattagaacaactattgtagaattgagtgaccctttgctttgcaaaggtcatatagaaatattctgccactgaggatctcatgtcgcccagtggttctgaaaataaatagaagttgcgtaccttcatggacacccatgaatgaaagtaaatataccctaatcatcacaggaagcatgtgcggtctgcacgtgaaagatgcatctcccatcagctaacagaaccaggtggagtctatgttttaataaggacgtgttattgatcgggaagtattaggttattatgcctaggtagttgcttctgggattccagtccaaaaggatcaccaaagcatcatgggattttcaatggcttcctgtggcttggcaaatgctcactgctaactgtgatttcccagttatccagagtagcagtcaaatcaaaggggaaagcctcatgtttcaataacttaaaacaaaacaaaaaaaaaaacggccaggcgcagtggctcacgcctgtaatcccagcacttcaggaggccaaggtgggtggatcatgaggtcaggaaatcaagaccatcctggctaacagggtgaaacctcatctctactaaaaatacaaaaaactagccggacatggtggcacgcgcctgtagtcccacctactcgggaggctgaagcaggacaattgcttgaatccaggaggcagaggttccagtgagccgagatggggtcactgcaatccagcctgagcgacagagcgagactctgtctcaaaaaaacaaacaaaaacaaacaaaaaaaaaaactcagtaaccttggtttaaagtatttccttggtggccctctgggttgtgtaacaatcggatgcattaattattatggcatcaaatgacaccagcaacatacatagtcagaaataactatttgattcaggcaggtgctattatttgtttcagcactgttaaatgtggggtttttgtttttgcaagagaaaaggcggttgtgtgtggtttcaagaagaagaaaagtcagaacaacatgcagcccattagaaaagataaattctttatttgtggaaaacaacagaagtggggctatttaggcaccgccaatgtttattatattcatatggcagagaataaacacagcacactagaagtttgcgctttgggtattaaaaaaaaaaaaaagcaaaaccttcttaggtcactgactatcttcttttgctcctttctatctgactcctcaggcaaggtgcaattcaaatccctggagaacctctcaaatatagctgctgttcaatgttactcagaaataaggaaagaaatttgacacggagacactccacatcttggctgcctggaaaaatatcatctttgaggtcattcaactcactaagtcatttttattattgttttgtctgtctattttctggtacagtctcaatgaaagatatgtggccctaatcatgcaaaaccgatctggggggaatcagttgtttcttcaggtcttcgcaggattccagctcccccaactacctccgtcgccttctaaaactggcaggctctggacgttttgcatgctgaagaaaatcactgttttgcctccagcaaggaacataaatgttgcaacactgactcctcctctcatgaagaaagagtgaacaagtgcaccgagttgagcttcttctcacagagccaccgggctggggaccggggagcggaggctgaaatccccagacgccggttttctgggctgggctttctgccttactcactccttctccctctttctggattttaccgaccgttcgcgaaacagctttccacacaatggagcttcatgtcctcgtgcaggaagtactcatcgactgatgtggcagactttgctccctggcaaaagtgagtacccatggcgagctgaggccgcctccgacggcgcgcggcaggggctgcgcgggcggccgctctccgggatgcgggttcgaggcccgcgtgctgaaggggagagcggggccaccggcgcgggctcctggagagaacgccagccaggagccagagtcggcagccggcggggaagcccgggatccgcccgcctcccgcccggatgtcccttctcagaggggctaaaaaatactcttaaggtgctttgcctccaccactgcccccaaccccagcttttacaaactgcactcggctcgcattcgcctttgtcaaaggcatcttcacctgtatccttgagcatgagtttcggcgttgattgtgggattctcagaatgcaaattatttgcgtcaaaataaaaagaaaagaaaaaaagagcggggagggggaaggggcgcagacaggtgatgtgatgaaagccggactcgagactctcccatcagcagcagccgccgccgcagcagcctcgcgggcatccggcggggaaagtttagggttagcaatgctgacctgaaaggtgttgctcctcccaaaagtcagcgggggtaggggcagatgagcagcctccgggccagaagccggagctggacggaggcacctaggcagaggaattgcagcccgggaggaagctggaaggagagcccgctggagaagggaggagggaagggaagaggagttggttaaagtcaggcaaactcaggtaactggagggccggcccgagtgctacggcaggggaaggcaagggctggagttctggctctttgagtagaaaactatccttttagtgacctctacctgtatcctggggaagcaacccacactgccctgaaaacaagcaacgtaggggattctatgactggacttgaaaatggttgcaaaacattattattagtctggagggatcactttgtcttcatttgtcaagttgaccgggcaagatttcccacctgaaatcgtgcttcacttgaccagggaagtgctgctaatcccaatcctgaccatcagctgtgcaaacttgggcaagaaacttaccctctctgggcttcgattttttttctgcaaagtttagggaattaattaattatatatatatattatagaaatatatataatatatatataaatgtttaatgaggtggaagtgctgaatagtgcaagagaggagcagatgaaaatattaatttcagtggttcttaaaaattaggggtgataggtccttttgagaattagctgtgagtcctcttcctgggggaaaatgcatatggcatgtacataaaattttacatgcaatccctgagggtttgtggatactccctgaaagccatgcctgaatcccaggtgacaatcccttattcctcctcctgtatcaagaccacccagccaactccttgctgctggttgggctgactgtgggagtaatccacagccttcttgggggtctggagtcagccacgctgctgaaggagacagctcccctgtcatgggtgagctccccacatgctctctccagagctctaccagcctctgactccaggggacccctcctcacaaccctttttaatgactctcctaaggcgacagtccttacccctagaattttcagtcccaccaaccctggagagccatctaaagaggatcgctgtctgaatcagagtgctcttcaggtcacctagctggatggcagggaggccaaggctttgtttggaaatgaagcagtctttgctccctgaggcatagtatgagtaggcagccatattcttttgaacctctgtactttgcctttagaggactaaggactcacatctctggggaccctgggtgttccactagcagtgccagcaaggcacatcagaaaacacacagggctttggagctcaacagactgggcttcagatcttgactcccacactgagcaagcctctgagttttcctgagcttcacttttcctgtcagcacaatgaaaataatgctgcttttttttttttttttttgcatggttgttgggagaatggaaatactatgaatcatgcctagcccatagtcaatgataaactttttcttaatattaatgtggcaccataaataagtgttcaatagtctcatgcttttaagaacagcttactctctctctcctatggggcttacattagtagaagaatgagtaaaattagttctggtctagttatgcacaaaaaggagtggtggcctcagaatacagagtcagactggctgttcgaattgtgcagtgtcaaggagagcactatgtattgccggcaagtaaagtatgtccagaccggcgtggatacttgacctgtctctcagttctcttttgacccataatcttgagtacaaaacagctagtgctgtgcctgcagctaaaaacagccaggcatggaaagaagtgttgtggctgggtccatcttcagaaactgtagagagaaatatctccattgtcatctttcacagtttggcacagatgtagccaactcagcatgtactctctctccatggggtcctggtgcctccattgcaagtggtcagatgatgtagcaatgaaagaaggaaacatcggaaacttaaaaggaaattggatatccacagagtagccaaagatctatcagtatactttggtgaggtattcctgcatgcaaagatagcaatattcatgcctactatttactgagcctttaagatgtgctaagcactttcacacattgcctcaattaattctcatagcaagattgcagagtatgagttatcatttaaagctttaccagtaaagaaactgaaacatggaaatgtacatacaccccccaaccccacaccccacatccgcctagctcaggaaaggcagaaccaggatccaagcccaggtctgtctgactttggcacccactctttttccactacccagtgctcccaagctccccaatatcaggcacttgcatcagccaaccggattaagattcttctaaaaggcaggaatagccaaatctagtgggtgcttttaagtggtgtgaacatgtgcttggcttgtgatacatattaacgggtagcaacaacaagatcacctatgggaggataatattcctgacccttcccaagcccagccattagactcaagattggcaatatccaacattagcaggtgaggctggcgctctgtcactgacttccttggtaatccttttagttaaacagagctctggaatgttcattctctaccacctttagaatcagaacaccacttacctttacctccctgtgctgagcacgttttcattcatttattcgacaagcatttgctgagctctgttttgtgctgggcacttgatgacacagtggggaatgagacacacaggatcccagcccttgtggagcttctatgccagagagagtgacagaaaacagtcgggtgaacaaatacataaataaaatcatttcagatactgataaatgctatgaagaaaatagaggctgaaggctacagagggacagggcgtgggagcaactttcaacagggaagtcagagaagactgccatacaaaggatacccttgaacttaaacccgcattttcaaaaagggagccagccctgtgaaagtctagggaaagggctaccttagcagaactctcaagagaaagttcttaaattggagtaaatgaagcagtaaagcttaaagtctgaagatgggccctttagaagttgacttgtatatagggggaattattatttgaatgcctactatactattctaagctgtgctgtatactctgtttatcttcccaatgatctggtgagttagctatttttgtttttattttacagttgaagaaaccaagagtcatcaaggttaaggagctagtccaaggttatggagctagtccaaggttatgaagctggtatttgaatcccttagtctatttcactccaaagcccacaactacttgctaacacagcatgtgggctttgagataatgtcttttggagaaagtaaggaagccgatagaaggagaatatcaaaagtaaattaagtagctgaatgctgacaacgatttgtatttgatgtcccaaattccagttagtgcacctacaactgaactgtccaatacagtagccactagccacatgtgcctattgagcacttgaaatgtggctatttcatattgagatgtactgtaaatgtacaacgcaccccagatttttaagacctagtattcccccaaaaaagtaaactgtcttggccaggtgtggtggctcatgcctgtaatccaagcactttaggaggccaaggcgggtggattgcctgagctcaggaattcgagaccagcctggggaacacggtgaaaccccgtctctattaaaaatgcaaaaattaggcaggcatggtggtgggtgcctgcaatcccagctacttgggaggctgaggcaggaaagtctcttgaacccgggaggcggaggttgcagtgagccaagattgcgccattgcactccagcctgggtgaaagagtgagactccgtctcaaacaaaaacaaaaacaaaagtaaactgtctcaatttttatattgattgtgtgttgaaatgataatattttaggtatactagtttaaataaaatatattaaaattaatttaacctttttcctttaatgtggcttaatagaaatgtttaaattacatatgtgactcacatgatatttccgttgaacagcactgatctagactaataagttgacaaatacatgataggacctttttcccccttcttccaaacgtgacttcttcctctgttcttgtgtcaggctccttctcatctgcccccatattcagttatttggtgaagcacgagagaaaagaggtccctcttccttctcccccaccctcatgctgctggttagcaggtgatcatttgaagtccactataccatgtcactttgggatctgataaaatagactcagtgattatattcatcaccaagaccaatcctctcactcaggtaaatctcaagaggctttcaaacgtcctacaatgaaagggtcattttaaatctggatttaaagttttacctttaaatcacttcctagtacattgtctttgtagttttgggcactttgtaaaatcagacgaggagacaactagagcttcatgtttttgtgcaaagctcattaaataagtaatctcatgcagtaataaatgtttctccctgtcctcttgcttaaaacagcatgaacaaaaagtagtcccagttgccagaagggctactccaggggcatcacaaaagaccacctttggtttctttcttttgtccactagctaaagtggccctcaaatatgtcaatgaaataaagatatattttttttcctgcagtttcatttatttcaaaaaaaagagcagtcagattctggtattgctggagaaagcctctgaagagcaaagacctggattctgcttttgtgtactctactggtttgcatgttaccctctctctcccttttttcccccaactttctcccttacttcctgtagtaagtttggtgttgatgagataatgccacaaaaaatgctaatggtgaaatgtgctgtacaaattggccatggttatgattgataacctgaatacaaatggcatctctagacatgtgcctgcagggaggagttgcctttatgtagctggagcaaaacattatgtaagattctcttggaataacatttgttcatttccacttgaaatccaaatctgggggaaatggcagtaaagaagctgacaagaatgaatcttagtgtatctgtcactggtagactgagttctttctctagtctgtataggttccagagagagaacacccaattgaaaaaggacaagctggttttattcactggccagaaatggaaaatgagagacctcttgctctaaaaagtcaccttctccctagctgtgggaagctgcaggattgtgatgagttagatgtggggcggggagctatgtaaacacatgcagggagaaagtacagaggcacagacacagataaacatgtttctccatgcgtcctatggagagaaaatggcggcagttttcttctagggatggggagcccagcattgtaacgctatgttaatgacctaaacggaacaaggggtagccagttctggtttgcactggtttcctgcaggcctcttgtatttggcaaaggatcaccaagctcctgcgacatcccaggccatctggagttctttaagcaagagtatctatagataaagaaactagggaagataacaatttaagaaaataatgagctttcccagctatttctctagggctgccctggtaatatttctacatcaacagcaacacatatttttcagcattgtgtaagccaggaaatctatgctagactccacggggaaaatagaagaataaaacatggttcttgctctggaggagcatagttcctagttgggaaggtggacagaaacataaaagaccagtagcatgtaaagaacattttctaagtgttacataaatgatgcaaacaaagttttgcaattctggagggcagcatgcccataacctctaaggtatattaagaaagacaaagtagaaaatgggcattgagggctggaagcctaaagacacaaggagagaaggagagagccacctcacataagaaaaaatgcacagtggtgtggcagtggaaatgtacatgggttcgggggtgcgtgatgtggaaaagaacagttggcttaatccagtggctccagatctgagctttacatcagaatcacctgagaagcttttaaaaattacaaatgcctcagccccactccagagcttccatttaattagtttaagactggggactggtctcagtggtgtttctgattgattttgttttgtttttgtttctgtctcaatttcccagaatattctaatgtgaagtcagagttgagaatcactgagcaaaaaccaagatttttatatcatagtcatgggacataaaatgaaagaagtaatcttttaaaggagattaaatggacaaccaagagtgtgacctttaatttgtagaaactgtatatacatgcacatttgtatgtagtcttttaaattcacagataattcctcgtggtgattctgtctacttggatgatgtggctgaaagcctttgtaaccagctgcctactcttgtcctctgtgtactttgggggtgtcctatagtggatcctagctaagtggggcacaatgggcatctcacaggagcttgtttctaccaggctttttgtaatcattgccaagggctttattatcatgcctaatagtgcccacagtagctattttataagcatctgcaatcttccctcacctctccaactttacaaattgagaaatggagtttaattacttgccttgggccaggagactagctggtgatgaaggtgaaatgagaattctcagggaggtgaaattagaatttccagctactgaattccacataccttattaaactcccaaagtgagtctacccactctcctgttggtgttagaatgttatttcttacatgaatgaatcagtgtcacagatcagtaggtgaagatgactggtttccctaagctgccaacactgtgattatctgagtgtcaatgacccataggcagtcacagtggtcccgagagccccgtccctgatgcctgggagctctcagtctagtgaagtttggccttgcatatttatagtttatccactctaacatctgggaagtgaagactctggttgctattccactgctcctagccccacactttacggctgttctgatttcccttctctgaagctcttgttcactgaaaggatatcagctttttgctacacccctgaaaaaaagaggagaaagcccagcattttaaacagctgcttttttttttcttttggatggagtcttgctctgtctccaggctggagtgcagtggcgcgatctcggctcaccgcaacctctgcctcccgggttcaagctagtctcctgcctcagcctcccgagtagctgggactacaggcacgcgccaccaagcccggctaatttttgtatttttagtagagatggggtttcaccatgttggccaggatggtctcgatctcttgacctcctgatctgcccgccttggcctcccaaagtgctgggattacaggcatgagccattgcacccggccaacagctacattttaaagaatcctttatatgtgttgggagcttctgggttcactgcccacggtgagactaggggtggggacggaggttcttctgaaggacagtgcggggaaaaagccagagtcttggcaatacagcctctttagacaaaaagataggtcaatttgtaccattcccaaatggttgggttttcttttctctgtctcaaaatccattactgatttaaaacaatttccaaaagctttagcaatagcaaaaagcaagcctcttaaacagtgttgctccacactgattgcacgtgagaatcacctagggagctttagaaacaactatagactcactgaatcaatattctgggaaggggcctggacattcgtatttatttacagttctccaggtttataatgtgcatccagggctaagagctactactggtcagctatgatccaaatcttaattacttatttgtatttcttcttttgccttgttttagagtctcatggcccagaaaaccatcaaactatatttttgttgagtagcaatttcatcattctgttctttaaaaaacatgattttgagcataatttaagtttgctacttctatagagagacctcacactcagtagcctcatcactaaaattttctgtgtgcaatttagaaatcacattgccagaagcttgctaattaattatgagactgaaagataaaggttaagctttcctgccacctatatattagatttcccaattgctatgttaatctttagttaaccaagacttgctttcttgtctcagccattttaaagccaattaactctgttcctgttcacacccttattaaaaatataattacagcagtagtctccagggactgtcattgggtaggctttaccaaggtaaattagccaagaaataactaggctgtgtaacaccctctcagaccctggaaatcattttggttgcagaagctacttagtatcagagtaggctggggtactcataaatttggatttggaaaaagccaattccaagtcatcctaaatgtggaagaatctgtgattttgagaatgattctggaatcagttatccagggtccagccaagtctgatacaccgatcctcagaaggttgtattaataacaaaaagaaaccaggtttttgtattagatttgatggaagaggctgggggacagaaggtgatgtagcattttgttttctggggtgctgagattgtgggattaggagaaaataagaaaaaagattgcaggggagaacgatggacagaggcctcctgttagtcaactatcatgggcatcagaatttctttattcactcaactaatgtttatggaggttctgctttgttccaaggacccattataggagctggagatagaaggatgaagttcctactctagtgtagtttagattccagtaagaggaaacagatatccacactaaaaacaaacaataaataaaacccaataaattagtcagtactatgaaaaaaatgcaatgaactgaagggaatagagtttgctgaaggctgctttcaatagcttgtacaagttgcactgtctgaggaggtgcccttcaagctagcacatcaatactaaaaagaaaagcatgccgagagctggcagaaagaaggcttcaggcagaaagaacaacagcaaaagtcctaagactggaaaaggtctgagttgttcaggaaacagaaaggagaccattgtggctggacccgaggtaagaagcaatgagggaaaggtgggaaaagagcaaggagggcccgaggtcatgggatggagttaggctgttaagtgctttgagagcctaacatcctaactcattgggaggttttcagcagggtaggaacatggttggcattgcctttgagagctcttcccagcttctgtgtggagaatggcttgaagactgaaagcagagggtttgtaggaggctgatcggaagtacaagcaagaggggagggtggatcatgccaaggtgacagcaagcaaggtggaagaggtgttggattcaggatggaatttggaggtatggccagcatggctttcagatggaggggaccagcgaaagtgctggaaaacctagtcctgctcaagatgattgttcctgccctacccttgttttagaccccttgttttgaactaaaacagaataatatctagtgctatttaaaaacattaggaattttaaccttaacttgtttaagcagaacaaaacaaatccctgcctggggagaaacttctgtttgctgcttttgcctcttaaccataaaaatttcatcctgtctcgtaagactattctgatggcttttgttgtttttgattactgtgcttttcgtaagtgctggaaaggtcacattcgcattactagtttatctcttttctgagtgttttgacactttggctgtgtttaccaaggccttcctgctgtcagacatttacatggggctttctacagttgatcagtttctccatataagtgctaatataatcgcaagcatttagtgggcactgactgtatgcaaggccttgttttaagaatttcatgttttaactcatttagtccttccagccaccctttataataaaaagtgtgtactcttattatcattttatagatgaggaaactgaggcaaaaaaagaggttaagtcatatgcccaagatcatacagctggtaagtagtaaagccaggttttgaactgaatccatctgtacagctctgggttcctagtaactatgttgtgccacttttctatgtaattgaagctgccaccttcagaagtagacttgtttctcctgcaaaaaccccaaggtaccactaggagacactaaaactgggccgggcttccgggagttggactggtggggagatggcataatctagaggctgaatgatccaacccccctccaggaaggcctcacatctaaaccacctgccatctgccaaggtgggaggataaaccaccccccaccccgccgccaacagggcactggctggtgaaagttgccaataccagaggagtcttgatgaaatgccctctcttttcctcaaactctttctgcctactattcatagtatctgtgttgtacccacccacctgccacttatcaaagactgaagaaaccaaagttattcaacaagccatgaagcaaattctaattgctccccacggccatctgaggctggcctttggaaacttaaaaaaaaaaaattaaaaaaagagagtcatattaatttatttgttaccacattatttgctttaaaattctggtggcttctttccagtgttttattagtagaagcgaaataagcctaggaaacacaatatttcattctgtcttctctgcttttcactgcatatctaccttcaaaaatgtcttctctcaagttacttggtttctcaataactagcgtgaaagtaacagaccttccttccttcctaatgatagtaacaacaagggatttacagaattgaagtttatataaggaaatgcattaagattttaacttaagtaagtgaactattcagcaatggctataaagacagtaattgtgatgatttgtcttctatattatatgtttaaactagttatatattttaattatataagatgcaatttttttgctccagtttccatagggtaattttcaacagagattaacatgcgttcattggaagtgttgaatttacctaatcaaatcatcaatttgtttattcaactttaattttcaaaaaaatgttattttaaaatattatatgatatgtgtcaggtatttcttacggttgacttccaaatttaaaactgcaaagaaaacagaaatccatacatatagttgcagtaaactatactcaattttggaagattgcagtggcaacatcagtgaattaaagtttgaaagctatttcaaatctttgcatattctccaaataactcagaatcctacaaaaagctaaatatttaaaaaaatttatcttcaaaccaataatgtaagtttcttctttattgggatgattttggttaaatatttagcagaaagtaagggtgaatatatatttgatataggtatgtcctaagctaaaatcaagtcatttaaagatcagagcaattaatggcagttatgtgatcacaggaatcagtctatctcctccctcagggtttgattcaatgagttttatttttctcttagcaacttttcttattttacttttcaaaggacatcattgaaaccataatagtgttcatatctgtgacttttaaatttttatttatttttatgcatggtttaaaattcatttagttcatttaaaattcaaagatataaaagagcattcataaaaatgtccccctctcctgtcctccagcctttacaaaaatataccatatatattaatatgggctaaatacccttttaaagttatctcacacgcaagatgctatgactgtgtgaagccggagcctacagactattgctgatcccccagtagtagtagcagtgactctttagtggccctggagcttcctttctaaactcaagtgtatatttaatgtggctatttagggatgaacagcagtattttcagagaaaagtatagaagaacagatgaaatcacacaagatgcacacatctgggtattggtgggcatgtactttcagcagtgagtttacaaataatctagacagagttaagtatcaggtttaagagtcctaggatctaagcctgcacgggttcagtcttctgcaggaacttgggaatgttggggttcacttaggcccccagtgttggcatgtacacccactttcaggaggctggaggtataagttcctctctgcatttgtctcaggtcatcacaggcctcagaagtttctcaacagaaaaggattgcatgggttggatgtccagaaggatacgtggagttaaacatcagtcagtggagctagaggcttgctaagacttgggaagaggatgagggaaggcaaaacctgtcacctaaaggggaattctagaatgtacttactacactcatgacattaccctaccaccttcatttatcaccttgtgtcaaacatagacttcttggtcaagaccactatgctgtaagctacctgagggcaggactatgacttattctcctttgtttaccctgccccagtgcctaacagtgtctttggaattggaatgttcaataagtgggttaaacttttgaaactgaatatttcaaataatcacagataacagatggttaaaaaccaagtccttctcagcctaactagtgccaaaccaaatcattgtccatgtctcctaaagaaatgaaagttttctaattacctatataggtctggactcaaaactataaggcagcacactgtctttggtgttgacctatgtcccaggttgtccatggtcatcacacactaatgaccacttgtatgtatttcatctagaggatcacacagagtggtatgctaggcccaaggaataagtttacctgcttatttcacttctccactgtcatcctactgtgtttcaggaagaatttcttttacctctgcttactctactaagatgccccacataagcccccaactccttttcttgtccccctcccactttgttgtctattttcttctgtcagaccccttcctcctccaaactgaaccttcctgagaatataccaaagaactcaataaaccattcagcccactatagttcaataaatgagcacttccagaatttgcattttaatagtggttcaacctcaagtctctgttggtggaaatgtcactgtgatctaggtgagggaaacattttgagagcctgtgggaacctccaatagcaccttatagtagcttcttctggtgcctgtgtaatactacaatttccagaagccttgttgatatccagctaagtgaaaagaaagtcctcagttccagagttcttacttctatttcttttttttttcttttcccttttgtttttttttgagacagagtctttttctgtcacccaggctgcagtgcagtggcgcaatctcggctcactgcaacctctgcctcctgcgttcaagcgattctcttgcctcagcctcctgagtagctggaacagatgtgcgtcaccaagcccagctaatttttttttttttttttttttttttagtagagacaggatttcaccatgttgaccaagctggtctcgaactcctgcctatccacctgcctcagcctcccaaagtgctgcaattacaggcatgcgccaccgtgcccggcccttacttctatttctaaatagcaatggattccactcttccaaggacccagaacttgccctaggggtgagggtcttttgtacatcttgcaactgagaacttttgctagaatcagacagacaacatagatctcagctctaattttccaggagtgaagctgtggagcaagtgagttacctctctgtctcactttttcatctgtacaatgaggctactaaaacatacattccagggttgctgggagaaaaagacaagacaaggtatgtacaacacttggcaccaaggaagcacacaattcatgggagtaattactatcatcctcaccaagagttcatgatttactgggggacaccaacacatgtacagtcaacagggtaaaatgctaagggtgtggggcaagtgttgagtctgagctcagtagaaatttatgagcctcaaaggccctaaaacatccttgaccactcagttctatttcacacccttcttgtacttcaccaacaaaccagcaacatgcttctggttggcagcccttataaaagaatttaccttctatagtcaagtccaaagctcttaactgcttaccacatgacagccaataagacaagatattggggcaaggaagatgactttttttcagggagccagcaatcctagaagatggcagactgatgtactaaagaaccatcttaagttgatagattgttaggctccttttatgttaggggaagggggaataggtagggggttaaggtccacagttgactggtgaccacaggcatctgggcatcagcagggatctaggaggttgcaaaacttctttgttcatggtcaactattttccagattgaccttgtttctataaatttttaagatggcattgttatttgtgtgcatactttctaatctcctcaggggtctgtttcaaaagagagatggtcattagttctgaagttaaactataatctaaattctttccatcattagcttggcctatgtataggaatgagcaaaggcagttagcctgtgaggttagaagcaagatggagtcagctatgtgatatttctcccactgttacacatctctgaatacaagaggaatacatttcttctttttgctgtgtttgcttcaagcctgtaccactgagaaattgggtgatccagggaagttttacttctcttgaacctcaggctctatctttgtaacaatggagaaatcaatgcctgcattctaggcccttttgagggtggaggaagacaatggttgagaaacttctcatctatagttgatcctcaatgcgtttgccccttttcctgtggcactgctttgtatttggatggttcgagcagtgcgtcacacatggaggaaaggcaatggaatgatgacaaatagtttgttgatttggtgctttgtacattcacccacaaatggcacagtttcagggccactgtccttgccaaatactatctgaagagctaggttatgagcctttggaacccagatctgataagcatggaggaaaactcctcaagggagatgaagctaggagattagcagaatatactttctccatttgtcccacatttgatgccagcaggcaaaccagagccagctgggcagtgtacaattcccagaaataaggaaagggtagaagcacctgtttttcctctagcaaaaccaaggcaaatggaaaagctcagaaatatatcagcaccattagcaagaggcacaacggggaaggctggaaatgtgctgaggaaaatcacattgccggtcaacgcatagctacctgctggagaagagagtctgcagacacacctcagcctggacaaaggcctccaggaccgggagctgtgctctgcaggaactgggccccaggcactgaggactgaaaaccagcccaacaaagcatacctgtttccatttgtgagagatgaaatgatatgggttttgtgactcactaaaccacttggaaggccaaacaattacaaaagcaagatgcctggcttcttctagccacatggaggggccctcagacttgagtagctgtgtgccacttgtctggggtggctgcaccaaaaggaacagtgaggtttagatgcttgttattgttcattgttcagttttggttctgtctatttacttctaattcctcaaatattattgtgattagtggtatagaaaggaaacgttcatttgtgagcaaagtgtgtaataagaatttaataatgaaattcccagaaaaaaaaactcagatagctaaagaaacagcagtaacatgagctccaaatatcttgagttgtattgttaaggtgagaatccataatgtaaagggaataatgtaaagggaatgctttgaaatcaaaggcataatccaagtgtgataacctaaaaggttgtggatttcttttaaagtagaaattacatgtggctttgggaaatcatcagctgaagcataagctatgcttatggattctcgctgtgttgtcactaagaccgattatataaagacttggcaaatccatgtacaaatgtaaaacttcccacaatggtatttcatggggatctccttttacaaagtggtcgttgatcaggacatttttcactgatatattcctttggaagcaatgaattttagataggatatgattattgtacaatgtgataggtagctctgattattcaagcagctagggcattattcagtggcaaagcattaagctactctggaatctttcttctgtgtaagcaggcagctgctgttgagactttctctttgtgggtgaatttgcccaaccaatggcaagcattcattgggagtaggggaatgacgctgatcactgttaatgacagttgaaaatgaaatgctttaatgaatctcatacttggacttggctgctgagccagagccctgtacttgaagagcttaattatgatgcctcaaaatttagatcttgaccctgaactgctatgacttcctcccaccctcagttttgagagaaactttaaattcgctaggggattcaatgttttacatgcttggttatgcaaaatgggaacagtagtgtccaaacaatggaataggcttctatattattattttcatttaggcagtataactgacatgattaccaaagtcatgttatagtacatgtatacaaattaatttcataccgggggacttcactggggggaaaaaagggaagtccctatttgtgaaaactatgattttggtttctttctgagtaaagcactgctaatctctttggtgtacaggaaagtatggtattatgttctaaaaatcagaagccccagaccttaatttcaactaatctgatgacatcattttgtactcagagtttcatttcccaacaatttcatgtttcttagtaggtggggaacccagaattgaaaggcatcaaaaacagctaaatataaccaaaaacctgctaactcaccagctttctaaaattcaggaagtatctttaacttgattgctgaatctccaaagacatgatgatcagatgactggttaatgggtattttttcagactctacatgattatcagaaatggctgccctggccaattgtatacctacgaagaggtattatgtagaagaacttatattcatctacttaatgtggacctcaaatattaaggatgttcctaatgtgttctagaccggagtcagcaatacttttcataaagagccagatagtaaatatttctaggctttttgggccatatagcctctgtcacaattcctcaactctgctcttgtcacacaaaagcagccatagacaatgcataggtgaatgaatgtggctgtgtttcaataaaactagactctcttaatgccaagtatttgctggaataacacaaattaatttatcctcaaatctgtttaacctattaatatgtcagtcaatattacattaatattttatgaatctggtatcatattatacatgaatttatctgaacatttggttaattcatgaatatttactcaatattaatactacatcatgaatctgttatcaagtcatatacagatttcttaaaaaatttcccttatttagcatacttgtgaataacatcaataagcaagtatcttaagttaactatcaggttatatagcagatcctctcccccttttgtaactctttctgttacaagggattttacattattatggtattgggaagtaagtctatttatcctgtccctatctgtcttcgtattaaccatattctgttatagcttttatctttgcagacagaatagttcaaatcttcatgatttgtccttaaacaacccccacttcctcatcctcttgaacattttatgcctccatcactgtctcttcaggtcttgtgagtccttgaagtgcagtgactaggctggaacatggtgttccaggttggtcacatcacctcttcctaatgatgccccattgtaccttttgactatagcaaggaataaacaaagtcagaagtgtgaaagtgggggagaaattgagaaagtgcaggggatttaggggagagaaaaatggactacaggaaaagaaaacattgacttttgcaaagtgctctaaactggctacaaatgcattccgtaattctttaaaccttaattgtaaccgcagttaagctttccggtgtgttggaataagaacaaaactaaaatccttctttgtatagaaattatcctgcagtaacttagagccaatatctctagttaggatgagcgcagtggctcatgcctgtagtcccagcactttgggaggctgaggcaggtggattgcttgcacccaagtagtttgagaccagcctgggcaacatagcgaaatgctgtctctacaaaaaaattaaaaaattagacgagcatggtgtcacgcacctgttgtcctagctacttgggggcactgaggggagagaatcacttgaacctgtaaggtcaaggctgcagtgagtcataatcacgccactgcactccagcctggataacagagttagacctgtctcaaaaaaaaagaggaagagatctctggttagagtttgtctctgatggatactaaccatgcaagtagtttacacaaaccacattctttctgtagaatgagaaaatcttggatataatttagcataatgagctaaataactctagactgagcttcgctgcccagacaggactctacttgtgatctgggaagatctacccttgcactgaattctctcctcttctctcctgactctgtgagaaaagtttgcatgaatttactgagattagttatagaaggaactgtgtgtcattgaaagtcttgtacagaagttcacattaaaatatatcatagtcatctttgggaatgattctgcaaaattcataaaacaaagatctctgaaaccctaaggcacactgtgctggaggctaagggaataatagtgagctgagtggtttctgcctacacagagcttctaatatattgaggaaagagatctcaatcaaattcaattgcatttataagtatggtaaggacaacaaaggagagagacattattctgtaggagaataaccctgtcaaagtgatgactgatttaagatcaaaatgggaaggtaaaattttctcagtacctgcaaaggcactgaggtgggagggagcatgccaatgtagggaaatgaagaaacccagtgtgtatgagccaagctgaataaaacatgagaagaagctggagaatgagagagaccagtccccaagctctcaaggagcaagaggaagccttttcggcatttgaagtggagggatggcatgatctcgtgcgtagtttttaaaagaaccactcaggctactcttttgagaatattgtgggaggccagagtagatgcctatagacttatacagaggttaaggcagttgataagagtataaacaatgatggtagcttacctcacatgctttttagattataggctagaaggtggcccaagcccatataccatcatggcacagtgaatacgttttccttctggatcgtggaaatgaatattgtgccacacagcttgattgacactccccaatgacttttaatactgtgggatctctggcacatacttcagaagatgagaaaggagttttaattaacctctgtttaggaattccatagacataattttcattaacatctacttggtatttcatctccatgaattctttccagtgataaagctagttggtttatcctccaggactgctcagttctgaacagtgggtcttaagtactctttggatttctttgaaggcttttttttatttttgttgactacctctctactcattttgccccagaaaaaatgtagtcatttctttgataagtgaaatctaagaaaggcttatttcatttggtacattaaagagatggaagaaagtaactttacataagaatataaatgccagctgtccagcatattacagaatagatttctaaatttgctgaaaggttaggaaaatggattcttatataggcttaaaatttttataatttttttggcattctagaatgaaataaagaaaatcggtatcatcttgatctcatcacccagaagaaaaaaaaaacactgatacatggtgaaatattttcctctctcatttttaaaaagaatcaggaatagattgtatacatatttttcaaattctttctacttagtgttatatgatagtcaataatatatgtgtatgtaagtagcaataaatcattcctgaaaacttgttttttaagcttgtataacattccgtcatatggatgtactgattttgctaatttgttaagtttaaaataatattcattttcatttctttgactactaggtataattaattttttcatacactcactacccttcatacttcttttattgatttcctttttatgttaattattaagatttctatttgactctcaacattttcttaatttttttatcattaatagatgtaaaaaaattcttaatttttaaaaaataaacccttttcatcttaaagatagcaatctattttccataatacttgttataaatatttccccagtttgatgttggtcttttaattttgtttaaagtatttttgacaaataaataagtttttgtggcttgaagtttgttcatttttttcatttgtgattacagtttagttgttgattcaacacatccttattgagtgttttgtgttcagcactaagcgagacacaagaggtaagacagaaaaacaaggtgcaggtggttttgccacttagagattacaatttaatgaggggatagacaaacaaaaccaggtcattataaaatagtatactacaagctatgcaagaggaaatacaggtgggaagaagtacctgatctggacctgggggataagggaaggcttctggaaggaaacaaccttctagctgagaatgaaggaaaatggcaacatgaatttagagagaggaaacagtatgtgtgaaagtgttgttcagtgtcctaaatgttaaaggtcctctttccccagaacatggagtgtgtgtgtgtgtgtgtgtgtgtgtgcgcgcgcgtgggtgtgtgaaggagcagggcagggtggtggtcaagtgtgagcaggaggccactggggaggctgcggcagtccgagagaaagacaatgatgttgggcagaggatgtgttgaataactcatcccttttcactggacaagcaatgcttcagtgtatattaagttcttattcatagcataccgtctattccagaataatctaattagttttattgctatatcaattcttgggccaacaccacactggttttgagtttaatgaaacgtctaaactggtaatgcatgcatcctctcatcacttttcattttcaaaattgatttacctattcttgccaatgcgtcctcccaagtaaactctaaaataatttcaaaagtcacaaaagcatacgtgtgtgtatatgcatgtgtgtaaatacatgtatatatgtgtatgtgtgtttcttccaaccatttttcagtttttggagaataagatgtttttattcaagttgctgtcagtaaatattttatattacatgacttctctatacacacacacacacacacacacacacacacacaatctcccattggtaatttgattgggaatgtgttaaatcaggagaacagacattctttttaatattgagtcagcccatcaagaagcattgaatgttttcccacttactcaattcttttatacttctttttaagcctttatagtcttactcatataggtcctgcatatttattgacggggtattcttttttcttttataattttagcttttaattatgaatggatttttcttccattatctcctctctggtattactggactacaggataaatattaatgatgtatatttactttttatctgattatttaactgattataattaattataagtgttcatagttaattataaaagtttataatcatggtgtctttaaataatgataattgttctccttccaaaaattgcatctaatttttatttggtgtcttacagcattgatcgtaacttctaatactaaataacaatgataatagtgagcgtcctgtcttaatatcaatttcaagaagaacacctcttacataacatttttaaaagtgtgttatgtggaagctaataaaataaacttgggaaatgcgacaaatgaaaattctctctcccaggcattcttaattcatattaacatattaagatgagatctgcaacaaagagatgagttcaactgagtttaacccagtatttctaaaatgtatttgactatggaagtatttttccctcatttagaattttacatcagttatgacagtcaaaattatattaatttgatcttctttctttttttagaaaaataattttcatactttcttgtcttttctgtttgatctctcttttgccatatggactatgatttgggtttacttttaatttttttcaataattgagaagctcgtcacccttctttttatttctacaagtggttacacttaaagtttccaagacatttctatccatatcttatacttagcaaagtcaaagacatgaccatacagttttctaatcaacttcaaaatgaaatgttatctttgaataaccccatcaaaagaaatttaatccatttttacttccttccaacctttcctcagtattggtaagaataatttaacattttttattcatgttactgtcagtaaatattttatattatatgacttctcttttgtgaattatgtgatctgttcagcaacataatcctttacaatacattcctgagcagttctatggttatctgatttctgtgtccataactattgtctttttataccataaatttctcatttttttactttttaattttaatatcttaagattcgccaccttttatcccatttatccttttagggtgtataatgtaggtcatctacattttgagaagtgcctgattctgtttactatagtgtcagttttaccccttactgccttcagtggacaaattagtactattatttcatttctggctcctctacaaccccttttaatctaacccagcactcttttccttccttacttttatctcataatggctacctgtccgttttccacagtattttctatttcagttgaagatgataaacagttttctgacattgacattaagatgatgtttcagttttcttgttagacaattttgttcactgtctaagctacttatttttcatgattactcgtctaggaataaaaatcaatctacttagacccaatatttttgaacactgagcatatgtaatgtgttcttaaacctgttcaatatgtactgggctctaaatgtcctggcctacagctggagggcagaatgacatgtcctagttcaatatcagcctctaacaggaatgctactgatgtagttttctgcactgagataggatcttcttttcttccattgcctattctcctggaggcaaaatagagaacataaaaagtcatcatctttggtatgttcttctttaggggctttttctttctcccagcccaacccccatagtccttacttgctagatgtgtgttccaggattcagttcaccactgcccagtcttctaacatccaatttcattgttttctgagagttgagaattttcatacagatatagaagggatgctgtgcttgtttgaaatggttctatttggcagaggatagccgaacagtttttaggcaaagaatgaactgtctacttactttctttgaagaagccaacaatttggttttgttgccaacagcaaataatatattggctaataattgtggtttacagtgacatgggtaatgttagtcataacatgtcttccaagtttctggctatggactaactgtaggtcttggagtttggtattatctagaattttccttctccctcctcccccacctcttatcttttagcatagttgaagattggaacttcttcccagaaatctagcatcttcataagtcctttccggttttaagatttttatcttatattttatatatatattacatatatttcctgtgaatcttggctgaatttctcatttaataaagtccaagttagtatgaataaataacatgtttcccgattttacacacatacagaaattcaaacacataatgaactctctggcagcctttagcatttgtaagtgctctctcaccaggaaaatcctttaatagataaccaagtgtcctggggaagaagggtgtcaggaaacttattatatttgtgtcactttcttcaaagggtgattaagtatatgtctccaaagatgtgatgttatcatctttgagtatcacttgaattcaagtcaatatttattgagaccccatgttgtatcaggtgccttactagaaagtcgacatatagagatgcataagacatgatctttttcagtgggtaatttaaggtctttcttctactgctagcattgtcatgtgtaaggctggtgggttgagtctttggaatttgtgaagattcttccaggttgtttaaaaaatcttttgattctcacaaatgtattttttctatttcttagaattatgttctttatggctaccaggaaatcctttgaaactggaattagattgcattattccactggggtaataggattggtaaggtaggagtgtctttgaagaataatgctaaataacccagacactaaggctgaatcttcagcacagctcttaaggcatcctgtaagtaccctctgctgcttattagaaatcccaaagccctgctcccttaggaaagcggcccatccccatcctcatcataagatgcaaggcatagctaaacatctcaacttctcacttgagtattatatactctcaggccaggatactttccaactcaagagtaagataacattacattctgatcttcttgtgtgtgtttttatgttttttttttcattttatttattatttttttttttgagacagaaattttactcttgtcacccaggctggaatacaacggcgcaacattctgatcttcttttgagagaaaagtttcacacaattagcctttgaaatacacattcctttaagtaccatgaaaacattgtcccatacaacaatatttctaagaaacacacatgtccctcccacaatgattttttcttgttaccaccaataaaaattagagctgtgttgtttttgttgttgggtttgtttttgtttttgttttttggtgactactgtgaccctcaaaaaatcaatccgactttctcgatcttgatttgcaacaccaaggttaccaaacaaagagaatggttcaatgagggaaagctcaactacctgccctaaatatttagtatagcaatgctgagcttttggtaatggctcaaaattctcatgctttcccactaaatgaaaaggggagctttgctactagtaaaccatattcaagaaataattcttattaatactttgcttctttcctatgaattattgctttgtaatggatgtttgacaagttactagcaaagcagtcttcgatgagcacagagacccatcagatctgtattaacacctccaaccactggagtttcattaagtaggtttctctacccctctccttcaggccacagataggaagaatgacattgggtccaaagttctggcacaaagaatgatgtctgccttcctgtgatgatttcaaattcagggtaataattccaactatctttccctggccatgatagaaagctcaagaaatcttggttccttgtctcttttcttccatccagttggtctttctaattacacactcaacacaatgttctgctgagcaagacatctgctgtagccactatcacccttggcataaccagatatttaaaggtacctaaaggagtttagctatattttgccaagatcctaagttctatggcataagaatccatccacttctctattgcctatagaaaaggacagctcagtctttctgaaagaattgttctcaaacaagaaagcatttgaggtaacatgtcaacaaggtggactggtaattggtgttcctttcagagccagttggaggaaatggccagctcagacattctcttctccccagtgtcctatgggaacaagatttacccagacacagctgactatgagaagtcttcagggatttacaacctgtctaagaacaaggccaatgggggactcactttgcaacacgtccctatttgattgtcagaggacagatactctattaacaaaggaatttgcactggtattttcagggacacatcaagtaattgccacttgaacgtttttccaggctttcaaaggaatgtaagaatggcctaaggctaaattacattcatgtctttagtgagtcattatattactggcaataaagtatattattactttactttcagatgccctcacatatttttttaaagtagaaaggagacatattatggtcaccattcttaagagacttaactaaaagacactaatttaatcttttagttacttaaaaatagctgttgctcacccactatgtgccaggctctataccaggcaccaatatgaaaaggtgagtattctctggtctccctaagcacagtctagtggaggagacagacaaaatgcagccatggccagaagggggagcagttaatgaacaagtaggcagagagtagggaggggattctgagagacagtacggacggactgagggtaagttgtacatccctgatattttgggcaattgcaaatagtttgatgaccaaatcacaaggagaagaagtgacagcaagcatggctgaaaatgtaggttggtgtcaaattgtaaaaagccttgaatactgtgctgaacggtttgatccgtgaatcaggtagaggacttgactcaggtctcttgactcaaaggtcatgttttttctctgctagattgcacttatccttccaaatgctagtggacaccacactgaatttgatcaaagatctctcaatggaaatatgtaaatttcctgtaagaagcaattggtaggttctcttattatcatctccatctcacagataaggaaactgaagtataaagaacttgagtaacttgtccaaggtcacacagctagttaggtgatcccagacaatttggctccagagtcactagtcctaactacaacaatttagcctctctttatctagaggtctttatgcatttgtctgcattctacttacgttggtattggtgagtaaagattcccttccagaataggtttgataaattgccaagtctgaaactgaaaaattaatatccatgataacagaggttttggggtcaaggagtgaaaggaattcatcccatcctgtctctaaatacttttttctttaccaatttatgggaatttgagaccagatatctggaaccaagcagcctcaccctattaagggaaagaaaaagaacagaagaaaagaggagaggagaagagaagagaagagaactaaaagtatctgcaaaaatattaaaggatttgaccgagatctctgagatgctccaaagattgcaattgtgcttactatccaagttaatggctgtaaatctaagagaattatgatgtgcctggtaaatattggttgttttgttttaagtcttcatggagaaaatggaaaagacattggcatgtaggatgaagtcacagcaggacagacaggtcctgcaagtgtttctttagatgcattgatattcataacatccaaacaggccttaaggctgtcttcttactttacacttaccaaaggggtaaaatatcattttccttggacacacaaataataaacgtactctcacaacatcacttgaatgttgtggttttgcaaatatactatgttttaaaagctatagccctcaaatcccttactagacatcaatatttgttggaatttcaacatcaaagatttattgtgaagggggagggggaggagttactccaaaggctagaaccagtgcatataccataataacaactctgcatgcattattgcttctaatcttcataattttgagtactatctttattgtcaccatttaatgaagatgttaaggttctgggggcttaagtgacttgcccaaagttacacagcttggtagaaacagaatttaccacagaacttgtgtgttaagccaaataattttctagttccatacaactaaaaattggaaggaaaaagtagagccttatgaatagagtcctgagcaagaaggatgaacaatctgcagatgaagtactctgtaaaggaaagatctgggtttgaattctaaccctgcctccgttcatctgtgtgatcttcgcaaagtctgttaactctttaaactgttggatatttataaaatgggactggtgctatttggcctgatatcttacaggggaagattcagtcaggccaggcgtatgtagggtctctctgacctggaaagccctatataaagacatggtaccattcttagtgttaggactgaaactacatccctagtgtcctgacacctcataccaatacccagaaaccctaggctcttccttcaatcccatactccttcctcagctgccaggacagcttggttaagaaaagccttgttcttggggagtatatccatgaaagtatctctatttcgttgcagtttcacattaagtaaaattagagtgcccttcacgaagaatatataattgaaagccctcccactgactgctggacaaagcacttgtcagtcaacaaaccaggtagattgagtctgccctcagagtttttgtattctgagagtgactagcaactttctctcatcctagagcaacagggctttcagaggacaggttctggggcagcgtgtagccacgatagaattggtttgcttttgtgtccaaagtcatgattatcaggagagctgccatttatcaaccacctctttgatacttggtgtataggacaggcgtgttaactatattatttctaaaccacaagataagtctgtgaagtatttttatccctggtttacaaaggaagaaatgaggctctgcgagacatgccagaaagaacatgctctacacaaccaactggttacaatgtgcggctttgtccagcactacctcttctttcttggcaatcatcagagccactcaaggcttggaggactgtgctggcaaaaaagaaatcttgtattttctaaaactcacacccacactttggaggggacaagattgagatcaaccccatttcctactcttttctttatgacagtttatcagagcattttttccttatattcactcagtcctgagtttctatttagttgtgataatagatacatttttgaatttttaataccttcgggtgcaaatttggaatctatggaggataagggagtaacaaaatgttatggaaattgaaatatataaattattaattttccctctcctctacagatttacaatcactttatttggggatatcaagtaggttatgtggttactgtagtactcatttaataatcagattttatttagagaactataaaaggtacaacttaagggggaaatatattttagatgatgtttttttttcaatttccaatttttgaagaatgacgtgtttttaaaaacttttaaagaatttctcccacatttcactccctttaaggtaaattgatagctgtgaaaatggcaccttggaaacatttctgtcataatcataggagagagtgagaattattaatattctcagccatgtagcatcataaagtagatcacagctgtttctttcagaaaatgtcatttgattttcgatcagatgtatggtccatctcacaatctaaccgcttccacatctggaatatcttaactgaaaatgtccacagcattacacggcctggctcagggggagaaaagaactagggcctgcatcgaattctgtctctcactcagctgatctgcattcctcctatagcatttccttataattaagaagagctcatagatttgggaactgcatgagcctctgtaaccttctggtgagggtgagaagctcagaactgcatttctatgcatttttccctagtctttcctgcttcggaggagaagccctgcaagagcttcctgccaagggaccctgctttctcagcagccggatccggagagccagaaatccatcttcagctcctttgaacttggctgttgttaatcatgctgtggttgtcctttaagagcaaaggcttcacggagagcagatcagctggctgtagggagggtttcagcttctcattgtaggcagatcatctgctaacagcttactgagagaaagttgaggacatgtggctgaaacactgtcagagctgctgtgaacacagtccaagtgagcaattttatgacccaaaccaagcagacactaagtgctttctagtggtggaaaaggagcagagagaaaaagaacaaagaccaagtggtggaaacaaaaaaaatatatatttctttcagcagctaacatatttttctgtttagaagattggtatctcctacttaaccacaaactacaacacataagatcaaataagattaaatgtccggtttgctaaatagcagagcgaagaaactaaggtcaagatttcagactcttacatctgaggaaagagagaggcaaagagaagatactggaaatgccaatatccagtcaatgaaataaacagaggctactgtaggcatccccagaagcttgccttttgtccagtgccatgggaaccacagaaggcactcagctttgcagcttcactcagaattggggcaatgctccacagagtcaagggcatgttattataaagtgctccatttgtttactttggcaagtggaagatgactttgctaagcgatactctgctggggctcagggccagcactgctggagtaggaaaagggagacttcctggggcaaggcttctcaatcttcctgccagcagcattgcagtcggagcggcactgaggtgtcaacaaaaggatgatgaactgtgtcagcagtgttagcaaatggctgaagtagaacggagctgcccaggatgctgccctgtcgctggggaatctgagggaggctgaaagatattgtaaaagagattgaagggctggactggctggaggaatggtgccatcggcatccatgccacaatactccaggactgccctgcctttgtcaggacagccatcagaggcggttttccctctaaccaggatgggcatcactccttgggcttgccagtcttacctctcctcatgcaattgcatgtccaaggcatgccctcaggggatggtgctgatccagggtggcaaacccaagtggggagaaaatgctgaatctcatcctctcagagatctgctgcagtcagcgactatactgaggtgcatgatctgagcagcagtcgctggttggggaggcttctttgtggagtgggtctcagccacagcctgagggtcctctcttggggatgctaccagttaattgggtcatcttcagcctccacccaaacttaggcctgtaggtccatcaattactatatcagcctcaaggactgaacaggtgggaggaaggactagtgtgagtgatggaagcagctgagctgaggagtgctggcacctgtgcaaatccagcaagaatgacatctggctgagcttcagtcattcacctaagcaccaatcgggggtcactcccagatctgagcaatgagggaaacttcccagggggaaccccgcacttgggtagacctgggggagcagccagaaggaaaggggttgaacctgtagttgattaagattcagagaaagaaaaaacaaaaacagaaaacgatcatagtttcagacactcccaatgagcctgtgacctccccaaaatcctatagccaaacacacgggtggatctggcctcactttcccattctcccacttgtgacttttgattccacatcatagctaaggtcctcggcaaattggattaaactttggatttaaaaataaaatagaattaaaataaaataaaaaagttggggacaggagaaagtggtttccaagaacctacacctctctaccctgaaatgactgaatattgtgttcccctcaaaattcatatgttgaaatcctaacccccaatataatggagcctttgggaggcttcatgaatgagattagtgcgcttacaaaagggtcccagagagctctctcacctttttccaccatgtgaggttacaacaggaagtcagcagtgtgcagtccagaaaagagccctaaccagaacctgaccatgctggcaacctgatctcagacttccagcctccagaactgtgagaaattaagttatgtggtttataagccactccgtctaaagcactttattatagcagcctgaactgattaagacactcctgagaacgattccttcggggaaggtcttgattagccttcacctagcccagtttgcaaacacactggagtgtcctgcccatggcaatgttcatgtagcagcctgggagacagaggagggggattcctgcaggagcaatcttcccaaggaggcagttcctactagctaactttcttgtcctgcttgtgctcattgaaggtccaaacctgtcccctgccctatgtttgttttcctcctaatcccctggctgatggagtcaggctttggagaattcctttaagagtcttagttggccttatggatcccaaaacacacccttctctattgatgccagattctgagcaggctgacagtgcatgcatgagaacctttcataaaataggactattttttattccctttgctttttctttgtgttatttcccctcttcactccctgtccttttaccttaccatatacatttgtcacctccttgcctggaaagcctagtgtcacctccctgccttttcacagcctataggattgagtccaaacttgccagcttggcctttcatggagtgcaggtttagtacaggactgctaaacacagtttcagaatgaaccattctcctggcctttatcattgccaatatttctctttattttattttattttattttatttagggagagccgatatttcataagagttgatggactgctttgcctggaaacttgagaattcatatttttattcaaaatcgttttcatttttttgcttagagcctgttaaagactgaggccctctctctgtcccttctactcccagccaaacccaatagacacatgtgagcaagttgtcacctgacccgaagctccagcccctggaaccaactgaaacaaaatgtatccttgcattttccagcaaggaattgccttgcctacaaaaatactctgtactttaatatgcagatcaattattaacagtaggctgtacctttcaccaggttgtaaaaggatgactgcgtagagccacagcattctccttgtcagtgtaggaaatgcagaggaggatgttacctccggcacttgcctctaagacacctaataaagatgaggaaggctccagcctgaagcgtgggtgaggtgtccagctgcccaaaggcgacaggtgagatactcaggtccccttcctctttttgctgtcagttctgattctctcctttcaatctttctcatctgtgattgggaatggcaggggtggggtgtgtttggggcatcagtggtggtaaaaatggtcttatgggcagggccatgttgaataagagatgagcatggagacagcgtattaacttaaaaggccaacaccgaggctcatttgagaccgtaggaattccagggagacagtgttgttcaggcatgggatcgaagatcaggagggcggctcaataacacgctggcccggtcacatgacagaccagtccttggagtgaactgggagacaaggaggctgctttggcatggagctgagaacatctctagatcgcactggaaggcagagagaggccagacagggaactctgaagagctgccacagcctgtgccagggtgacatcagggtgagttgagatgatttttttaacaaacttcattttttgcagcagtcttaggcttacagaaaaattgaacagaaagtacagacagttcccacatacccgttttcccccacagagtttcttctattaataacatcttatgttcgtgtggtatgtttatcatgatgaaccgatgttgatatatcattattaactaacaagtccagagtttacattagggtttactttttgggtcgtatggttctatgagttttaacaaatgtataatgacctgtatctatcattacagtatcatacagaatagtttcacttccctaaaaatcaccctcccttccttcctgcaaatctctgacaactgctgatctttttactgtctctatacttgtgtcttttctgaaatgtcatgtagtcagaatcatgcagaatgtagtcttttctgactgcttctttcacttagcaatatgcttttaagcttcctccatgtttttccagggcttggtagcttctctccgttttagcactgagtgatactccattgtatggatgtactgtagtctgtttatccatttgggcagactttccagcaagatagaaggcagaagcaatggaaagggtggatgaagggaaaactgcaaggaacacaggacaagatagaagcaagagcaggaaggttttggagaagtggaaaaacaagctagagagataggcacagaggcctaacctggggtaaggcagggccttgtaaccaacgctcagtgagagaggcagcccctcactgacctgcaccaggcctttcctgattttatagacagagtgtcatgaggtcatgagggcaggaaccatgtcagcttcatcctgagagcccagcactttgtaggcatctaataaatatttattacaccaatgaaaccttcaaagtctcttctaaaaaagcaagttctcccagacaccagaagacaaatggcctagcagcccctgagccagtcatctcgggcagttgtgagctggttgcttatttgaaccctccatgccacggggcagcatcaagcttgcctgacacacacctcctgagccaggaattcaccactttgccaccatctctgcctggcttgggagatgctccgtggacagaaccagagccgtgctgcagggaagcagaaaaaccaaaggagatgcatgccaatctaacatgccagtttaaaaaaaggcattcttgcctcagagtaagaatccagctctccatgcactcgtctttcaacccaatcacaaggcatcagaattagcccatatgacctctatgggacaagaagagcaagcagggtgatttgggtgctaagaaatagctgtgagaggatgatgcggcagctgtgccctccagatgttcggagagaacatctgtgcaacaatagcagtagctcccatgcactgatgtgagaacccagcctaaggggtacagcaatctgggtggtagggggtagctctcagagggtctgacaattcacctaaagattgcaggaccaataggaacctgccagtcagaatttcctagctcagtggtgccctccaagcaagagagcttatcagccagacctgtgtcttggtgcaacatcactgcttaaaatcaagtcctcccaaggcatggtgtccattttactttctctggatgaaatgaagacagagaatgaacccagtaagatgatagagtgctttgctttggatctgttcatatcttacccgtgtttgtgctcacatgagttacacagtcagtacaagggtagagagctcttgagaatttcttacctaagggaaagaacttgggggctgctttgctcaaaggctatttttcagtgtggggcttatctagagacatatattttgctccttgtccccactgctgttgcataactacgggagttgagggtcactatacacagacacagatggtagagatgggggcagtggttgggcaaggaatagctgccttgccacttcgaagtctcctaaatggcatctctgaagaagaaggatatgtccacagggagaagggccccatggtgactctgttgctcctaatgtgccaggctcagactcttcaaaccacaagaagtggcccagcgagttccatgtaactgcaaatgcaagcaggaaaaaaccacactcagatctcagcacagcatcagtcttggggacagctggcctttcctaatgcagcagcatctggctgcttctgctgtacctggatgtcttcagggcagttcttccacacagaggaccccaaataaaagcagaattcctaccattaagctttccgtatccaaaactttctatgtgaaagatacagcatctgtgtctcacaagaatctgttttcttggggcatctgctatttggcagctaaccaaaacagaattcccatcttattttcttgttcatttgtgctacatggaagggactggtcctgaatattcagggcaacatccagcatttggtagtagtggagagaaagagaagagaaagctctggactgtgttcctctgtctgggaatgtgactctcacacctcccaaatcctcccattcacactttttctccctgactttccagaaccctttttaggcttagctccttttatcttaccctacacgctttctttctacccacactggtgggtacttttcagccatagacattggagcacatttaaatatgctggagtccttagagaattaagaggtgggggagagaggagggcacagagctgaggatggcactagctcattcacaaggagccctgaatttccagggacattaaagaacagatgctcatgacagagcatagagctctgccctaattgtttgtaatgttgaactatgtgtcattcgttcactcatatattctctcaacattggaattgagcaccaattatgtaacagagtaggtcttggcaatacaaagatgaatgaaacataccccttgtccccaagaagtatgtggacacgacaggcacatggaccaatgatggtcatgtcaagcgtgatgaagtccatggtcctgagggacacttggaccacggcctgcatgagagggcctggaacccaactgggcggatctagaaagaattcctctggacttgattcctgaacttgaaggtagagatggaaggagaagagttctgggtagcatgttcctggcagaagaagcccactgcaagagcaaaggcactgaggaagcctggtggtcactggaaaactgggattcaagtagctgaaatcgtaagggtgcagcctagggagaagtgagacccgtggtggggggcagagccaaatctctgtatccaaacctttctatatgaaagatacagtgtctgtgtctcacaagaatctgttttcttcgggtgtctgttatttgagtgctaaccagaacagaatttctaaagatggtctttgaggccaggtaacaaggctgaggctaagaagaactatggaaggtctgttggcaggagagatgtatgattagatctgcattagcagaaggaaagttctggctgaaatctgcagagcagtttggaggggacaagacagatgacatggagaacacttaggacgctgttataataaaataggctagaaatgatgttcctcagaagtccctttctccctgcacacctggccacctcagacttcctgttcaaggggaaggcaggctggggagagaggtttcttgaaaataacacatctgggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagattgcgccactgcactccagcctgggcgacagagcgagactccgtctcaaaaaaaaaaaaaaaaaaaaaaaaaaaaaaaaaaaaaaagaaaataacacatctgttaattggatcatttctgtgtggtcaatgtctgtaggggctttgttttggtcatcatagtataaaatccccattatgtaatatttcctcctgataaaagctcactgtgtgtctataccctaccagcttccttatagtatttgctcattaccaggttcaaggacctgtctgtgtggctcttccccagagcctctgttggaaagaagatttgtctttggttataagtagatacacagtggtcaagatgctctagcacagtgcagcagaataagatgggctcagtagggaaagatcattcacccctaaagtgtacacttattcttttctgattatgataggattatgttgaaattaaaaattgtttcaacgaaaaagcaactgattgcttaggccaaagcagaactttttttttttttcctgaggcaaagtctcagtctgtcacccatgctggagtgcagtggcacaatctcacaatctcggctcactgcaacctccatctccccagttctagcgattctcctgcctcagacttccgagtagctaggattacaggcacctgccactatgcccagctaatttttgtatttttagtagagacagggttttgccacgttggccaggctggtcttgaactcctgacctcaagcgatccactcgcatcagccttccgaagtgctgggattacaggtgtgagccaccatgcccagccagaattatttttagtactgtagttaagagggcacattctggagcaaactgcctgctaagtgttcgctgtggggcattggggaagaacttaatctctttgtgccttggtttccacatgtaaaatgggataattatattgtccccctgtactggtttgctggggctgccataacaaagtaccacaactgggtggcttaaacaacagaaatgtgttgtctcatagtgctggaagccgactcacctcagaagcatggactcccttacctccaagtccaaggcaatggggctctctccctcttgcctcttgaattcctgcatctcatttcactgggtaaacagggaggctcctgtgctccagcaggaaaaccctggactgggaagcaggatgtctactctgatcctgctgccccaaagctgtgcggctttagacaagtggtttgacctttctgggctcagtttccttgattttcactattatttgaagggcttggggtcatggaaatcatgaactcttcacactgagaggaatcttcataatccattttgtagataacgaacctaaggctgaagaggtcaggggcttgcacccagtcatagagctaaatgaggtgcaaagaacctagaactccggcgtcttgactcccacctgggacacattttatcagtaatagtgaactctcatctgttgatagtgttagaattctcacatttactccccataacaactttctttttttttttttaaacggagtttctctctgtcacccaggctggagtgcagtggcacgatctcagctcactacaacctctgcctcccgggttcaagctattcttcagcctcagcctccctagtagctgggaatacaggcatgcaccatggcgcctggttaatttttgtatttttagtaaggatggggttttgccatgttggccagactggtctcaaactcctgacctcaagtggtccacctgcctcaacctcccaaagtgctgggatcacaggtgtaagccaccatgcctgaccagcacccttctgaagtaggtgctttcagaaatctgaaagcatagtgtcggttagcagggttggatctcttctggtactgtgaggaagaatctgtgccatggctgtctgctagcttctggtggtgtgctggtcatccttagtgttacttggcttgcagaagcaccatcgatctctgctttcatcgtcgtgtggtgctgcccctgcatgcatgtatctgtgtccaaatttcccctttttataagagcaccaatcatattgaaatagggctcaccctcataatctcatctcaactaattatatctgcaataaccctacttccaaaaaacaccacgttctgaggtcctgggtgttgggatttcaacgtatgaatttggggtgggagggcacaattcaacccaaacattacctaataaagttttcaacagtaagtaaatgagttaactcctggaaagcatttaaaacagtgtctgacattcagaaagctctcagtaaacgttacattatgctgggtataaataaaaagctcccaggacagtggacggcattgagattccaccggtttgtattagtgtggcctcgccagtaatttacatcttctatcttttttggttggtcagggcttaagccataccaggtaaatattttgaataatactcctagctaaaaggtgcaaggagtagatactgtgggttctgatttttctttcccgttctccaagctgtgtacacagaaccatgcaagtcgccccaaccagggaaaaacaactgccatttcttttaaaggggaaccaatgaaggtcttgtcctgatgagctcacaaaagcaaacttctccatgtctgtcgctcactcagtgggctgaagcagagccttcacgctaagctttggagacaaagcttcttagagaatgtgcaacgtgggctgatcccaggctgcccaaggagcagctgacgagtgtaaaagtgtttgctcaccgattagaatcagtcctttaaaaaataaataaggtatgttgatcttttatgtgatgattaaacaaatcagatggcccaaaatgaattccaggtaaagaggaataaaatatcagaaggcaagctgctgaaattagcaagagctgaactcgaaaagcccgactttccaggcacggctagtttcttcctagcaagttcctgacggagctgggtggctgccccaggtgactgcagtagcaggagattaaggagacagcacctgcctgacaaaaaaggttgctgacacaataggccaaagttaaattgagctgccaagggaaaatgattggggatatgcagttaacagttgagggagataccagaagaatttgtgtccacagagagattttgatggggctgactttgccgctgaccgactcacctcagaagcatggactcccttacctccaagtccaaggcaatggggctctctccctcttgcctcttgaattcctgcatctcatttcactgggtaaacagggaggctcctgtgctccagcaggaaaaccctggactgggaagcaggatgtctactctgatcctgctgccccaaagctatgcggcttcagacaagtggtttgacctttctgggctcagtttccttgattttcactattatttgaagggcttggggtcatggaaatcatgaactcttcacactgagaggaatcttcataatccattttgtagataaggaacctaaggctgaagaggtcaggggcttgcacccagccatagagctaaatgaggggcaaagaacctagaactctggcgtcttgactcccacctgggacacattttatcagtaatagtgagctctcatctgttgatagtgttagaattctcacatttactccccataacaaccttcttcttcttttttttttttttaaacggagtttctctctgtcacccaggctggagtgcagtggcgtgatctcggctcaccgcaacctctgcctccagggttcaagctattcttcagcctcagcctccctagtagccgggaatacaggcatgcaccatggcgcctggttaatttttgtatttttagtaaagatggggtttcaccatgttggccagactggtctcaaactcctgacctcaagtggtccacgtgcctcaacctcccaaagtgctgggatcacaggtgtaagccaccatgcctgaccagcacccttctgaagtaggcactcttatacccattttactgatcaggagaccggcttgcccaggatcctgcagctactgaatagaggggccagaactttgctggtttggtgcgcttcctggtacacaccagctgcctccaatctccctttgataatcctagccacatgccaccgcgggtgctctagtgtaggctggcaccaaccccacccagcaagagccaggatctgcttcttgagggcaggcaggtttatcacacagcggggtgcagaagagtagtattcatcttcctagtgtaaccacttataactacttttcagtgaatcaaatagatttttaagcaagaacattgtaaaaatctgcttaatcaagggtggagcaaaatgagttagccagggccaccctagctcagatggggtggtagctgcctctgctccacaatgaggtatttacacttgctccccaccctctcctttgccccattatcttttagttaaagggccaggtgcaccagaacacaggtgccttgagtagcaccagcacctctcagggtcatagggaagagctgtttcctctgggtaaactgaggcctcaataaggcataaatgccttctctgggtgaagaagatatgccctctaagatctctccagggtgaatctagaataagttgtagtctagatggcttggcagcactagccagtgtgacagtaagtcttgatgaacatcagtcagcgtcatgctgagggacaacctcgaggagagggaatgtgtacttgttacaacagcacacccaatagaaatagcatgtaagctacaaatgtaactttatattttctagcaaaaaaaaaattttttaaagaaaccagtgcaattcattttaatagatcttatttgtttcaatatatcccaaatattgtcctttcaatgtgtgataatatagttattagtgagatattttccattccctttttcatacaaagtctttgatactcagtgtgtatttcactctgacagtgcacctcaatgtggtgcaataggcgagggtctatgtggtacatcccgtgcccagtgtgcacttaaaggctgtagatccatatatggcgactgtctcctagatagatgagcccagcaaggctcagtgggtgttttgaggtccatggtctctcaggtcccgttccaccccgacattcgacgaatcagagaacactaatatggttgggaacacttttatcttgctccccatagtctgaacagaaagagacgccacagaatacaatcacgactctctccctcctacggactccctccccacaagcaatcaatgggctggtctcagacaaagacacctagtcaaggctggtgaaacctgctctatttcctagtaggcctccacctgtaattctcagcagtttgtgtgtatagatagaattcctgccttctactaatgtgactgttcctgctcagagatctagagttaattattagcaaattcacagtgaaccagagctaggtcttgctgtaaggctcctgtgttttttagaagtacgttgccatggggatttttgtccccactgggttcctcctcaggaccccagacagatagatacacaaaccctgggcccataattttagttagaaaaggcccaagcctagaacctcagggaactcatttggaagctttttttttttaggaaacttacctttcctatttgacatctcaatcaaacaggtgtttggggagaataaaagcatactaccttagaagggactggggtcatctggccagacttgtggaataaagagaatttcattccttgtataaaataactctaaataatggtaagctcttaggagacttgatctactggctacatatacccactatgaaattaacacattctggaatttagatggaagaatatggaaattggtccttctcagtgtatggacgaagcatcagaaatgaagagaagggccaagcctagagagcaaaactaaagactcactggtctgtgggcttcctgcccaaggagagctgaaagctaaaggatgcttcacaatgtcctacaagttgtttttctaaagtccttccagcggttgaaactgtgtttatgcaaaacaaaactttcctttgttgctataatctagaggtggactttggcttaagtcatgccaaaatattatcattctaaaccagtaacacctatatttgttgagcatttactatatgtgtggcactatgctaaacttaactaccccttttcctcatgtgtaacagtcaggtgacttcacagctgccttgtggatacttgtgttatttgaaagattgcataaacacatgtaaaatgcttagaagtctaccacctcatcttacctacagctttggtgagtccctgctttggccaagtagaatcattccctgtgaggaggggaagaggataagaaacaggcagagttgaccttacaggtagacacaacaggcgagggtccatgtggtgcaatggatcccatgcacatgcctgattcagtcattctagttgagtaggattgtctggttggttgttattattttgttttttgtttgtttctttcttttgttttataagatggagtctcactctgtcgcctaggctggagtgcagtggctcaatctcggctcactgctgcaacctcttcctcccgggatcaagcaattctcctgcctcagcctaccgagtagctggggctacaggggcatgccaccacacctggctaatgttttgtattttagtagaaatggggtttcaccgtgttgcccaggctggtctcaaactcctgagctcaggcaatcctcccacctcagcctcccagagtgctaggattacagacgtgagccaccgtgcctggccagtttttatcttgaaagcttaagggtctcccacttaaattcaaatactcttctgaggataaccttttaatcagccaactatcatgaatctcaattatcaggaattccagttattccaattatcaggaattctttatatcatcccaggaatctaaaagagcaaggtcttataggtaagggcaaactttctgatgccttggaattcagaccctaagtagagatggtcatttgacatctagtctgatcgactgtagagttacttctatacaaataaattcaagttatcacagggtttctttcagttggggacaatactttgaaaacttttaggctctgaatgaataacttggcaaaagaaaatgttagggtccttcaaataccatacttgttgtggttttctcacagatacaccagtctataaccctgaggtttcaacactccactcagttgtgggctttttatctaaatcaaaactatcacatgcccacatgtgcatctgcagccaaccacaaatgatctaacaggaccagatttcactggagctctgtgacccttctcccagtgtgaactgaagggaaaaaaacctggagcctaagggactcccttttccgtgtcctgaagaccactggctttggttaagccaatatgatgggctcattgagagagagactcaggacctcggatcatgccacactctctggccccagaaggcataccacaggctgccagctttgttggagaacctgagacttaaggccaggatatatcaagagccctgtacccagttctgtgatgtcttaatacctttgacaagagacattggcaactcactgggtgtccattggggggcgacaaggaaacagactgatgaaaccagagaatgtgacaactaattacatgttgtttcctgtagaagagaaattctcagaggaacgtggtgactgtctgttctttaatggactgtcatatgaaagcaggagaaggagattcttccttactccaaatgacaaaactaggagcagtgaaatgagcttataaggtggccgggtttttctagcaattggagctctctgcagtgagtggacacttggcagggtagtgcctactccgcatttgatgtgttcacaccacggctagaagtaggtgtcgcaacttccagttgaagagggaattcttttccttgggtgggagaggggctagagaacgtctcaggttgttgctaactatgagcatggttttataattgtttaaaagtgggtaaacaagaagagtgtgtttatggtgtctgtattccacaaactattatttcccacattaactgtttcatatatggaaaatctgagaaacaggaatgctaacaaggttgcagtataatttaaaaatacttctgagagatcattgtatcccaaaggcagtgcccagtgaggttaagagcgtggtttgtggaatctgagcccacaggggtttaaatcctgcctctgcccttcttagattctgtgaacttggacagattccctcacttatttaagacttcacttttcagcccttgagatcccacctgctcaattatctaaatgaaatctatcactgtggaaagagcaaaggcctcctgctgttgagcaaaatgttttccagtcctttgtttctgtgtgaaataaagcagctccatcccagtgctaaatgatcaactgcatatgacagaatgagcttatttcatgctcccagtaaatacaagaccatagactactctggatggtagtttaagtttaagatgaaattgcttcttctgattgccttcttctttattgcttctttctctgttgttccttccttctcttgtttataacactaacagtcaaatctatctgtgtggaaatctatctactatatagaacgctacatcacaatttacagaggggaaaatatttttgtcggcagtaacatttcactggaagaggcactatttggccacctaactctgggatttaggctcaggtagaatcagtgcctcagtttctttaggtcagccattatgagttgttccttatttgacctagcacatatatagatggtggttaaatttagcaaaattctcttcacaaaggtttcatttgtctggaagactctaagtactgatctggtcagagtaccatcaaagccccttgtttgtcatgagaccgtggaccaacatgttagtctttctcatgtaaaaaaaaaaatcatcaacaaatgcagtgggagttggtagtcatgagtttgaggtagtacaatatccttaaagtacacactcaatcatgtgtgataattggccaactctacctaacaacagttgaagacctccaaacagctatcaggactactggaatcatgtctccagaagaacctggagaaacattcacatttgtgtggaccaaggaggaaagcaacccagacgacttctacttagaagcacaggcacatagagcctgtgttattggcacaggtatttctctcctaagagccttttctgcttaagaaggcttgaggatctattcccattaatcataaaaaagggatttgctgggctaaattattttagcctcctctttatgccttacttcacaaagaattgcagttaatctgtaaatgagttctgatgttatgaaaattggatatggcaaattgtgttattaagtctattaagggatgaagaaggactcttctaaaagaataacgtagtctgagtggcagctctcacttaatagacatctacctagaaatgtttctgaacttaatggacacatgatataattcaaaattaatataagcacacagcacctctccccataaccttattgaaattaagggttccaaatcattcttctctcccttttacttcacctgcaacatgtggctcacccttctttagactaagagctaaactctaatgcctagttaatgtaaaacaatgccaggattattaagcatgattctgataagttttaacccctaatgagattatccttggttaaataaattgaatggctagtggaattccaatgtaaagtcagcagaggttagctggttgctagatatttaactatacataccaggaagctatgaggacaaatttccatttgcacagagccttgagaattggccattttaggactaaatgtgctgctcattacttttactcaaggacatactaatgaccaatatatgtttaaatacctactatgtacaactgctttcaaaaacactttcaatcttgaattgagaaggtaggagatccatacctgtattaggccatcctcacagtgctataaagaaatatctgagactgggtaatttattaaaaaaagaggtggatgaagctggaaaccatcattctgagcaaactatcacaaggacagaacaccgcatgttctcactcataggtgcgaattgaacaatgagaacacttggacacagggtggggaacctcacacaccagggcctgtcatggggtggggagagtggggagggatagcattaggagatatacctaatgtaaatgacaagttaatgggtgcagcacaccaacatggcacatgtatacacgtgtaacaaacctgcacgttgtgcagatgtaccctagaatttaaagtataataaaaaaaaaagtggggaaaagaaaagaaaagaggtttaattggctcacggttctgcaggctatacaggaagcatgatactggcatctgttcagcttctgtggaggcctcgggaaacttacaatcatggcagaaggcaaaggggcaacaggtatgtcacatggccaaagcaggagtgagagagagaacaaggtgccacacacttttaaacaactacatctcatgagaagtcactcactatcacgaagagagcaccaagggaatggtgctaaaccaaggtccccaacccccaggccacggatcagtattggtccatggcctgttagaaaccaggccacacagcaggaggtgagtggcgggcaagcaagcaaagtttcatttgtatttacagctgctccccatcgctcattactgcctgagctcagcctcctgtcagatcagcagcagcattagattctcataggagtgcaaacgctattgtgaactgcacatgtgagggatctaggttgcacactccttatgagactataatgcgtggtgatcggtcattgtctcccgtcactcccaaatgggaccgcctagttgcaggaaagcaagctcaggactcccactgattttacattatggtgagttgtataattatttcattaaatattacaaggtaataataatagaaataaagtgcacaataaatgtaatgtgcttgaatcatcccaaaaccaccccctctctgccccgtcccagtccatggaaaaattgtcttccacaaaaccaatccctggtgccaaaaactttgggaactgttgtgctaaaccactcataagaaatccaaacccatgatccagtcacctcccaccaggccccacctccaacactggggattataatccaacatgaaatttgggtggggacacacatccaaactatatcaataccttcataaaagcaattaaataactgtacagtgtgataggcaataaatgtcaaatgtcatatgtatgaggaacatagagaggtgctgttatcaagtcactgtgtgacccactgagcactcgcaatgaggcacaggtagtaatgtacctgctcacttgcttattgttgtcccaccacgctgaattgggagcttcatgagagcagggcccatgtcgcatctattaccacaactgccttattcgcgtggcctgtagctagcaatcagtaaaaaattacagcatggatgaagctacagaaagaaagtaaatactgacaggtgggcaaaatttttagatatggatatttaatgatgggatgaacagatgaatcaagacaggaaacaaggcttcgcgtggcaaatatatcctttcatttgcccagcaaacatttgcagatccctcactatgtgctagacactgtgggcacatttctgtgtggattggtgtttttctctctcaaaactggagagattttgagatcagcctgtatgtagtgagatgaagaggtatgtggttgagatcaggagtagttgggattctgtgagggatagggctccttaggtgtagagagccttgagacctttgttgtgaggatagtgaaaatcaacaaaagaatttatgttaaggaaggttaaaaagtcactctaaaggtctcagaagtgcctatgacatcatgaggagatgtccattcctgaaaactttagccaggttacaaacactttaagaaatcctatctcaaaacttcaagaaaagtgagatctgtatttacacagatagaatttccaggactggattatatttgcacttttttgttaaatttttacttaactagtatattaatattgatagtactttgtgacttttttcataaatataacttttaaaaaatatggtatttctaaaaaggtttggtgcattgttaaaatgtggttttgatttattcacagacagaaatcttctctaacagactatacttccatttcataattcagtgaggtaatgggactcagttatactaaatttatcatagagcaaactttgctagttttcatctgttcattacattttatgtaatggcagacagtgtaataactaataccgttaacccaaccatctcttccctataatgtttctataggaacatacagtgtacattttgcagttctctacacgcagacaaattctaccagtgtgtattctgattacaagctagttgcttcataggccatatgtctatcttcagtccctatgaatcatgtaaattacagagcaaactgccgatactcagtatatgtatatgacacataagagtcaagtatactcagctcctaagagcaagtgagaagacaaagaagatctactgtgtgtagaaatacttcttaaatcatctttcctgaaggcctagtttgcaactgagtcgcaaaaatttggtttcaaaaagttaagcttgcaataataaaaagataacccagtttaacaatgggcaaagtgatctgaacagacatttctcaaaaaatgatatagaaatggccagtaagcacaagaaaagatactcatcatcattactaattagggaaatgcaaatcagaacgacaatgagtcacctcttcacagtcactaggatggctatgattaaaaaaaaaaaagacaggcaataaccagtgttggcaaggatgtggacaatttagaaccctcatacactattggtagacatgcgaaatgaaatagtcatttcagaaaacattctggcagttcctcaaaaggttgaacataaagttactaggtgaaccaacaattccactactagctatatatccgccaaactgaaaacagatactcaagcaaatacttgtacatgaatgtttatagcagccctattcacactgtccacatacttgaaaacaattcaaatatccatcaatggataaatagataaacaaaacgtggtaatttgtacaatcgaggattcagccatagaaaagagtgaagtactgatacatactagaacatagatgaacctcaaaaatgttatggtaagtaaaggaaaccagtcaaaaaagaccacatactttatgattccatgtgtatgatatgtccagaatagggaattccatacagacaaaaagtagatgagtgtttgccaggggctggggagaggtggggatggggaatgactggctgatggttagtttccttaggtggtgaaaaaaatgttttaaaattgattgtagtaatggatccacagccttgtgaatataccaaaaaccactgaactgtgtaggggtgggttgcccctccacacctgtgggtgtttctcgtaaggtggaacgagagacttaggaaagaaaaagacacagagacaaagtatagagaaagaaataaggggacccggggaaccagcgttcagcatatggaggatcccgccagcctctgagttcccttagtatttattgatcattcgtgggtgtttctcgaagagggggaggtgtcagggtcacaagacaattgtggggagagggtcagcagacaaacacgtgaacaaaggtctttgcatcatagacactgtaaaggattaagtgctgtgcttttagatatgcatacacataaacatctcaatgctttacaaagcagtattgctgcccgcaggtcccacctccagccctaaggcagtttttccctatctcagtagatggagcatacaatcgggttttataccaagacattccattgcccagggacaggcaggagacagatgccttcctcttgtctcaactgcaagaggcatgccttcctcttatactaatcctcctcagcacagaccctttacgggtgtcgggctgggggacggtcaggtctttcccttcccacgaggccgtatttcagactatcacatggggagaaaccttggacaatacctggctttcctaggcagaggtccctgcggccttccgcagtttttgtgtccctgggtacttgagattagggagtggtgatgactcttaaggagcgtgctgccttcaagcatctgtttaacaaagcacatcttgcaccgcccttaatccatttaactctgagtttgacacagcacatgtttcagagagcacggggttgggggtaaggttatagattaacagaatctcaaggcagaagaatttttcttagtacagaacaaaatggagtctcctatgtctacttctttctacacagacacagtaacaatctgatctctcttgcttttccccacagaactgtacactgtaaaagggtgagtttgtggtatgtaaatttatctgaatttttaaaataaaaaagaaagttaaaaaatgttaaacttggaattaatgatggtttttttgaagcagattagtaactactgaaattagtccttgatttttggaaaagcctttaaaaaatggtaagtgggagaagttataaacaaagagatgaatgagtcacagaaaattgggagacaaatagatgataacaagggacagtacagaaagactcaactgagttttatcaaatcactcaggcagataaacatgggggctgcatgtgcatccgtatgtgtgtatatgtttatttacatctaatatacacacatgatattacatgaaatattataacatataataaatatatattcatactggaaaaattctcaaagaatataccaccaaatgttaacaatagctgtccctgtttagtgggatttcaggtgacttagatcctttccccctttggcctctcagtatcttataactttgtgtgctaagatcattgatagttgaacaataagaagaagaaagtgagtgtggaaggatgttgctagagaaagtgtattcttgattatatggaggaagtgggggcagtttgtgaagtcttccttacgaatagcatcctatttgagaagaccagtcttcacactggaaaaaatgcatagagcaaggtgggcatcacttgcagaacagtttggcacaggactacctctgaaatattaaggcttaggagacttgttcttagaaactcttcaggcaaagtttacaaaaggccttttcctccttgcttagcagattctcccaaggcatccacatctacactctccgtaagtcactatatactggacctagcacacatctgtctacccatcattgtattagtctgtcctcacgctgcttataaagacatacctgagactgggcaatttacaaaagaaacaggtgtaatggacttacagttccatatggctggggaagcctcacaatcgtggtggaagacaaggaggagcaagttgtgtcttacatgaatggcagcaggcaaagagagagagcttgtgcagggaaactcctgctttcaaaactatcagatcttgtgagaattattcactattatgagaacagcatgggaaatacccgcccccattatttaattatttcccaccaggtccctcccacaacacgtgcgcattatgggggctacaagatgagatttgggtggggacacagagccaaaccatatcaactatctatctatctatccatccatctgtccatccatttatctttaattgggatacgtctacaagacaactgatacctaaaagtatgggaatttcatttgctaagtcacaaaataacttttaaaccatccttatattatacctaacatgatctgagcacataatattgtctaagtcagacccattcttgcctctctgagcttacactcttgtcaagtgtgagccagaaggagttggtccaagtagagcaagtctcacaggctttgtggtactcagggtgggggtcttacccaacatttcctcccagaagctgaaaggcagagacaagaaattcatcctgaaagagttcacaagggtaaagtcaaggtggctggtccccagacaggtcataggaataaggttctggtcatacaacaggaggcaaggagcccaagtagagggacttgggtgtggggcaagtgggagggtttcattgaaaaactaggtagaagacagggagtaatggtggataaggcaaaggacagcatctaattcaggcctgtcatcaagctagagaatgttcacagcagtgttgtttgaaagagaaaggcatggaaaacactttgttgtctatcagcaggtgtgaataatttaattgtggtgttttcaaatagtgagatttccagcagaggaaattaataaaccagagctgcatgtgtcgatgtagaaaaaaacccaaagtgtccagacatggtggctcacgcctgtaatcctagcactttgggaggccgaggcgggtggattgcctgagctcaggagttcgagaccagcctgggcaacatggtgaaactccgtctccactaaaatacaaaaaattagccgggcgtggcggcctacgcctgtagtcccagctacttgggaggctgaggcaggagaattgctagaacctgggaggcagaggttgcagtgagccgagatcgcgccactgcattctagcttgggtgacagagtgagactccgtctcttagcaaaaaaaaaaaaaaaccgaacacccagtgttctcactcataggtgggaattgaacaatgagaacacttggacacaggaaggggaacatcacacaccggggcctgttgtggggtggggggaaggaggagggatagcattaggagatatacctaatgtaaatgatgagttaatggatgcagcacaccaacatggcacattcatacatatgtaataaacatgcacgttgtgcacacgtaccctagaacttaaagtataataaaaaaagtaaaaagaaaagaaaagaaacaacaacaaaaaaaaactaccctttaaaggaatgcatataaacaataatttatttctttcacattcatttcacagtttgcttactgaagcatcagtgtgtctttcaattggatgtgatgtgttttgaagacataagaggcaggaaagttttggttgccaaaaataaagagaaacagggaagaatttagcttctgaactggatggtcactcttgccagaggccttggaggagggcaaggttttgcattttgtttgccaattttttccttaaataaagtgccctggacttcaggtcagtcttgccccttgagctgctaaatgattctgccagattctttcagctgagctgtgcggggtcctgaagacctgctttgacttcctctgcaccaaactgactcactccccagggaacaagatcaaggctgaggaagagaaaaagcagggcatgaatggaccctatacccaaaatagtaattccattttctccacctgccattctaccatcacagtgaagcttttctaaattgtaagaggctcttgtaaaaatgaagccactcctgggagatgttgaattttatcagccaacatgtatgtgggtgtccatggaaaacaagaccttggcaaattataccacaaatgggctggggcaagtgggaggagagtgataggagaacgtttgaatcaggacaaaacgagtgaacaatgtggaggcaaagggtgggaacaagatgtgctttgccaaccagacaagtttttcaaggctaatttttctagagaccatcttaagaacaattgcaacactagacaaaaagcacacaaaccaaaaaaagaaaaaaatctaaacccaacagcctaagtatcagaaaccatcttcttatccatatggttaaaaagtcaaaatgaatttattacattttcacagaaccatttcctgggccggaactcatttctccttaaataaatactataaaattttcctcagaacaaatcaagtcccctctataaccccagaagacaaagtacatcggcagtaaaaacagacacaaagtctccactgttgtcagaggtagcatggcctggtgggaggacagggagctcatgctgccgcatcagtcgggaggagggatttgtcttctccacagggcaggatccctacaggaaacaggacaaactgagaagggcttgacaatggaactctttacaaaggtgtcagcagagtattcaaaaccacaggagaattgagtgtcagggctagcaactgtacggttccagagccaacccatgtcggaagggtcagagggtgggacagtcaccacaaccccagaagggagagttctgtagaaagggccatctggagggaagcagtgaccttcagtcagcccaaggtgacagccaggcagcaaggagatgagtaccctcagcctcactccttcccttcctccaacctcctaccaagcctccctgtgggtcaagctcatcctgggagtcagaaggcaagagagcccctagatgcagtccacatagttcagagcaggttgcaggtcaggaagggtgaagacaggagaggcaaagggaagacattgggcaggtcttccagctcacggccctgtcatgcctgcagtcactgtagtacagactgaatgttcactgtgtcctgctttcagcatttaagatgcctctgagataaagagcctgccttgagtctcacgggacatgctcacattttctgaaaccatgtagcttgcactgttaacctcttcctcggtttagaggttttaggggctcgtttcacaaagctgccccagcccctcatgttaaacaacctgagggctgtgactgggcaaaaaataaataaatacatttgcattcaacattgacaaaatacacacttaagtgagacttttttgcatcacaaaaaaataagtttttacttttttcaaaaagtaaaggttctttaaaagatatcatctagagtagaattaagggctattattagaaaatcacagtggtccctaggcaagacattttgagggatgaacttaagcaggccccagactcacgtcttccatgtcctacaacccaggcataccccatcatcccataccttcaatttatccaaatacttcctgtttcagttggcaaattccactgccccaagcttccaaatgtcttccactgctggcttagccttcttcctaaatcccctccccatagtgtcctggaccccattaaaatgccagcaatgaaagcatctcctttcccctgtctagcacagccaggtacatctgttctgagtggtcagtgcccaaaacagcccagttgctaaacagtttgaccatcacctatgctcacacaggagttactgagatgatggtcctcaactgcaaataaaaaaacacaggccactctgtaggagccattagctcacaacttgctgggcaggctcaagttttaggactcagcatgctgaataacacctctatccaatggtaaatttctctggaaatgaatccaaaaacctctcagatgacagatcctgggactttcaagttgttacatagcagcaagggttgctgtcatgatttgtttactctttgattccctgctgtggctcatttgagatcttggagtgtttgctgcagtaattatggcaggatttttccagagtggttttagcatcagtgaaagaattagtgttcattactccttaattctatcactcaacaaattataggggtaaaattagatcctattaaaaaaaaaaaaaaacagggaaaaacagcaaacagaaacaagccggaaaagaggaaactaaattcaccctctaatactgataagcaattcttccctaccactaaattttaaaccttcatcagagacagtactttgtccgtttgttcaatactttattcttagtgcctattacagtgcctggtacatagttggccctcaatatatgtttatttaatgaactgattaaataaactagactcaggctctgacccttgtgctaaatctgtgctcacaatagatgttttagggcatattaaattttgaagtcagttcatctctatggaatttataggcaaaggggctttctttttttagaggtaggttcttgttctgtcacccagactagagtgcattttgcattttgagtgcagtggtgtctgccagtcagactagagtgcagtggtgtgatcatagctgactgcagcctcaaacttctcggctcaaacaatcctcccacctcagcttcctcactagcagactacaggcacatgccattgcacctggctaattttttaattttatttttttatttttgtagagacagaggtttgccacattgcccaggctggtctaaaactcctgggctcaagctatcctcctgcctttatttctattttgaagcaaacaaaatgatgcaaatgaataaagagtcctaggaagaagtgtcctctgctcttgactgtccactaactccagacttcatagtggccccctttgcttaaggcatatgataaacttctaatgatgcttgaattatatttccaccagcaggatcagttattttcctcagactcaaattttgcaatcaaaatgcacagtgtacacacggctgcttatattgcagcacatagcatctattttaccatttcaatttgtgtgatttcttacatgatggattgtgggatgacaataatgtgttctcagtgaagcctcttgactaaaccaaaatttgcatttttataaacctccatgaaacagctttacttagtaagattctataatgctatactaaagaaaattacgtggtagcttctaaaagaaatactccctccatcacagagaccgagcctcatatgaaaacagtaagcagcacacaggaaactcatgctgtagatgaatttggagagccacctcaggttatttgcattatagaatgctaaacgcagactatgcaagaaaccagccacctagagagatctatatagaagtagagaaacttccataccaccagcaattttggctttccaataaatattgagtgatgtccaaaagtcgtataattcaaaaagtctagggtaaggaacaagataaaagctaacccttgtgggtgttggtaaatcaataattaattggagatcttccatgatatttcctcataagaatcattgctaaaattgttgtaatgactacacagactcccaagattgcaatagtcaaacaacacaaactgttgaagtcatgaagggatatgcaacatggctccttggttaaccttttggtagggatccagtttccaccatcatgaagtcctgttttcaatattaatttacatcattagaatgcctgctgttccatcagcattttcttgagatttcctgggccattctcagaaaccagagttagaatgcagaaattaatcatatttcattttgacctaactattatacccagatatttataagcctgaagtatatttttgccttactgataaaccaataagaaagaacttgaatatctcataaaataaggtctttccgcaagccacacatatctagatatggataatagagctaaataatcaggtgtcgagtccaatacactgtcaatctatgtttgacaagcatccagttccttgccttgagtcattcagttcttcgttgttcttgctggaatgaaagcctatacaaaacctagcattaatgaagttaatatgaaactaattagctgcaatgctactgcgggaaaacggccaatcatcatttaatgaatgattctcagttaagcacttcagaaaagtatttcctctgccccataatcacccagcttcatgaagatcctgctttccaggtttgaggtgtgggatccagattcacttataacctaatcaggaaatgaacaggatgatcttgtactgaagtcctatattagtaatatatcaaatgaataaagaaaaatgtaaataaagttagaacttgtagtatcgttttatcaactcgcagtatgtgaaatccatgatgtacctgcaccataaataaaacaagatcttcaaacttcccagggctatttaattcttccatgatttttgttcacaaagaacaatcattgctcagcctattcattgctccttttggaatgaaatacttttattactattcacttcaaaatatttttaaatttctgttgtgattgctccttagacccacgggtttattaaaagtatattgcttatttttaaatatttagggatattttagttacttgtctgatattgattcctaattcagtttctctgtggtcagaatgcatgttctgtatgacttcaaccctttgaaatttgctgaaacaatgttatgattcaggatatggccttggtgaatattccatgagtacttaaaaggaacatacattctacagttgttggctgtagtgttttattatataaacgtcaattaagtcatttcttaatcatgttgagaaatcatctatgcccttactaattttttattttcatgtttaatcagatatgagaatggtgcgttaacatcttctatgattgtgtatttgtctatttctgcttttagtcttggaagtttttgctttgtatattttgggtctatgtaattagatgaatgtagatctttattttcctgatgaattgacccttttatcattatgacatgtcactttttatatttaatagtatttcttgcattaagttttaatttatctgatattatgtataactctaccaactttcttcagattagtgttatgatggtctttttttcccatatctttattttcaaccttcttggtccttattagagtatttaatccatttacatttagtgtaattactggattatttgaatttaaacctaccatcttagtatttctttttctgttgtctcacctattctttgtttctattttaatccctgcttgcctttataaaaattttaaacaatgacaatttttaaaatattttcatttatcttctttgttaccttattaattaggcctctgttgtaattcacctagtgctaacccagggattatagcatccatctttcactcattacagtctacttaagttaacttagtcctttagttagcatcatttctgtcttccatactactgtatgcgttttaattctacatatattattaaaattataagacatttttattgttgttttaaatagtcagtttaaaaaatgtaccctatatttactgttttcaatgaactttcttttttcccacattacatacttccatgaacacctccttttggcctatagaactcctattaatatttcttttagttcagagctgctggtatgtattttctcagttttagtctgggctcactttctgtgattctctcatccctggattattgactttcaaaactcagtcatattggcagcccctagcccagtgacactgtctcaaatcccagaacaatttatttaatgccacatctattcttgctccaaaaattggcaaatgcctcaagaagaaatgaagagaagccagtatgagactcgcctcaatctacttcccttttctgtgggatcttggatccctctcattgaccaatatctttaaagagttagatgatagatagatagatagatagatagatagatagatagatagatagatgatagacaaacagattgatgttatttttagcagcagcattagtgtgaataagctactccattttagctagaggtagaagtaatttcttcttagagaaaaagtttgtatagaattgaatttaccatcatagccattcttgaatgtcaggccaattgaactcctaagactctagcatatacaaaaaacagaaaccactatttcttatcatatgtttaagggtgtgtatttggaaccaatttagccacaaacttccagatgatgctgacataccaataattactattaaaaagcaatataatacacagggaaagcaaatatagtcaattgatatatgagctgttgctcttattgcaaggattgtaagagttctgcagtgtggccattatatgtgtgcctcacaacttgtattcattgtaagcttcctttgagaatttttatctaagaataagtctaccctcattttttgtggagtatcagagcttcttctcctatttgtcttcaagattgaaaggagaatattgaatgctgattctctgaacatctgcaataatgtattccaagatattggcaaaatcagtccaaaggctcaaccatcccagctaattaaattacctggttaactctgtggactaccaaatctaaatggatgtaagagaggaagaaatttgaaaaaaataaagattacacagttgaaaaaacaagatattctccagttatgaattcttttccccaagagtgtcttttgtgtacattgttattacaaaatccagttgtcacattaaacaagccatgctatccaaagcagagttgattgtggctggaaatttattccaatattgaaaagatgtgaaagggctataacacgtatcagacaatctagaattgaccactaggggacatgaccatgaagccttagacaataattcatatttagtttgaagtactattctgaggcaaaacaaacaaaaaagaatgattatggaggactcaatcttaaagtgtctccaagcatgtcttgttctgtctcaaaccttggcctcaacaatcaaagctctgtatcattatttgcaacacatgaatgctaaatggtatcatttctgactatggacctatgtgtagttaagttgtgtgtaggaatatgaggatagaaactattactatcaaccaaatggtaatattggacatgtttcaaagattgtctgaaagagcttgtccatggagactaacccttaacaagtcccaggtttctcctctcctagaatgtgaattccacgttcaccagcagaattcagttctgctgaaatagtcatggaacagtattgttttaatttctcaaacttttcaaccatatgtttataaaggtttataagacaaataagactatccctggcatataattctttcagtaaatacttcacatattcttccataagaattagcctcttctgtaaactctggagctaccccaaggtaagatcgtactactgtaaataagcccgaatcactagattccaaaggccaatggttacccaggcattatttgtttatgacctaagaaaataagtccatagaaataaattggcttgaacagaaccatcaaaaacccctttcaatagacatctcaaatgaaataggtggttctacttcctgagaacacctaaagaacctttgtgtaaaagaagaaatcattatttccattcagtagcaatttttgaatggtgtaacttgctatctccttgcctattggtacaatgcagagaaactgttcaaaggtgagccattcggtaaagaacgatagagttaatcagagagtctctgttatgcagctacatggaatgcaggtgttcattgctggtgtttttacccgctttgagttcttgtttgtttttgttcctatagtaggatgctgcactgatttgggcagggcaaagtggtggttgatggaagagcagaacacctgggaaagtcatccagagtaatttttgatcccaagaaaagatcagcagaattctccttgagtctctaagtcttcacattgtagaactgcttaggtaaaaactaattcaggaaatgtgcagttataaaactttaataagtcacccattaactgacattttaaatgtaaatgtactaaggggactctttatttccctctcattcgtaagtggaccatcctcaacacagagacccaaaccagaaacttaggaatcatctttgattactctctttcaatcttatcaaatcttattagcaaatcttatccctgaaatctttgtccctgaaatatatctcaagtcttacctgtcctcaccagttccaccgctaccatcctaatcctggcatcaactctgaactggactgagtcctccagcagcctggttccactgcttctattttttttccattgtctctctccatttcattgtacacacagttgccaaaataatattttaaaatctgtatcactaatttaaacgcttgtggcttttcagtgtacttagaagaaaatccacacttgtagaccctgatgcattcagcccctacctgcctccccagtcttataccagactccatttctcatatattgcagccatgcttgccttttcaacatctcaagcaatcgaagtgctttctcgatttgagactttttgtgcttgctattttcattgcccggaatgccttttctgagaatctcaagcagttgactcctctgcattttttatgtataagctttacatggttcatattcagagatcccttccctgagcacccttagtaaactgttcttggctttgttgggtattattggaacttaccactgcctataattattatgtttgtcatcaggtttacttgtttcttgcctgtgtcctccactagattgtaagccccagatatcagctaattggttgtataagtttccattctttatatagtctttgaatagtaatcatgtacttagtaaagccactaaggcaagtggccaaggagacgtggacagttatttatatctaatccaatctgaagaattattccaagcaaaaatgacgtgactgacggcttaaaatagctaaaaacttatttagttctatctcaaacctcagcttcaataagcaggctttcagccacatgttttcagtatatgaattgccagagcttcctaccaactagtcatatagtgtgtctaccttaacctggtacctttacttgggttgcatttcatcagcagccaagtccatctatttgtcacagtgtctctagtacactgcttctacatagtcagcaatcagtgaatacttgatgcctgcatgcatgaataaatgaacttctcaggaatgctagggccagagaaagttgatgtttaaaaagttagaaaatgtaggcacttgagaaggattaagaaattaacataagccttctttgaatttatcattgaaatctattattcaatttacatgtacaatttcagcaatacatatacttcctttagtcaaatacatctccctgtagcacttaccatgtctctgaccctttgccttgcaaattccactctgataataccagcagtgaatagaaatttaaaaagccactgtcctcactccttccactcatgttctaatgtaagcctttcttttatgcagcctgaatgcacaattcacttgtcattatctcgcatcctagctgctcctcatgaaatggcattcctctggatttgctgagtcctaatgttcaggcaaagtaaatcccacatcattctggcaggctttcaggaagacttagggactcgttgtctgctagtgcaaataacagcaaagtgtggtaggacttcctccttagttcagcgaagagccaggtccttgtcgcacggccatgaaaaattaggctcacagacgatttcgagggggagaaaaatgaaatttattgggcaaaaatggggaaattagaaacaggggccctctccaaagccagagtccctgctagagtacttcccacctcacaggttgaatcccaggtgccacccaggaagaggaggggccagactcctcccctctgccagcagagcaaacttctgtggctccaccccagtgtgtattcctcccagtgcgcaagtcggttggagttttctgggaaccgccttcccacctggctgtctcaaaaggactcccagttgcagaggtatgtgtgattcaacaagatccactggcagaaaatagaggcaaattaactcaaggagtccattggaatatatcaacgtactccccttccactcacaaggcaatgatttctaaaacagtgaatcattttacttacaaggggtcacaatggagacaggatagaggaaactgcccgggagacacagggacgaggcatgtggagaggtagaccttggatccagttctgcagccagtgagctgctcactcagacctgttgctcccctccagagcctccctttcttcatctggggtatgaaacaactggaccagcttatctctgagatcccgctcagctctgaccctcctgttggagaaggcttgcattctgagactgcagtcccaagtagcaatctcttcggagggcatgtatgtgattacgtacttagtgtgctcacatagtttcataagaatccggtaaaattcattcttatgctacttttgtattcccacttattttgaatggaaaatccttgtacatatttcctcaaattatggataaaaagtatacaaaatacaccctagaggccaagaagctccttttggtagaaagaatgttgagccctatgaatttgagctactcaaactttgtggtttgttttgggagccaatcttgaatataaaatattttttgatccagcagaaaggtgaaatcacattgaagtttacaaaatagtaatgctaagatagatagattttcttgtgtgccacacttatgttgtaaccagaacttaattcaccataatcattgacaagtcttttgttactggaaaggataagggttggcaggtcttgtgacaaatgttagaatttaatgcccaggatttttcttgatgcacaggactcattggaaaagcggcagctatttattgtgactatgaatcacgtccacagatgaatatgattaagtgctaaatccatagcagctcaagttttttaaagccttggaaaattggctttaaaaaatatcacctgacaaacctcaagctttttctgtctcacaagacttttggaaaagaactaggatcgacagtgttttaaggctcacaaggaaaagaatctaacacttgtaaaattatcttctgtgcaagttttattttccaacgtgaatctgggctgccaagcatactggctctagccagatcttcattagccgatccaaaaagacagtcggggcatttatccagataatgcaagccaacactaccctctgagaaaacaaaaagtaacttgcctgatgaagcaaggaacctcaccgattattccagattaatgcatctccttttactggcaccatgatcagatattttcaagacaaagtacttggcaagttggaatccagctgggtcctttgatttttgaattcactttgcttctgtgattatggccacagttttgaaaataaagtcatgtggatagagttgtgatttttagggatcaggatgcctcataaaacaacaatgctgtattcttttgtagaacaagatcctgcctaggcctctttcctagtattaatctttggtcatgatgaatgtgctcccaaccatccaacctatccctttgcaaccaggcttttgtgagatcaaataatttttagagttgaaatgaagttattaccagctctaaaataaggtactacaggagggaagtaaggaccgacaagagttaaatcactttctagggttgcgcaggtaactgggaatgaagccaggatgacaactctacttgctctttcattgtatcttatgcttctctgatgtcttccaagggatagcaatataatcaatagtcttgaaagaaagatctttgtagagaaagggtcagcagattatgtttgtaattgactagatagaagtagttttgcttttgcaggttaaatggcctctataaaatgtaattacccaatgggttcttcctgcccactacacaaagaccacagctctgcagtaaagagtttaactgacacaaggccggccacgccatgtgagagacagagttattactcaagtcagtcttatcgaaggcttgtgggctagtggtttttcaaagacagtttaggggaagaggtgggggtggctaggaaatgggtgctttccactgattggttgaagcggagaagaaatcgtaaggggtcaaagctgtcctcttgagctgattcacttataggtggggccctaagggtgatttggcaggtccgggtgaagccatctggtacaagtggagccaaccatgtcagacatgcaaaaaacctgaaaacatatctcaaaaggccaatctgcaatagtgatgttatctgcaggagtaattggggaatttgcatatcttgtgaccagcctacaccttagcagaattcaggctcctctcctccccatagactggggctctctcatggctttacaaaggtggttgacttttggggaggggctattatcatttaaaccataacctaaaagtcttccaaagttatcttggcctcagcccaggagtaattaaggcagcttgaccactaaaggtaagagcagagatggctaaatcagatctccttcactgccataattttctcactgatacaatttttgcaaaggcattttcacccactacccaactgtgtcattgtagcatgaaggcagccatagaaaggaataggcatgactgttccagtggaactttatgaattaacactgaaatggaaatgtcatacaattgtgacatgtcacagaatatttcatttttaattgttttcaactattcaaaaatgtcaaaatcatttttagcttggtggtggactggatttggtccagagcagtagtttgcctgcctctgttatagagtaacacatctgagcccatgagagaattgatcctgtaccttgggtaatgctcttcctctctggctcctttctacacctcagtcacttttcccctgcaagagtgttgtcacattagactgtaaaattggatcacttttatatttcatctctaacatgccttatttaataaaagtcattctaggtatgactaaagttccagggctaacttagaaaaggactgaagagaagaattccttctgacaaatgcggacccagccacaaatgccagtgatattgtcccaagtattggtggcttgggttgcacttgataacagagggcaaaagaaagtataaattttgcttgttaacatagctttagtggaaaatacagaaaatgcccccaaactccatgctaagatcatgaactaaactgttacaatgaaaggaattacttgggtttctataaaaacagctgcctcaaggaatttgccacattccttgggtctgcctgagctctggtggcccactgcttggataggcctggtttgtttgctaacttaacatgcttgcttaacggccaaacattcccttgaaattcaaggactttctgtcccgctgacactgtttatttgtatcagtagagtggagggctctctggtgacactctagttttttctgggttataagcagatgcaggtctgtagtttttctgacttggatggggccaatgggtctaagccaagaggaaaatgcttttttctttttcgtgtttatttccttttttttttttttcctatcttgattggagtacccttagaaggaaaaggagagccataatcgttctctggaggccaaaagaaggccgaaggatgccaaaaattgtcacagtggtgacttttggctggagccagtgcagaatgaggggctatgagtgtgtcactagaactgtaatccagatctcttccatgaggtcaggaaccctgattcgtattgctttttccatgctgtagaacatgacaccccactcaatcacttgtgctggttcattgttacttgttatagtagtcattgttatcaagactttttggttgtaagtgtcagaaacctaactcaaacagagctaagcaaaaataaatctataaataaatataattagctcaaaagtctgaactcactggattgatcttcagacataattgcatgcagtgttcaagcagcagctaccatctctccttcccttcctctctcttatctctgctttcctctgtgttaacatcctgctctgataagctttctccatgtggaatgaaagacgggctccagcctttccaggctcctaagttccttgcagctcacggtcccagaaggaaagagattgtctcccagcatctgtctccataaaaagaagccaccgtccttgcttgagtcatgttctcactcttggacttagcagagtccagaggggcttggatactctcacttggatactctcaatacgtgccagcaaggggcacatattcacccttcattgggcaaggtaagcctgttaacagtcccactcgaatcatggggagtaagcaaaaggaagttctgaaaatgaaagaatgtgggacagacataaaactcaaagctgtgcactatgctagtaaattattcttgtgtacttaatatgaatatggcttttataaacagtaagcaaatcagaagccaccctgtgaatcatcagttatctctagacatttctggattccttctttattccctgataatcttctttccttcctttcactgcgttgtaagtggaaataacacaagccaaaaagaccctctcctgctctcaatacacacatggtctagttcaggaagacaacatataaacagcaggcatacgagcaatttcagtagactgtgatgcctgcccagggtgctcgtggtctacctttcatggaccaaagacaacaggaataagagcattcatcttcctctgctattgtgagaatatagacagtgcaaagacttggatgccagtgctaacatccctgcctgacctgactttgagaaaaggaccgccattttcagcacaacccacaggttctctaaatactcaaagtgtgaggctagcagataaatttggcttatagagggagcttcataccatggttagaacacagcaagaaaggaacaaatttttaatgtattaattgaaaatcagatttctcagctgggaagaagatattagctggaacacacacaaaaaagtatttttaaaggtgcccttttaaaggctgccaaaactcacccaaagtagtattcaaatatgaagacagatgtcttttcaagacgggaaattttagttccgagtatgaaagagaattttatttatttgttttttcccttgccttttcaggcttttcactgacttcgaggggatgagggtatgtgtgcttaaagtagatgccagagtgtcttcttggaacttcaggtttccatgagtagaaggaagtgttgaatgaatgaggacccacggccctgtccagtgtggacatgccataaccctgtgctgagcttcctcatctgtgttctgggcttacattgaatatggcataagcaaccccgaagagccacaaaactctgctctgttaagggaggagggcaagtcctccctggaaggggttgtctcatcaaccaggaaatggtggtcaggatggatacagtagcatctatacctcagcccccttgaagtatcctgatgtccactccccacaaaatctaggccttccataggaagtcaagaggatattgtgctgatataaatttggaccaccagtgagtttgccctcagacctggtaagaagtgcatatttcagatataagatattgctctggcctcagctacatacagtttccataaaggaaaactttgaaggactgcctgcaggaaaagaatagcctcgtgttgatgtatctagggacagaactctcaggcaggacaacagcttcctcaagtcttgtgactacactctttttcccaagatatctcattgcatctttaatttagctcctaattcaaagccaagctcatggactgtttcaagctctggaccatgagcttagctctgaattaggagctaaattaaggatgcaacgagacatcctgggagaaatagtatagtcacaagacttgaggaagctttagtgaaaagcagacccacccagcatgtgtaattcttccatgaggtttcatctcacagtctgcatgtcttgcaagtgggcttagggccacaggggcaggagctcttggtactcagaatgttgtctagaagtttggaggagagagatcccttccaacctaggtcaaaaggcagaactggtaaaggacttgcagacatgataactttgagcacaatatctgagagagcaatccatggaagtcatttgaggaagagcattgtagacaacaggaatagcaagttcataagccctgacctcaggaacctgcccggtacattcaggagcatcaaggagaccatactggccaaatggcacaagtgtgaggaaagtgttggtaggaggtgatttcagagggatgcctggaggccagatcctggagagtcttgtaggtcattgtataactttgacttttactttgaatgagatggtaagcacttatgagcagaaaagtgtatgatttaacttacgttctaaaagaagtattctggctcctgtattaaaaataaactgaagggcaaggagagaggtggagagacccattgggaggctaacgcagacatttatccaggcaaatatcacttagacctcggtggtgcaagtaaggaaaatgagaggaaattgcatttataaaaatctcatttaaagatagagtcaacaggattcatcattggattggattggagtaaatgagagagagagggaaatcaaggatgattcaaagttggttttgtttttttttttgttttttttttttatcttgagcaactggagagatggagacaacattttaaattactttgttctttggtaacatggcagtaaacacacttataaactgtattacaggtggcaatcaaaataagcacctggctgatttgaaatatggtttaaaaaaaattacaaagtaaggaagatgaacttgtattgttctgcccatgcaaacaatctgtaaaactgtgtgcatttatatatttttcagtcattaatatttacagcgggagagaactgtttgtgaaatcatgaattatcttttgtttgaattttattttattaatgagttagaagtacctttgtaagccattgtaccttttttctaaaggtgagagcctaaaactaccatgttgcaatggaataagccctggttctagcttcacgccctgggagtgacttctattagctttggaatctccggtaactcctttaatcctttgaattctcactttctatgtcttaaaggtgatggctgcccatttcatcaactgtgaaatggcatccaagtcccaggtatcgttaagaaccaacggcttccattttaaacagaagttttgttaaacaaatatttggttttacaagggtattataattcatacccttattcattgttcttccttgctcccaatagtcgatgggttttttttttagctgtggcttatgtgatcaaagaggtgaaacaagttagctcaattggttatattctgaaattaataaggtgttctttttgcatgtgtatacaaattaacttccctctgtttcttggccacacacctcacctcagcttcacaaatgagtagaattgattacaacatgaatcagacaagagagtgtagatctatcactgttattgagaaagcagttcaaaaaacaagcattcccgcatgttagtaacatgtttttataaaagctgtaaatgtatatttattcatatgatttaatattttttatcttcagtttttattttaagttcaggggtacatgtacaggatgtgcaggttagttacacaggtaaacatgtgccgtggtggtttgctgcacagatcctcccatcatgtaggtattaagcccagcatccattagctattcttcctggtgcccaccctcccctgaaccccctcccctgacaggctccagtgtgtgttggtccctgcaatgtgtccacgcgttctcatcattcagctcccactaataagtgaaaacatgtagtgtttggttttctgttcctgcattaattcgctggggataatggctttcagctccatccatgtccctgaagaagacatgatctcgtttttttatggctgcatagtattccatggtgtatacgtaccacattttctttatccagtctattattaatgggcatttggcttgattccatgtatttgctattgtgaatagtgctgcaataaacatatgtgtgcatgtatctttataatagaatggtttatattcctttgggtatatactcggtaagggaattgctgggtcaagtggtatttctgcctctgggtctttgaggaattgccacactgtcttccatagtggttgaactaatttacactcccaccaacagcataaaagccttcctttttctctgcaacctcactagagtcagtaatatttcttcaaatatgaaggacttgacctcagatcctttatgatgatcataaatacataaatagataagttaaaaaataggaaggacagtgtgatactaaataactacaaaattagagatgtatcaaaaagtatttaggcactaaaatagttgagagatcattttcagagcctccaagagtttctatgccttgaattatttgagcatccagtgcaagctttcagagtccttgcttccttaaatataaaacaagaagtcagatacctttgcctctgacttctcagaggtctttgagcttgacagttctataattctatgagttttctacctagaaactattccttccattcagttaggaaatatattcaagtatattttatttaatcttaaactttggaatcccattttggtaagctgctgttatttgaaggtgttgacgtatcctctgggatctgagaaaattattatcaaaaccaattaaaggaatcatctattttgtgcgattggttttgaaatctgtccagtgggctctttctggaggcaaggatcctggttaccaagagactttgctgcaaataaggcaaactgggatgacatttggggttgggatccttctcaggaccaaatgggcacccatcatctttgggtctagaagactgcactggcataaagcagctgacttcctgtagccttgcagaaataacaatggggtgtgtgtgtgtgtgtgtagtgtgtgtagtgtgtgcagtgtgtgtgtgtgtgtgtgtgtacaatggtggggaacagttggcagagcaatgagcaagaaatgggaaacgacactcagaaaagcagcaacctaccctgagcaaatcaaagaatttcttagaatgcaacactagctgtgtgtatgaataattggcttgcaaatcacttcctctatttgcttgttatataataccaatcatttcagtgtcactgacgaaagcccagaagggaattaccacttaccagccagttttacatatggcttttgtgaggaataaggccttgaggatgagggtctaaatctctggcccacagatctggacaggcagatttcaagctgatcattacatatcttttgagagagacaatcccagacgaattggcctggggggcaacatgagaaggcaagacaaaagaacattgtaaagacttcacctagaatccaaattgtagttctctcagcaagttatcaagaagcaaattaactgctagattttgtaatccaaagattatttaatctgtttagctttgtgttggaaggatcgctactaatcatctcttttattaaaatatgataatgatagccatcctttattaagtgcttatgatataccaggcactttgtatacatgatttgccttattcagaataaccctgaaggatcaatattattgtctccatatcaaagagagggaaactaaggcatacaaaagttatttgctcaaggtcaaacagcatggtaagaggaactgcaatttcattccaggtcttacggataccaagtccgatgcctgccagcttgcacctgttaagtcatgtgatacttaggaaatgtacacatcaccccagtgcagaggcctttatccacttcccttcattttgcctggattgttgctgtgagtgagaaataaatgacatgaaatgatcatgtatatcactgtcttcagaggatggttagttccttgctctggattgtttttctcttttgttggatatttattttgacttctctgcaaactaaaaatatgcatgctctagtttctcttgggtacataactcccaatatattgtgaagaatgaaactggcctacaaagtttaattaagaagcagtgaactagagcttacttagacaatacttgtactagtgtgggttcatgttgtccatttgtctttagaggtgtagaaccttgaaagtcagctaattaatcactattactgttgtgtacagtattggcaatctcctatgctaaaattttttgtgatgatttgaaggtgggagggggcaatatttactaagtctctcaacctacatggcaatatctgaaacctgcttataatgtagtaatagcttaggcaccacctatttctgaaacataaatcatcccacaatataagcctcccagttttattcatgcgtcttaccatgtataaatatcttttaatataccatttatttccttgagggacagttatttgtagcataaatctgcctggataaaatagtaaaaattgctatgccccagtgaattcagtttacaaaagcttacatacgtgaatgagacattggaaatgtggtttatagttaaggagaatggatcacacggattatacctgtataacttccctagaaggttgataccactaagatattaacaccaaaaaactgaaaatagtatttttcatcttactttgttatgtaccctttgtgaatttctgaaaaacacctttctattatgatgggataaattacggtgtggtaacaaacaagcccaacctgtttgttccggtcaactagttgctttataacaaaccaccccaaaatttgtttaaaacagctatcatttgattgtgctcacaagttctgtgagttaggaaataagacacaacacagtggtcttatgtctgttgtgtaatgtctgggttctcagctgtgaacactcaaatggcttggaaactgaaatcagctggaggcttccttattcatatgtttggtgcctggctgggatgactcagattagttggggctcttgacaaaagcacctatacatgaaccctctcaggagccttggctctatggtggctggattctgagagggagcatgcagagaaaagaattccaagacaatggatgctctaagagaagctacttggccttttctgatctagtcttggtggtcatgcagcatcacttttgccacccagatcaaaggggaagaggagacagactccacctgtggatgggagagtgtcaaattcacacagaagttgtatgcaagctattcttggtcatcttgctcatctatgaaatataccctcctccatgcattgacttacaacaagggtttatttcttgctcaaagtctgctgtgaatctaggcaattctccagagcagctgttcttttgttggcttagcaatccaagctgctgcttccatcttacagcttttccatatcaactcatgattccacaaccattgctacgaggcaagagtagtatggaggatcacacactactcttagaaaccaccagctggaagggacttatatcactcctgcttacatttgatggctcacatagccatgcccaaattcagtagagcaagcatggccctcctgtgtacccagaaaggaaggagagctagaaatattggtaaatagcaatattgtttaccatagcctcagagatattgcctcgtggtgaaaccctataattcccctcaattctgatttttgccctttatcaaatcattttattcattccttcatccatccaacaaagatgttttatatgcctactattagcaacaatcagtagcttgttcctggagggaatgcagctgctccccgccaaaacaccatataattcactctagaaaactaaaatttcagatgctttgtcattgattattgtggggagaaaatgtctctttcagctccgactttgtcctgtctcctctaaggcatgtgaaataagatttttttttcctattcttacctcctatggtcccattttatggttttcatgcactactgtcagtcaaatatttatcatatgtctttcaatatctttccaatatttatcatatatctttccccttgtaggccttaactttatgacccactattaagcacgcagctgtatttccagaaaatgtagatggtttaattcaatactgcatggcaattaactgtcttataaattaaatcattttaatccatcttagagttatcatgcataattagtctgacagcacaattctgtttgttgttgttttaaaggaaatttagatatcaaggctgcaaagaatgcgtaagtctaggcagaaggctcttattttccaaaagcagagcccatcgttgcatttcaacaatgaccgcaacaaaaaccatcaggagctgtttggggcctgtttgtgctttagtcttcaattagaaaaaaatgtgtttctgatggaaaaccatagaacaatcctcactctgtggtaagaaagaataaagagaaagaagtgggctctatgatagactgaagcaagaatactattttagactaggtagtggccgggcgtggtggctcacgcctgtaatcctagcactttgagaggccaaggtgggcgtatcacctgaggttgggagttcgagaccagcctgaccaacatggagaaaccctgtctctactaaaaatacaaaattagctgggcgtcgtggcgcatgcctgtaatcccagctactcaggcgcactggctcacgcctgtacttgggaggctgaggcaggagaatcgcttgagcccaggaggcagaggttgcagtgagctgagattgcgccattgcactccagcctgggcaacaagagtgaaactctgtctcagaaaaaaaaaaaagactaggtagttatcttcctgggtggttttggctatgtagaaaatcactcttactctcgattaatttatgtaccaaatcatgctttgaaatatcccactgaaaaggtctaaattattgatatcttgggtcaagttctgacttgaaggcaaatagtaggaaatacaatggcatttattggaggcacacactacaaatattgtagtatctttaagatgtgtttaaataaacaagtagatgataaaactataaattagagtcactaagactctctagcagagacccttaccttttgaagtgcaccttaaaatggcaacaacacttatcagaaattccataagaagcttagttgtctgctactctattgcagtatcatatgtgtgagctgcatgaaaactggatattattattatcaaaggttattatcaaatggagcacaattttattaataacaatattattattatcaaaggttttaatttgctaaaactatacagcttccttaggtcttccaaactaggtcagccagttaaccctcagatctggagtaccacatttggctgagtcagaagaaataaagatgctctcaaaaccacaaacaaaactgataatagacattctgataactttaactcccacagtaataaatcttgggtcttttaaagttggtcagatgtacacagagctgcttactaattatactaaaatagttactaagcaactcgacattttgatttccaagaatttcagataaagattatgaactttatttatttggtgctttagagtccaaggcactattttacagcctaaagctgtatttctcaaggccatcttcttgcattcttctaaaacttaagagggatcatctgtcctcaaaaatataagaaattctgtaaatgtgtatttttgtgtatatatatatttgatatttaaaattctgtatctatatatacttccaagaccccttagaacttacacggtacctgtaatttgtttcttttttatacttaagtacaagtaatgttagtgatacatttaaaactaggaattaccttgtttgcaatatcaaatttttgtaaaatattgagttaaaaaagtctcctaaaattaagatttgaactattataaatggcttcaaagatcctttcgtttctaagagaaggaaggaattaggatttattgtgcatgtatttcataccaggtgctcatctacagttattgaatccttgcaacaatcgtatcaggtaaacgctgttattcttctcttacagatgaaaaatctaaaccttctaaaatgaaagtttgtccaagttaacatgaccaattaggagagcttggattccaacccaaatctgttcagtatcaaagctcactctcttccatccttgccccttctcagctcacatagtagctttcagaaaacagtagctatctaccccagataaaattaagcctttttttccttaggagaggctagaaactgaatcttctaccccctttattggcatcacacaggcacaaaaatcaccaattctcaaaaaccctatactcccaagttcaacccaaattgaatggttggaatattgttggtttgtatggaataattaacccacatctaaaaattaattatacaaagtgaagtggagattgaagcagttttctagataattaaggcaaaaataactgcaatttttttaaaagacagtttgaaatatttagaagggtagattgcaaaattatccaacttaaggtagtcatattcagggagtttagccaaaacacctctgaagttcattgccttacaaatgagtataaaacttaaacctatgattaattccctgttgtttttctatctgtattatacatataaatatattttatatattgtcctcctgagatttcaagagcaattttcttctaattcttctaatttcttctatggattcaccatagtgaatccaccgacacgtctaccctgtgacaatcttgttctccatttgattgcatgaaaaataccatatgaatttgacaaatcattggtttttttgtttgtttttctcttttgctgcatatcattgcctatgcttcttgagcactagaatatatttgtgcatgtataaaccaaggcctttcttctgaaaattaatagtactttgaatctcttctatattctggttcttttaaactgtggttgttttaagtttgcctctcttgttttaggatttattctttattttgaggccctgatttttcacaaaacatttttctcaacgaatcctgagaacactggacaatcatagcttttagctatcatgagtcccattaccctttggcctccagttaagctctgtcctgcaagacataaattgtctgattatcaactcctactttgagtgaaaaatggttgaatgaaatgaatatgcagttcatttcaacaaagcaagaaatttgctgtttaaaattgtgtttttataattcttgagatggaaatatagcagacctctgtgaatctgagaaggcatttcatgcttccagaaatgaggggagaagtggcaatgatattgctcatgaacaattggaagcaatgatactagagtatgcagcaaatctcagggagatttcagtggtacagtaactggcctcacaaaagtgggatttattgcattaaatctttgctgtcctttctggctggtttgatatttaagaaattattaaacataaaattgtatgagcagttacctatggtaggacaaaatggactgacctctaatggcttggtagatgggataattttgggaagagagagtggagctcagttcagcatcctactctcctcctcaacatcatttcccattcttggcccttgagtttagataggagttgggcatgtgtgtgtgtgtatgtgtgtgtgtggtgaagtgggtagattcctgttcccaacccaattagataactccacttccatctatcttccttgcatcttctccagctcatttgcaaaagaatgaaagaagccttgcttcaaaaaggtttagagggctaaataagagcacaaactggattttctgaaaactgacctgattgcctgggtaattaaactgtcactccagcaaaagcatttgtctccaaaaagtactgaggttgtctttcatcactctaagtctagacattctgaaacctccatcctctcctgcagagagaggaattaagtctccacatttctaaaccattgacagtctgtggggtgccccattgtgttcctgacttcctattctcagaaggagttataacgatgacaatgatgcatgcatgagacatagaggtcctccccagccctcggttaggaagtaaggcagccacccatgtactgaacacaatagtgctttggaaagagctctgttaaaagtgagtctcaaaaatgtaaaggcctttacgagaggaacttaatctccagtgtgataaaacgatgcacacattacaaggagatggatgttatgaaaacaataagtacacccaagagtacacgtacaaatctgcattgcaattgatttatttggatgcctgtttcttcctacactatgagctccttggggccatgaaattcatttgttttatctatatatactctctttgatatcccccaccctgacagctagtgcagtcctttctaaatagttgttactaaatatgtcaaatcaaatgcctacaaggactggttggtagaaccagattctggaagtgaccaagcaggtctagcttcataagaatgccatcatcgtagatttgagggtcatgatgaagttgtactaggatttatggaggttctttgtcaaccagttcacaccaccagtgacttaaggaaactatatgtcgtctattgggaacagtcctgcttaaagcaattagcagggacaattaatttggagggaagtctctctccactcaacagcattcaaataccctctgcattagccatgttttgaaaaactccaattgcctgagtcactgatagacaaacagaaatgcagactattttgtatgcagttttataaagaagtttctaaccagagaagaaaggtgttattttgaaatattaagctcttagttgttctttcatttcagtgaacatttgttgagggcctgacatgagctaggcacatggcaaagttttagagatgcaaaggtaaattaagacccctgtgttaattctcatgcgggcaaagcaagcacattttttaagttgcaataatgcaacaatggtggtgtgtacatagtagggcaaaagcatagagaaagccatggaaatcctcaagccaagttcaaagagtcctctaatgtatggcataccacaacaaggaccttcaaagggtgcatttggtaagaaaaggcaacctccaaagattcatccaatcctaaggtttcatagagtagggacttcttcccttagctggaaaggaaagaagtcatttggtgtgcagtagacataaattaggggccgtccactttttcttgcaatgattcatctaatggaggagcagaccctggagagaaacatatctcttcttgtcttcattttgttcttcttttattaaatcacccgcaggacaaccggatgctccagcaatagattatagaaaaaacagatgggtatttctgtgcagtcagaaggctcctgtgcccttttccagcataaaacgtttatgaaaatcaattttcagtgcctgctgaaccaggctgatgtgagaactagctttccacagttcataatattcactccgggatgatttgacagggctgatattttatcacgaatacaaaggagatgagcaccattctcctaatatattcattacttgtctcaccaccctggtaaataatatgcatatggtaatttgagagacacagtgttcccattgctcttttttattcccagaactctggctgtcttttctaaatgctgcaaatcaaaggcaaagttacctcacgcacctgtagtcccagctactcaagagacagaggctctagaccaggacttgaagttcagcctgggcaacacagtgagaccctatgtctttaaaaaaaattgcctaaaaatttggccaggtgcggtggcccatgcctgtaattggaggaactttgggaggccaaggtgggcagatcacttgaggccaggagtttgagaccatcctggccaacatggctaaaccctgtctctactaaaaatacaaaaaaaaaaaaaaattagccaggcatggtggtgtgcacctgtaatcccagctacttgggaggctgaggcataagaatcacttgaacctgggaggcagaggttgcagtgagccgagattgtgccactgctgtattccagtctgggtgatagagcgagactctgcctcaaaaaaattaaattaaaatttaaaataaaaaattacttaaaaatttgattttacattcctcctattctcactttctggtgcccatacaacacataaattacattcttctctatgtttacctgcatctctagggaacaaagcccctttcacttgttctgttactatagaatgttctacaataccccaataaagattcattcatttgttcatttacaaatatctattaagcacctactgtgtgtcaagcagtatgctaaatcttaagcatgaaacaaaagaaagataaaagtatctgattcagggactggttgttctgttgttctgggttttttttttttttttttggaagcttgttgaaaatctgtggcatcatacaaaacaaaaaagaatgcaaaactggtgccttaaatagaaatgtattaataatgagtgttagagctaagagaaggcaaaatgtctacagaacacatgatttcaattaacaacagtgagtaaacgaatgatctggaaaaaaattatgatcgggcccatgatttttttttgtcgttttttaaaaattttgtttgtttttctcatactcatattattctaaggcccattgattttagaaagaaaatctgttttataaacttagcatattaaaag

SEQ ID NO: 1191 - DNA, 2723 bp, Homo sapiens
ggaggctgaaatccccagacgccggttttctgggctgggctttctgcttactcactccttctccctctttctggattttaccgaccgttcgcgaaacagctttccacacaatggagcttcatgtcctcgtgcaggaagtactcatcgactgatgtggcagactttgctccctgacaaaactaaagaactctcctattcatggaggcgaacactgaggatgctttccacatgaaccctgaagtgaacttctgatacatttcctgcagcaagagaaggcagccaacatgaaggaaaatgtggcatctgcaaccgttttcactctgctactttttctcaacacctgccttctgaatggacagttacctcctggaaaacctgagatctttaaatgtcgttctcccaataaggaaacattcacctgctggtggaggcctgggacagatggaggacttcctaccaattattcactgacttaccacagggaaggagagacactcatgcatgaatgtccagactacataaccggtggccccaactcctgccactttggcaagcagtacacctccatgtggaggacatacatcatgatggtcaatgccactaaccagatgggaagcagtttctcggatgaactttatgtggacgtgacttacatagttcagccagaccctcctttggagctggctgtggaagtaaaacagccagaagacagaaaaccctacctgtggattaaatggtctccacctaccctgattgacttaaaaactggttggttcacgctcctgtatgaaattcgattaaaacccgagaaagcagctgagtgggagatccattttgctgggcagcaaacagagtttaagattctcagcctacatccaggacagaaataccttgtccaggttcgctgcaaaccagaccatggatactggagtgcatggagtccagcgaccttcattcagatacctagtgacttcaccatgaatgatacaaccgtgtggatctctgtggctgtcctttctgctgtcatctgtttgattattgtctgggcagtggctttgaagggctatagcatggtgacctgcatctttccgccagttcctgggccaaaaataaaaggatttgatgctcatctgttggagaagggcaagtctgaagaactactgagtgccttgggatgccaagactttcctcccacttctgactatgaggacttgctggtggagtatttagaagtagatgatagtgaggaccagcatctaatgtcagtccattcaaaagaacacccaagtcaaggtatgaaacccacatacctggatcctgacactgactcaggccgggggagctgtgacagcccttcccttttgtctgaaaagtgtgaggaaccccaggccaatccctccacattctatgatcctgaggtcattgagaagccagagaatcctgaaacaacccacacctgggacccccagtgcataagcatggaaggcaaaatcccctattttcatgctggtggatccaaatgttcaacatggcccttaccacagcccagccagcacaaccccagatcctcttaccacaatattactgatgtgtgtgagctggctgtgggccctgcaggtgcaccggccactctgttgaatgaagcaggtaaagatgctttaaaatcctctcaaaccattaagtctagagaagagggaaaggcaacccagcagagggaggtagaaagcttccattctgagactgaccaggatacgccctggctgctgccccaggagaaaaccccctttggctccgctaaacccttggattatgtggagattcacaaggtcaacaaagatggtgcattatcattgctaccaaaacagagagagaacagcggcaagcccaagaagcccgggactcctgagaacaataaggagtatgccaaggtgtccggggtcatggataacaacatcctggtgttggtgccagatccacatgctaaaaacgtggcttgctttgaagaatcagccaaagaggccccaccatcacttgaacagaatcaagctgagaaagccctggccaacttcactgcaacatcaagcaagtgcaggctccagctgggtggtttggattacctggatcccgcatgttttacacactcctttcactgatagcttgactaatggaatgattggttaaaatgtgatttttcttcaggtaacactacagagtacgtgaaatgctcaagaatgtagtcagactgacactactaaagctcccagctcctttcatgctccatttttaaccacttgcctctttctccagcagctgattccagaacaaatcattatgtttcctaactgtgatttgtagatttactttttgctgttagttataaaactatgtgttcaatgaaataaaagcacactgcttagtattcttgagggacaatgccaataggtatatcctctggaaaaggctttcatgatttggcatgggacagacggaaatgaaattgtcaaaattgtttaccatagaaagatgacaaaagaaaattttccacataggaaaatgccatgaaaattgcttttgaaaaacaactgcataacctttacactcctcgtccattttattaggattacccaaatataaccatttaaagaaagaatgcattccagaacaaattgtttacataagttcctataccttactgacacattgctgatatgcaagtaagaaat

SEQ ID NO: 1192 - DNA, 1869 bp, Homo sapiens
atgaaggaaaatgtggcatctgcaaccgttttcactctgctactttttctcaacacctgccttctgaatggacagttacctcctggaaaacctgagatctttaaatgtcgttctcccaataaggaaacattcacctgctggtggaggcctgggacagatggaggacttcctaccaattattcactgacttaccacagggaaggagagacactcatgcatgaatgtccagactacataaccggtggccccaactcctgccactttggcaagcagtacacctccatgtggaggacatacatcatgatggtcaatgccactaaccagatgggaagcagtttctcggatgaactttatgtggacgtgacttacatagttcagccagaccctcctttggagctggctgtggaagtaaaacagccagaagacagaaaaccctacctgtggattaaatggtctccacctaccctgattgacttaaaaactggttggttcacgctcctgtatgaaattcgattaaaacccgagaaagcagctgagtgggagatccattttgctgggcagcaaacagagtttaagattctcagcctacatccaggacagaaataccttgtccaggttcgctgcaaaccagaccatggatactggagtgcatggagtccagcgaccttcattcagatacctagtgacttcaccatgaatgatacaaccgtgtggatctctgtggctgtcctttctgctgtcatctgtttgattattgtctgggcagtggctttgaagggctatagcatggtgacctgcatctttccgccagttcctgggccaaaaataaaaggatttgatgctcatctgttggagaagggcaagtctgaagaactactgagtgccttgggatgccaagactttcctcccacttctgactatgaggacttgctggtggagtatttagaagtagatgatagtgaggaccagcatctaatgtcagtccattcaaaagaacacccaagtcaaggtatgaaacccacatacctggatcctgacactgactcaggccgggggagctgtgacagcccttcccttttgtctgaaaagtgtgaggaaccccaggccaatccctccacattctatgatcctgaggtcattgagaagccagagaatcctgaaacaacccacacctgggacccccagtgcataagcatggaaggcaaaatcccctattttcatgctggtggatccaaatgttcaacatggcccttaccacagcccagccagcacaaccccagatcctcttaccacaatattactgatgtgtgtgagctggctgtgggccctgcaggtgcaccggccactctgttgaatgaagcaggtaaagatgctttaaaatcctctcaaaccattaagtctagagaagagggaaaggcaacccagcagagggaggtagaaagcttccattctgagactgaccaggatacgccctggctgctgccccaggagaaaaccccctttggctccgctaaacccttggattatgtggagattcacaaggtcaacaaagatggtgcattatcattgctaccaaaacagagagagaacagcggcaagcccaagaagcccgggactcctgagaacaataaggagtatgccaaggtgtccggggtcatggataacaacatcctggtgttggtgccagatccacatgctaaaaacgtggcttgctttgaagaatcagccaaagaggccccaccatcacttgaacagaatcaagctgagaaagccctggccaacttcactgcaacatcaagcaagtgcaggctccagctgggtggtttggattacctggatcccgcatgttttacacactcctttcactga

SEQ ID NO: 1193 - DNA, 96389 bp, Mus musculus
  misc_feature (455)..(570): "n" at positions 455 thru 570 can be any base
  misc_feature (8609)..(8909): "n" at positions 8609 thru 8909 can be any base
  misc_feature (15838)..(16208): "n" at positions 15838 thru 16208 can be any base
  misc_feature (25601)..(25620): "n" at positions 25601 thru 25620 can be any base
  misc_feature (47215)..(47234): "n" at positions 47215 thru 47234 can be any base
  misc_feature (91841)..(91893): "n" at positions 91841 thru 91893 can be any base
  misc_feature (95110)..(95784): "n" at positions 95110 thru 95784 can be any base
agccagtcttgtaagcctttgttctttcttggggctatggccgctcggcactcctttgtggcttgctcatagatgagctgttttatcagaggcgcagcttgctctgactctccaaaaatacgctctgctgcctctgtcattttggccacaaaatctgagaaggattcctgaggtccctggacaacttttgttaattgaccagtggtttcacctgctcgggagagcgcctttcaggccctaatagccgtggaagaaatctgggcataagctccccaatggtagtttgtctgatcagcagaataagctccctgacccgttaacaaatcaaaagtccaatctctctgctctggagtcaaagcagctgcgtttgctcgggcctgcgcttgtgcagcttcgtgccaaagcgctctctatttcatatatttgcccatactagggagagcggcttttacaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggttccgtatttacggaccgactcggcaatttctttaatttgtaagtattctaccggaagcgtggacacgcccaccctcggctccttcaaagactggaaatgcctgttgtattttcctttgttcctctctgggaatgaatgagtctgcgcactgcctctctgcgcactgcctctctgcgcactgcctctctgcgcatctctctgcgcattgcctctctgcgcattgctgacgcactacgcagggcgggggctccgcatagggcggaccttgaagccgactgccctgaggccaatcagcaaactggccttcgccagccgcttttggcttctttaactgattagctagcactttacctggctggtacccttttttctcataatgagctgctttttcctcccagtctgtttcctcagaggagaattcttcatctgcttcagagctaccaagagctggctccccgagcccatctagcgatgagcacaggctccttttcctagagacctccgctaattgatctttctttttttccctttttcctctttttcttctaatctctctccaggtattcctacctaaccttaactttttctcgggtttaagacccttggaaaggcctgtatacttattttgtgtaccatatttcctttttgttcctactctctctccccactttacttctgatagcttgtcctgaatttcctctagaatttttagccctatcttaatcacttgataacatgtgaaaaggaacaaaagggctcctaacaccagaaaaaattcaaggccaaacatatttcactttacttctgatagactgtcttgaatttccttagaaagtttaagatcagacttacctcgtaaagctgtactcactggtactctcgttccccagctgaaaagttctgaattcatacagttgaatccttcttaacagtctgctttacgggaacctttattaccgcgacccgcagttctggttctggaatgagggatcttccttgcgccagtcccgagttttttctcgtcccgggtttcggcaccaattgttattaaacgcgttctcacgaccggccaggaagaacaccacagaccagaatcttctgcggcaaaactttattgcttacatcttcaggagcaagagtgtaagaagcaagagagagagaaaacgaaaccccgtcccttttttaggagagttatatttcgcctaggacgtgtcactccctgattggctgcagcccatcggccgagttgacgtcacggggaaggcagagcacatggagtggagaaccaccctcggcatatgcgcagattatttgtttaccacttagaacacagctgtcagcgccatcttgtaacggcgaatgtgggcgcggctcccaacaagcttatatggtattctctctctctctttcttccccaagggagtgtgaggcttctcttcctatcaccagcctttcacttaagccagtacctcagctgggtttgtgtgtcctcacccacccccaccccctttttttttccaagacagggcttctctgtgtagccctggctgttctggaattccctctgtagcccagggtgtccttgaacacggagatctccctgcctctgccttctgagtgctggaattaaaggtgtgtgccaccactactgggcttttttttttttttttttttttgagacagggtttcctttatgtacccctggatgtcctggaacttgctttgtagatcaggctggcctccaactcagagatcttggtaaactccacagagggagtagctacaaatggggtgtgaagaagaggaccaaggatcaactcaagaggatctaagggtttgagactgagaactgggcaaggtcaacagaagaaataaggaagctcagggagaaagcagacctcaggacctgaggactgtgatattatcaagtagacccgagagagagaggctgtctgtgggagtcaacttaggaactataaagctaccaagagggaaatccagagaagacatgctgttgataagctggatgggtaacccagctcgttggatgttgcctcagaagtatgaggacccgaatccccagagcccacgtagaagctggacgtggcggaacacggaatgccagagcctcctctgcttcctgtctggccatcccctttccagatatctcacatatggagaagggcacagtgacctaaagacagcttgggagatcaggaaggtagtcagcgtctgggcataagggctggcttaacttacttagccatccttgcccataaaaagaagggagcactagaaaccattcccagtgatgaaaaagacgaaacaagacaaactcgcagaagcacatagcataggaaagagctcaaagtaagtaggtagttttggggtttgttttatttgttgttaagacagaggttcactccagtcagtggtggcgcacgcctttaatcccagcacttgggaggcagaggcagacagatttctgagttcgaggtcagcctggtctacagagtgagttccaggacagccagggctacacagagaaaccctatcttgaaaaacaacaacaaaaaaagacagaggttcactatgtagccttgactgacctagcattcactatgtagaccaggctgatctagaattaacagagatcctcctgcgtctacctgccatatcctgagattaaagtcctgatgcctggtttctaaaaacgtatttttaaagaagtcaggagggcaccagggacaggagagcaagtgacgctcctgctacagggacttctgtaggaaaagatgtcccttgtaataaccaagctcctggcagggacagaggaagggtagtagaagactcaggggtttggagcagggaaacgggaaaggtggtgctttcaaaatctgaccctggcttagcgctatcaccatctggttcagtgaggctctggcgctctctctctctctctctctctctctctctctctctctctctctctctctctccctctcttccctccttcgttcctgaggagaaacgctgagtcagcgcagggcttctctagctcccagaattttggggtgtttttccagaatccagggggcttgcccctctgccttgcgctgcctgctgcttctctggccagaagcagttagacccaaacagcagcgggataatgacctcctgacagcataccctttgaggagagtcagcaaaggctgctgtcacacccaaccactctgttccaatctagatgggtcaaagtcctctgtctcttttataactcacatctccatccccattccaactagcctgctatggtcagtatgtctcccagctagcctccccttctccattgtcagctccccgggactgtccgctgtccattctctggtactcaatggttttcagatatcatttaaacctagctcaccttgctgtagctccacggttatgggaagggccttcccactttcccagcctcaatctatgccacagccttacactgacttcatctgtcatcatgatctaaagtcatttatgcccatagctctctgccttggccatttgccagcttttcttgtactatcttctcttcctcagatattccattcctcatctctcaaaaaatgacacggaactggaaggttccccccacccccatattgtccctccaaaatttcctaatgagttggatgtgcctccattgcagagtttccatagtaattggtagtttgtcacctctccccttattgttccttgtatcttagggtaacagttgaggaatgtgactttctcattattagactgagagtttttccaaaatgaagatcagatcttgtttgtatctgtatttacacagcttagcataggacctatctacctcatactatcaactagtctcacattccttggggagtaatggtggaatgagtaaataatcttatcacaacaggggtgtcttgtggaaggaagacaacagagggtttggcctgtaatctcagtactttgggtggttgaggcaggatgagaaagataatggaaacacacaaatagaccccctcccaccccgccctcccaccccccaacccccagccacacggcaggctcctaaatctcagctactcattctgctattcaaggcttgggtctttcccaccggcctttccttttattcagacaattttcaacttttgctgagcagctgctgtagcagcaaaaggcagcaggacatttctggttgctgggatcaacagcatgaacgttttccatggatcaccaagcaggttctattttgagagtgtccaactcttaacagggcattagatctctaggcaaggcattatggcaaggggaaaactgccagaaaactgtagtcaggaaagcagtgaagccaagactaggagaccactaggagtgcatgccagtagtaaatccagcacttaggagattcagggcaaatgatccagagttcaagtttggcctcagctatataatgagttcaagcccaacctgggcttcatgaaaccctatctcaaagttacaaagtaaaagttacaaagtagccgggtgtggtggcgcacgcctttaatcccagcactcaggaggcagaggcaggcggatttctgagttcgaggccagcctggtctacaaagtgagttccaggacagccagagccatacagagaaaccctgtctcgaaaaaacaaacaaaaaacaaacttacaaagctagtaaaaacaaatatattttaaaaactgttaggagggatatctgggtcctgaaccatgaaaatcccagagtggaacaaaagtatagccaaggccttgagattccctggcttgaaaccagatggaagttgaacatcagtcacatgacccaacatagctttcagaagcaaaaggagcaatgtatttaagtgtaccacaaaggtatctcacattgcaatgaggcagaattcacagacctgaacttcattaaggtcttctctctgcctgttagcactctcctgccctctcccctcaacctctcccagcttcccctggccttgacaaaatgctgctccttgacgtgacatagtacagatctattagcaagaagaacaaccacgttactttcttctcaattctaaagcctctagaaattccatctgagtggttcagtgtaggccacttgtgacaactgtcaaagaggaaccacagcacatttgtggctgtgcatatggtccctccagaaccttgtgagtctgggggaaagtcctaggaaagcaggagttgttcaggcatcatcacaagtgtttaattctggaagacaacagttagaccagactttaataaaacctgcctgtagcagccagtgtcctgagtccattcattccaaaggagcccaagccttaagcagcagataggagatgggggtgaggagaggggaaagaggagagaagaaagaagagaggggggggaaaagatttttctaggcttaaagatattttggagggatggtgctggtgcatgccttcagtcccaacaccgagaaggcagaaggcagaggcagaggcagaggcagaggcagaggcagaggcagaggcagaggcagaggcagaggcagaggcagaggcagaggcagaggcagaggcagaggcagaggcagaggcagaggcgcagaggcagaggctcagaggcagaggcaggcaaatctctgagtctgaggatagccgggtccatagactaactcaaaacaaataaacaaacaaacgaatctccaaaagaacccaaccccccaagggaataaaaagaaagaagaggaggagaaaagaaggaaaaagagagacagacagagagagagacacacacagagacagagacagagagacagagagatcctgtttaagcaggagctggagagctagctcagtagtttagagcatggctactcttcaagagaacccaggctcaattccaccacaactgtttgtaattccagttccaggggatctggcacccctcacacagatatgcaggcaggcaaaacaccaatgcatgcaaaacataaggaaatttttaaaaagtattttggagacactgcagacttaagcaccatacaggtatcagcatattgaagattctaaacaggacaccaagaaaagctctgtttaactttaaatcataatgatgtatgtatttgtgtgtggagtgctccttttttgcgtaacatctacaaatcatccgccttttaccagtcatgctctggagacaggcatacatcatcatctagttactttataaaggctgaggtgatccgtcagtgaatagtcttgaattaaaacagtattttccatacctgatatatttgcttttgaccttcctggagtatgtcttatattccctctctgtactattcttggatttttttaaaaaataaaagcagtctcattatgtaaccctggttaacctgaaactcactatgctaggctggcctcaaactcacaaagatccctttgtttctgcctgtggagtagtgagttaattaaaggtatgggctaccacacccagctgaatatttttatttaaaattaatcacccaacatcttaaaaaaaaacccttgaacttaaacagttattactgtgggttttatgtggtagttaagtgttttccgtcatacacattgaaatagatataaagcagtaaaaaatgtaaaagtctgtctgtgtggggccaaaagtcctctcaagtgcttatgaccatgtgtgggatcattggttggagaagaaagagtggccatgtggacatcactagccaaacatagatagaggcgtttagtctatggtgggatgttgggtggccatgattgggcctaggataccacctttgattcatcatcctggggcctgcattctgtttccatgactactagctggtcttcctgggagggacctggaaagcaaatgacgatgatcccaagtcaccaggggctggaagctaaagcagaggcactatttttcttgaaggctgaattatttcagcctaactgcagtaaatgggtgggaggcagatgctttgcttggtggcctgggattgcttttgacatgggaaagcggctattgaggagacactaatgcaggcaaaactggctctggcatacagctgtggagaaagagtgctggaatcaggcagacctaaacatcaaatgatacatattatctacaggcccttaaacaaagtctttttgtttgtttgggattgtctattaaacacaattatcgctgttgtcccgttgtccagatgaagaaactgggactcagagtggttaaacaacttgttcaaggtcatggaagaataggaaaattctgcttaggaaagcagaattgaaaaataggccagttgacttccaagtgtggactcttagccactgcattgttgtgtttgcctttgttgattggactcttctgtcagaggacctgttgattcctgggggctaagtgctgaacaagatggagaggtcctaaccctcactgacctcgaattatataaaggagacagaaaagaagtcactagctcccatatgggtaacttaacaactgtgataactgttataaaggagagaggcacatgggtacagcatgcggaaaggggcgtgcagcacttcaagcttggtttttcgggacagtttctctaagtagccctggttgtcctggaactcactctgtagatcaggctggcctcgaactcagaaatccgcctgcctctgcctctcaactgttgggattaaaggcgtatgccaccactgcccagctggcttgagttttgaaatattcacaagaattaaccctaagtgtttatcactcaatgtttatgaacattttccgaatttatttatatgggggattgagccagactggagatgaattcagcctgggatgttcttgcaaatccaattgctaatgtcattaatccctcaagacagtttgatagtggtcgatggtccacacccaggactgtgaggagtcagggcagaccttatagtatggtgttccctaaataannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttggaatattagccctctcacatcaaactaattcctgtctcacagtaggcgcttaataaatgtttataaaaagaacaaatgcagtagggtacttgtgacacagggctacatgactgtaaactggagctaaacctgactgaaaaattaaaataatttttaaaaatgggtgtgaagtgctgggcggtggtggcgcacgccttcaatcccagcacgtgggaggcagaggcaggaggatttctgagttcgaggccagcctggtctactgagtgagttccaggacagtcagggctacacagagaaaccctgtctcgaacacccccccccctacaaaaaaaaagaataaataataaataaatggatgtgaagtattccagaagtctggacaaaggctgtgaggagactccagctaaatgccttacggctgctggtgaactaagatcggggcagccaaggtacgtgcggatcaaacttgtctggctctagagatgcagaagctggagacacggtccctggccagcttagctgggtcccgccgcggcctttaaaggcctaccacgtggccgcccgggtgtccaaggtccagaggcggtgtccacgctgcgcctgcgtgctgctagagccggtgtcccgcctctgagaacgccagtcccgtagcaaggcagaaagcagagagtgggcggagttaagtccgtatgctaataaaggggcggaacttgcgaggcaaaaccggctctgtctcccggacctctaagagacccgccgcaaccctcagcctctttccacgagcgctgacgtcgacgacgacgtcccatttaaaagcggccgcgcaggcgcagtgaggggaaatgcgaacttaggctgttacacaactgctggggtctgttctcgctgtccgcccgcccggcagtctgtcagtcgcgtcgctaccgccgctgcctcctccactgtcccgggagtctcgggccggtggctgctgtcgccgtctgttcgtgcttctcaggagcttcgtccgcccgttcaggccgtccctgccgtccgcctctcttcccccgcgctgcctctgagcccgcagcgttcgcacgccggccgacatgagcggggaccatctccacaacgattcccaggtgcgaccagccggcccccgactcgtccccagctgctcgggcccgggccggctccggccccggccagggccccggtcccagccccagccggccgcgccgggttgacaggcccgagtctgcgatgaggggcggccggttggagtcgcttggatggccgggtcccgggcggagccgtcaagttggagtttggtggggggatggcagccccgggtaggccattcgcgggcctctgggttccggggcgccgggtgggcccgagccccggcccccggccgcgcgctctcgtccgccgccccggggcttcatgtgccggttgtttcatcttccctcttttctttcctcagatcgaagcggatttccgattgaatggtgagtgtgccccccgccccgccccaagtgtccccacacgccgctgcctgcctcccccgcgccgggccggagccgggcagaggacagacatggcgtcccagagactaagtcccggctcctcgctcaccggccccattgttcccatcgggccgcctctggaccccctttcccggggtctcagcacccccagatcacggccttctccagagggggcaccggagaccccgcgtcgaccgtcgctgggtctcgggcggcctttctccgccgggattcttcccgggaaagtcgccttgtcgacggtcgggacttagtctctgcgccattttctttttctctctcctctcctttctgtgcctgtgtctttctctccctccctcagctccttccttgagctgtccagaaagagctttctgcagagcagagccatataaatcacagacctcaccaaagaaggaaggcttagggacggaattatcttttattttttcttaatagaactttattttggaagttacttgctttctgcttcatgtttgcttgctttcttcttcttttttaatttttgtgattccagaacgaaagattcccttaggcagctaagggttttatgggttttttttgtttcttttgttttttgtttttagtccttttattttttaaatggtgagatgtttataatagcagttacagttcttgaaactaaagccatcttttgtggagttctttgtattttgggattgttttcccaagttgtgctgtttgcaaagataactccctttaaaaaagttttcaggttgtctgtgtgtcatctagtgtgagtgttggacttgagcatatattctttaaaaaaaattaaaagtattagtgaccagaacttcctattgtggcaaggtagagttttttgttttttgggttatttttgagacacagtttattgtgcttgttccgaaaggttgctgaattgctcatttagacatggtgtgctggccttttctttggggtcatagggagttttaaaaaagattttatttattgaagtagagtggccagccctgactcctgtcttcttcctcattcttctcaggggctgctatttttttcaggaattaagagttaactggctttcctcacatccttaggctcttgagccctttccagtcatgttttcaaaatatttccactaaagttacccagggaagaatgttggtgggtgtctcccaccaccccagtaagaagctcacatttaatggattttccagcaattccattgtagtatgctggaaattcccacagattcttatgggtccgattgtgttcagttagtttgggttctggggaactgagtgggagaagccattgagtaggttttctggtgcagcagtccatggtactggcctgcccaactgaaagccttatgtttatatttccaagttggtcatccaaagagagatgacactgagttagagactctgtctaggtaaagcttttcttgagcacctaatatatgccaggtactgtgctagaattgaacctgtcaccaaccacatctgtctttgttcaactcagcctattgggggagtcacatcagttaattacaaggtaggcgttggagtgtatgtgtacccaaaatgctttgggagcataaagggcttaattttatctgggggtggggaaatttcttggaggtgactgagcagggtgttgtataagactaggtactgagaattgtcaggggttggattatttcttgggagtccatcctatcaggcttttaaacgagggagatgagactgtcaagcatatagataagcttctttggaaagggggtaaagaaaggatgtggtagttgtggatgtaaaatggttttgagctctctgaaggaaggtaggaatttaatatagaaaatttatttgctttttagttgggcctagtatgtaatatatttagcaatgaaacaaaattgagtcctttttcctcttaagtttaacttccattgttcccatctaaatacaaaagagctattgaatctatgcatgattatgggctgggtatgttatctttgcatttttatagagtgaattgaactgcctatgttaacttttaggatgtatttccattttccaacaatgatatttagtatttattgggcacctaactgttcaggcttgaatctcatcttactctttggaaaggacccttaggagttaattacagttatctccatttgagatgaaactgagtgtactcagtgaagccatgaacctagcctctgtgcaaaccggatgatgctggtatgaagaaatgaagtttcctgttttgtatggggcaattaagagggaaagggaaaaattgatagcatgccggttactttttaccaaaatcttgaagaaaaaaagcagttttgtgtacctactaccttaaggttctaatgttgtagtgattgtctttgtggttattgtctggatgttagtgtcagtaactatttgctctatcaagcgtacactgttagctagtgattgataaatataaaagacaatttaaaaaattaaaactagtttttaatacccaggcttcttaattgatctttatagtgagaggatatttacttaaacatggttttaggtgagtctgaacaatcacattcatgaagtaaaaccacatatcccttggtttgcttcctcaaatcttctaagataaaaaagattttctctcctaactggagcggttttgttttgttttgttttaatagtacttaacatttacagccttttgtgggaaatttagaacattctgggtcatactcaactgctgtgaaatgttatttgtgtggtaaatctatatttaagatataagcaatgagctagtcacttcaggagcacagcccatactttgtatttccctttcacctgagtgaaagattccctttgtcagtagcactaatcatagtgagcttgaattattattatagtagtgcacaggatgcctagctgcacagctgttaacattagttgaaggtgctggtaatccttttctgtttcaagaactctaagttcctgtctgttttactggaattatggagctacacaacttcattatattgtaatttgacaatgtgtagattatgagtaggtctaatggatttaatttgaatgaagggaattgttttgattgtaatggttgtacttctgtgcttgctgtgcatgagttatgataggcattgaggaggctcgtgaggctttaagcctgaaaactggtgatctctccaaatgaaatctggaaatctttagatttagtctggacgactaatagaagtattagattccagtggagtctttttaccctttagagccagactccttgagggacatttttgaaattagtaaactgctgatatcttagagcatatcagatctcacaaatttcagcctgtctatttctagtaaaacaagaaaatctagggtttcctaaagaaatcagaaaaaaaaaaaaaaaaaccctcatggtttaaaagacaaatgggatactatttctaagccttgaatctatttttctttggtaagcagatagtgtgggacctggagttggctcccaaatctcatgtcgatcaatagcacaggggcagggaagtagattctttttcctgtcagcataaaaatgatggattttagagtttgaaagatactgatttattctgggtatagtgaagtgtgatagctgtttgtatgagtgacaggaatctttatagttaacctgttttaaggttataccaaagttagaatttataagatttttttttttgttttcagtgtgcgtggcatgggaaagtgaaaaaagtctgctttttaaacttgtaaatatgttagaaaattgtatattatagcagcagttgtcttatgttgattgtgacatggaaaataatttgtgtcattttagaagaccatattggggcatcagtgtataacatatactatagatcttcaataacttttatctaatgatgctgagtaaaattggctttcttcaaagccaaacccagtcattttcccagaagtgtgttgtgatttttctcctatgaaactatgatggactctaatttagaagttcactttgaaatgaattccaagtgtaattactttgaatataggtatagtttaccttgagactacaaaatgctggcaatatttggtgttaaacccagaaagtttatatttatttgttttaaaagaaagaaaaggaaggaaggaaggaaggagggaagaaggagggaagaaagaaagaagaaaaaaacggcttaaaggaatggcatttagaagtgggagtccttgaatgaaattctttcctgtggttttaaattacatgattatgccttgattacttttaatctactaacttgacaaatcaaagtcatttgggcaaacaattgagaattcaccttcttaaggtgtagagtttaggatagaagttccagacttagtcaatggagtactgtgtttaagggaagatttcagattctatttaccttaagtaataaccaggtgtgttgtttctcttttcattctttgtaagtctgaagtatgagaagcaccattctattctgtggcttcagctctagttgaaataggaattctaaaactgaatacattagtttggaagaattagctttttttcaagcaccttctcttcctacctcctcttgactgtctaggtgctggcagtgtgctgggctgataagtgtgggcctgggaactttagaagggaatgaagaaagaagggtggagggaagcactgtggcctaggcttgattaggaaagaaaacgtttaaagcagaaccctatttagatattatagtattttgttactgttagagaaagcatcttagagttgtttaacaagttggcgttgtttaacatggcatctgctcagtatgttctcagacagtagtgttactgttatttggggtagtaattctagattataatagcattgacttagattgcccacatcaatgtgagttaactgttacatatgtctcaattttggtaaggaggcaactttagtttttatttctttttagtaggtactcatttttaattttttgccctgtttttagatacatccacttttctactattctcacctatataccatccctgacactttctgaattcttatatgcttttctaccagaatattttattttattttattttatttttttggtttttcaagacagggtttctctgtatagccctggctgtcctggaactcactttgtagaccaggctggcctggaactcagaaatccgcctgcctctacctcccgagtgctaggattaaaggcgtgcgccaccatgcctggcccttctaccagaatattaatccatattttatttcatttttgttttgtgccaccctgtcctcccacttttaattaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcctttccctctccctccctccccctccccatatccctggctgccctggatttcattatgtagaataaaggtttggctgatctcaaaccttaaactcacagagaactacttgcctcaacctcctgagtgctgagattaaaagcatggaccaccactttcttgaggcttcctattttttctaagagccaagaactagccaacccttgtggatttctgagttcgaggccagcctggtctacaaagtgagttccaggacagccagggctacacagagaaaccctgtaaacctccccctcaagaaaaaaaaaccgcatgttttttcaaagaccccaaaacatttttaagttgcaagactgaagacacctgagaattatttaatccttattaattctgtatctttcttaaagtggccaactcagccgtcttgaaatagggaaatgagtatccacgtaagctcaggcctgtgttcctagcttcttagaaagccgaggcaagaggatgatcaaatgagttccatgtcaacctcggcaatttagtgagaccttgtcctaaaaataaaaagagggaggcagtggtgctttcagacaagactgcagctaccaaagcccaaagcccagaatttaggacagagcacttgcaccatgaatcaaaccatcagctttgctgtcctgctggcagttttggtggtgtgctgagggggaaaaggtgcctgcttggtgatacagagcctttgtctagtatgtgttcagtctgacactgcactgtggggttgcccaagctcatataacacttctagtccagccacaccaacaagcacatcgtcttctcagccagttttaccaacaaggatagggcacctctacatgcaaaactcacctctagccagtctcctgtggtctttaatcagaatatctctgtgctcagagacagctacattgctcagatacaaggatttaagccttctggctcagaataccacatggtggtagcagctgttccttctttcattctcccagatttcatttctctgctcattcactccctttatcccctcatgctttggagggaaacaccctgttcctcataaggtactactgtactacgacatgccataaacattccactcaccctaccactttgttccctgtacaccattggctgatcttgtaatcttccttccagagttgcttctattaaaaatggcagtcagtacaactcaagagtagagcacacacctacaatgtgcaatgctataggtttgatctctagtactacaaaaacaacccctaaattaaagcttatattaatagttgtatgagaggataggtatttgtgagttgtgaaaaagatcatgcagttagaaacttccacagtggctcataagtcttgttaatgctaaatactgaattgtcttgaatttgttatttttaaactaccacttaaaggaaataaaagtcacttaggaatgcttcgctagtatccattagactaaacctaatgagtcttagaataaatcttataccattgatcaagaagatcattataataggcaaagactatatagaattaaggtaggtactggtactaatgtatttccatatcaaattgttgaataagatgaattatctggtcataatcttctggttaagctctataatcctgacatttatttgtacaaagcctagttttattttgtataatttggctgcttaaggatatatcctcccccaacctcaaagctccaaggttggacagtatttgtgcttccttaaggttgtgatatcaaataattcctaatgaggaaggggttctctagagcataggcaatttggaagttactttttctgttacccaggccttaagagctcagttgatggaagtgaaggaggacaagcctgcagaaacagtcttactctaattgagaaggctcgagaaggtacatgttcaggttagattagtctacctcctgggaaaggagaagattgcaatgaagggatatccttgtgaaaatgagtcatactacagagacttatgtaggcaagaataaagcattctgggctggagagatggctcagcggttaagagcgctgactgctcttccaaaggtcccgagttcaaatcacagcaaccccatggtggctcacaaccatccgtaacaagatctgatgccctcttctggtgtgtctgaagacaactacagtgtacttacatataataaatagatctttaaaaaaaaaaagaataaagcattctaactttaagtattgtccttaaaagataagttagtacaaatagtatttgtcttgctcctgaagtagactaatgcttcagtttaatatactctgcaaactcaggttttgacttttaagggacattgttcagaagcagtctacttagtggtagcccacccctgtagattatgctatgtgggaaagatgcttcagcttcatgggtgggtcagacagaattctaggtatggagttaggtaaggcaaagggattctcaattgttattatgcagaggaggtcatatagtagaatgttttggtcccaagtttctagattagcaaaatccagttctgtattgtcctctattgtagctataatatgataataccatatcaggcttttaacaaggtagaaaatatacccctaatataactaccttgatcaagagccctgaggaggaaaggacacaggtatggattatcccttagaaccatagagtaggttttcttgaggtatctttagatgatcagctgagatgagagacccttccttggggtcgtagtttgtcacagtgatttgggggggggggggtttcctaagggaatttttggcttcttaccaaatttttggcatcagtttgtctacaaccacaggtctccttaatttcttctcttgtcattactcatattctctattttcccagtgtgagcaattttcttgagttctctcaccttttgtcacatggtatctaatcccaactgtgacatcccattgtgccacctaatgcatccctttttccatccaagtagatggcactgttttcaagagggctccttggaccatcaaggccatccagtataatgggagtccccagggccatgacaccgccaggctccacagttgtgctccctaagtacacaaaggcatctttggtggtagcagagctcaagtgcagcagctgtacctgctgctttttattgtggtaaaaaatagttatactgaatattgtgtcatgtcggagcatgagagactggctgtaagaactccatctgtgtctgggcacctagctttcactggcatggaactgctcatagttcatgctcagaatttggctagtgtagcctaccaggctggctcatggcagctggtaactggtacagcagatgcccaggaacagctacaatgttgcaagacaccaacatgaaaggtagtgctgcctccctccccaaccctaccttctgtaaatggaattctgagggcttttctttgccctttttgctcccaattaacagcagggcatttgtatgcccaccattgtagtccgttttagcttctgagtataacacagagaactaataaagttattaaactgtaggcactatgctggccatatagtcatctattctaaccctcaatggctgcctacttcccagccacgtggttctttacctgcaatctgagtcttcttaccctggctcgtgcttttccatgtgtgtcctcttggcaactccctgctgatctgcttgccaccagccagtcgtcctgtccttctccaggtctctcttcttcctcttctctcatctctctccctctctttttgggaacccctgactctgatcagaagccccaccttattcacttctgctcagctataggctgaattagattttattaaccaatctgaggtgatagaaaagagtttttacacatctttgagacaggagatgctccaaataccatgacaatgccaacctccagactgctggcaggtccatcagcatctgaatacactgtacaaaactgtacaaaaccccctcccccaacaaccttcggttttgttgaatttaaaatactcacatgtgactgattgctttcttagacagtacaactttgaatgtagatacaacccaagagatttaggtttatattttgcttgaatagatgtttggggctcttgtaacttctccagaaatctgaagaccagtgtgtatagtgtgttaaaatagaatgaattttccacctatatgtttacattactttattttagataatgtgctaatagaacttaccacttagaagttcagatagatcatggttttacttgaccacctcccacccccagtgccaaacaacagaaaatttaaagtcctttagatagaataagttcttattttatctcagtgtccctaagaagtagttaatgtctatatttggcaaagtaggttggcttaaatttacacaatttcatggatcagtattctttaaaatgattaactgtttgcttataacttcatttgaaagtctaaatttcgcttgggcgtggtggcgcacgcctttaatcccagcactcaggaggcagaggcaggcggatttctgagttcgaggccagcctggtctacagagtgagttccaggacagccagggctgcacagagaaaccctgtctcggaaaaaaaaaaaagaaagaaaagaaaaaaaggaagtcttaagtttctagcatgttacctatatcaagtttgcagttacattaagttgcagttaataatgtaaacactacatatacataaattatagagaatctggtacatttacttttacgtaagagcagattagaactattctttcctgtatggccgtcagggttgttttctcacgtgcatgcctatgttgagtatgtgctacagcttataaataattgcgttcacaattagctaagacatattaatctactgagacaaaatgatatagccttggctgctgagaccactgacaatagatatttaagatcttaacaacttgagtaaattatgtagagaccagaaatagaaccagtttcctctcagtttagctttgaatattatcaggtttttggataatagagtaggaaatgcttagaggtgaaatgaatagcagaaatgtaatcaattactattactctagcaatgtctaaaaggctctgtaatttcacctgtcactattttccactttagaaatttaggctcagatgttaattagctcacagttgtgtaatttttaactaaactctaaagcaaggagtttaatccactgtttgattgatgccacagattgagttaaatgtgaaacagaatgaggtgaaggggtgcctgagtgacacccccaggacatcatgggagtagttaaatatccatcagactgtggttctgtttgtgatggatcttaagtcgattgataatggctttttaatgttttatcagcatttatgtctgtgtgtccctgaactggtgttacagacaggtgtgagctgccgtgtgggtgctagaaattgaactggggtgggtgtgggttggggagtggtggtggctgtggttccctgaaagagcagccagcactctgctgagtcatctcttcagcttcagccctatctctccttttttttttttttttttttggtttttttttttttttttgagacagggtttctctgtgtagctctggctgtcccggaactcactttgtagaccaggctggcctcgaactcagaaatccgactgcctctgcctcccaagtgctgggattaaaggcgtgcgccaccacgccccggggctcttcctttttttaaagacaggttcttgctatgtagctctgtcgtggaactcactccaggcgaaataatagcattgcctgcctttgcggtttttaaaggcttgtaccaccactcctggattatttgtttattttatagtactgaggattgaatctccagggctttacccacatttgctatacaagtactcggctcctgacccacatccccagcccaggatttgcttcagagtgaattcttttttttttttttggcttttcgagacagggtttttctttatagccctggttgtcctggaactcactctgtagaccaggctggcctggaactcagagatcctcctgactctgcctcccgagtgctgggattaaaggtgtgcgccaccacacccggctcagagtgaattcttttttcctctcctttgcaatttcagaattcttaagaagagattttagtcaggaactccttgtgtcttctgacttagaaagatttattaattatgttctagaattttgaattctcaatgagaactattgtaaaataactgcttttgtatagatttacttaaattagccactgttaagatggacctaacactgagagtaaactaacacttttattaaagtatgaattgagacagttggaaagagggagtggaattttttcactgttcttaacttccaatgacaataagctttcaggcttgttagttcctgggggggagattcatggagagtcctagtacatgggcacacttggatgttgggctttatcaccagaggccagtttgttatctgtcctaaacaaaaacagaattttaaagcattagaaagtacaagtgcataatattaagtatgttgattttgtataaactccagctttggggatgtggttctaagaccaagatgcagggtttcagtaagctttataataatgtcttcttttttcttttgtctttctttcttccttttttttttttggtttctttttcgagacagggcttctctgtgtagccatggctgtcctggaactcactctgtagaccaggctggcctcgaactcagaaatccacctgcctctgcctcccgagtgctgggattaaagtcgtgcgccaccacactcggctatgttttcttttaaaaaattaagttaattagtccattctgatagatggtttattgttatgttattttgtggttctggaaagcaaacctaagtccttgtacatgggaggcaaatcctgtagcactgagctacattctaagccagtggtccgcagcctttctaatgccctgatcctttactcaggatgtggtgaccccgatcaaaacattattttcattgctactttataattgtaattttgctttttcaaatttataatttattgtaaaatatctgatatgtaacccttataaaaggattgttcaatctccgaaggagtcatgacccacagattgagaaccactgctaaagctcttgtttttatgattttatgatgaatttttttggagaaaagttcttgctatgtagccccagctagcctggaatacattatgtagatgagtgaagctggcctccaactcaccgagatctccttaaaggaggattaaaggcatgtgccaccaagcacagtgtattgtctttttttgagacaaggcattgttaaatattataggctggcctccagtgcccagtcagtctacttgcctctgcctccttagattacatttaagggctatcacaagtagttccagtgttcattttgtgaactggttgtatatttgtatgtctgagaggaatagagattttctatgacaaaagttgtactgtgtgtgtaccttcttggggaagacagctttggatagtatatataactccttcctcctacactgtttacacctgtaaatactatatttgaaggaggaaagtcatactgtcatatagctgttataataaaatctcaaagtctatcaagaaaagttggtgtaaagagtctggcttcaaacatggctcagagctccctttgtaccagaaagttctttctgcctttgtttttatggaaggaaggaaaggactctttcttatagcttgatttggttactttaaaatcttggagattgtgaaacagttctataattgttaatgtttgttaattctttagtgtatcttctccacgagatggaattgtctcctaggcaaatgcagtaccattgagcctgggtcactcccccagcccgtttcctcttagaaagtgtaagtgtgtttggattgtcttttgattgcatttaaagaaaaatagacttgtctattttgttaggtggccacctactaaataatgcaaacatgaataatgcaaacagcagaaaaaagagacccccccacctcaaggtagaagagaaccaactcctgaaagatattctctcatttctaaagactttcaagcttgtaggggtgattctcctatctatgccaccagtgttgagattataggtgcctgccacctcatctggcattttatatgggttctctagttgtggactagcattatgacatgctgagccatctccctggaccagcctggaaattcctcagacttctaagtacaggattgttagagaaggccaaaaaaagtacaggattgttagagaaggccaaaattgtattagtttgtctttgtcagaatctctaagtataggggaataaaaccccaaacatcttttatccaatgttgccttatcaggcaaggtacctagggcatggttcctgctttgagtgtgtatatgtatgtatgtatatatgtgtgtgtgtgtgtgtgtgtgtgtgtgtgtgtgtatatatatatatatatatatatatatatatatatccaaagcttttaccttgtatgcaatgactaagtttaattcagttctatataaattaataatgaagataattaaataatgattgcatttcctaggcagttgtcagtatgtttgtaatttgttagaaattagccaggaattctgttgaaactattctgttgattagcttaccaaaacaaaacaaaacaaaaacaaaaaacccagtttttctgaatcccagcttttgtttcctctaacaaagaggaacatttttactaaggacacagatatcaagtttataatgagcagagatgtaaagctcctgagacctttcccatgctgccttttgagtggtgctgctgagacagggtttccctttagctgtagagcaaatctgttttatctgtgtgtggtagagtttaattatgattgttcatattctgtctcattcttttgaaggagtaggttctttagcttctgagcagttaaaggggctacaggtattctctgtctcattcatcttttttttttttttttggcttttccagacagggtttctctgtagccctggcccctggctgtcctggaactcttttgtagaccaggctgggccttgaactcagaaatctgcctgcctctgcctcccgagtgctgggattaaaggcgtgcgtcaccacgcctggtttaaactttttttaaaaaatatgttcccgataagaaatcaacttcatttnnnnnnnnnnnnnnnnnnnncactgccaaaagtacattttacttaattttgatcagtcatgagtggatgaaattttcagcaatgataatagtggctagctgctgttgctcattgtccctcctctcctgctccttgctctctgacccccgactacccttccctcccacaccctccagctctcccacctccagccccccaaaacaagaacagggtttctctgtagctctggcaacactggagctccctctgtagatcggtctggcctagaagtaagagatcttcctgcctctgattcctgagctctgagattaaaggtatgcttcaccactgcacaggttgttgcttatttctggctgtagttaggccatctgccagagtgcttgattcttaatttcctcagctcctagtaaaagtagcccaaactgcttttttcaccttagctcaatctctaaaacccacttcataaaagaatagaagtaatttacaagcacaagtaaatgtaggaaaatagcagtagcaagacatttatagcattattaatacaattattctttgaaggatggtaatatagaaattcggttataattcttcagaatagtcttaatttcctcattgtttttcttaatccttttttgtgtacttagtgttagtctgccttttgattggttccctttatctgtcacttgtttttcctcttagtaaacttgctgtccattcttcctttttctaactctagagtctagaggtagataccttgaaggtatgttatgtcttcagggtaaattcctaggcactgctgggtcagaggagggattgagctagttatttcattagacattgtggaattctcctgcctcaagaattatattttccaactaggtatatcttatttaaaaaaatataaagcaaaatgcatatttagtaaggaatagctattacctttggtgaaatgtgtatatttccttttcattaaaatggccacatgttaagagtctgcatgttgctggctcttgttttaatgtccatttgtcttgagtgtcttgtgtaatggctatttaagtccatatattcatttacatgattggattataaaggacagagcccttgtctgatcagtctttagtaaggtgctttgaacttgagaaatataatgtttgtaaattaaatagcccttatagtataatcctgcagctgctaatacaaggatgacttttgttgtgtgcattaaccattgaatcctgtgtaatgctaactagaaattgctcctacagtgagaaaaagatggaggatcttcatcatttggtagtttgttttctgctttatttttaaatgtgtgtatatctgtgcccttggaatccagagatgaaattataggtacttgtgagttcacccaacattaagtgctaggaactgaactcaggacctggaaatttatttacttaaaagcccttttaattttaaggaggaatactttggataataataacaaaaagatgttgatttttctagtgttttctatttattcatttacttatgcgtttttctggaataattttatttaaatgacaccaaaaaatttgttgcacatttctgtcttcaaagactttagctagcattcttcctgtggtttcatctagagttttcttttttcttttttatctttcatattttatttgcattgatgttttgcctgcatgtatgtatgtctatgtgagagtgacagatcttggagttacatttatagctgctatgtgggtggtgggatttgaaactgggtccttcgggaagagtcagtatatttaactactactgagccatctctccacccaccatccagagttttcaaatgttaagaattgaaacaattattgttttgtatgtgagattgtgtatgggttcaagcagaatgtcttaagaggcataggatatttagtgaataagattttatggttagccaggtgtggtggcccacgcctttaaacccagtcagtgcttgggaggcagaggcaggtggatttctgagttccgaggccagcctggtctacatagtgagttccaggacagccaagactgttacacagaaatacctgttagtgagtttctttaaaaacccagttgtgttatgtggatttttatggtgctatagtacacagtggttggcatgtttcatttcttagctatcaagttttttacagttctttttgcatttgatagatacttcgagtgtcacaaatgtttttacaaatattttaacaatatctactttttgacaaattccaggaggtatacttaatctttaaagccactaatgtattctctataaacaagtattttcagcatgcatgatagagttctgtgtgcttttactgggttttaccttttacttactgcctcttcctttgtactgtctaggtcaggggtcccactactgccttatatactttagacaaataaagtctttgctttctgttttactagggcctctggttcttccagctactaggacctcaagaatatcccttaccttccctcctcctctatactctttttcacaataagttcttagaactgggttcaacttctattttcttgaaaaatttcccattgttcttaatcttaatcttttgctattactgtcttctggtttctggttttttttttgtctttgtttttgtttttgttttttgttttttgtttttcctttaagtatgatttttggtcttttacaaattgaagtagctgtcatcctagagtagaacattctgacccagggttaactattaaaatttatcttttggcacctactgtggtggcaaaggtctgttttcccagtgtacttaggaggtgggggcagggggatcttgagttctatagacagcttagcaagcccttgtttcaaaaacccaagggctgggaatattcaaaaggaaccagtttccagtgtagaacaggactttggatttgaccccctagccccaattccaaacaaaattgtttttttttttcctcaatagattctctcttgaattacacttattttcttcttttacataataaggaaaaataaagaatggaaaggaaaatgcttagagctcatgttcattatctaaatgtaaaaagttccaaggatacacatgtgtaactgcagtttgatttcctgtgtacccatcataactttaatagctagcaatcttttgctagtgttttatatatctttataattcttgattctaactctaatttactcagaaatattttttaagtacttttaaagatttcttttttcttttgagacatgggttctctgtgtagtcctggctgtccttgaactcaatctgtagacccaggcgggcctcaaactctacctgcttctgccctaagtgctgggcctaaaggtgtgatccaccactgttggtaaaggtttttttttttttttttttttttttttttttggttttggttttggtttttcgagatagggtttctctgtgtggccctggctgtcctggaattcactttgtagaccaggctggcctcaaaactcaaaaatctgcctgcctctgcctccccagtgctgggattaaaggcgtgtgccaccacacccagcaggggtaaaggttttaatctatcagtttacctactagtagtatacagggcatctatacagttaagttagtagattattaagttttttaaatgttaaatgattgtttaacaactttctttgtggcaatgctacttgtatagtgatttaaatctattgtatcatttttcctcagatatccaagcctgccatgtagaacttaactgtattgatttatagagctcaacagacattcatatctcttattacacttacattgatttgtatgtagaggttggtgggcagacagggttatggaacacatgttctggtcagaagacaatccatggaagtcatttttctgctgtgtagattcctggggattgcacataattgtcatgtttggcatcagggacttttccagcctgagctggaaaagccatagagatttcaattaagaactttgtcttctttgttttctgctttgttttgtttttaatttaaaatctctcacagcatctgtagcacagtttgaggatatactagatatgtaatgactttgagttcatattattggcctagatgttttgtccatggaattatttaccagcaaccctaattttctctgagatagttaatttttacatttttagatagcatttgttttcaaaggcttgggacccggttttaaattccattttgaaaatttatgcatttcaggaagataataatgtgaaatctaataggaactactctgaatttgtattttaaagtttagtgctttttagtgacttttgcatgtttgtatttgacaaaaataaatttgtttgtttatttagacagggtctctctgtaaccctggttgtcctggaactctctgtgtagaccaggctggccttgaactcaatctgtctgcctttgtctcctgagtgctgggattaaaggcgtgtactaccaggtctggcttcaaattttaaagtttgctaatctctaactttattataaaagtcgttcattatggaaaataagatgaagcacacttaagaactcaagttcacaaatttctaaattttaaaattactacattctttttaaaatgtatgtcttccagtcttttttgtatgtggtcatggatttattgaattacatacagtggtgctcattttctctccttttcagataatttccttgtcatgcctttgaaccaaagcagtagatcttaacgttcaatattctgaagcccatttactgatttctaactataaacaaaacaacacatgctttatttcaggttgtagtcctggtgcatgcatgcattgtcatttttatgccatgaggtaaaagtcaccagttttatcctgattgactcagcatgttaagactttagactggagacttagaagtcagagggtcctgtacactgcatgggagatttgagttcagtcttctaacactatatgctttacttactattctcatctctgtgggatggaaagttcttagaaccagggccttgatcttgcaagtattagtgtttctctttccttgggatctgtctagaatagacatgcagttatgccaaatagcacttcagttgcttcagatcagcaatacttaatttatatataatcttattgctgtgaaacatgctacttcaaatttagttgatataggttggttataagtgtcaaatacattacattcgttagtctggttgaatgtaagaaagaattcatttaaaaaaaaaagtttttcgggctggcgagatggctcagtggttaagagcgccgattgctcttccgaaggtcccgagttcaaatcccagcaaccatatggtggctcacaaccatctgtaacgaaatctgatgccctcttctggagtatctgaggacagctacagtgtacttacatataataaataaataaatctttaaaaaaaaataattaaaaaaaaaaaaagtttttcataaaaatcgcatgtcacctagagtaacagtcatctgaaggctaaattgggctgtggcatattcacttccaagataatttcttcacgtggctattagaaggaagtatcagttcctcaccacatgtttcttgagtgctgctagtttggtagctgatttctcactagaacaaggagagcaaatgggaagttgcagtgcctttgtgagctaatgttgggtgctgtactgccatttacttgtgcaagtgcaagagacggacggtgcatgtgcatttgcaggtcaacatcagatgtctatcaggcttgctctgccttatttttaaaagatgtatcttattacttgtccatgtgtatgtatgagtatagatggccctggaggccaggagagggtgttagatctcaaggggctagaattacaggaggttgtgagttgcccctaacatggatgctatgaactgacccctctgttatctatctcagcaagtactcttaactactgaaacttttctccagcctcttttcacctttttttttttttttttttttttttttagataaaatatttattgaactggcgcttccagagatctgtctctgtttccccagaactgtgatatagataggtacacagcaataagccaaaatcagagatacatatagcactgtttccctcctgtattcttaaaaaggcaccacagtaaatgagaatagaaagggaatcagtgggagtggggataagtgtgagtaatggaggggatattatcaaagtactttatatgtttaaatattttcataaggcttaggatgtagctttgtggaactgggtgggggtgagaatgggggcgagcaactgatgttttggtaagcaaaactcaaatcaagagaaaattgattaaataaaattttactaaattttaaaagaggctctttgaaaaacacctttaggatttatttatttatgaatgaatgactggtcatagtgactacagggataacttagcagttaggagcactggctgttcttccagagaatggggtgttgatttccaacacccacatggaggctcacgaccatatacagctccagttctagagaatctaatgtcctcttctggcttcccaggcattgcatacacatggtacacagacatccatataagcaaaatacccatatatataaatctctctctgtttttttaaaagcctgttcacttttatactttctaacacttgagtctttgaggttggaagatatgtatccaaaatagcaagccatagtatcataatatatgtggccaaaaatagcaatccagaagtatataaagaacttacagaggcaggtggatctctgtgagtccaaggatagcctggtctagacagagaaaccctgtcctgaaaaaccagggggtagggggaagaacatatacagctcagtaatacaatgtacagtcaaacaagcaaatactgtagtgaacttgcaatagttatttaaaggatgtgaatagtcaataagcacaaatagttttcattaaatatttaatcactagaagaaaattaggaattaaattcataatgagggtgctggctggttaagagcacttgctcttgtagaggacctaggtttggctctaacattttcagttccagagaatccaatactcttatggcctccacagggacccagcacacagggcatttacatacatgcaggcaaaacattcatgggtaaaatttttaaaaataattaaaaaaacacagcaggctaattatatatatatatatattatgtatatataaataaataaaacatccccaaccaaagcaaattttgcaaaagaaagcatttaactggggacttgcttacagtttcatcagaggtttagtccgttatcatgtttaggagcatggcagcaggaggtaggcatggagctagagagtagctgagagctatattccgattctggcctactgtccaagaggctcctgggcctgcttttggcttttgaaacctcaaagcccactcctagtgataaactttcactaataaagatacaagtttcaaacagtgccactacgatactatgggggtgggggtggggtcattcttactcaaatcaccataatataccttttagaagagcaaaaattaagacagtaaaggctgttagccaggcattgtaatgtactcaggaagcagaggtaggtggggctctcagattgaggccagcctgatgtacatagagaattacatgctcaccagagctgcatagcaagagtttgccttaaagaaaaacaaacaaacaaagccaacactggtaattctagatgttgctaatgatttgtagtagcttggaactcttaataatattcatggaaatatatgagagtatgccacttaggaatatatagttgagcagtttccaataaagttaaaagtgaattttttatatgatctagcagttttacttcatttagaagcaaaggttcatcaacatgtgagttgtaaattacagtacttccatgtaatggttttcactcagcaggaaatgaagccatggaggcagcttagtgggacagtgcttgcttattatttataagttactggatttgaggcaaggcaatgggatgtctttgtgaagtctccttaccagtaggatgtgcttttatggtcactttgccctttgactgacttctgtttctaaagttgtttgttaaggcaggtaggcaaatgatgccttatgattccttgtgattgacttgtctcttatgattgcagattctcacaaacacaaagataaacacaaagatcgagaacaccggcataaggagcacaagaaggataaggataaggaccgggaaaagtctaagcatagcaacaggtaagaattgaccaacagcggggagggtatagggaactttcgggatagcatttgaaatgtaaataaagaaaatatctaataaagataaataaataattaaaaaagaattgatcaatagggagttagcatccttggtgtccatggataggtatcagcttgaggtgagtagcaaagtaagagactatatctgttgtagttactgaagagactcctttaagaattaatgcctcacttggtaagtttagatctagatgtacagagaagcacagtgagtcttctttcaatatgcatttctttctttttttttttttttggtttttcgagacagggtttctctgtgtagtcctggctgtcctgaaactcactctgtagaccaggctggcctcgaactcagaaatccgcctgcctctgcctcccgagtgctaggattaaaggcgtgtgccaccacgcccagcaatgccattgtttcttaaagctatatttatatttaaaatttatattttaaaactgctttattggtttgtcttattgtcagcagacaagttaaagagaaaattcctatccttttttaataattgtgttttgttttaccattttttgagacttgttttctttttatatccttggctgtcctggagctagctctgtagatttgagtgctaggattaaaggtgtgtgccaccaccacccagccagtaataaattttttgagtcattaaaaaactagtttaattttctcttaggatatttcttctcaaattatgtgctcctcctgttttttcccatcacatagtcatttcttacaacttagtttatgttttattcttaatattgttttttcccatctcgtagtcatttcttacaacttagtttatgttttattcttaatattaatctcagcacttgagtcaagttttgctttttatgcacccttcttctcaatctacatttgtctatctaacactaccaaaagagacttgagagcaaagaacactgccaacaataaagaaacccatttcatgataatacaaaggacattaaaaatgtttctatagtatcatcagagcctcaaaatatgcacacacagaaactattagaattttgaagagaattcatgattgtagttaatgattttattcttttgttttcaataattgttattcgtgcatgtaagaaatttccaaggctaagggagggttaaataacagaaaacagtatctgagcatggttgactaacacctgtatgtaaccttagcattctgagcctgagcacggtggataaccagaagattgaggccagatctaggctacatggtgcaagacactaacttacagaaacaaacaaacaaacaaacaaacaaaaaagtgtagtgttgcacaacttgacttaattgacatttacagaatagtgacaccaaaatcttaggactgtgttcaagtaggtgctgagataactcgtgcttttagctagtctctcttaaaatcatcccttttacttctccatgcttttgtgtgtgtgtgtgtggtgtgtgtgtgtgtgtgtgcgcgcgcgcgcgcgcgcgtgcatgcatgttttcatttccttctaatgtgcatagtgcttatctaggaggctttggttgccttcctctgctgaatttcccttgtcatttgcctttacctcacactgttaattgagcattgtaaacttcttttaaatttcttagatacgacatgtttctgataaaccactaggccttaaaatatgctatggctattgtagagtactcttactcttcactccttattccccttctcctattagagattgaacgtagggccttaaatgctagtcaacaataccacaatatccctgacccttttttagattgatagagattgggtcccaccaccttgcccaggcttgttggttcttgttccataggcccaggcaggcctggaaactacttcatcttcccaagcactactgtacctggactttcttgttgctttcttaatattcttttagtaataactttctaactatgtcatattactaatttctgtggtctcctgaatatattatttccatagtaattaccaggtttggctgttaggaataatactgctatgaacattgatatttgaacacacatttgaagttctgttctcaattccttcaggtgtgtacatctaagagtggaggtattggaccatgtcagtcgttgctttctttttccttttgaggtactggggattggactgaggtgattgaacatggccaacattctacagctgagctacatctgtaacccttaacccgttttaccctgcttgttatgatggcctagcttatgtataatgcaatagaaaaacaaagaggtttcgatttgttgggttttttttaacttattttttcctctttaccatgaagaagctttatcatcagtagtgatcagagacatgtttttacaggtctgatcaagacatgctgattttaatgttattaggaatttattttgaaaatatttaaaagaaagattaatatttaaaacaagcttttccaaaatgatttcatgttctcttacatatttcaccaaccacaatttatgattataatgagcgagagggacagcataaagcaaaagtgtatctaaggacctagggactagtttcttgtactgttttactgaaatcttttcttaaaactggtattttattgtcagaactattacaataattcaatagcctctgtcttgggcgtcctggcctgtccactaatgtgttctatgactttcactaggtcacccaaaaccctttttctccagtgcttcacaggagggcccaggagtcaataaatgtaaagatcttatgaagtgctctacaaatgtgaaaatatattttgtccatttttcataattacagttttgagtgagtaagcacacacagatttaggcagctttttgttatgctttgctttttgacagtgtctaaaaatgtcttaaatgccagcttatgttacttcctttttctttggattccaagtctctcaaacttgtcacgaaaagcactaatcacattaaattctaactttaggaaaacttcatccccgactgtctactatttggcatctgacgttgcatggtttacactaatcaaatgaaataattacttatatatttttaattagatttatcttatgggtattttttatgtatgtgtaccttcatgtatgtatgtgtaccacatgtatgcctggtaccctcaaagatcagaagaggacatcaagtaccctggaattggagtcatgtggatggttttgaaccactatgtggatgctaggaactgaacccaggccctctgcaagagcagcaagtactcagctttgccatctccatagtcctcattttttgataatgtagctatagttatatgttggtgacttacatgaatttggcataagttttagtcatttggaaagagggaacctcaattgggaaactgaaaaactgcttccctaagatcggcctataggccattcgtggtggtacacacctttaatcccagtacttgggaggcagaggcaggtggatttctgagttcgaggccagcctggtctacaaagtgagttccaggacagccagagctacacagaaaaaccctgtctcaaccccccccccccccaaaaaaaagatcggcctataggcaagaggtgggggggggggttgttctagattaatggttgatgttagaaggctcaatctactgtggctgaggtggtagttgtataagaaggctggctgggcgacccatgcagagtaagccagtaagcagcattcctttatggcttcatggcttctgccttcagtgcgatgtgacccgggacatgtaagccaaataaaccattttctccccaagttccttttgatcagtgttttatcagaacaatagaaagtagtaatattttacagatcagatatttaaaaatacactttgaaataaaaggactgtttttctaggtctcaaggcattactgggcttgtagtgtgaccaggtagctctcttaatcattcttaatcagattttctttaatttgtaatattgaaaagcactataaaacaaaaggtcaagttctgccactcacaaactgtatcctaatctaagcatcttaccttttttgcctccttttcatttttgattgatttcctgctaagtaatttagataatgatggtgatgatgacaattataacaaaacctaataaaagatcatgtagataaattgcaactgtcagtttttgtagtggaatctaactcagtagttaattattgataaatctgatttggaactaggactttttagttatttctagctttatagttgagtactatcattgcttttaagatttcatggtggaggcaacctttttgtttgtttttgcagatgttggttatcaaacttgttgattctggctctttttttttaaaaaaaaaatctttttattcatttaatgtatatgagtacactgttgcaatcttcagacacaccagaagagagcatcagatactattacagatggttgtgagccatcatgtgattgctgggatttgaactcaggacctctgaaagagcagtcagtgctcttaactactgagccatctctccagcccccaacctttttgtttttttaagaccgggtttctctgtgtagctctggctgttctaaaactagttctataggccaggctgaccagcaactcagataccctcctgtttctgcctctcaagtgctgggattgaagacatatatcaccacacccagctcatggagacaacatatgaagctagccactgaaaatagttacgatcacagaaggatgaaaggataatggctaaaaaaagaggtatctggtgggtacagtggtacttgacttgggaggttatggcagaagggtgaccaagttccaagccaaactgagctataactgtctcaaatataattaaaggagcctttcagatgataagaaaagcatgaagaggttaaggaatgtagctccgtgttagtgtgtaccccgtagaatatacaagccctatgttttattcccaatatcacaagaaacaaaacatacacaagacatgttactgttgtagcatgcattttgtttcagaatggatccaattaagtggatactttagttacaaagtgtaggacagaaatgaggtctaaaatgttgtcttgagataaactactgctgaaaactgttttaattcaagaaattgctttaatttaaagaagagctttagtttttaaagggaggaagaagctactggaaacagttcagaaaggggaatttataatacagaaatggttcttgttttggacaattgggcagctttttataataagataggtagccacaaaaggctgagctgtaaaccagaatataacgtataaattagaacttcgagaaggaatagaggtttagaaagtgcactggtttgggcatctttggaaacatcctttttttttttttttttggaaacatccttttatcttttccagtccgcaaacgaaggaataagttattctatttgacttttctgtaattgcacacaattttccttcctgggcacaagatgcaatgattttttttcagacagcaagttcaaactaacctaatagaaaattcctcgtgataaacactaaatgagttttgtttgtttatttgtcttgaaatagttacccaggctggatttaattaagatcttatggattatacttatgaatgtaagtttaaaatgttatgactttctgagcacccttaggaaatacaaccctgggacttaattcatctctctgacttctatattcaaaatacatacattcttatccgtttgtcaatcataattgaaagttgtgttcaatttacctttatttaatgccttcagagtgagagtgtggtgattcagcaattgggatataccaaaaagcgggcagtaaggtgtttcttgtaagtggaaagcaaaagttctcaaagaagagcgtgaatggttgtgttgaactccagaaaatgatggctgtgtattaattccttatacccaatttataggccaaaatttatagtagatatgtttgtataaggaaatcaacccccacccggacctccaccccaaccctgcccttgtatatagagttgggtactatctggtgtcaggaattcactacatccaaggtgggcaagtgtccttgtgattttgcttagtagcctaatgatgatggacattcagcagccgctatgctttagagccttttgaaaactagctgctgtactattgtctgggagacaacttaaagttacccggaattcttttatttaaagcatttaagctttattttgatgcctgctttccttgtaaacacattaatttctttccttctgtattgttaaagcctactcattctcttataggagtgcctgagatgccattgtctgtcaccctgtctgctgctttgcatagttggcaaatattagtggctaagttctcttctcagaagatgagcagattctacctaatagtgtttggtttttgtttgctttgtttgggaagaatagaatagaatagaagtaatagaatggttaatttcatgactggagacaaactgcctgagttgaactcctcattttccctggacaagttacttaagcattctgtgcttttaatttccagatgtgcaaagtttagataccagtattcatttcagggttttgttgtagcaagatgtgtataatattaggtggtaatatcgttgctatttgctaaatactttaattgaccataaagtaaactttaaattttgatggcttcccatagccaacatctagccttcctgagtatcagactctgagttttgcaggagtactactactctctatattttttttctaaagattaattacttttctagtgcaaaagaggaatgctttattttcccattttactgccatccctcacttgtcctttctcatgccttccttctgcttaaggtctttaaagaaaccctgccatttttttctttagtttgtttagcttctatgagaatcatagaccagaagtttcataattgtcacctaagaaatagcatggctattttctcccaccatctttatcattagtttcttctcctcctcctcttcctctaactcttcctcctcttcctcttcttcctcccccctcccttcttcatgatcatcatcattaaaattcagttgtttgaagtataagtcaagcatgcacattatgaaaaaaaggttttaagaatttttattatccttcttttaaaaattattcttagagattttgaagacatcattatctatcacctctttgtctttctttctgcgctctcttctgaagtgaccctgagattttaaaggaggggggtgcgtgtgttgcgtgtattccatttagggctatggatattgtctatttactttcttaaacatgacttgcttattcaaccggtgtggtacagtcttacagagaaacatgagtattgaatcaaggagtcaacctctgttcatagccattcattaggatttttttttctttcagagtgcctcatatctgtggtgttaattttatatttcatccaaaagtgtaaccattacagaatatccatgtaggtcctgagcactatgtttttcaagttccttcctatgcttgttcctaagcatttcttttatgtatttaatttctagaagtcttttcattggtaaagttggccactctctagcctctgttgtagcctttggttgttaaaactagctttgtgactttgacatactgtctattgctgaaaaagtggcaagatctcctgcccaggtggtgcatgcctttaatcccagccagcacaaaggaggcagaagtaggtggatgcctgactttgatatcagcctggtttacatagtgagtttcaggacagcagagttatggggagaaaccctgtcttaatacccaactgtaaattatctgagtttaactagttcaaaatacaaacctagtttatgatattccaaacagatgggtataaaggagacttagtctgtttaaaaaataaggttgacatttcatccgttttactgttattggtacacaagaggattaatactccaggaggatctttgagttttctacatagattctcattaggctccctcttcagaggaagtaacaatttgtgtgttttgttttattaccctagagtagtcttgatataccattactacttactgattcttttagtttggtgttctaatgaataacaaaactgaaatctagagactcaggtttgcatcctctgattgccaaaaggtcatttttccactaaggcagattagttttctaataattttcattaagaaagagaattgagaagagtagtgtaataactaaaggaagacagagcctgaagcactctaattagccatttatattttcataagaagtaatcacaaaggtttgatcttttcaagtatttagaaaatacctacttggtggcaagatatgtcaaatcttagacttaagtacaacaccatttatatctgaggttgaagaggtggttcagcagtttagagtacttactacttttcaagagtaccccattacagtcacttgcacccacatgccagctcacagcttactctagtcccaggggatctgacaccctctgtcttcctcaaataccaggtgtgcatgtggtacagacatacatgcaggcaaaacacccacatacaataaacaaatatttttaaaaacgatttaagtggaaatgtaataacaatgtacaggttttctaaacttctaaatggaaatactaagtttaatcctagcattgtcctctataacagaatttgcattagttttttgtcttgtttttttgagacagggtttctctgtatagccgtggctgtactggaactcactctgtagaccaggctggccttgaacttagaaatctgcctctgcctctgcctctgcctcctctgcctcctctgcctcatgctgggattaaaggcgtatgccaccactgcctccttccttccttccttccttccttacttccttccttccttccttcctttctttctttctgatttatttattaattttatttatgtgatgagtacactgtaactgtcttcagacacaccgaagagagcagcatcagatctcattacagatggttgtgagccaccatgtggttgctgggaattgagctcaggacctctggaagagcagtcagtgtgcatcagttttttaagtgaccatttcttctgtatatacatttgtctaaaagaaaataaaacctcttagaattattacagaattgagtaaaataagggttgtaagaccaagtacagccagtcaggtgtggcttacacctttaatctcccaacaggggccagcaggtccctgtgagtttaagaacagcctggtctacatagtgagttataggctagccaggctgcatattaagacccaatctcaaagacaagccaaaaacccaaagcacacacaccatgcacacatgctacacacactagtctgtacataatactttctcaacatcaaaaaacaagtgcaatgctgtaaggatgttgtaaggagaagatgtgttcatcatcaaaatgcctgcgattgtttctggagtttatttttatgtaaaatttgtgtaggagactaagggtttttgttgttgttgttgttgttataggtttctataactattactatagtacctttataatagaagctaaacatggtaatatcaaaaccatgcatattatcatgtgtatgatatatagtgagtctagttttagtctttgcactatataaaggatttttttatactgatagaaacacatcatgaaaacacaatgagtggaatgatgtactgttggtaaaatgtggtctctgtgtgtgccattagcattctgtgtgccattcagccttaatgagtggaaggtttgctgtggaaacttgccctttaatgtatagctcatataagtaacagctaacgagtgctggaggagaatggaaatgagggagtatgtaaacaatgcaaagtgggccctccttccctcccatctgtgatagtgctggaatcctcctaaacctgtagtcctgtatctgctagtctttaccttctggttaattttctaagaatttgtttttttgaggcagggtttctctgtgtggcccttggctgtcctagaactaactctgtagacccggctggcctcgaactcacatttgcctgcctctgcccaccaagtgttgggatcaaaggtgtgcactaccactgctcagcttcagtttgtgtttataacccagatgcctgtcttagttatggctacttttgtgcatagaagtgagtgtaacagtaggcgatttgatatgtattctgttgcttggcttaattaaatgccattgctttttgtcttgtttttaatcttctttatagacaaacaccttttttaggaaagtgtttaaaggaaaattcttgggtctcttgagatcattgccagtgaggccagctttttctgctctgagtcaaacaagtggcaaatgagctgtgacaaatcttatagtcctgactgtttctattgtttgggcttacagttagcaattctgcacctgtgatgaacccctaattcagaccacttgagcttgagttctgttttgcttagctgtggaataatccagcagggagcaggtgccttaacaccaaagaaaatgactatccacattgttctgcaacatgtggtttttgctgctagtctcttgtctttatctacatttacagtcaaaggtattttgtatagtcttgttgggatctgtcagtagtattctggatgtgtacttaaaataacaaatattccttaatagttatcttatttcatataacacagtttcctctctggttaatcatttagattgcatccattttctcattttctttttccctttggatactatagtaagtaccaaaataaacatcttccctaagagacatttctagaagatcttatatgaacatgtatgatcattttaatgactcttgccttgtgatgtaatatcttgctttccaaaatagaaaaatgtacttttacggggctactaatatgacacatacctctttcaaataagacttagaaatatgatgaacatagaccttgtccttgctttcaggtgggtcttattgtgaggaagaggcctgcaggatctacaaacttcatctgtttcttcgtagttagtgagaaagcttttagtgtgttgggccattcagtttacaatgttttgtcctgagtctggcacagtcaacaaatacttttttgggtaatttggattgagtcctcttacagcagttgtgactgttggagatagacctttcaactgtatattttattgttagaaagttacagaaataagactaaacctactgtatattctactaccttttaaaatgcttgcagagcttacattatgtagtgctttagagtttatccacctgcttcagtaagacctaatctgaaagcttaacttgtcttttttttttttttaaatctttcttttgatatgcagggcaaaatcctggctatactttctctaacactgagcttctcacttgttctctgagacaacttccccagtgcccccttctgccatgtagttgcttgtttgccaagtagctatttgcagacctccattgctgaacatgccagcctaattcagcagcatagattttttttttcttggtcttcctcttttctctttcttttcctctgggaggtactgagatttccacctgtgtgccctgaacttccttctgaatctcttaagtttttttgttaatgagagtgggaactccgaatttccatgtaataattagtcaactatgaaggcatcctaaagaagctcttgttaggataggaaacaggtgaccatgttcaggattctagcaactttatttttaagggacttgattgattgctgaatcaacagacacataaagggccaccatcccccaggtctcatttgttccatgataacctcattatgggtcatgaagcaaggttatgccatggaatcgtttatatttccagttgttcatgtgttcctaacacagcagtgcagttatacactgggtacatgtctttgtctctcctggatcaccatgggctcctgtcccagcagcaacttgtacctaggagctgaagggagatcaatacaaactccttatgacttttagtgctttctggttacactcggtgaatttaacccaggaggtcccctctgatacagctagcagtctttgaaccttttttcaggactgtgtaagcattataagttttcatggtgtatggcttttgagttgattttgttgttcttactctaggctaactttttatgtcttatttttaacagtgaacataaagattctgaaaagaaacacaaagagaaagagaaaaccaaacacaaagatggcagctcagaaaaacataaagacaaacataaagacagagacaaggaaagacgaaaggaggaaaaggtacagaactttgccttaaggggaaacaagagttaagatgtacttttattttgaatactttagaagtggtaatgaaagtaactttgttatatctacccttgaccctgtagcagacttcaaaattagcaggtagtgctatagcaaaaactacaactaaacactggcttccttgcaatgtactcattaaactcctcactccccaaacaaaaaagattttagattcaatctgtctgaagctatgataaccaaattatttaacaccatgtctttaacaatgcaataagtatgtttattttatactacagtgtgcctataatgtttctggaaacatcttttctgttttagggaaagttttgtttttggaaaacctaaagctttattgggtctcctctgattgaagattctggggctgtgtctatacttagttgatagactgactaagtttgactagcatgaaggaagtcttatgatttccagcactactaccaacagttgtgtttgtgtgtgcctgttattctagcacttgggaggtggggagatagggcgagtagaaacttaaggtcatacttgggctacagagtgagttcaaggtgatcccnnnnnnnnnnnnnnnnnnnntgtgtatgtgtcaaggtttttcaatgcattgtttttttgttttgttttgtttttttgtttttgttttttaaagtgaaaaagaaatttgtaggtgggcaatcatacactagagagggcaggaaatagactagtctattttatggtaccctcaccccactgtgaggctcgcagcaaatttttgagtagtggatatatttattggggagatgaaatctactgttattttaagattaaaaagttgctgttttgaggaagaactttctcgattaatttcaccagaattgtcaaaaaacagccctgggaaaatgtctttagttgacccacttcagttttgctaacaagaagagtcagtccaggatcaagatgctccaaaatagcctggcatgatcttgccattcccgaacactcaatgactgtggttatcagcacaggacacgagcagtattgagcctgtcagcattctgtcttggagaagggtagatgaggtctcttccttgaagactaccatccattaatggttattagaggaagttgagacattttctcaggtggtatagtcactgttaaggtgcctatctacactcctataagcaattctgattcaactcagtgggacatccaaaaagcaggaagaaaagacaagtcatggctgggaaggggatcattaggaacggggagtgagtagatccgagtacctcatatacttgcatataccataatgaaacctgctttatgtataattagtgtatgctaacaaatttaaaatctcccaaattgatggtaatcttcttgaataagagttttttgtcttgttttagtattaaaaactttcaaagtacttactgagaggctgtggttttaccttgcagattagagctgctggggatgcaaaaataaagaaggaaaaggaaaatggcttctctaggtaagaccttttgctacagcagctttttttgggaggggggtgtgtgactctgcatggtggtgtctaagcttttccaacatgaactgaactagccaccttgacaattcaaaaaaagtcagtattaagagcacttgacctaggcaaactttggttttttaatagttctagttagtgagactgaacagcatttatccagaaatctaccagaaatggagaaggctatcagaatgaggtttttttttggtttttcgagacagggtttctctggctgtcctggaactcactttgtagaccaggctggcctcgaactcagaaatccgcctgcctctgcctcccgagtgctgggattaaaggtgtgtgccaccacgcccggccagaatgagattttaaaagttgaggtatatacataccacaaaatttgctatgctagcatatatatagcttatgggcttttatggtatttacctcactatttcccaatatttcaagagaaactccttggtagtaattatggaatttcttagtcttaaattaattcctcctttgtaatataagacatacgtaaacccttattggacttaattttttaatatagtgtatattacctataggctgtttttacactctgcagtccatctgttctgttttcctcattttcagttccctaaagtaagtgctcaagtccactctagattgagaagaccatttaagatcacattgtatattctgatgtcttccatggaaccacggaatggatttgttaagacttgttgaaagcatttgccttattgactgtaacagagttttaagagctttgctttcttgagactttgtatccaggtcctttagaaaaagagaagcaggtgccttttatagggatattttacaaatggtgtaagaaagcagaataataaagttgagtaagcattctacaaagtaccctaggaattctgttaaacaataaaatgaggctcacgatgtctattctttgccaagagatcctgcaagatatgaatagattatttgaactttcgtcatgaattcacttaatgacttgggggattagaaggacaggcgtgtgtgctttgcccccgattgtcgttgctggcctgcttgtcagcagtgagtcctgtagagaatccagatgcttcacttgaacttcatcttcgaagtgtggtaactcactatttgctttcacacacgacacttaggatggggcattaactttgaaccattggatgttgtagtgtcttctttggatctccagggctttgtaattgaaggcgaaacagctgtagaagtggcatttaggaattggggaaaatgtgctggaataagaagagctaatctttttaaaccttcagattttgttgcaagcaaactggttttaatgcttttagaaagaaaggagaatacattatctatacttcatgctgtgaatatattttactgttgagactagatacttacacttcagatccaccacttcatgaatggcagctttattttgggaggccattttctttactgagttaagtcagtgaggtctaatttgaagagatgtaacaagccaacctaggaaagaacattccaaggtttctgagtgtttgtccgtgtcaccggcaattctccttccccttccccttcccccatcatcatcatcactaccaccacctcctcctcctccaccaccaccactaccaccatcaccatatcactataagatagctgacatacacgctcccctatctcattattagtaaatggcagagtcttctgaagttcagagtggcttgaaccattacataaaccaagacgaacctccactcctgctcctcctccttaattgttggaagtgttgaaattacagacgtgtgtacccaacttaatttaaaaaagaaaaaattagatatttaaattttacgtgtatgagtaaatgttttgctcatatgtatctgtgcttgcctatttccatggaggtaaaaatgaagtgttggatatcctggagctagttataggtgatggtgagcttcctggtgagtgttggataaatctgggctccttgcaaaaacaagtgctctataagtgctgagccatctctccagacccccagtttattctttctagttagtacaggtttcataatgtcattgtactctggctcataaattctctagatagatagagattttgcaaaggaaagaaaatgtgacattcttttctcccttgctataaacctatcccgttctattttcatgaaaagattttttttttaaatgtatatgactattttagcctcatgtagttctatacaccatgcctgtgcctagtcactaaagaagatcccctggaacttgggtctatgctttctggaagattagtaagtgctcctaaacattatgccatctctccatctcctttcatgccacatttttaaaaattgagggttttttgcataataaagaaaacatgttatttcttctatttttccctgcaaataacacaattttattctttatgcctgaataaaattccattgtgtatatgccatattttctttatccattcatctattgattagcatctacactggttctggatttatactattatggatttacagagagatccatgttttatggtgtactgacaaagcttctcttgggcatatacctaggagtagtatagctgggtcatgttgtggaagacctctataggattttcatagtgactgtaccagtttacatcctcagttgcatttttttttcacatcaccttttattactgaaggaattcagggcaggaacctggagctaggagctggcgcagaggtcatggaggggtgctgcttactggcttgcctgtcatggcttgctcaacctgctttctcagtgctcaggaccagcagcccaggggtggtcctacacacaatggactgggttctctcacatcaatcactaattaaaatgccctacaactgtatctttagggaggtattttctcagttgaggtcccttcctttccaataactgtagcttgtgtcactcaggtggacattaaactaggcagggcacctactttatgttatttaacacaattctgacaatttagtaatccttaactagctgctttgttctctctttagtccgccacgaattaaagatgaacctgaggatgatggctattttgctcctccaaaagaggatattaagccattgaagaggcttcgagatgaagatgagtatgtatttcttccattttgattaaagtggaacatataaagaaatttcaattttgaaataatgtttgttgctgcctgattaacaatggtaaaattggaatcaaccttgttcatcaacaaatgaatggctaatggacgtgtgatctgtgggtggatagtagaatgtgctgctcatctctatagaaacatgaaattaatagttttataggaatatggatggatttaaaatatgtaatagcaagcaaggtcatataatctcaaagaaaaaaactcacattctctcctggaattctaccaatactttgaaggaagagaataggaaaggctaagtaattgaaacagatgaggaagtactgaatgcattataaacgaggatataaagctaattgtttttctacttctgtttttatgtggaatcttctttttttcctcccccaccctctttttccccatttggtggtagataagggcataaactacattcagtattgaaaatgtaaaattgaacaaagctgtagaacttcattctgagtgcctgtttaaaatataaatgttcattgaactagatctgttagttttagtatggtaatttggaagagtttatatatacatgtgtgtatatatatatatgtatatataaatttataaaaaattataaaattataagaagagatacttcataatttttattttatttattttttgtttgtttggttttttgttgttgtttgtttgtttgtttgtttcgagacagggtttctctgtatagctctggctgccctcggaactcagaaatcagcctgcctctgcctctcaagtgctgggattaaaggcatgcaacaccaccaccggactacttcaacaacgtttaaaaagaaaaggccagagccaggcatgatgccaccgcctttaatcctattactcaagaggcagaggcaggggatctctaagtttaaggccagcctgatctatagaacagggtctaggactgccagggctacacagagataccttgtcttgaaaaaataaacaaaacaaaacagaagggaaaatctgttttaagaataaatatgtgtatatctataattaataataatatattaattggcatttgtggttaatggactaatttatgagaagtgggtttgctaagcaaattaatttatgggttatgtgtaatgtgttttttcttactaaaaaaataatgcatatttattatagatatttcaaactatttcaaaatagaattagtgacgggtaaactattttagatccttgggagtttttcagttttgtaccacaagtaaattgagaaatattaggttagggatatatagctcagttggtagaatgcttatctaccacacaaaaagccaggggttgatcccagaacctcatagaactcatacaaacctcatataccaacatttgggaagtggaggcaagaagatcagaaattcagtcatttttgactacagagtgaatttgaggctaacttgggctacatgagactctgcttcaattctttttccttctaggatctatgccttttgatataagggaaccttcaatgtacagagatagtgaagttgatattgttatttaaggcttacatttacctccaatgataatgtattccattttactagttttgagtattatattatataattatataatacttattctattctatgagatagtcacaggatttaagatggaatggctgaggctgtagcacagttgataaagtacttactttacaagcatgaggacctgagtttgatccagagctcacatacaaatttcaggtgtgctagagcatgctaggacttggaaaggcagagaccggagactccctaggactgctggcaatttagcttagcttacttagtgagctccatgctcctgagaagccaggtctcaatggagcttgagaatgttctttaggaggacagtacaagttgtccattggcttccacatgaatatgagcattcagacgtgtgtgcacttaaataacatttaaaaatcaaataatggctacagctatagcttagttgttaagagtgcttgctgttcttctagagaactcaagtttgtttgccagcatccatattaggcagctctttatagcctctagtctgtttctgtctgtcttttatatttatttcactttttatattatgtcatgatcctgaacatttatatgtataccatatgcatgcctggtacctacagaagcctaaagagttcatcagattctttagaactggagttatagattgctatgagctatcccatgtggatgctgataactaagctgaggttctctgcaagagcagccagtagtcttaccagcttgaacatctccccagaccttaatctcgtcttcactaccattgaattcctatcaagaataacagcagtcacctgccatggacacttttcaaagagttgggagatcctaattctataggtgagatctcttgagttgtagttgcaataactgcatattcatgttctcctttctagtgctgattataaacctaagaaaattaagacagaagatatcaagaaggagaagaaaagaaaatcagaagaggaagaggttagtaaaagtttttgaggcatacatttatttgtataaaatagccttaaaaagcatgagattatttttaattgtgggtatcatgatgcacatgtggaagtcagaggacagctttgagaagtcgattctcctggaaattgaacgggggttaagtttgacagcaggtacctttaactgctgcatcatcatctcttatgtcctaaaatagatcttgaggccaaatgagctttagaaaatttttggtttgttgtagtagttagagtggggaaatgttttgcaaacaagttgtggttgtgctgagtttgccaagattttgaagtatccagattactcgccacccttgagtctattcatagcctgcgttgatgttgataaagtatgccacctgtaggtatgcagaaaaatgttcataaggaacaactctgaaaattctgtcttaacaatatttcatgaccaatgaagcatgctctttcctcattttaaataaatgtagctctaatttaatcagtgccctcttggttgtaggatgaaatctaagcactggagtacctttcctcagtctggcctttgcatcttgtgccttgcttcattttgtccctcctgagctcaccttgctctggccatactggctgcctctgtttgtttttcacaccagattttgtacttcagatttcggtgtgtagtacatgttgttcttctgtctggaacacacattatttattcccttctactgttttataatcttccataatttcataactttagttcaagtacttttttccaaggatcctatttggtgcttgtggtagatataaatagaataatgtagttattttctttatttttttaattacttgtatttacttgcaagaattttttttaaaaaaatcagcaattctttaggctcttaagtagagttcttaactttatgttcattctgtgaggttaatcaatgttgtggacaaaataggcttaaatgtggttaggttaaaatgtaccagcagtcataatagtgataatggggcatgggcttttgagattgttatctcagggtgagtatggtgacacacacctctaatcccagcactcagaaggcagaggcaggaatacatgagtttgcgtctacaaagaccttgtattcaggaggcacagagaaagtaatttgatcagttatggtgactgcaaaattgtaatctcagtactttgaagactgagatgggagaattatgagatcaaagtctagcctgggctacacagtgacaactaaatatgccatttattaagaacttgatatgcaggctggagagatggctcagtggttaagagcaccgactgctcttccaaaggtcctgagttcaaatcccagcaaccacatggtggctcacaaccatccgtgatgagatctgactccctcttctggtgcatctgaagacagctacagtgtacttagaaataataaataaatctttaaaaaaaaaagattttaaaatttttgtatatgagacccgcttgtaccatgtttgtctcagatgcctgcagaagttagaagagaacatcagagagagagagacagagacagagagataaggagttttactctgtgactcctggcaatcctcctatctcccccttgactataggtatttttagactcgagccaccaacagagtatttgaatgctcttctacttgcacacttgtattcctcattgttacttaaaatgcaatagcatagcatttgcttttttcatccttaaaataatacttaaagaccttcaagtttattactactttgattaccatcttattacagactcacaggatattctctagccattttcattcatcatattctgttggtttttgtttgtttgatttgaaaatatacttagggttttattttgttcagcagcagttatataaacttgatcaaatggaaactgattttagaactatcttgattattgctggaagagaagaaaccaaatagtttccattccataaaccatctttcattgctatataaaacttaccaagtaaagcctcatgtgatgctgaaaatgtagatcaaagttaggttcttcagaagaaagtagattctctggagtctgcctctttacctgttgagtcacatttttgttgggatgtgttttggatttgtcttactcttgggtttgaagcttttttttttttttgtttttagagttacacacccacggttgacctcaaactcaaacgatccctttgtctctgtctcctgaatactaagattgaaggcatatgctatccccagcctattttgtgtttttaagattggaatctggcagtctgtctttgaactcctgtggctaagttactactgtttagacacacaaagacaggatactctcaacttcgctctcaacctcgaacttcatcccctcactcccttccttccaattcctgtcctacctctctcctaactttgcctctcatttattgtcttaatccactgagcccacttagtattttcttagaacatgggtgtggtgtgagcatagttagcctctcaggacctcaatccctgaagtaaacagactcttccctaacctagcagtaaaggttttttgggtttttttgggttttttttgggggggagggggggaataggggttctctgtgttaaccctggctgtcctggcctcaaactcaagaggtccacctgcttctgtctccctaatactggaattaaaggtgtacgctaccactatgcctgactttttttttttttttttggtatgcttttactatgtatgtatcatgacagttcctgctacagcttcctttagtgctagaatcaacaggtgtgcactatcatgcttgactggtgtgttttgtttttttgtttttttttttttttttactttgccactgcgagcagttcccagctgagaatactcttaactttgtgtatataagcaatagtaactgaatcacagaaatctcctttcagatcaaatactaaatttttcttgtatttcttttctatactttgttatatttaaagagattaaagatgaacacactttaaaataaatgaagaaaataccctgggattactgttagttccccaggctttcccttgtgaaattcctaaataattgtttgctagagggactgcgggaagtatttactcaattgtaaaatatcaataaatttttcccttgatttcggggaggaattagatatacgatcttttccagttccaggacttcttgttcatagtttttcttcctagtggcttccaaaaacagcttccaggcgtgtaaacaatcctgatttaagtgctttctgtttttttgtaggatggtaaacttaaaaagcccaagaataaagataaagataaaaaagttgctgagccagataataagaaaaagaagccgaaaaaggaagaggaacagaagtggaaatggtaacatctcagcactgggttaagatgtcagcactttcactgtgcagcccaattaaacaagagttgaaatattaaggttaatttcttgacatttgatggagaagtacttacagactcttttgaagaacagataagttttcagatcctagtaatttaccagctctaaatctagtggatctcaaaactagtttcttctcattgaatcggattgaatatagcttatatatagaagggacttcaaaatgaattcattcattcattcattcattcattcaatcacttcaaattgtacctagtagtattataatatatcagtgtatatatactttatgtaatgtttaaatcaggctaagtctacctatctcataatacattctatctttatgctgagaactaccagcatactttcctgtgtcagtttattattgctcttagaaatgtattcactatgtaaagggttcttttttttttaatctataaatcattttcataaaactgccaatttgcataggttttcaggtctatttgtcttttttcctctctcaactgacctcatagagccaagtttactcagatttaagaaaagcatgcataagcttaaagtgtactagaacacctgctactcttgcaaaggacttatgtttagttatcttctcataatcctctatagctccaccctcttctggacaaacatcatctttttccccaaataatccatcttttaagacaaccaaaaacaagaacaagaataattctaaacagataattctttaccaaaagacttggagaatggccagttcatcacctatgctaggttgaagtttcaagtctttgggcaaagaaaaatgttaaaaaagaagctagggataaataatattgtataggaattactgttgaaagaccaggacttaacagtcttaacaatgacaatgcttatgcaatacatacatgcatacatacataattaagaaaccttaaagaacaagcattatcatatcttctccaaatcagagtctgttcttcattctagacagcttccagaaatctctagttttagatttttatctacaaatctttatttttcataaattatatagtctgttttaagatacctgctaacaccaggagaccttgacttgagaaagtagtaggcctatgctgttgctcaggctggccttgggttcctggctttttttccccttagcctcccaagttactggaactgtaagccaatcccaatcccattatgtccaatacggaattctttgtgtattatattaactctttataggatttttaacttctgagctattttctattcatttttagactgttaaactttttgtctttccaaggaaacttttttgtttttttttaaataaaactgctacctaacttgaatttataagcctacccttctttagttggtgctggtgttggactgttagaaggccaacactacagttttatttgtatggtagtaccggtctgtttaaactcaaggttttgtgtttagtgattcattgaatctttgcttaaatggtaaggaagttgttatttgtcctgaagaaaaaaaacatgttgaatttggaggaattgtgaaacatggcttggaatcttaatttcaaaacaatggagttgatgacaagaatataaagggaatggtattctgaatcactccccggttactatatgactattaaaacagatgagtcacttgtaggtgctttcacatgcttgcaaacatttttctctgatttggagagtagtaaatttgaaggttaggtagtttctatctgggcatttgacatcagctagtataataacgttttatctgtaaagtggttgttgattatacaaagtctttattgttccctctttttgtttttcgagacagggtttctctgtagagctctggctgccctggaactcactttgtagaccaggctggcctcgaactcagaaatccgcctgcctctgcctcctgagtgctggattaagggtgtgccaccacgcccggcttattccctctttataaaatctttaagaaagaaaataatacttctttcttacaatgtaatttagatgtatatttacattttgtcatcttattgtaaataagctgtaatgagaaactgtacatccattaagaggcaacaaaaagaagttttggtgggactgaaatagaaaaattggaatcttggagagaatattgtatagaatacagggaggtacgtctaccaatactcagctttcctttgtccttactgctgttgctcaggctggccttgggttcctggctttttttccttagcctcccaagttactggaactgtcagccaatcccattatgtccaatatggaattctttgtgtattatatcaaccctttttaggatttttaacttatgagctattttcattatgagttacctctttttttcttgaatattccatttgatccatagggttttttgtttttgtttttgttttttaaattttgatgtaacccaacttatgtggttttgttgctgttacttttatatttattgtatccaggaagtcactgccaaattcagtgtgatgaagccattccctcttattttctcctaatgtccaaatgagctttagtttttataaattagaattttaattcctgattcatatagagttaatttttgtatatagtataaaggacttgccccagtgtcattctcttcaaactccagtgttgaaactctgtcatctctaaccataacatgatgataattcctgtttaaaatgacttgccaatatatgttgacagtaattttatataacagtattgttacagcttaaacggattcatttatctcttaccctgtgattctgaatgtttaaaatatgggacttggaattcatggaattaattaacagcagaacaaggcagaactatcccagcactcaggagacaggcagatcaagttcaaggccagcttggtctacagagctatttccaggacagccaggactacacagagaaaccctgtctcaaaagacaacaactacaaacccaaaccaaaacaggaatccataaaattccttttgtgtagaagtagcagtaataagtttgagaaatttaaaagtagtctgtatgtatcagatggattcttttacaactctgagaggggtggtaagatctgtttatcagtgtaaagggtgtgttagagacacatccatatgtaatgcccaaaatcagtagatttgtacttgtaaaatactggatctcattggtgaatttataaaaaataaagtgacacaaaaaaaatcaatctgatgttatagttctatacaagatcagttttataaagataattgctataatatttattgaactttcacatccaaaactaattttgaagtgatcagtaaaagtagaaatgtaataaattttaataattctttgtatatatttacagttaattgtttttatatgcttaatttttttaaactttttttaaagatttatttattatttattattatatgtaagtacactgtagctgttttcagacacaccagaagagagagtcagatctcgttacggatggttgtgagccaccatgtggttgctgggatttgaactcaggaccttcggaagagcagtcgggtgctcttacctgttgagccatctcaccagccccctatgcttaatttttaaaaaataaaatgttttagaaagatatttattctgcagtttatttagatttttgtcaagtatctacgggatagttccctgtatttcagaagtgccttaaacttagtgcacctccattagaatctcctcagtcctcttgcgtttgtattgttggttttcttgagtccaggtcttactatgtagccttggctgtcccagaactctaccttctgctggtctcagaattccacactctggaactgaaggcatccagtctggttgtgctttgaattttcaaatagggctgctttcttctaaactctcacctgcatgtgccatcagtttagtaatgcctcttttgcatgtaccactgtggcatattttatatataaatagttttatatgggttttttgagtgatggatggtcttttaatacttagtatctctaaattgaaactgttgaaatgaaatttttttaattaccatattctttcagtttgcttgaaattgctgctcttttcagtgagacacagcctttgaatgggcaccacaaattgattagttaattattttgaatttaataggtgaggatctttttactaagccaggtgatcacttaatgagcttgtgccttgtctttgaaaggtgggaagaagaacgttatccagaaggcatcaaatggaaattcctagagcataaagggcctgtcttcgctccaccatatgagcctctgccagagagtgtcaagttttactatgatggtgagttatttcaggttgtttgaattttggctaagaatggtttgtttctattcagggttagaaaatgagggcactgcctatattgcacagtcctagctagttatttcactttgttttattgtctatgtgtggcttgggaaaaggaatctcaggtgtttaattcagaaggacccctttgctgcttgaaaaatatgaaaaagggggctgttaatgtcttatctgtagtctaaaaaggtttatctgtttggctcacagcctataaaatacacattgaaggtttttattttgagtgtgtaactcaataggaagctgttctgtattgagttctcatttaaatagtagcacttagtgataatatagtatgccaacatgctgcttatcactagaaattgtattagcaaaggattagtggccatcattcagcttataggtaagaaacctaagctatgtcactctaagtagtgcaactgtgcctttgacaggtgaattttaaagaaacgctctgcctaggtctcttaattttatttttttgagacatttctaactgtgtagccctgcctggcctgtaacttgataatatagatcagctgtccttgaattcagtagatgtacccatctgctcctgaggcacatgccaccttatctggcctccttgggtctcttggaactttctaaaatgtctgagagttccacatctgtgtttttgtccttgggttgagggatctgagagtagcctctcacaatccttcgactgactgtgtatcaggtagtaatgtccaactgactccttcattctaagagttctgtccagagatgctagagttcgttctcaaactctctatgtatttataattcaccaggttaatagatgagaggtaggactgggtgtttatgaatcaaataaatgtatttactaacagggagagacactggacaccaaaatagcaaaaccattcagagctatttggtgtatctctttttttttttttttttttttttttttaaatttatttatttattatatgtaagtatactgtagctgtcttcagacactccagaagaagagggcgtcagattttgttacagatggttgtgagccaccatgtggttgctgggatttgaactctggaccttcagaagagcagtcgggtgctcttacccactgagccatctcaccagccccttggtgtatctctttaaccgccagcaatggctttaggagcatagatgcctgtgggtttaggatgagacgggtttattagcatccaataattgaaatctgtatatgaaacaagtgaattttgacctgggtctcatccttaagatattttatttctctctctccctccctcttttttttttttttttttttgagataaggtctcatttttgtagtcttagctggctttgatctcagaggcctgcttgtctctgcctgagtgctggaattaaagattcccatcactgattactaataatacccaacctgataccttatttttacaaacacacccccacataccgtcattctccaaaatctaggggtgaaaaaaatgaaaatggaaaaaaatcacatgttttgggaaatggatgttcaactaatattttcgaaaggttcggaaatgtttattgaatatgcttgtgttcagacacccaagtcccagatagatagagactactgatttaatctatgtaggaagtcagtggcataaaacacttggtggtgtgactggcaagtttttagattagctaaccagtttgaccagaaactgtaagacaccctacacactagatcattcctgaagatttacgaaaatacacaaatttaaacttcctagtgaagagaaaaggccttaagaccttgaaaaagacaattgctgtattctgtagcctgacctgagctcactaactttagacagctcgctggaaaagcctcactgtgaaagccaaggtgatgacgatagaaagtagtttttttttttttttttttttattgtggggtttcaaggaaactaaggcctgtggtccctacctctagtttccttttctctgttggtcctcctaggatttcctccctttggttataaaactcctccaaataagtcaagagtgtttgacttactagtgcaaactgataagtaagtactggtaggcaggacattgctgccttgccctggacttccccctggccgcctctgcacaggacatgagttggctgaagcacagaattgcagccgctgttaaggacctgccatttcaactctgactcaacagtttctttttgtttccgggagctcaacttttcccacaaagtactacgatgattgctgggaacctacacaccctccaccactccggtgctatagctgttacttaatccttccacagcccatttaaaacaaatcaagtaggttctttgtgggtgggacaaagccagtgcagtgcaaaggctccccacccaaaataagaacactattggggaatatttagtttatgaaaacaaacataccagggaacacattccttaaaatttccttatctatttttattttttgttttgagatgctgattttgtagctgagaccagtttcaaatgcacaatcctcctttcccagccttccgaatgctacaattataggctactgctaccttgtctttttgcccccatttgtttgtttgtttgtttgtattcccctccattatatttgaatcatgttgctgttttgctggcaactcttgttcagactgagtggggaaaacaggaaacaccttactcaaaaaatccttttccaacacagaatcttgagtgtgctgaggaagagctacaccacctatttgccttttaggttatgtcttctaagctgataatgtacctgtagcacaagtttgttttgtgatgtattccctatgtttcatacagtctggttgagcaatactacccattatgagatgagatgtctctcaattattacaatgagtaggcttctggttaagttttagatttctgtaataaattttaattcttttgaattattattagtacttacatagttgtaagtgtgagatattaatctcatttagaatgcagcaaaatgctattgtggcataaattgtttctatataatattataaagttgatttttttttttttgagaaaagatagaaattggccctaggagtgcaatattctctttgaatattttgtagattaagcttttaagtacttttctttcactgtcagttatgatctatctgaggacacaaaatcacttccaggatttattaactattgtagtggctttccttgtgaaccacaggcttttttggacagtctttacatatacttacttgctgcctaacccaccctcacctcatgctgtggaatgattagactttcctgaaagaagtgagttcctggtgctattcccagtgtttcaggtgcatgtgtacctgtatttcactctgaatacactagtgctccaaaagtgcttttctggctgggaggctggctcagtgggtaaagtacctgctgtaccagcctggtgtcttaaggatgtttttttagaaccacatcaaagtagcacacttgtctgcaattgtagcgtgtccctgtggtgagaggggaagtggagacgagaatggatgagtccgtgccagctagcctctatatatatatatagcagtgaacaaagagaccttatctcaaaataagatggaaggcaaggactgacacctaaggctctgaccttccatgggtactgttgtacacatacaaccccacacatagacatacagtgcagtttttgattctaggtataggactgaggcccaaaacttggtatttataacaaacttgcttgtgatggttttggtctgtgaactacttgagtagcaaggttctagaggaaggtcttatttacgctttttatgtgggaaatctgggcttgcctgctatgaatatatattcttattcatattccacccacgtaactttgaagaagaaagatgcctatttcttttccccacaattcctttcttccactccctgcccctatcctttcctccccttcttgaacagaggctgcttagcttagcagtggcaggagtccttctgaggatttgatttttaaaaaccattgaagaggtgtaaaggaccctgcttgctgaaaggaaaaggaagagtggctgggccttccccaggtcatccctgtcctgagcaggcacctgggaacaattaactggcatagtctccaaaaaaagacccaggtaaatatctactaaagagaaggagaaatttttaagtagatctctgacagtatgttactctgttgttgttatcactgtgtgtcagcagacctttgtacaccttggaaaggtgagccatcagtcatgacctctccagtgttcagtgcacatagaatatgaatagtgtgcctcactgtttggaaccattttcttccttcaggtaaagttatgaagctgagtcctaaagcagaagaagtagctacattctttgcaaaaatgcttgaccacgaatatactactaaggaaatattcaggaaaaatttctttaaagattggagaaaggtattgtggcccatgtgttcatatcttaatcatttataaaagtgctgacttagaggtatagctcatttgttaatgtcttgtttgtttaaaaaatgcaaagtatagtttaatgtatatcttttttcccttactattttaatgtggtttttgttcaacaagaatatatcccttctcagctttcatgtgactgcaggaaggagcttatcagattaggttaaacagaaaacctcaaatccagttgagcaaaggaagcattgtttctgcagggactgtcctctgatgcctttacacagggtcagtctgaccatctattctgtattgatataaaaaagtaccattgttttcaatttggataattttgaaaagaggttgaattaaaattcaccatccaagggcattctaaatttaataagagcagattagtgtgcatgggaataagaaagtatttctctttattgctaaagtaattgattaatataggtctcttggattggtgtttatatgtttgagtttgtgtttttgtcaaagatcgctaaaaaatgagtaattttctttgataaatgactaatgatattttatatgaaactaatcatcttataacagagcagcaccactccccagaagcaatggttattgaggttggcttcccttctagacacctttgattaaaggggaaaaaggatgaattttgaagagacaggaagacttattaatatatttaattttcttaacctttttactcaattaggaaatgactaatgacgaaaaaaatacgattaccaacctaagcaaatgcgactttacacagatgagccagtatttcaaagcgcagtcagaagctcggaaacagatgagcaaggaagaaaaattggtatgatcgtctgctaaactagaaaatcttggatagtgattctttgtataattttttgcttcttgtgacacaacagtgaattcattacttttatatttttctgtgttaaagatttacttagtaaagtataattacatgtatgtgttgtgctaactggcagctatctgtgttggcacatgcctgtaatctcagcatctagacttgagcaagaactatgatgtctccacaaaacaaacaaaatattgcattagacttctttaagttcattttatctgtagttttccaaatcactgaaaaaaagtgattctgaaagtgtgcattaaattttacactttcaccatcaaatgcatgttttatggacttatcccctaccacaaaataaaccaaaacaaaatccatgacagtgttgaaactaaaagggaaaaaaattgctttatacccttttgtgagtctgtgttttgcattcaatccttctttactacccagcatttacctctcctctttctaaggctcacatttaaaaatacctaggaagggctcagttggtacagggctttcctaatgtgtgtggaaccatgattttgcttctcagcactgcataaaaccatgtgtagtgatggtacatgcttagagtgtcagcccttgggaagcgggggatcagaaattcactgtcattctcagttacatagagagtttgaagacatctggggtacatgagaccagatacttaaactaagctacactgaaaataaatgacatttataagtctataccctttgtaatgaagattaagtgttgaagcactagttcactggtagacacagttctgtaatactacaaaagacaaaagttgagaatcttatttgtgtaaagtcagttattcttgatagatcttttggcagtttattttatatatctgtaataatatatgtacgtttaaaatacactagacattttcctatattttagtttgtttctgagtgattttaaactttaccttgatctttcttctgcaagagataaaaatatgtaattcttagcatgtaggagtttgaatccattttgtatacttccttggtctattttagaaaatcaaagaagaaaatgaaaagttattgaaagaatacggcttttgtgtaatggataatcatagagagcggattgccaacttcaagatagagcctccggggcttttccgaggccgagggaaccaccccaagatgggtatgctgaagagaaggatcatgcctgaggacatcatcatcaactgtagcaagtgagcacaaaactctttaggggggagaagtgggtgcagggctatttcctcaaggctggttattgggactattcctagtgttatgagagcggtgcagcgcttgcatgggcaggtctcccaagtttgttcaggattgagggcaggatgagaggggacatggtttgtcacttttcatttcattttctttctgaatggttatgttcatagagacgcaaaggttccttctccccctcctggacataaatggaaggaagtccgacatgataacaaggttacttggctggtctcctggacagagaatatccaaggttctatcaaatatatcatgctgaatcccagttcacgaatcaaggtaagcataaatctaggccacatccattggtggagctaatatagtaatctcattctcttttggttgtattgtaatgtgctttctagactcattttaacaaatgatactcatttcaacaaattaaaaacctaccctctccctggcttcatggttagttagcattacctagtaaactcttattaaagatgttttacatttgtgtcctatagtaatcttagctgtggacattctctgaaatcccattatgttctgagtgaatgcatgtggtaataatggttgtgcaggtgctactgtctggtggtcaggatgtgatgaagtggctagtaggcttatgtgagaaatgtagatactatttttctctaaatatagagacaactataggacctagagctttatatactttatgttttctgataaaacatactttgtctcatctgagtaggttcctttaggttgtgattgaaatattgctagcccaccatgtatacatactcaattgttttcaattgttagatttactgagagggactgtctctgatcttgttagccaggtagctataaactctgtgttctttagcattttataagctccttccatcagactttatggatatatgaactacaaataaaagagacattgggttcacaaaaaaacagccaagaaaattggctctgtgtagcctatagaactgttttccattgaagagtctaaagctaaagaaacccttgttcctaaggatttagcttctgttaagatccaagagtcacagatgaaaatgctatgtaaatttacatgctttctagcttatatcctgtgttctgacatgtgtctctaccttcttaatgaaaaataccatctggatactttcttcaaataaattggaaaatagtatctgtttcagaataagaaaataatcagaagggagaactgagactcctttattcctttcttccatgagatagtttacagaactacagaagtgggtaaagaaaccatgtttttttttttttttctttatgggtgggcaaattgtgtaaggatccagttgtgttagaagaaaggtagtcgttcttgtacataagagtagttattcttaacatcagaatggactttttaaaggaaattagattaaaatgagctctttaaagaggtcttctaaatagacccaggtgcttatggacaaaagaggaaggtaagttggtctacagggatgtgacaagtaccacacagtgtcaagtagggctggggaggaagctcaatggataagaatcctttttgtaaaaaagacctgagttcacctctccagcacccacataaagctacacatagccatgcagacttcagtgttgggaactgtcagaagctaggagctcctggctgattgtggtcttcagtttcttaatcaggtggaggggctaacgagataactcagtggctaagtgtactggctatttttcgtgattgccggtgtttgatattcctagcgcccatacatacaacagtatgaggtagagaatctcctcatgcttacagagttgtatgcctacatgcatacatacatacatacatgcatacatgcatacatacataccacaccctgtaatgtgcatgtaccacatataccacaactaccaagtagtagtggttctatatataatattattaatatactaaatgtcacattaatggtacattctatatatatatattcaccacagtcagtatattgtcagtctgtgatgagtattattttagtgttaaaaagcttttcatgtaagttgacatttaataactattacaggcatatattcacaaataaatttagtctgtgggaattaaaaaaaaagtcctacatctgatagctggcaactcttctcagtcttcttagaatgtaatttagatctccaatctcatgctttcccatgacatcctggtgtcaaattgtggccagtcttaaataacatgcccaagaagacggtcttctgttccgggaagagaaccctttaaggactttgaatgaaggctctcttaaacatgggttaccaatttcagcaagattagcaagttattacaccaataaatataaactacgagaaatgctgctgcacagaagtatcagtaccatttaagagcatacctcagtgctcaatcttagctcagtttcaggaaaggcttttccacaaagataatatttaaggttgtatttgtgagatgaataggaatctcatttgccactggaaagaaaaacaaagggaattagcatttcaaagagggaatgagaacttttcaagtttctgccatgagaaagagctcacgtgtttggagaacagagtgctttgagcagtaagagaaatgaagaaggccccgcagaagcagacaggccaggacttcagttccaactttttaaatgagtctaaaaggaagctaccgacctagacagacgtaaagaagaaaataggactggagtggtgacataattgatagttttgactactacttggtgtatgtagcctgtatgtattgaacacaaacaggaagttaggaggcctctagatagctcttcttcaggcaagaaactgtagtgatcaaggcaggtgatagcagtgagagtggaggaaaaggagtagatttcaagtatgtggctgttgtgtcctcctataggcaaaatcacaggaaactgtagttctcacaagagtgagatagatacctgctaggcaagccagagcagcaccccaaggacagaggtgcttagtctaggcagtaataaccagataactgcatagtaaggatttttctaggtttcttcaagatggttttgaccgtaaacttgaaaatcaccccatgatagaatgcttgacttgatacaactgggatgagattccaagagtagtcatcacaggtctggaaaggtggaactgctggcaaccaggggtgaggaggcagtgcctgtggcttcttgcagttgctctcagtcttgtcataggctccttcatctagcagaatagcagtggcttcagagggaagaatatgatagcaccatgaatagtgtactgctaccagagaattattccattcttaaataaagacataggttcaagctttaggattttttggtgggagggggcatggggttgttgttgctgttgttgttttataggcttctttatttttatgtgtgagtattttgcctgcataatgcatgcatactgttttatgtcccttgtgtttgcagagtccaataaaaggtatcagatccccagaaccagaggtagttagggacagtggcaagctcttcatgggtgctaggaaccaaatgtacttcctttttaagggcagagagtgcacttagtctctgaacaatttttctaggtctgagttttcttttaatgaaataattcaaatatgtaagaatgtcttgtctgccattgtcagatcttagcactttgtccaatatactcaaatcagttaattaaaaaaactactcttgaaggggggttggtgagatggcccagaggttaagagcactgactgctcttccagagttcctgagttcaaatcccaccaatcacatggtggctcacaaccacctgtaatgagatctgaagacagctacagtgtacttacatataataaataaataaataaatcttaaaaaaaaaatactctagtggcatagcctttatttaacctaatacttgggaggcagaagagtcgctttgagctgggcatggtggcacacgcctttaatcccagcacttgggaggcagaggcaggcagatttctgagttcgaggccagcctcgtctacaaagtgagttccaggacagccagagctatacagagaaacctgtctcagaaagaaagaaagaaagaaagaaagaaagaaagaaagaaagaaagaaagaaagaaagaaagaaagaaagaaagaaagaaagaaagaagagagagtgtgtgtgtcgctttgagtctaaggctatcctggtttttgtagcaagttccaagctagccagggctactagggaggccttgtttttttttttttccctagattctgagagatttcacatgttccatcaagtgttaccatgcaaatatacacatggaggatttatgggtggcactaactgttcataaaaccaaaaacttgaagtagtaggggggcatgggggacttgaggagaaatggatgatagatatcattttattatataaatgtatgaacatttcaaaagtaaagataaaatatgtggcaattcaaattattttttaaaagctgggcatggtaacacttgctggtaactccagcactggggagatgggaagggatccctgggcctggcttgtccaacagtctgacctaagtggtgagttctgggccagtgagagaccctatttcaggtacaagcctctgagcaaccagcttgagtttgtcttactcacaaactcaaagtatattagcaaatggcatcttcctcagtacaggtcctgtgaagagttaaaagcaaatgactcacttcctgttctgcctatattattgagtggataagtatctacatttaaaagaagtatggtggccactggtttataactatcactaactagttttttctccattatggagaagttgccaactagggaaagaggaaaaggagtcagagactcctacaatatctacctttgttttaccaaactgattttctactccatactagtaatgtgctgatgtagtaatagaatttgagggagcacatttctgccagtgtcaggaaggtactttttatgatggctttgatgtgactccctggaagacctaggtgggtattttttagaagcagtcctaaagggttttgagtctattatcattttataggttctgatcagcagcgctgtaagccaccaggataagcgtatttgggaactagcccttgcctgctagcccttcacaggatgtctcctcttcttgatcctcatcctagtgttctagagaaaactttgatttgttccaggaggccaatcatgtcaaggaaacactctttagtggtttcttctataaattacttacttgactttctcaaactttgtctgcctgaccacaaccaatgcttatgtgttttgtagtggtgaaaagagtccactcctggctagatagtgtattttagtgagtctctcaggtgtcttggtggtggtttatgtaagaaattgtggtagaggtacaccttgctttgtagctttgtaccaggaggatagcttgtattgtacattttctaatttattctcttaatgtcaagttggacttagagaaatcagagagaaattttcagcttcctgaaagttattgaaccccttgtttaaaagccaaacaagcccatacaaatagtacacactcagttgtgaggaaatgttgacgactccctagcacatccaaaaaagcattactttctgagcatttgttaagatctggaagtaagcctttttattccatgcacccccatgctttcatgtggtcctatgggttaggtccttttgtcttaggtggaaaacaatatacaaaaagaaatcactaccatctcctctttgttgtaggatctttaaatctcatgtctgtgtaggggcatgtgcgtttgagtcctgcagtgtgggaggcattagattcctctggagctggagtcacaggtcacctctgatatgcgtattgagcacaagtcttctggaagagagcagcatgggctctcaattgataagccatctctaaccccagattcttaggggattttcaccttgtaaaattctgccttgtggaattttcctgatctttctcacttgacattattgatccttgctttcaagtccttttctactcagggtggtaacagaaatcttttgttgtttaatatcagtctttattttttttataatattttttatttagtatttatatattttacataatgtacaactccacacttcccaactactaccagattccctacacacatcattctctcaactgtgactcagttgaaatagtggtgtccatatatgcatacataggggctgtccaatggggtgtgggaaagctaccaggtatcacacctcaaaagagaccactacaaatacacactagcagctatcaaatgtcaatagctcctcagctaggagttggggtttatgtatccctccccatttcatgatggaatgttgatactgtgcaagcaaccagagcagttcctgagtgcagtgtggccctaccatgtttagaagacaccttggccccagtcaagtttgtacctctttaagtctttccatcaccttttccgatgcttcctgaattttgaggtcagagtgtgtgatgtaggggttcaattcatgcctgaatatttcacagacattctgttctctgtaatttgaccagtcgcagccctggtattaaccaaatccattgcacaactcttctgatgaggaccaagtctgggggtgtacagatatgtgtttagaaagcagcctggtgccatgtccatttagcaaagtctcatcagtgcttttcttaacccatcagacctgtgagttccccagctataggttctcagataggtttatattaccaagcacgtgtgacattttcatgggctttaggatcagatctcaaactttatgccaaaagctcttttgttatgtttttaaagaagccaggtagtcgtggttggtgtacacctttaatcctaacatttggaggcagaggccagcagatctctgagttcaaggaagctaaatctatggagctagctctaggacagttagggctatatagagaaaccctgtcttgaaaaaccaaagaaagaaggaaggtgttcccagaaacattttttttctcagtcaaatcagagaccattttaaatgcagaagtgagaaaatggtgaataattacgcctattcatggaagcttttgtcttccttggtaattacatgttgttgtcttgggttctgtttctttgataggtccctgaaaccgctatggctgtcttgaatttaatggaattcagtgctagcagagaactggagcatgcattccacagcaaggctgtggtgcttctgaagcaatggagatgcttacatcctttatgttgacagaagtcagtttgggggcatgcttggtggatctcacaagagtgggaaccattttttagataggaaagctttcttagcaattatacaggacggagtcagtagaatagcaagtattcttgtcatgttacatgccccagactttctcttcagttctatgcttttccagctttggttaaaatcaggttcctgttttggggttcagagctctaaatattcaatgtgttgctccactgcagggtgagaaagactggcagaagtatgagactgcgcggcgtctgaagaagtgtgtggacaagatccgaaatcagtatcgggaagactggaagtccaaagagatgaaagttcgtcagagagctgtagcactgtacttcattgataaggtggggacatgttcctttatccacattggacagttctgtttacaggtatagggaatgtctacagtatagggatcaggaatgtatatctgctgtgtgacttataatccaaatttacttaagtaggaagagtagatgtggatacaaagaaagaggcatgtacagtatgttggctattgagcagtctctataacaagaggatctgcataaactgaacattattagttagtttgtttgtttgcttgtttttggtttttcgagacaaggtttctctgtgtagccctggctgtcctggaactcactttgtagacgaggctgggctcaaactcagaaatcttcctgcctctgcctcccaagtgctgggattaaaggcgtgtgccaccactgcccggctgtttgtttttttaataactgtgatgctcaagatttttgaccataatctgcaaaagtacttactttatgtcaaaatccaacataacagttttatttatgtgaaattaaatcgaaagttgcacaaaccactggttaactagtagcattgaattctggtggttatttctcatttcattcttttagaaaatgacaattataacctatacaattcttaaaaaagtgtgatttatgataattgcagtttgaaagatagtttttttagtgctcagatttttttcttcattttacacttaaattttagcccaaattctgaattcacacaaaattgataagtttttaatctgactgttctcatgaaaatatggtctcatttgttgccttgttttaatttttttcttcttctatctctactctaaggatggagtagagaaacttgggtctctgggtattctgtgactgacctacctacctacctacctacctaccttccttccctccttcccttcttacctccctctctccctccctccctcctccttcctcctcctcctccttctctccctttctctctctgtctctctctctctctctctctctctcttactcttttatttgttactatatttaagtacactgtagctgtcttcagacctgaagaggatgtcagatcttattacagatggttgcaagttaccatgtggttgctgggctcttaacagctgagccatctctctagccctgtgactttcttatgagttgagtttctaagttatgtagactgatgttcattccatctacaaaattgggggcttctggtttagagtgtcattgagattatatgtggtctatgtttcttcactcatctctttctgaacaactctgttccctttcttgcacagcttgctctgagagcaggcaatgagaaggaagaaggagagacggcagacactgtgggctgctgttcacttagagtggaacacatcaatttacacccagaattggatggtcaggagtatgtggtggaatttgactttcctgggaaggactcaatcagatactataacaaagtcccagttgagaaacgagtaagttcatgtggcctgtgcttctttctctagcttgctctttttacatgtttgtttattcagcaaatattttttgagggcttttgcatgttctgcattttgatgagctctagtaaaattgatctcaaagaaagaaaagagataatatttggtatatggtgtgcctcatttcatgcctgccctgcaacctctgctacattgctgggaacctgtggccatctctggaagcagtttataacagagtctgcagagagttagcctttatagcaaactcaatgttaagattgaacacagccgctttagtgatttaagcatcacagcatctgctgatcacttgttatcttgtggtttttcttagccccagtccaagccccaactgaataaaatggtaatctttcagttctcagtctctgagctcatctctgtagacccatgagatagacataggtacctactactttcgcccattcgataacagtgggtgccagttcaatcgagtaactagggtaagcataggttggctataagggagtgtttttgttcttaggaagtagatgccaggatgtttgatgctaacaaacatcctatttgagttacaatatataccacaaatggctgagaactgatacttaggtatttatgtaaatttacacatgcagaacaagaatttgggtataatatatataggttgtctttctaccttttctcttttttgaaagttattgtgagtttgaaattatttctaaaaaattttaaaataataattggacttgttttaggtttttaaaaacttacaactgtttatggagaacaagcagcctgaggacgatctttttgatcgacttaatgtgagtaaacacaggacactaggctaaagtccaaggcaatctcaagctcctggggtcaagagttgtcaaagggtatttggactgtccattcagtctagattgtccagtgacattctacatatccctcctcccttggggcactcagtcatctgtaaccagcagcagaccctccctcctcccaccctgtgggtggtgctgtggattcctaccaaagctgcaaggcagagggagctgagctttccatggatcttccctcttcctttcatcctttcatgctttcatgagacgcccagctgcctttgctacagacctaaggctttcacttgctttctttactgggagagatatttataagaaagaaaaaatttgttgtcttgaacttaagattaaagtactttatagaaaggcactatgcaatccttcctgtattctggaattattttccctctttgctaacttcctctgtgaaggacaggacagtaactggcaggatggtggcagcactggcacaaggactcctagtattcactgtaagggaaagggtgatttggtgtttacctcagttccaatatcctctttgttgtcgtgtttaatgcagactggtattctaaataaacatcttcaggatctcatggagggcttgactgccaaggtgttccgtacctacaatgcctccatcacactacagcagcagcttaaagagctcacagcccgtaagtaatactctgtatggttgtccttgggatggtgccagtttccttctcttcattctttcccgccaacctcttgaagaggctttgctgtctaagcaaaaccaaggcctttcttcccactgctgctgcaaactctagattaatctcatagaatactaacaagagctttgcatctggtctaaaaatttttatgttttatctgtgttacttacaagctcagagggtataggcagtggtgttaaattggggagaatagagttgtcatggttaccagaaaaatgtagtagtaaatctttttctttttttctttttggtcttcataatagtatgtaataattacctctgggaccttagaacttcttttcctctccatttaaaacaaactctcacactgtagctaaaggctgggcacattcatcatgtgatccaagctagtgaaccttctgcttcagcctacccacagctgaggctgtaggcaacccttctgctcctgccacttgaatttccactgccttctataaatgtatcaaatgctcttagacgagccagagatggtatgctggagatcagtaattaggattggtttaaacagtggctaaaaagcctggatgtgttggtggcagcccagcacttggaagcagaggcaaacaaatctcttgagtttgaagctagcctggtctatagagcaagttcaaggaccctgtcttaaaagaacaccccatccccactcctacccctccacaaaaaagaaagaaagtcagatccctagaactagagtaatagatgaaaccaaacccaggttctctgcatgagcagcaagtattttttaaccactgagccttctctgcagcccctgcagtatagcttaggatcccttcatctcattctcctgtagtcatttcttctagcacagctgcagcatttgctacatctgcctagtaagtgggagacagggaataagaaaagcagtataaaggtctgggggctttgggtttttgttttttgttttggtttgtttgtttgtttaaagatttacttgttttatgtgagtacactgtcactgtcttcagacataccagaagaggatattggattccattacagatgactatgaaccactgtgtggttgctgggaattgcactcacaaccatctggaaagcagtcagtgctcttaacagctgagccatctctccaggcccaactcttgaagtttttaagaaacaaaaccaaaaatatagatttccctgtaatgtagacaagctgggcagtagttatagctattcaggaacttagcagtttagagaccacctggacttcataatgagacctggacacaaaatccagtaagggtaaagaaaaatataaaagagaggctcagaattcctcctgtgacagaaactcattcaggtttatgtagaaatttactgcctttgactcaaatgttgaccttgaaacttggttatgataaactgaaggtttgtaaaaacatctagaatgcatttcatgtgtatattcttggtatacaaactgacccagttactattatatttctttgtagctgatgagaatgtaccagcgaagattctatcttataaccgtgccaatcgagctgttgcaattctttgtaaccaccagagggcgccaccaaagacctttgagaagtcaatgatgaacttgcagtctaaggtatggtgggtccaaaggtagggtagcaaagggagtccatgtctgatgtcttctgacaagcagaggcttctggaatctgacatagtatggcctgggataacagcaggctaatctgggtcggtttagaaagattttttttcaacaaatggaaataatttgatagtatcattgtttttttttcctaaaatatttgtgctggagacacaagttctctatgagccactttctgttttgaagtgctaactttgacataccactgaattgctagttgttgtccttgttatacttagggaaaatggaaatcttcgtggtagaatgcttgccttgtgtgcagcatgctctgggctccatccctagcatgacaaaaataaagtctcggtgatctggctaagaaacatgacagaaagatacacctcagtggcagaacccacctttgcttgtctaccatatgtgaagccctgggcttgatccccaaagcagaagcaggggaagggagaggaatcctgttacattgtttgaagtttaaaagatggtgaagcaatggcatttaattcgctcctaatcctagaacaactatttacatcggttgaggtgtgtcagatatgactgtgtcaggttgtgccctattgggagagactgatacgagaacaagttgttgtttctctctcggcactggctgcttaactatgcatttaaatccacagtgaacatgttaaaacagacacacagggttacaatggaaaacatttaatacacacagtctgtggcttaggaataagtatcctcatttaagatcttgaggtgatcctaacaattataaagtttaagacaatgataataaaagtgacatttccagagttctgcaacactgcaatgcataacaggaaagtattcaccatctgttggcaatagtcacaagacaagttatttctttggattcttgctcacagttaaagaggaaataatgtcaactagagagtagccaaagtacagatgcattttttttttaatccaaatttatagaattctatacttggacaatttacttttagaaactgctttgcaatgaaacttaacacatattttcaggcttagaatattcccctattgagatttctgcaagatgagaacacaggcataatgtatattaatctaaagctacaacctagagattctgatacccctggcctgaaaggatctccagatccacagggagtgaatctcaaatctgcacctaaggtcagcaaaggacgacggtcagcaagctaagaaccccacagactgccttttgagcatgagcctttgctttgccctgttagatggagatcctctgatgctgcttactttcctcatgtgttgtcattccaagcccagaataaataaagtatgagtaccaggtgctatttacacagttcaggagacccttcctggagaatgaggaggtcatttgttgctctcatttgaaaccactgtttgagcagctcgggctgtctgccaaagaagccctccaagtgtaggaaccttctccagtgtgcccacaaagtaaacacacgcccagttgcctagtcagtcaatggagtctttgagagaatttgacatagcttgccagtttagcattcacagaaatggttacgactgtgatttgctgtgtttctagtctaagaagcctctgcctagttgtggctccaatgcttttgtgtgcaaagtcagttctagtacaacatagatagtggaaggaagccactaacagtaaacatttaatgattctctcacaatggtgaattgtttctaatcttgggctgcattttatgtgggtcccctacccccacccccggaagggtagagggtggcaatgggtgtggtgtttttctaacaaattttaggctcagtcaacaacaacccaatgtgtgtaagtcaacatgtattcactctgggatattctcttgacctcataggtcagcagggtgattatggggataggattctttagaatccagcagcacaaactcaccagcattagctacaatatcatcatattgctgtttctaagcaacacccaaagcagaatttaggttttgtgggttcaacaagcaggaaagaatgatggaattattctgtctcttccttgtagatatggattccataagatttcctctgtggagggaaaacttcaattgatgcttattgaatgatgactaattttcttctcactttagactcctttactttctaaaatagtaagccaagttgaagcaattcctcattgatgtctacttgccagtttataatttcctgtgatatcctctttagtatatcctttcccaaagctggcaattctttcccagatttggcaggcttgcttagtagatgtgtgtatctcctctggtagtctcagaaggaatgctaaaggcccagagtggtggcccacgcctataatcccagcatttgaaagtcaaggacaggaagatcactgatcactgagtttaaggccagcttagtctacagagtgagttctagtctcttccttccttcctttttttttttttgaaacagggtttctctgtatagccctggctgtcctggaactcaactctgtataccaggctggcctcaaactcagaaatctgcctgcctctgcctcccaagtgctgggattaaaggtgtgcaccaccggctccagtctctttctaacgaactaactaactcataaacaaacaaaagaatgctaaagtctggcataggattaatttgaaaatagctgtcatctgggtcctcctctgttttctaaagctagtgtgttttcctgaaagagtacaaccagatttccaggttactctacagaaccttatattgttcaccgaagaacgtaaatgagcagcagacagcagctggattgttttctgcagtcactgtccaccattttcataaagcctttttgtactaggaagcactacagctcccagttttacgttctcagatgaagcttctttccctctccaggtcattttattcctaactgcactgccgtttttctctgtctatctagattgatgccaagaaagatcagttagcagatgctcgaagggacctgaaaagtgctaaggctgatgccaaagtcatgaaggatgcaaagaccaagaagtatgtacctgacactgtaccaagggttggataagggagaacagttggcaccatcactcagaggcctgagtgttccagctcacatggtctcattatgtagccttggcttcctaggataaaccaccattctcagctgttttcaaatacttcttgaggaaattttccatgattttctcctttaagcagtatataggatacttgtttgttcttgtccagaggtcagtcttaatgtatgattctgccattcttccagggtagtagagtcaaaaaagaaggctgtacagagactagaagagcagttgatgaagctggaagttcaagccacagatcgagaggagaacaaacaaattgccttggggacctccaaactcaattatctggaccctaggatcacagtggcttggtaagtcttaggcctgtgtagatttcctgcttttggttaaggaaaggcagaaagtctcttggatattgccagctccttcatgccgtgtctaagtttacatttcttccaggagagcctacagctctggttgctgaggtacatggaatatcctaggtgccccatgggcacattagtatagtagcccatgcctgctttcgagatctctgagataaagaatgagctgataaaataaagtcctttgaatatttttgtgcaccagaaagctctggacccctgctatgggttatcattgagctagactaatctcctttgttgtctccatatttattcgtttcttttttctttctttctttctttctttttttttttttacaggtgcaaaaagtggggggtcccaattgagaagatttacaacaaaacccagagggagaagtttgcttgggccattgatatgactgatgaggactacgagttttgaccagtctcggcaggggttctgtgaaaaggaacagtgtggtttggggaagatggataaactgagcctcacttgccctcacacccgagggagaggccacaagtcttaacaaaccaacatctttgcaaaaagatagacctggagatactataagggagagctgagccagttgtcctatggacaacttatttaaaaatatttcagatatcaaaattctagctgtatgatttgttttgaattttgtttttactttcaagagagcaagtggatgggaatttgtcagcatcctgccaggcaaattcagttttgctgcaatgtttggattctctcagctactgtatgtgaagtctgattatattggtgcgtttttacagttagggttttgcaataacttctatattttaatagaaacaaattcctaaactccctcctctcccctatttcaggaatttaaaattaagtagaacaaaacaaaaacccagcgcacctattacagctgtcattctatcgtcatgggaatcagttttcattaaacttgaagcagttgtgacttcggcagtgttttggttcagacacctattcacagaaaagcatgatgggaaaatatttcctgacttgagtgttcctttttaaatgtgaatttttatttcgttttaattattttaaaatatttaagccttcttcttgatcttaaagatcgtgtagcttggggttggggagggatgaagggcgagtgagtctaaggataatgtaataatcagtgactgaaaccattttcccatcatcctttgttctgaccattctttgtaccctttaagagatccatctttttctttggaaaccccagtctttcatttgaaagatgttattgtataaaaacttccacaggtcaataaatttagaggaaaatgagcatttggtccaagaaaaacaaaaaccaaaacaaaacaaaaaaggaaaaataatcaagattttagggcttttattttttcttttgtaattgtgtaaaaaatggaaaaaaaaacataaaaaggaaaattttaatgtgaagactttttttttgctataatcattagttttagaggcattgttagttagtgtgtgtgcagagtccattcccacatctttcctcaagtatcttctatttttatcatgaattcccttttaatcaactgtaggttatttaaaataaactcctacaacttaacggaaacttagcgtctgcctgtttgtgaatgaggccccaggccagagtaaaggctcagggctgagatttagtgcagttcatggtctattcattcaggtcagcaagggtcggtccctcccagtgggaaggtggtatgggcttgtcctgggagtacatctgtcctgatgtgggataaagagtatcagtttccatccctaaagacagccccagaaagcaagggaatgtacaataaacctttaggaactgcctaatcccagtgtgggcagtgcctactgagtgggacagccttgtttatttgagaaacaatcgtagagagctttccatgtgtactgaacagaaacaggatagctagcttatatggagaagcctccagacggaatgaagattctgaattgattgattgaaggacttaactgttaactgtaacaagcccagagctctggataccccaaagtagccatgatccctaccaagtgttccttctgttaccctaagtctgaaattcaaggtgagaaagtgaactccagactaaagggaaggtccgaatgggccaccaattgaagggcccacacctgagcttgctggcatccgcaatctattcagaaccgcctttcttagtggtctgcgttatcactgatgctgggaccacagcagcaaactcttggtcccttgaagcttgaacttcaattggctattgaaggcagcacttactcctgagaataaaaacagtataaccatcactgtttggaaccaagaacattatagccaggtgtttttgaattctgtagtgttagagttagccagacagaatgttaaaacgggaggcctttggtaaccaaccaatactctctggctggtagctggtaagaaatgaaccttagttttaggacctggtaacaaagacaacagcaaatagcaaagtgcattccaggcagtggtggcgggcctcttgaggaaagccacagagcacacatgaatctcagctgatcctgactgggactgagaagaggctgccaagattgggggagctgatgagttttagaggtatataaggcttgcgcttagagaatgggagtaaacctgccatccttgatgacccagcacatctcaattgtagcccattatgcaagagcagaagctaggtgggcagtatctgggaagcccctttctgtgggcaaagggcagtgcttctatgtggcaccaagctacacatcatccacactcttgccatctgtgcagcaagtgcactgtctcttccaaaagctgggacctaacaactgacacatttaaaaagtgaaaagagacacttcacacacacacacacacacacacacacacacacacacacacacacacctcagcctttccagccacaacctctcttcagtttcacaatcaagtaagtacctgcgatgagtcacccactgcactgtcttttcccaccctctgcatccagtgtctaccacaaccctctccctgggttctaaccctggtcaccagtgaccacgcaacaaggagagagtgcagtcttcattcaccatcttgcctaagctctttttgggtggaattgaatgctgttactttacatgccataaatgtaacattttaataaatgatttttagtaactgctgacaagttcatccatcatcatgggtcagttttagatcacttttcatccctcacacccatttgcagctattctgcactcccatatgcatcctccactggtctcaggtttattctctaaacatgtcttatggatgttttatttgaaagagctcatagtatatgtccaccccttgtaaaagtgcctctctggctcctgtaatgtcgcccagtttcactcctatttctgtcaggctgtttgtggctgagacatttttaatgtagctgccatcgtccttctcatttcatgtagccaatgcagtcacactcctgagctctgcacgcacagtcagccacacagttctgcaggatatccacagaaacctctggaggacaactcaggactcgctgttctaagcctgctgggtctgggtttcctgtgtgtgaaaagcacctcactgaaccaggcagactcagcccttggcccttccttccaagctcatatctagtaatttgtcgactttgaaattctttcctaaatacttgtaccacatataggcattttcccaatttttaaaatttcttacatttttttaaaccttttttttttctagaacttttatttcagcccttgcagatccctcctataagacattttcaatttgttcggaacaaaagagcacttcttggagaacatactgccctgaaatgacctcagtcaagctagttttggatgcttatgagtagtcccctgatgacaaatcagtaaacagggagggaggggagatttaacagactttccccacaaccctaaggaagcagcctttttgaaattgccatatagattttttaggttaaataattacgctgtacttacatattttaaaaaatctttcagagaaaatattcctggaaaacagtgctcatcagtgcagaggctggggctagtggtgtaggccagaggcagggcccgtgaccctggggtctgcccataacactataaaaccaccaccaccaaaaccgtcaatgtaatcagttcccaaagttgggtggaggctcactatactaactgtcatgcctgtacttacattggaaaatccttatagccgggcagtggtggcgcacgcctttgatcccagcccttgggaggcagaggcaggcagacctctgagttcgaggccagcctggatgtttaaattaaggcaattatgcttaaattaaaattcccagtgaccgcagatctgccctatatactgtctgggtagaagttacaaggagtatatttttcaaactcaaacttcacacgtaagatgggtgcatcttagggctagagagatgcttaaggggttaagaacacttgttactcttgcagaggattggtgtttggaacctaacaactacatggtggctcacagccaaccaagtaacaattccaggtgatccagtaatctctcctgaccactgtgcaccgggcacacaactggtgtgcatgcgtatacacaggcaaagcactcatacacaaagtaatttttaaaaggtaggtacagcttacgtgtaaattattcttcaataagtctgggctttcagaagcagtggggacgatgtgctttgataacattggatggttctctcatggtgaaaaagacagactcaaggctggagagatggctcagcagataagagtcctgaattcccagcaaccacatggtggctcacaaccacctgtaataatatctgatgccctcttctggtgtgcctcaagacagcaacagtgtactcatctataataaatgaataagtctttaaaaagagaaaaagacagactcaaagattcatgcaaagtttactgataggactgaatgtagggaatcaatatttataaatagtttttaacaatcctattcaaagtatacacgtgccactgaacacatacttggcattttaatcattcatctttaaacctttgtacttcctttgcagaaacactccacaaaataccttggggtgaccttattgtgaaaggaatagttacctcatttggagaggctgtttgtcatgaatacacagcacctctcactttgttctcttcccataatcactaaagaatctagataaggtccttcttgctccctgtgcctttgtcagaccaagcatggcctgtttctgaacaggcttgctgtgttcctgccctgctgagattctctagaaggcacagtagggatgtgtgctggaacaaagggggcgagagtaaaagcaagtccatgctggtctcagtttcccctgtcttcagcaccacatgcttgacctcagtgaaacaagcactgtaccggccgttcctggctgaagagagctaatggtaacagtcagtagtgaggcagccagggctgtggacacaagaggttgttgggaactgttggcatagatgtgagttatggagcttttgttctacaagacagggtttctctgtgtacccttggctatcctggaacttgctctgcagaccaggctggcctcaaactcataaagatctgcctgcctctgcctcccaagtgctgggattaaaggtgtgccaccaccacccagcaggtacgatttttaacttgagtaaaaacaaacaaaacccctaaagttcctttaagggactgagaatgcaactgacttaaggaaaggagcccggaggttatgatgtcagaagggatggggccctagataggtttgcaggtcagaggacaagggcttatactgcaggttcactgaggtgtgcacttaggaagtgcttgctgcatgtacagttaacagcagaggaaataagggacggaacacagcttgatgaatggattaagcagacacttcaagtctaagtctttgtctccctctgtgaacggaacatcactatgctctgacatgatgacttctagagtcaatcattataacgaagaaaagtgtgttagcacttggtactagcctgctaagaatgccctctgttattttaatcacatacatagtcatgtgagaatattttcttataatttaattccaggaaaatgttattccctttccacagaactagttagcaaacattgagagtcactactttagctactatagagctcagccacagctgcctcttaatcgcagcagctccattaccactcaaccatactgtgattgcccttataatcacatctcccatttcaaccacacagcatttttgtccttttctgttttaagtgccctctatttttcctaaagagcttggtgcagtggtgcccactggatgtctcaattcttgggaggctggggaggcctcaagtttaaggccagcctgggttctacaagcaagaccatacctgaagaaaaatgcagtgaacatagcagcgtacctgcttcctgttcaaggaaagacttgtcatcacttctggaagaagtgtaaatagaaatccatctgccagtccgtcagctcacaaagagccaggaggctgaggatgaacgttttgcagaacaatgaacatccattccaggatagcactgcacaacacagttccctggaagttgtctgaggctgttcgcactcccatctccttcctgttgcttccacaatgctgaccttagggctgctccctaaaaagtattctacccactaacctatcagagacagcaccctaaaacaaattccgacctagccgggaagcacagtagctcacatttttaatcccagcaaggctgagttgctgagtcaggagaatagctaaactcaagatgagcctggatttgtacaaacttgtacaaaataactaannnnnnnnnnnnnnnnnnnnnnnnnnnnnnnnnnnnnnnnnnnnnnnnnnnnnatctctaggacccacatggtaactgtaaataaagaagctcacttaggatacccaagatataagatacaatttgctaaacgcatgaaattcaagaagaacgaagaccaaagtgtggacactttgccccttcttagaaatgggaacaaaacactcatggaaggagttacagagacaaaatttggagctgcgacgaaaggatggaccatctagtgattgccatatgcagggacccatcccataatcagcttccaaacgttgacaccattgcatacactagcaagattttgctgaaaggacccagatatagctgtctcttgtgagactatgccggggcctagcaaacacagaagtggatgatcacagtcagctattggatggatcacacggcccccaatggaggagctagagaaagtacccaaggagctaaagggatctgcaaccctataggtggaacaacaatatgaactaaccagtaccccggagctcttgtctctagctgcatatgtatcaaaagatggcctagtcagccatcactgcaaagagaggcccattggacttgcaaactttatatgccccagtacaggggaaccccagggccaaaaagggggagtgggtgtgtaggggattggggggtgggtatgggggacttttgggatagcattgaaaatgtaaacgaggaaaatacctaataaaaaataaattaaaaaaaagaagaagctcacaatatgcttaccactgttctaagtagttattaaacgcaatatgagatcaggcccacaggccagaggggcagctgggcagtctttccttgactccaggaacaggcttggtataagctaaggttgaagcatgagtgttgcctgaaataagccccaatctgggctagtcggggtgacgtcacaggcaagtgccttgtgtgggggctagagcacctcccagacagcacaaatgtatatacattaccagtgacacctacacatccttatatatgctgagctgggggaagcccatactggctacaccctgtgtgtgccctacttttcccaaacttccttgggtagaaggagacacctaaggcctaggaagctaggaagaggaaatgaggccctgtttcccaattataggcctggcaaacaaattgctgttggaagaaaatcatggagcccctgggggtgggggtggggtcttgttacagacacaaaagcaaaaaaggtttgggctgaacacaaggaagctcccagaaaatagaattttaaagcatactgtagcctctaggctgctggagttggcacagaaagctcaacaacgattacaacattttaagagggtgtctcctgagagaaccggccagaccaggcaggcagggaaaggccctgttcagctccatctgccctctctgtctaatcatcctggctggccattcccctccactgagtaaaaaccccagggcctttgcacatgctgttattcatacctggaaagtactttcctccagccttcccttcaaaatacatatgtccatctctttacaccatttggcctctcttgaagtcctacagacataagacacagctcctcttacttaatgattggccagctagccaatggccaccaggattacctctcacccagtgggctctcttgtggaacacagacactcagcttcccacttattacatagcctgacttcaagtcacggggctctgaaaccttgattagaagataattaggatcatgagttgtgcaagccaacctcaagtccagtttccgcctacatcagaggcctgtcactaggtggcagtcagtctatctcaactccccagtccctcaggacaaagttcctcagtggtatacagaattcggacgttcttgagaccaccctcaagggaaatagcgcatctgtcactatttgcctggcaaagcgaaggtggcccaggtgggtgggttgtccaaacccatacatcacaaattctagtctcaggaatcccaggggagctttcctgcaaggggatgttgtgtgggacttctcacctctgaaatgcagatgctgtccagagctgcagggtagctgtccaactaactgtctgctcatcattggccagacggcaggatcaagggatgccctcgggtttacccgtgctgttcagagaacggcttttggaagattgattttaagttatttaacagtcacagacaggtgtcatgtctggagaatagaggcaaagtccgcggtgagggatgaagcaggagagataggggaaggcaagacaggactgctgggccacgaagctgtgctgatttgaagcacagtgggaattcacgtacgcaatttcaaaggctttagtggtaaattctgaagctcagatgcaggcaagacccaagaggatagtgtacacagagagaagaggggtcctcaggatcgtgcgtagagtggagagagccccaaaggcaggagggaagagcctcagtggattacttagggatgagggagagaagaaaaaaggttcttgcaaggtgtggggtcttccaaattcaggagttcactgccatatagagaaggtgtagcgggtgaaaggggccatgtgatgaggatggcaagcaaggctgtggcgcagatgacgagatgcctgggtcgggaggtcaggggagacccaggattggggtcacctgtgtctgcgcagaggggaagccaccctgcaactggcccagcactgagtccagaggaaaatgaggcagaggacaaaccagagcttcggagactaagtgcaggtagggcgcgggcggagcgtgaggagggcagcggaccacgcgagaggcctcgaaggccaccggacccgcgtccgagagtctgagggccctgcccacacctgcgtggccccctccccagaggccacactccaaggccaccctagaacccgtctgtctgctcaagcccttgcaaaagacgtctgcgcagagggggcgtggcaggcgtgctgtcactcacggcctgttagccaatccacgagtgcgcccctccccggagagggtgcgcggagggcccgcccccgccgccaccgcgggtgtgaggaggccaggctggcgcggctccctccgcccggcagccttgccaggtaaccgggttcggcgggagggctgggggtcgcgcagccccctcgctccctgggaggcgtgcacactgccgcggcgggtcccgtgtgggccggaggcccgtgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctcgcgcctgcccgcctcccaaacacttgggcaaactttcgggcctcgcgcctggcgccccgtctccgcccagtccctggtggtcactctggggcgggtggaggggggcatccgggtcttggatcacctgataggacaccccctcccccagtagggggggagtgttccaggcactttgccctgaggcctaagagtcctcactggttggacaagtggagtgggattccggcccttagcatcgggcggctgtcagtggctgtgaggggaagccaagacagggaccccctcatccaacctgagaacctggggaaccgacaagatcttcctgcccactgccatttctccagagtgtgctgtctgtgaaaactcctaagagctccgggatgggcttattggcgcaagaacctttggaatcctcatgtagaacttaggcagatgttggggtagggctggttgtggagcagagcgggcctactcatctccctcttctttgggaggatggggtatgaaagctaaaaccgtgactgcttccccctccccatgtcccgtggatggttttttttttttttttttttttgccccagatctgaattttggaggtcca

SEQ ID NO: 1194 - DNA, 3458 bp, Mus musculus
atgagtggggaccatctccacaacgattcccagatcgaagcggatttccgattgaatgattctcacaaacacaaagataaacacaaagatcgagaacaccggcataaggagcacaagaaggataaggataaggaccgggaaaagtctaagcatagcaacagtgaacataaagattctgaaaagaaacacaaagagaaagagaaaaccaaacacaaagatggcagctcagaaaaacataaagacaaacataaagacagagacaaggaaagaccgaaggaggaaaagattagagctgctggggatgcaaaaataaagaaggaaaaggaaaatggcttctctagtccgccacgaattaaagatgaacctgaggatgatggctattttgttcctccaaaagaggatattaagccattgaagaggcttcgagatgaagatgatgctgattataaacctaagaaaattaagacagaagatatcaaggagaagaaaagaaaactagaagaggaagaggatggtaaattaaaaaagcccaagaataaagataaagataaaaaagttgctgagccagataataagaaaaagaagccgaaaaaggaagaggaacagaagtggaaatggtgggaagaagaacgttatccagaaggcatcaaatggaaattcctagagcataaagggcctgtcttcgctccaccatatgagcctctgccagagagtgtcaagttttactatgatggtaaagttatgaagctgagtcctaaagcagaagaagtagctacattctttgcaaaaatgcttgaccacgaatatactactaaggaaatattctggaaaaatttctttaaagattggagaaaggaaatgactaatgacgaaaaaaatacgattaccaacctaagcaaatgcgactttacacagatgagccagtatttcaaagcgcagtcagaagctcggaaacagatgagcaaggaagaaaaattgaaaatcaaagaagaaaatgaaaagttattgaaagaatacggattttgtgtaatggataatcatagagagcggattgccaacttcaagatagagcctccggggcttttccgaggccgagggaaccaccccaagatgggtatgctgaagagaaggatcatgcctgaggacatcatcatcaactgtagcaaagacgcaaaggttccttctccccctcctggtcataaatggaaagaagtccgacatgataacaaggttacttggctggtctcctggacagagaatatccaaggttctatcaaatatatcatgctgaatcccagttcacgaatcaagggtgagaaagactggcagaagtatgagactgcgcggcgtctgaagaagtgtgtggacaagatccgaaatcagtatcgggaagactggaagtccaaagagatgaaggttcgtcagagagctgtagcactgtacttcattgataagcttgctctgagagcaggcaatgagaaggaagaaggagagacggcagacactgtgggctgctgttcacttagagtggaacacatcaatttacacccagaattggatgttcaggagtatgtggtggaatttgactttccttggaaggactcaatcagatactataacaaagtcccagttgagaaacgagtttttaaaaacttacaactgtttatggagaacaagcagcctgaggacgatctttttgatcgacttaatactggtattctaaataaacatcttcaggatctcatggagggcttgactgcgaaggtgttccgtacctacaatgcctccatcacactacagcagcagcttaaagagctcacagcccctgatgagaatgtaccagcgaagattctatcttataaccgtgccaatcgagctgttgcaattctttgtaaccaccagagggcgccaccaaagacctttgagaagtcaatgatgaacttgcagtctaagattgatgccaagaaagatcagttagcagatgctcgaagggacctgaaaagtgctaaggctgatgccaaagtcatgaaggatgcaaagaccaagaaggtagtagagtcaaaaaagaaggctgtacagagactagaagagcagttgatgaagctggaagttcaagccacagatcgagaggagaacaaacaaattgccttggggacctccaaactcaattatctggaccctaggatcacagtggcttggtgcaaaaagtggggggtcccaattgagaagatttacaacaaaacccagagggagaagtttgcttgggccattgatatgacttatgaggactacgagttttgaccagtctcggcaggggttctgtgaaaaggaacagtgtggtttggggaagatggataaactgagcctcacttgccctcacacccgagggagaggccacaagtcttaacaaaccaacatctttgcaaaaagatagacctggagatactataagggagagctgagccagttgtcctatggacaacttatttaaaaatatttcagatatcaaaattctagctgtatgatttgttttgaattttgtttttactttcaagagagcaagtggatgggaatttgtcagcatcctgccaggcaaattcagttttgctgcaatgtttggattctctcagctactgatatgtgaagtctgattatattggtgcgtttttacagttagggttttgcaataacttctatattttaatagaaacaaattcctaaactccctcctctcccctatttcaggaatttaaaattaagtagaacaaaacaaaaacccagcgcacctattacagctgtcattctatcgttatgggaatcagttttcattaaacttgaagcagttgtgacattggcagtgttttggttcagacacctattcacagaaaagcatgatgggaaaatatttcctgacttgagtgttcctttttaaatgtgaatttttatttcgttttaattattttaaaatatttaagccttcttcttgatcttaaagatcgtgtagcttggggttggggagggatgaagggcgagtgagtctaaggataatgtaataatcagtgactgaaaccattttcccatcatcctttgttctgaccattctttgtaccctttaagagatccatcttttctttggaaaccccagtctttcatttgaaagatgttattgtataaaaacttccacaggtcaataaatttagaggaaaatgagcatttggtccaagaaaaacaaaaaccaaaacaaaacaaaaaaggaaaaataatcaagattttagggcttttattttttcttttgtaattgtgtaaaaaatggaaaaaaaaacataaaaaggaaaattttaatgtgaagactttttttttgctataatcattagttttagaggcattgttagttagtgtgtgtgcagagtccattcccacatctttcctcaagtatcttctatttttatcatgaattc

SEQ ID NO: 1195 - DNA, 2301 bp, Mus musculus
atgagtggggaccatctccacaacgattcccagatcgaagcggatttccgattgaatgattctcacaaacacaaagataaacacaaagatcgagaacaccggcataaggagcacaagaaggataaggataaggaccgggaaaagtctaagcatagcaacagtgaacataaagattctgaaaagaaacacaaagagaaagagaaaaccaaacacaaagatggcagctcagaaaaacataaagacaaacataaagacagagacaaggaaagaccgaaggaggaaaagattagagctgctggggatgcaaaaataaagaaggaaaaggaaaatggcttctctagtccgccacgaattaaagatgaacctgaggatgatggctattttgttcctccaaaagaggatattaagccattgaagaggcttcgagatgaagatgatgctgattataaacctaagaaaattaagacagaagatatcaaggagaagaaaagaaaactagaagaggaagaggatggtaaattaaaaaagcccaagaataaagataaagataaaaaagttgctgagccagataataagaaaaagaagccgaaaaaggaagaggaacagaagtggaaatggtgggaagaagaacgttatccagaaggcatcaaatggaaattcctagagcataaagggcctgtcttcgctccaccatatgagcctctgccagagagtgtcaagttttactatgatggtaaagttatgaagctgagtcctaaagcagaagaagtagctacattctttgcaaaaatgcttgaccacgaatatactactaaggaaatattctggaaaaatttctttaaagattggagaaaggaaatgactaatgacgaaaaaaatacgattaccaacctaagcaaatgcgactttacacagatgagccagtatttcaaagcgcagtcagaagctcggaaacagatgagcaaggaagaaaaattgaaaatcaaagaagaaaatgaaaagttattgaaagaatacggattttgtgtaatggataatcatagagagcggattgccaacttcaagatagagcctccggggcttttccgaggccgagggaaccaccccaagatgggtatgctgaagagaaggatcatgcctgaggacatcatcatcaactgtagcaaagacgcaaaggttccttctccccctcctggtcataaatggaaagaagtccgacatgataacaaggttacttggctggtctcctggacagagaatatccaaggttctatcaaatatatcatgctgaatcccagttcacgaatcaagggtgagaaagactggcagaagtatgagactgcgcggcgtctgaagaagtgtgtggacaagatccgaaatcagtatcgggaagactggaagtccaaagagatgaaggttcgtcagagagctgtagcactgtacttcattgataagcttgctctgagagcaggcaatgagaaggaagaaggagagacggcagacactgtgggctgctgttcacttagagtggaacacatcaatttacacccagaattggatgttcaggagtatgtggtggaatttgactttccttggaaggactcaatcagatactataacaaagtcccagttgagaaacgagtttttaaaaacttacaactgtttatggagaacaagcagcctgaggacgatctttttgatcgacttaatactggtattctaaataaacatcttcaggatctcatggagggcttgactgcgaaggtgttccgtacctacaatgcctccatcacactacagcagcagcttaaagagctcacagcccctgatgagaatgtaccagcgaagattctatcttataaccgtgccaatcgagctgttgcaattctttgtaaccaccagagggcgccaccaaagacctttgagaagtcaatgatgaacttgcagtctaagattgatgccaagaaagatcagttagcagatgctcgaagggacctgaaaagtgctaaggctgatgccaaagtcatgaaggatgcaaagaccaagaaggtagtagagtcaaaaaagaaggctgtacagagactagaagagcagttgatgaagctggaagttcaagccacagatcgagaggagaacaaacaaattgccttggggacctccaaactcaattatctggaccctaggatcacagtggcttggtgcaaaaagtggggggtcccaattgagaagatttacaacaaaacccagagggagaagtttgcttgggccattgatatgacttatgaggactacgagttttga

SEQ ID NO: 1196 - DNA, 96592 bp, Homo sapiens
ttcaaactcctgggctcaggtaatccccgcacttcagtctcctgcctagctaggactacatgtgcatactcccatgcctgactaatttgaaaaacatttttgcggggagagatgaggtcttgctatcttgccttgtctggtcttgaactcctgggctcaagcaatccttccaccttggtctcccaaagcattgagattacaggtgtgagccaccatgcccagccaagcctcaagtcttgaatactttaaatccattttctttcttttttttttttttttgacagcgtcttgctctgttgcccaggctggagtgcaatggtgcaatctcagctcactgcaacctctgcctcccaggtttaagcaattataggtgtgtgccaccacacccagctaatttatgtgtgtgtgtgtgtgtgtgtgtgtgtgtgtgtgtgtgtgtgtatttttagtagagacgggatttcgccaagttgcccaggctggtttcacactcctgagctcaggcaatctgcccacctcagcctcccaaggtgctaggattacaggcatgagccaccatgcctggcctgtaggtaatattttctaaaacacatattatgttcctccattgctcatagcaactctcagtgacttcccagtgctatgaagataaactgcaaatgccttagagaccctgcatgaactgggccttgcttacctctccagcttcatctctcactactcctcttcaccctctaccccttagccatactgaattaccagcagttccccacataaaccctgctctttccagtttccaaatttttgcccatctgttctcttggccttgagtgcttgtctccctcacttgccttctttattctccccaacctttacctggctgacttctgtttccattttgagacctaagtttaagtgccatttccactggaaatccgtgcctgactctgtaattctggatggcagttcttctaaagggctcctaccgcaaacacactgtactttatcctcgaggcactcatcacagtaagtgacaattacttgttcccttctctgtctcacccaccagacctgagctccttgagagcaggggccttgtctttctagttcacggctgaattcctaatactagcttagtacctggcttatagttgattgtgtgtgtgtgtgtgtgtgtgtgtgtgtgtgtgtgtgtgtgtgtgatgcagggaagccaaagaagggtcaggatgcaatgataacctggggaaggagggacaattacaaaggaaagtcttgggcagattccatacaggtagtagccaccaatgggatgtggaggacaggatcaagggttaactcaagaggcttcaaggttctgagcctgagtgactgggaggaatagagctattcactaagcagagaccatagaagcgaagggcagtttcaggagaaaagctgaacccaggaccaaagggctgtgggggtcatcaagtggacacatgaaataggcatatgggtaaatatttctatggttctaaaaaggagtcaaggctggagacattcatttaagaagctacctggccaggcacggtggctcacgcctgtaatctcagcactttgggaagccaaggtgggcagatcatttgaggtcaggagtttgagaccagcctggccaacatggtaaaatctcgtctctactaaaaatataaaaattagccaggtgtggtggtgggcacctgtaatcccagctactcgggaggctgaggcaggagaattacttgaacctgggaggtgaggttgcagtgagctgagatcacaccactgcactccagcctgggcaacagagtgagactccgtctcaagataaaaacaaggctaccaagatgggggcatatagagagaagacaagtgtgatgatataatcttggggatccattaaattgtgctgaaagaagagagggagagagaaatggtatttggacaggtaagaaaaaagccaggagaattaatggtcattggatccaaatgcaaaggacctcaaagaatgtgctcatccacctcattgagtgttgcaggaaggtggagaagaataggctactctacttggaaactaggaagtccctgattagaatagaagccagaccaacagtgttaaaggaatgaaaaataaagcagaaaaggcagcacatgtagactgtcctttctgaatctttcaaacacaggtgagggcaacagtgacctaaggacaacttgggaagcaggttaggggttctaagactgggctccatacacacactgcttaagttcaaatcatagccccaacactcaatagctgtgtgactttgggcaagttaacttacttaactttcctaagtctcagtttccttgtctaaaacggtgggacaagtagcccctgtttcatatggttattgcaatgattatatgaaaatgtatgtgaagcactcagcacagggcagagacgtggtaagcaaccaattaacgtgagacatgaattttaacagggtcaaggaggaaaactgggaggaggagaagttgccatgcaggagggagagaagatgctcgggtgaactaggctttgaggaggtggaagggaggggactgaggacttggagggcttgtggagagggaggatggggaagtaggccttttcaaaacccaactttggctaaaggatcacctgctggttactgaatgaagcagctacttctgttccattttcttggggagtcatgctgaggcatctctaggagcttctctcactcctagaatcttccagtgtttcctggagcctggtctctgcctctatgcctcccactgcctgctggttctctagctggaggcagctggactcaggcagccgcaggatgtcccagcagcacacattgggagagggggattcagagagagctgcttcacaacttctctttgggctatacccttgacacaggccaaatccttctgtccccgtcacaggtacagatactttctatcttcaggtattccaaatgatcttccatgattaaggttgcttctgaaacacaatggtctccctggacctccgagctaatctgcctatttccagtgtcagttccaccaaactgttccccctctgctgcctgtgattgttctcatacctgtttaaaaccctgtcataattcaccttgcagtatctccaccagaactgggagggcctctcccacctgcccagcctacattggttatatcttcacttttaccctctgctccatcctgaccaaagctatggctctgcatatattgcctctcttcttgcaatatcttttcttctcttccacgggctagcaacccctcatctttcaagaatagtgtccaactagaaacctttcctaatattgcccccaccaccactggtgagttggatgtgctcctttactcaagagttcccacagcaactggtggctggcctcctcttccctattattccttataccttagtgttacagctggagaatacctctgtctcattatcagactaggcactcttccaaaatgaggattaggtcttataaatagctgtatctctagggcttagtataggacctaccaacctcaaataggtaagtagtacctatttgccttcattcctcagggaatactggttgaatgaataaatgtcctcatttaggatgtattctggcaggaagacaatggagatgcaagtggactacttttcttgccccaagccacatggccaggatcctacatctttgttgcttgactgcctctcatttcataattcaagagttgccagctttcttattgatactgaccttttttttttttttttttgagatggagtttccctctcgttgcccaggctggagtgcaatggcgcaatctcggctcactgcaacctccacctcccaggttcaagcaattctcctgcctcagcctccctagtagctgggattacaggcgtgcagcaccacgcctggctaattttgtggttttagtagagaggggtttctccatgttggtcaggctggtctcgaactcccgacctcaggtgatcctcccgccttggcctcccaaagtgctgggattacaggcgtgagccactgcgcccggcctgattctgacctttttattccacacatctcaactgttgctgagctgtttcattctaggaggcaaagagcttttctggttgttcctgagatcaccagcctgaatctcctttcttgagcacccagcagtttcttttccaagggtatcggaatcttgaaagggcagcagattcttaggcatgggcggggagagctgctagaagacatcactgtcaaagaattggcaaagtcaagaatgtgccagcatccaagggtcaaaacgtcaggtgggacatcctgttccacagcatgatagccccagagggggtgccaaaaggatgacaaaagccttgtgagtgcccaggaatcaagtagagattaggaccaacccatcagagtgcaattaagcaaaagggggaatcaatttaaaggtgccagaacaggaaccatgcaaccaggcttcaggagaaagtaggaacgagggtcctgaacttcattcatcagggtcctctctctctcttttttaagacaaggtgacactctgtcacccaggctggagtgcagtggcacgatcttggctcattgctgcctcagcctctcaggtgttcctcacctcagcctccctagtagctgagactgcaggcacacaccactatgcccagctaatttttgtttgtagagacagcattttgccatgttgcataggctgacttcaaactcctaggctcaaatgatccagccgcctcaggctcccaaagtgttaggcttacaggtgtgagccatctggcgggagggacttctatctcttatctcttctcttcctccacccactttctcctatatcctcccccacttccaggtttctctggcccttccaacagcaagtatcgccaggagcagctccctaatctacatactacagatctatccacaagaagacagatggaaccactcttttcttctgaattctagaaccttaaggaagttaacctgagtggctcagcttggatcaagtgcccatcctggtccaaacaactgtagcagcacatctgtgtatttgtgtatcttgttcctccataatcttgcagtccggggaaagtgtgcagatggatgggtccctgaaaagcaagagttgtttagacaacgctagaggtgttcagttctgggagacaagagttgggccaggttgataactagcctaagagagtcggaatcagatgaataagaactagatcttgggtgacaacctagatcaagagtcttgaggttcagtcatttcaaaaagctcaagtctcattgcttcttggccttctggctaagatcatgtgcagtatctgttcttaccagtttaatatctgatacatcctctatctgaggataatataataaatagatttttggagcaaggagatggaataggagcttgttctgtccactctacacattggcctggattgcagtacctccaggaatggtgcaccctctctaccacccccaaaaagcccaagtctcaagaggtagtctggaaaaaagtgtttttggatttacctacatttttttttccaagatggagtctcgctctgtcacccaggctggagtgcagtggcgccatcttggctcactgtaacctctgcctccaggattcaagcagttctcctgcctcagtctcccaagtagctgggattacaggtgtgtgccaaccatgctcagctaatttttctatttttagtagagacagggtttcaccatgttggccaggcaggtctcaaagtcctgacctcaggtgatctgcctgccttggcctcccgaagtgctaagattacaggcgtgagccactgcgcccggcctaatttttgtaattttagtagagacgagttttcaccatgttgaccaggctggtctcgaactcctgacctcaggtgatccacccccgccctcggcctcccaaagtgctggcactacaggcatgagccaccgctcctggccgggtttgcctacattttggagatgctgcacaccatgtccctcttttcaagagtcacgtaagtatttacatatggaagaccctgagaaggcacctgggaaaaaacctgtttaactgtaaatataataatgtatgtatttgtatgtggagctcttcttttagtggattatctataaaccgtccactgttcccaatgcatactttggagacagacctacactaccagttttcacctgctagttatttttataagggttgggatggtccatgagtgaacagtcttgatttaaagcagtgtttcccaaacctcatttatttgcctatagccttcctggagtttgtcttatatgtccgctctgtgcactattcctatatgtttttatgtaaatcaatcacttttttaaaaagcctcatcccagttatatccttaaaacaatggttattttttctcatacacatcgaaatacatatctattagaattaaaatgcttgtccatgcactatcaataatctcctcaagtaccatatggtggggacatgtgtttgaagtgttaggagtcaggagtggtctctgtaagacagagtaagtcagtcaacctctgagcactgccagccacacatgctggcagagaagttcagcctgtgacaagactgcccggatatttccatgtctgtgcacggggatgtcctcggtctgccattgtgaagtctgtgctgttttcatgcctacctagtcttctttggaggggcctggaaagcaaatgcaggctgggtacagtggctcatgcctgtaatcccagcactttgggaggcaaaggtgggcagatcacgaggtcaggagtttgagaccagcctgaccaacatagtgaaaccttgtctctactaaaattgcaaaaattagctgggtgtggtggtacgtggctgtaatcccagctacccgggaggctgaggcaggataattgcttgaacccaggaggcggaggttgcagtaagcccagatggcaccactgcactccagcctgggtgacagagactccatctcaaaaaaaaaaaaaaaaagaaaaaaaagcaaatgcagattctccctgggaaacggggggttgggagagtggagtagtgtggatgcattgttattcctgaaggccgtcctcaaattatcttggactcactgcagcaagcagatgcctcatcttctggccagggattgatcctgagatgggaagagtatgagaagagacaccaacagcaaggcaaaactggctctggcagcttgcttcagagaaagagtatagctttggagtcaggccgacctgagtatgaatccaagactcagcacttactaggtgcctgccctcaaaccattattttttgatagtcattacatacccacaatgatcaccatggagtggatgaggaaacagggactcagagaagttaaacaacttgcctgatatcacacaggtaacaaacagcagagcagaattcaaacctaagttgatttgacttccaaatgtgtgctcctaaccaaagcagggtaacctgctttgatttgcccatttcttgagcacctcttctgtaggagggcctgttgctgggtgctgggaattcagtggtaggcaagatggacaagattcccccctctcacagaccttgcttgctataggggaaatagacaggaaaccaattactacatttgtaacttaataacaagtgtcataagtgttacaaaggagatagatactataaggcaccttttatttttatttgtttatttattttttgagactcactcgctctgttgcccaggctggggtacagtggtgcggtctcggctcactgcaacctctgcctcccaggttcaagcgattctcctgcctcagcctcccgagtagctgggattacaggtgtgaaccaccacactctgctaatttttgtatttttagtagagacagggtttcaccatgttggccaggctgttgttgaactcctgacctcaagtgattgatccacattgacctcccaaagtgctgtgattacaggcgttagccaccgcgcctggcctataaggcacccttggtcagccagtggaagcagggtcagtagtgcgccggagagtcactttgaaaaagtgatatttaggttgatcttgaagcattcacaagatgtggtaaacacatctaatggtaaacatgtgatggtaaacattagatgtgataaagatactgatggtccactggatgaacagttttcatatttacttccaaatgatttcatagatattatttcacagataacacttaggatgaaggtaaataaaaaggagatcaattaaaatatgaaataataatagtgaaagtggtaatagatgtggcaatatccacaaaggagtaatggttagattagcatattgagaagatcactttggcaattgttggaatgcagtttacgagagggccaagaatggaagcagcaatccctgttagaagtgtagtgttttggagtgcggtgttttttgttggtttgttttttgttttttttaaaccaggtctcactctgttgcccaggctggagtgcagtgcagcctcgacctcctcctcgggctcaggtgatcctcccacctcagcctcccgagtagccgggactacaggcacatgccaccacaccccgccagtttttgtatttttttgtagagtcagggttctgccatgttgcccaggctggtcttgaactcctgggttcaagtgatctgccagcctcggcctcccaaagtgctaagattacaagtgtgagacaccacccccagccagcacattgtattaatccaagcaggagaacgcagacttcaaaggcttatgggcagcagagagaagtagatgaagcaaagagatgcaatcagcgggactagtgggaaatgagggaaaggaaggtgtcaggatggggctttttctagctgagtggagttcagttcattcccagagaagcttgagaggtatccaactatagatgcaaggtagctggctgttggtcccttgtctttaggacagtttgacttttgtaatacaggcgacctcacagagctattgtgagaattcagagctgggcacagaatagatgctctataaacggtagttctattccccatttgccccgtcctcccagcatgccagggatacaggggcggatagagacaggttcagttccctttggtctcttgcattcccccttccctcagcacaattcctgggctcatagcggatgctcaataagtatttgtagaatgaaccaaagaaatcagacccttggtgacccagggctacatgtactcggcggaaaactggggttaaaccggacccttggttggttgaaaaattaaaataatttttaaaaagtgggcgtgaaataatccagaagttggagggcctggacaaaggctggggaggggactcctcccaccaggcggcctcagggtcggcttagcaagaaaggaggcgctggggagacctctggggtcccagctgccaaggtactcgccgctccaaggagatgcggacgccggataccagctctgcccaagattgctgggtcccgccgcggcctttaaaggcccaccacgtggctgcgcggccagccctggtccggaggcggtgcccgggtggcgcctgcgcactgcctagcagaggggctggggttccgagaaaaagcgtctggagaggaaggggaggctgcttggggtgggacgccgtgggaggagtcggctccttatgcaaatcacagcggagcgcgcacggtccggaggcggggcttgcgatgcaaagacaggtccgtctggcgaacagcgagggggcgggccgcaaccctctgcctctttccgcgagcgctgacgtcgccgacgtgttgtttaaaagcggccgcgcaggcgcagtgagcccaaatgcgaacttaggctgttacacaactgctggggtctgttctcgccgcccgcccggcagtcaggcagcgtcgccgccgtggtagcagcctcagccgtttctggagtctcgggcccacagtcaccgccgcttacctgcgcctcctcgagcctccggagtccccgtccgcccgcacaggccggttcgccgtctgcgtctcccccacgccgcctcgcctgccgccgcgctcgtccctccgggccgacatgagtggggaccacctccacaacgattcccaggtacggcccggcctgaccctggcggccccggaccccggcctggccgtcccgcgacccccggcgcaggccccgaccccagccccggcccggcagctttgacaggccggagcccccggtgaggggccgcctgccggagtagatcggctcgctaggccgcgagcgagggccgcgaagttacagttcgaggcagggatggctgccctctgtggccacccccgggtccccgtcctccccgggggcgcagggtgagccagaccccggccgcgcgcgctcgccgccggaggggttaaagtggctgttgtttgatattctctccttttctttttccagatcgaagcggatttccgattgaatggtgagtgtgccccctgcgccgactccggggccccccagccgccggccgcctcccccgcgccctgccggtgccgggcagaggacagacatggcgtcccagagactaagtcccggctcctcgctcaccggccccattgttcccatcgggccgcctcttgaccccctttccggggaccccagctcctccagatcccggccctcccaagaggggacaacggagaccccgtgtcgtccgccaccgggcctcgggcggtctttccgggccgggattcctcccgggaaagtcgccttgtcgacggtcgggacttagtctctgcgccattttctttttctctctcctctcctttctgtgcctgtgtctctttctctccctccctcggctctttccttgagctgcccagaatgagctttctgcagagcaaagccgtataaatcacatacttcaccagagagggaaggctgggggactgaattattattttttaaactttattttgggggttattccctttatgcttcatgtttgtttccttttctgcttccagaatgaaagatttccttaagcaactgttaattttttttttgataggctgtttatgataggaattatggctctaaaactaaagccacgctttgtggagttctttatatttccaggttgtttttcccaagttacgttctttgcaaaggtagcagtacctccctaaagaaagtttgcaagttctctgtgggtcacccaatgtaaatgttggatttttaaaaaattatgttagtcactggaacttttcattgtggtcgaggttcccaatgcagtgtttttctggaaacgcagtttagtgtacttgttggaaggaaagattgttgagcatctcttgtggacctggtgtgttggccttttcgtttgggttgtaaggaggaaaaaaagattttatttattgaagcaaagagtgtccagtacccacccctgcttcctgttcattctttttcacgagccactgtttttcaggaatcaagaactggctttttttttttttcccaattctttatgtttttgaacccttttcagccaaatcaaggcatttattcttactgtatttccacttcagttacccagggaagagtcctccaataaaaagctcatccttgcaggctttcgaacaaccctgttgaaggagaagttaccttctgtagtgtgctgggaattcccactgattttgatggtacataatcctgctcaattgagtttgggttccgggaacctctccaatgggagaagttgatgagtaggttttctaatgttgtaatcagcagtccatcatgttagcctgctctactgagagcaaccttatgttcagagtttgaagtggggcatccagcaggagatggtactcagccaggagagaatctggtttaaagtatggcatttcttgagcaccagatatgtgccaaccactgtgcttggtgctagagctgatcctgtaaccataacactcccttgctctcaattcagtctattgggggagacataattagttaattataaggtaactactggggcatatgtgtacccaaaatgctttgaagtataggggagttaattttgtctgagggtggggaaatttctcagaggaggtgacttctgagctgggggttgtggaagactgggcgcagagaattgtcaggggttggagtgtttcttaagtacgtttaaccaacctatcacgattttaaaagagggaggaggtgaggcctgcagtttagaaagccacagtatagacatgtttctttgggatacaggagcaaagaaaggatgtgcaggtgaggatgtaagaagtccttttgaccttgctagaggaaggtgggatctttaatatggaatgtgttcttttggctgtcaggctgggctgagtaggtaatgtaagtaatgaaacaaagtttagccctttcttgtgagaaagttaacttacatggttctcacctaagtcacgtgaatgattgtgagctggctaggttattgatctttactgacatttttatagaggctgaagtaatctgcgtatgttgacttttagaatgtgttggctcacatttaatagcaataatagctaatatttattgaatacttactgccaggcatgaatctcagctctttccatggatcatctaattaaatgtaatccttggaaggacccttgtgagttaggtcctgttatttctgttttgtagatgaggaaactgaggcttcagtgtatttactagcttgcccaagggctgtgagttggccactctaaatcccatgagctgagccactatgctagagtgatactatatgatactagcatgaaaaaataaaaagccacaaatctctattttcttacagagctgaaaaaggagagaaggaaggatttgataatttgtcatttgctttttatctaaacatgctttttgaagagaatctgccaccataaagttctgacattggtgtaattattctttgtgaatattgtctggaagatgtggtgttggtaactatgcttgctatctcaagtaatacattgttaaccagtgattgatttatgtaactatgaaaaaaactttaaaaaaagtagaaatcaatgtttaattatgcccagacatgtcattattgaactttgtattaagagattgtttaagcgtgattttaagagggcctaacccatcttacagattaactgtacaagttcatatattaaaatcaaacgtctctcattttgcctgccctcatcccctaagatataaaagattcccccccgtccccccactttggagctcattcttcgcaatatttaaaattgtagctctttgcatgtaatttagaacattctgacccatactcaactgctgggagactctgttatttatatttaaaatgttgacagtgagttaggaatttggagcagaaaccatatctaagtctaagtgaaaagacttcctaagtattggtagaactaactgtagtggggctgagtcattattacagtactgtacaggctgcgtagctatctgtagaattgataatggtaataccaggttaaagtgttagcgattcttctgctgtttcagaggtcttgaagtttttgcctgtctgctatggagatagggagttctcccccatttgacccccttagcaaagcacaatacttggctccatcagtctttagtctaagaagtgatatataggatcatggtttgacatcatcttgtgctgattctggttggcttaatggaatcaaattggatgaaggtaattaaatatgaattgtttctgatgctaatagatagttgtacttctgtctgttgggtatgggttgggatgggcggtagcatagctgattgcggtgggggaatttcagatagctgatgatgtggctatctgaaaattgccactacatttttaaaactgaaaagtgatggtaccgccaaatgaaatctgcagcatcctcagactcaatcaggaaatacttaagcattatgctccagggtggttttcttcccttacattgcaactggactccttgaggcacctttttagaattagtgagccgctaggatttttatactatgctttgacataaaagaaagttgcttgtcaatatgtgtttttttagtttaccagcatatcagatctcacaaacaaattttaggctcggattggatgtttctagtaaaaacaagaaaatccaggcatcactaaaagaatcagaaatacgttgtggcttgaaaggtgcaaactaaataatatagctagcagtaacggtcaccaactcctgcttttctttggttcagtagatagagtaaaatggaaaataggaaaccaaggtcagtccccaaatctcattttaaccaatagcagcaaaaaaaaaaaaaaaaaaaggaattgagtctgactttttccccttgctgtcagcataaagatggggaattgagagagttggaaagacattcattagtttgttcagattattaaataacatgtcttaaagtttatattccaaaattgggctgtgaggtttttttgttttgcttgttttcagtgcatgtgtggggtggggaggtgcaaaaaaatgtttgccttctaatatacagctttgttgtatattaattatatagtaacagttgtccctgctgctaatggtatggaaaatgattctgttgtgctttctgaatacatatcattttagaagtttcagattatactaaaaccatgttatttcatattagttggacatgaatgcatatttatatgacacatcattatcaacttttgccttttgccatctttttagtgcaaagtaaaactgatattcttcaaatccaaagtcgtttcctcagaagtgtgttttgtgagggattgcatctttcccatgtgaaactgtgtcgaactccagtaaactgtgtttgcttgggaaaatgaattcaaatgtaattagtttgaatgaagctgtggaaatgtttgaaatgagtattttgacattggacctggaggtttaaaaaaaaaaaccctattgaaagaatagtaaaatatattggatgtggaggtgagagtcagttgagtgaattttctgtgttgtatggtttagattatctgactatcccttaattattttgaaaccattaactttggataataagggcatttaggcaaacagttgacacatggatttcttaaggtaaaaagtttagagacttccaaactagtccttaagaggcgaatgggtattgtgtttaaaggaagctttcagattgtgtttaaacttcgagtagtaatatttggaactgtcttttctccctatttccatgcctcatacatctcaagtttgagcagcagctttccatccccatggctccaggccaatagctgcagtagaaaatctaaaatagaggccagggttggaataattagcattttgccaacccccaccctccctgccacctgcctatctagatgtggacagtatgtgctgtgttgatagcatagggcctgggaagggtggagagggatgtaaatgagggcagggtggacaaagtttgattgggggttgcggggaagcttgtagaggaatgtctgttagatattgatggtattttggtggcgttatgagaaatggctgatagtttgctgaaatgatttaatagtaaatagatattgttgaacattttctgtgtgtataggaaagatcctagatatttttcacactgggagagaagtgatgttactggtatctcatgcatatctctggagtatatagatcgtaatatcaactttggctatctgtatcgaagtttgtattaactgtctttatgtgtgtcatttatgtctcttaacgtttagtaagaaagaaattccaaggaaggtaggcaacttttaattttaacttctttcctttactttttttttgggcggggtggggggcagacagggtttctgtttgttgcccgggctggagcgcagtagtgtgattgcagctcactgcaacctctgcctcctgggctcaagcgatcctcctacctcaccctcccaagtagctggaactacaggtgcatgtcaccacgccgggctaatttttgcattttttgtagagacgaggtttctcgccatgttgcccaggctggtcttgaacccctgggctcaagcagcctgcccacctcagcctctcaaagtgctgggcatgagccactgtgcctgacccttaatttctttttggtaggtattcatttttcatttgttgtcttaagcttctagtttcactcacttacctgtctgctaaatttttctgaaatgtgtaataaatgttttaatttaccatctcccttctacccttcccatcagatttggggtggggaggcatctctaccaggcaattaattcccctctgagcctttgaaattaacatttttgtttctgtggattcaaggagcctaaagaacacagttcattagcattcctaagaaacacctaggtaagctccaacaaaagatgttaaagcaatcagtatttttagggacttcagatctcctgtatttgttgttgtaaatgatgatgttgggaaaagaatttaacagatccctgggtattctgacgttttcctatattttaagaacgaaaccgacccagccagcttgtggtcccattattctttatattgtttttcttagcacacgctagcaaagatagatgcctaggacttttcttggctattggagtttatagaaaaaaagttctttgttgaaggttagtcctccaccagaataatacaccctttttccccttagtagaagtccaaatgttaatcttgctatcatatatgtatgaatgcccagatttataaagctttgtaggtatattactgattgtgcaggagactaatctaggaggcttcaggatcattgtcatttgtggatctcattggctaagaccttttacttaacctgactccagtaaggtagcccctttgtttccttgtagttgactatgtgagctcttgccaagcagcagaagtgggatgaagggaactaattttgaaaacttattaggcaccacatttttatgtgcattaaatctgaattgaataaagataatatagattgcataggcttatggggagaaccagagaccaggaaaggaaacgtttttttctttttaccctttatgccttttcatgtcccctttttgataacatgctgccttggtccagattctggaaaccccactcaggctgtaattggtaagcttctagtacagatgtcagaacctgcccttgattatctgctgttagagatagcttggaccctttgtatgtggaatgttaggtctaggggaagagtgggggtgtgaggagacagctgtggtaaaatagaaaattggtgtaggattccgaaaaatcgagataagtccctgttcttcctatgaaacatgatctgaccactgaaccttgttttcttatccataagcaaggataatatttatgtttcacaaactgttgagaattagataagtatatgaaggtgcctctctgtcctcattgtaaaatgtaaactttgatgagacagcctctattctcaactggatctttattttgaatgttaggtttgaaatagtgattgatgttggggagtctgtctttcattggtattccctgttaaagttttaaatcttcttgacatttacacagtgaattgtaacatgtaactagtgttgttgagtctttacctaattgaatcagcagagcctacactgatgtcttccagttacaaagcggtcactgtaaagtaaaaggtgtcttcatatctaggtttgggctgagaaggatccaattgtatatctagttcctacttttcttttttttttttttttttgagatggagtctcactctgttacccaggctggagtgcagtggcgcaatctcggctcactgcaagctccgcctcccaggttcacgccattctcctgccttagcctcctaagttgctgggactacaggcgcccgccaccacgcctggctaattttttgtatttttagtagatacagggtttcaccgtgttagccaggatggtctcgatctcctgacctcgtgatccaccagcctcggcctcccaaagtgctgggattacatgcatgagccaccgcgccaagcctaattcctacttttctaagaatgtttacagcaaagtggtcattgccaaaggaacttgtagcagtacagaagatgggctcagaaatgaaagaagtctattgatgtgactaatttctcaaccatttaatagaattatggattttctattaaaaataacttgacccttttcgatgcatttaataaaatgccaagttcattatttgttaattttttaaaaccacaaaattcaatatgtcttgtgtcagcatattttttcaaaggccactattttacttctcccccaaaacgtttttaaattaaacagagaactctcaaagcacctgagaattacttcagtttttcatttattcaaatagttgcttaaagtgaccaacttggttttctttgaaatagtaattcttgggaataagaataccttaaataatataataaagcttatgtgtgagaatttagtaccaaatgccgtgttaacagttatgcgtgagtataggcatttgggagattccatgaaaaaatttgataaagtcagtagaaatttcagtaatggctcataagtctagctaatgctgaatattgaattgccttgaatttgtttttttggaagtgttacttaaaggaaataaacaaaagtcatttaaggatgtgttcactagtgttcattaggtttaagccaaatggatcttagtagagatcttacgccattcagcaaaaggattatcacagaagcatcacaacaggcgcagacttaaattcaattaaaagtaggcaggaggacataattttgttgtatagaaattatggaatagggcctaattttaaagagtcttcaaagataaacatatcaggaaaaatatagctcataaaatatggggaaaaaaatctgggaagatgagtatttgttaatgctctgtagctccattgccctcagtatacaaggaatgtgcccacaatagggttggatttaaaagtcttcaaagctttggtctctttttctttcgttttcctctgatacagaatgcgaatagtctcccggcctccaaccccctctacatccccaccaccccataatagagacttaaagggaatttaaattcgagttcttgagcttctgctcaatggctaggtctttgaacaagttaatatcagagccttagttcttcacctataaagtaggtttaatacttaccttacaacattgaggattaaagagcatgagaggattactttatgaaaggtgaagcttagaacagaatttttagttccttgccaatgctaaaaaacaacaacaacaacacctttttcagaaattgctttattaggcttttgtacaaagggaacatctttactttctttaaatttgcacatatatctattgtgaaattttaaccaagctggaggggtcactagggagcattgagtatgatactattgctgtaaatcatagaaaggctggctcaggagggtactgacttgctttgactttgcggcaacttcagttgtccagtgacaaggcttgctgcatacacaccactttgtttgtttctcataccttaaattgtggattaaaaatctttggggcaggcctggaggctcatgcctataatcccagcactttgggaggccgagatgggcagatcacttgagcccaggagttcaagatcagcctgggcaacatgggaaaaacctgtctcaacaaaaaaaatacaaaaattagccaggtgtgttggtgcatgcctgtagtcccagctacttagaaggctgaggtggaaggattgcttaagccccgggaggtggaggttgcagtgagccgtgagcatgccactgtacctaccccgttttgggcaacagagtgagaccctgtctcaaaaaaaaaaaaaaatcatcatcatctttggcagtgattaactttctcctttcacacttgggatggtgcaatatttggcatctacttaggaagctaaaattttcacgtttaattgtaaatggaaaagtttaagttgccatattcattcatacaaacattcagaaagtgaatattgtgactagacacagatgaacaagacaaacccacatgcctatcaggatgaactttgaaattagtacgttgtaggtatatacagtcacttcctctgttgagatttttcattaggcctcagtacaaaggctgctgtcatacaacatgaatggggactggaggtactttctggcagttaatatttcactatcagtgcaagagagtgacgtctccatttagtcctaatcgtgagtttttccccccttaaagaaattggagacctaggaccttggatttccaaagatttccaaactcttatttcttaaaatgttacaaaaaatggtttttttttgtatacctatatacccattaaacttttttgcctgaaataggcaaaaagatttaagttctgtgtatttatttcctgttatctttttgtatcagacatccatgttgcatgaattttagaaaaatagttttcagctgggcttggtaatggctcatgcctgtaattccaccattttaggaggccgaggcgggcggatcacgaggtcaggagatcgagaccatcctggctaacacggcgaaaccccgtctctactaaaaatacaaaaaactagccgggcgtggtggcgggcgcctgtagtccagctacttgggaggctgaggcaggagaatggcatgaacccaggaggcggagcttgcagtgagccgagattgcgccactgcactccagcctgggcgtcagagcgagactccatctcaaaaaaaaaagaaaaatagttttcacatttcctgagcaggtaggttgtcggaatggctagagatggtcacattctgtgtgagaaatcatgtgacaatagctaattcaagtatttgaaataatttaaatccttgaactgaattgattgaaataaagtatttaaaatcaccatcttcacatatttgaagaactaaaatcttagagaataaactctacttaaagtcctgggaaactaattttatgaaactattgaaatattattgccccttcctaatccatgaagtatcttgatatgggtaatacataaaagctgttaaagctcttcagagaaagatgcagagtacatagtggtattacttacagtggtttgaatactagaaaagtgatcgggacaaaatgttagacttactgtgccttaatcatacagtcagtgcatttttgcaggaatggatgcaatgtaagtagttcttactatttaataccagaaatgaagaaacagtagcttcttaggaattgattgtggctcaggatctatttcttaatttttaatgcttccacttaaccaggagaggaaagggaggagaaggaacacaaatttgttagtctttataactactggcttgttacacttgatttccaaaccacaagtgctccagggccaggcaccccacactgagaagtccctaagaagtgcatttattggaaatttgatttttaaaaaaaacctcatctctactaaaaatacaaaagattagctgggcctggtggcgcatgcctgtagtcctagatactcaggaggctgaagcaggagaatcacttgaacctgggaggcagaggttgcaatgagccgagatggcaccactgcacttcagcctgggagacagcgaggcatcgtctcaaaaaaaaaaaaaaaaaaaaagaccatgttaggttctgtttaagtagtatttcttataccctggaatgaatgaatgcctcttagtctttagaatttcataaggtttagctaggtatactcaatacttctccattttactacatatttttaggaaggcactaggtattgtgaactccttgagagttctaaacatctcagagcctgtttgagtattgatggcatagtcacagatactccatttcctttctagggaagtctgcctgcattaccacgtaaccccaagccagaagtgtaaccacttttctctgacttgcattgagcttttgttatcctcttttaatatttcattctgtagtagtctgtatttatgtgttttccttattaagaagtggccagcactttgggaggccaaagtgggtgaattgctttagcccaggagttctaaagcagcctgggcaacatgtcgggaccccgtctctacaaaaaaataacaaaaattagccaagcatggtggtgtgcacctacagtcccagctacttgggaggctgaggaaggaggatcagttgagcctaggaggttgaggctgcagggagccatgtttgccctactgtgccccagaacgagaccctgtctcaaaaaaaaaaaaaaaaaaaaaattaagagcactgtttcatcctgtatggtcaatacagatgcttttaccaaatgtttcagttgtgaagtgcaaactcctttctccccccagctggttgaagatcaagtgggagacttttgagagcttaacagtaagttttccttgtttttctcaagctgatatgcctaaaagtcacctggggatgattggtgaaaatacatattcctactcgtacaccttgaagttgattctatagtggaaggtactgaaaatctgcatttttaatgtatcttcaacaatcccaaatgattctgactaatgcaggtgacccataacctcctttggagaagttgatctatctgaactttactatcttatttggctaaagatctatattttgcttcattcaattacgatactccacaggttaaggtataaagcttacagggtgatgatgatgatgatgatgatgattattattattatttggagacagagtctccctttgtcgcccaggctggggtgcagtgacacgatctgggcttgctgcaacccccacctcctgggttcaagcgattctcctgcctcatcctcctgagtacctgggattacaggcacaccaccaccacacctggctaatttttgtatttttagtggagacggagttttgccatgttggccacgatggtcccaaacttctggcctcaagtgatccggctgcctcagcctcccaaagtgcttagattacagtagtgagccaccgtgcccagccaagattacaggatatttttaaaggaccagaacagtattttttaatatatgtttataaaagcttgatacttcactctaagttatagtttctacctttcagtgagcatttaccaaatagcagatatagttaactgcctttgcagctgttttactgtgtgtcagaatcctaatcctttctcctacttcagtgtttaacaagccatttaattctgatgttactttttcggattgggtgacaagcagagcacaatgagcagggtttgttttcatactaatactaggatggttaaatcaggactttagaaagtaagtggaataatttagtggaatactgaaaatccagtctgtggagctcactgcctttagattaaattagttggggacttcagctcctgatggtactgattgaaatggaagcatttgaataaagcagtatagttgacgcttgaacaacacgagggttagggatgctgactcctatgcagtcaaaaattcgagttataacttttgactcctcgaaaacttaactaatagcctactgttgaccagaagccttactgataacagaaacagtcaattaacacacattttgtatgttatatgtattatatactatgatctcacaataaagtaagctagagaaaaggaaatattaagaaaattgtaaggaagagaaaatatatttaccatttattaagtgaaaatggatcatcataaaagccttcatcctcattgtcttgttgagtaggctgagggggaagaggagagtttggtcttgctgtctcaggagtagcagaggagaaagaaaaccctcatgtaagtggactcaagcatttcaaacacatattgttcaggtgtcatctgtggttctcaatgtgtggtttcctgatcagcagaactgcattgtttgaaaacttgttggacatgcagattctcgggcctcacccatacctactgactcttaaactctgggagtagggtcttagccatttgggttttaatgagtgtctaccaggtgatcagatgtgcactgaagtttcagaaccaatagaatagagcaagataccagttttgtagtaattcaacctcttaagcagtattccttgttctttcacaaggaaccatgtatggagttcattacttgtgctttcttacagttgtgaagttggagtaattcataatcgggggaggatcttctggagtataaaaaaatttaaggagcagttatatgattaacaccagaaaggtttcttgtatttctactgaatatatgccacttcagtaggagaggtgtgttcagtcttattctttctacagctagtggcccagagaatggcctgcgcatttcaagccctgtcaatgagaattgtctagacaaagaaggtcccttggttgaattagtaataggatacatgaaacaatgtgtcagcacacttaaagtctttatggccagacaaagtatggtcttagtgtgtttggaggcccctgaccattggaaacaaaggcagtttaggctgagctgtggatccgcacgtaggccagaggtttgtagtcactctcactcttcccaggcattaagcgttccttaatggaagcaaaggaggacaagcctacaggaatgggcctgccctaattgagctggcctgagaagatacattttcaggttagacaagtcctttttcccttttaagttctgcctcttgggaaagaagatgcatttgtagtgcagggatgtccttgtgaaaatgtgacttgttatagagcagtatttgaaatgcaagtgcccagccgggcgtggtggctcacgcctgtaatcccagcactttgggaggccgaggcaggcggatcacctgaggtcgggagtttgagaccagcctgaccaacatggagaaaccccatctctactaaaaatacaaaattagccaggcgtggtggcagacacctgtaatcccagctactcgggaggctgaggcaggagaatcgcttgaaccctggaggcggaggttgcagtgagccaagatcatgccattgcactccagcagggcaacaagagcaaaactccttctcaaaaaaaagaaaaaaagaaatgcaattgcccatcttaagggtcttgtactagttaattactttcagagataagtaaaaaaattccagtgttgtcttctattaagagagcaaaggtagttagtaaaaatgggatttgtttgccctgctcccgaagcttaaaataattgctctatctcagttttgtcttatgcttcggcagactaataacttcagttgaaatgttttctgggcaggtgttcattgagggcctgattctccagaggttctgtgcagaagcaggctgctttgagatagccagcttagccaggcctgggaaccacacagaatagtgcagtaccatgtagggaaaagtccttgactgggctgcaataggcagagtggagagtgctaggaagcagagtattttcctggataatttcatccagtagaactttttgtcatgatggaaatgtcctatatttgtgctgtccaatatggtagctattagccatatgaggtgtgtctgtgtgtgtgtgagtgagagagagagagagagacaagagtcttgctctgtcattcaggctggagtgcagtggcgcgatctcagcttactgcagcctctgcctcccaggctcaggtgattcgaccctcagcctcccgatagctaggattacaggcgtgggccaccacgctcagccagtttttttgtatttagtagagacggggttttgccatgttgaccaggtttgtgtcaaactcctggcctctagtgattcacctgcctcagcctcccaaagtgctgggattacaagcatgagccactgcacctggcctatatgaggttttgagcccccttgaaatatgtggtaagtgggaccaaagaacttaattattttattttattttattttaatttaaatataaactagccaatagtggctaccatattggacagctctagataaaatttaggtaagacccaagagattgtggtttagattctgcttggaatatgagtgattggggctcttggaatttaaaaatccaaagacacgtgtgaatttgatgttatgagtttgaataacagccttccttcagtatgtctacattgttttatcctgactgacattgtaagtcctaagaggacttacaactggtaagtaaagttgtgtttaccaaagcagttggaagttcaggcagttgtacgttttatttgaccccttagagctaaacaggtgaaaatttcaggtcctttggatgaagtaagttctcattttatctcagcaaccctatgaggtaggttatgtctgttgcgtagttgacaaaacagatgaacttatatttatgtacacctttatggattagtagcctttaaaatggttagttttatcccacaacttcatttgaaattgtaagtttctagcatgttgcctataacaagaaggtaatttatttctatttgttaaattgttatcagtaataagtcaatatcctactataagtggtagagaatcaaagattgtagactaccaaatagcacccaagaggctaattcatgcaaggtgttgcttatagtaaaagcagatcagaactcagctgctgtatgccatctggggttatcttctcacttgcacgctcatgaccagtgtaggctgcatcttataagtaatctggctcacagttagctagacatatattagtctgatggaacaaaatccgattgtagctttgaccactatgaggaccactgtcatataaggtcttagataccaacttgagtaaattgcttaaggactgggaatagatccagattcctccaggtttagcttcaagttgtgatcagttttcgtgggatgcaaggagaaaatgaataggaatgaaataaatagctgatatttgaacatttttaatgccctaggcagcgtcttaagaattctaagctttcatttatcaatcctgaggtagttaacattactatttccagtaatgttcactgggccagtttacttttgaagaaattgaatctcacggtttaagtaaagtaactagctcaaggctatatagttataactaagccacagagcagggaggctaatctaggcctacctcatgccacagcctgagttcttagttgtgatacaaaacaaggtaaagggggacctggggtgacttagttgcctcctgagaattctgggctgtggtggaattacccatcagactgggggcgcccatctcttcacttatgatgtgtccttaacagactaaatgcaggctctgctgcactttaatgtaattctttccctattaagggaagcttgcttgcctttgcagcaaagccccctggatagtttattttttagcagttcagcttgtgcttggacccagttgttccagaaatcagtaaaacctatttgagtattcaagaaaaaggatctttttgttaactaaggattaactagaaaccttattttataagggttcctgaagtctgcttatttactaaggaatttcatcagaggtggttagcattttgtgaacaagtatgatgttgttcccacttcaaggggaataaataacaaatttaaccagcttgctgcttaagaagcagaattagcagtgggccagtcattggcctctcttcagagttctcatgtgactcacttagttttgcagagtgaggtagattttaaccactttcaagtcaagttgattggccattcatgagctgtgtgcagggagagaagagagacgagaacaagttagcagaaagctgaggtgtgttagacgggagttgtaggtaagtcagggaggatattcttcatttagaccctgagcttgagtaagacacctttctacaggagacattgcggatactttctagttagtactagcgcagtgttctgcaaactacacctgcttttgtgtggtccacgaactaagaatggttttgtatttttaaatttaggcatgtgccacataacaagatttctgtcaacaatagaccacttatataatgatggtcccataagatagaaggtggtatttttactgcctcttttctgtgttgcagatacgttcagatacacaaatacttaacactgtgttacagtttcctacagtactgtaacatgctgtacaggtttgtagcctaggagcaacaggctataccatatagcctaggcggtagtaggctataccatctaggtttgtgtaagcacactatgatgtttgcatgacaaaatcgcctaatgacacatttctcagaatgtagttggaggaaaaaaattgaaaggagagtattacttcatgacacaggaaaatcatttgaaatacaaattccagtgtccataaataaagttcactagaatgtggccatgctcattcatttacatgtaatctgtggtagtttttgtgctactgtggcagaattgaatacttgcagtggaacttgaatgggctacaaggtgtatttagtacctggcccttcacagaaaaagtttgctgacctgattgaatgtgcttgtgtgtatcacaggaagctcaccaggactcttggtatgtagcctctagctcccaaaggcatctgagccccactggcaggactcagttacctgtctctgtctaagcatgactccacccattagcgtccagacaacgaagaaaacttctattttaaagagcttgactaaccccctccttattatctaagttagagtagctgtgccaccccttaagtagcttttccttcttcctttcaaataggggttggaagagtagcaggtgagaacaacctctttcttcctcaattgtagagactcaatagtctaggctataaattaaaaaaaaaaaaaaaaaattccccagaggctgactcagcacatgcctgccttttaaaggaacagagagacccaattggaatagaaactgaaaataaaatcagcagcacatgaatttttgtaggtggctcgtatttgctattaatattgctcagaagactcaggaataagaaataataatgcagggtttcttcaaaatatggttctggacagtggattatagttacctggagagcttgtgttaaaatatctgaggatgattccaagtaccagggcttatacacaggaatacttgagaaccactgcactcaagcatttaaaattttccttttacctaaatccacatgggccaagacaatttttaaaattcatagaattcatgtgaccagacgtaaggggtcaataaaggtcattttatagatcagaaaactgagacccaaagctgagaaataagttatctaaaaccccaccaggacattgcattaaaggagttgctctaagcgtgtcttcttactattagaaagtgaaattgacttttaaatctgtcacttagtttttggcataataataaaacaatgaacagtctgttctggctctaattgcgcctagaatctccagatcagaagaccttcttgtagatcaagtaacatacttctctgaaagacagtttgtcggtcctatcactgaagtctgaattatttttttgatttttaaatataattaattggtccctggaaatgagaaccagaggaagataagaagatgaacttgaatttaaggaccataatggaaggagtgggatgggaaagaaggctgtaaaataagacagtggttgtggagagacagattaaggtaaggagagaaggttgtaaaataagacaggaaggggttgtggagagacagattaaggtaattgtggtgttgtaaagccataaaagaaatttaaatgcggaagtggcctggaagagaaaacattctctgatcatttaacccttttgtgtgtgtgtcagtttgaggcgtaaagtagacgaatagcctccttcttgtgtgtcttttccatggcaaagcctttaaggataatagctgaccactaatctcacacagctgctgatgtttaagaacctaattcttgaagtgtttttaagtcagtttgtggcatttcttctgaacacttgggcactttggaaattgtagtgacaggttttagaaatttgaagttgtgttgcagaggtgataacaaaattgggtctttgagcaactctgagtcttttaatgcagtgcacttctaagtttccgatggtatttccccaagttttgaatattgaaaagaaagaccacactttgcaaaataattggcaactttcatttaattcagtttgaccctgtcttgaacttggtctttgtaacttcttatgagggtcttttccaacggtaacattagaggctgattctggaacttcatggaggcaagtccagtgaaacttgggcagttagggggaccctttccctctcccttttcaaagttactcagtcagcagctgctactgttgggatggcgtggtcaggtgggtattatgcttattatgaaacttgatgagggcagggactcagttttggggctgagttgtatttcaacacttaagtggcactcagtaaatacttgaacaaatgaatattgtgaatcccaacttccttaaggacagaagaactatttatacttgtctgccatcttcttagctagagattttttttttgtttgttttgttagctttcaagttgaggtccctaacaggggaatcccatagtttcaatgatgaacaggtccatgacaaaaattcttgtttatatgcaatacacatttagggagaataaatggtcatgtggactttaaaaattggaaatgttactagtctcttctctcattcttttgttttgttttatgttgaggcagagtttcactcttgttgcttaggctggagtgcaatggcacgatcttggctcactgcaacctccgcctccgggttcaagtgattctcctgcctcagcctcccaagtagctgggattacaggtgtgcatcaccatgcccggctaatttttgtattttttagtagagatgggctttcaccgtgttggtcaggctggtcttgaactcctgaactcaggtgatccacctgccttggcctcccaaagtgctgggattacaggcatgagccactgctcccagccctcattcatcagttttttaagggtttctttagagctgaatcctcccagcagttttctttccttttgaattccagagctctttgggcctttagccagaaacagtctctgtcctgcttactttgaaaggctgttaactatgccctggaattttggaaatgttctccttgagaattgctgtaaagtagtgataaggactcttctgtaggctacaaattgaaaccagccaccattaagatggctcacagacagggtgtcctggattgaaactggaccaacgttggtatagtctgaatttgaggagtaaaaagaaatatgcccttccctctcccctaacagttggggaatacttgtttttactcctcaaccattccccttttaatgatgacaagttttcaggctttttcactgcctttagttttgcattaagttcctgggagattcacacacccctgatatttactgcactcctggatgccagttttttatcactcaagaccagcttgttatctgtcctagacagaagccatcttcttttaaaagtattagaacatactgggtatagagtgttaaagagaatgttgatttttttaaaacttctgcttttggggatgtgatatgggtttgaaagtcagggaggaagtagaagatgtaagggtttgccccagtacaagagttttaataatgaggtgataaatattttctttaaataatttattcacccattgtgttcactcaagtggttctagtgttcactttccttatgcgctagttgtatatttgtatgtcagagaagagcagagattatctttgacagaagttatattgtgagtgtctttttggagaaggtaggttttgattgtgtaactatgccacacctccattccccatacacttgacttgatgattatctttgaaggaggagcccatcatattatacagctgccctaagtctcaaatctatcatcaaaaggcagtgtaaaggggactggctcaaaacatggcaaagagtctcctttatatcagaaagctctctgcctttgcttataaggcagcaaaggactcttcttcctgccctgatctgattaccctaaaagctttaagatcatggaatagttgataaaacagtcagtattctgtgctgatgacttatccttttctcccttaagaaagagtaaatgtttttgcttggattgagtttagagacaccagatagaataagattggcaacactgttagccacctgctgaccacagctaaacaggcatatgtgcttctgcatggggaatgctatggcgttaacagtgccttccttaaaacctgtaagttcgttaggcttccgggtaccagggttgttagagtaggccacagtttacttcctttttcataagtgcttttctttcctggatctcagtataggaaggaaaatcagacagcatttctcagttgttggctcggtgggcattgtgaatgggtatggttgctgcctcaaatgcacatatacaacctgagctaagttgtatgaaatgattgagtaggctgacttcagttctatgtaaattaatcaaggagaaggtttaggaatggttgtaccgcattgacagttgttaacatgtttataatttcttggagattagccaggaattctgttacaactacacacaaatattgattgactttcaaaataaaattctttaaaatcactgaaattttctgagcccaagtttcttcatctgtaagataagcaaatttactaaggtcatgggtatctagtacatgatggacagagatttgaagctctttaccactgatttatgctaccttctcatagatctagtagttaagtgacttttacccaaggtcatacactgagtgatagaacaaggattttgaataagatatttttcactgttgcactggtctgctttctccagcttccttcagaggtccctaaaggggacctctgtgctgctctgcagtgcctctatcacattagggtttggtcatggtcttttgtgctcatcatgtttgaacatgtttatcaaagtattttacagacttggttatttcttcccctcatgtaatttgtgtatttgtctgttttccctatggagaatgaactttttatcttatatatgcctgatgtgacattgatttggccacttggggttgaccttgtacttggtttccatatctgcagcttcattgtcattttgggtttaggccagctttcaggaactttttaacagttggatcaaattttgttggattcatttgatactgagtttcttattcctgtatattttgtttcctttctatctaagcagagaactaggactctagagttacaagaagttagagtatatctataacttttttaaaagaaaaaaaaaggaccaggcatggtggctcactcctgtaatcccagcactttgggaggccaaggcaggtatatcacttgaggtcaggagttcgagaccagcctggtaaacatgctgaaaccctatctctacaaaaatacaaaaattagctggccatgatggtatgcacctgtaatcccagctactcgggagcctgaggcaggagaatctcttgaacctgggaggcggaggttgcagggagctgagattgcaccactgcactccagcctggacagtagagtgagactctgtctaaacaaacaacaaaaaaaaactctgttttggacacatgactttagggagataaacataactctgggattttattttttaatatgctcctgaaaacagtcaactctcccatttcctagctgggagaagtatgtctcacttaattttgctcattcaggagaggatgaatttttcagcaatgatagtaatagctggctgttgcaactcatttcttgctgcagcgtagcacatccaccaagaatgccctttcaccttcctttgtcttgccaactccctcttagctttcagtaagacttggctcaaactgcatcctccaggaagcctatgttaactcctaactgccactcttggatccagggtttttatttcatcttgttcgctggtggaaccgggctgttttatctcattatattactcttcactttgaaacaaggaggcagttaacctagattcagtatttttactcttagactttttttcccccaaaatgcccataaattaagcaatcttactgccttactgcgcttactgaaaaatagcagcacagcagaaaaatagaaaatcttgctatcatgtaagagatgtggaagtaatggtgcccacatgcttcatttggaaaatgtctattacctttataaagagtttgtatagtttctaaatacaggagcattatgatgcgatagaaactgttactttaatgttaattgacgttcgaaaatttgagtttcaaatgtttcctaaaacattttttcttaacccttttgctattccattgatctgccattctacattctgcctcctttgtttccctgtcacttattaaaaatactgcctcttaactttgttgtcatccacttatttctctagatacaccttggagtgttttttcaggctgaattgttaggcatgggattgctgggtttaaagagggagtgtgtgagtttgtttgattttgccaaattcttccttcatgggggttataccaactagatgcaccttattttcagagatggtaaaatgaggcaaaaagtatcttagatttgaggaaatcgttaccacccagagttgtgaaacttagaggtgatatatgtaatactgccttgcacaaaatatacatttagtaaaggatactgatatggtttggctgtgtccccacccaaatctcatgttgaattgtagctctcataatcttcctgtgttgtgggagggacccggtgggaggtgattgaatcacccgggcagttacctccatgctgttcttgtgatagtgagttctcatgaggtccgatggttttataaggggcttccccaccccgcccccgcacctgccccactttgcttcacacttctccttgctgccatcatttgaagaaggacgtgtttgcttccccttccaccatgattgtaagtttcctgaggccttcccagctctgcagaactgtgagtcaattaaacctctttataaattacccagtcttgggtatgtctttattagcagcgtgagaatggactaatacagatacctagatacccattattatcttttgtgaactgggactatttctctatcgtaagagtggtaagaaacttgagttgagatagtgtttgaaagcacgctagcatggtgctggcacccgtattagtgcccttttctcttgtgtgccttgggcagccagctacttgagattatatcttaattaccttaatggattgtaaactccttgagggcagagtccttgtctggtgagtctttagcaggaagctttggacttgaatatatttggttttaaattgaattagtcttcagaatatatttctgaaacagtaggaaaaggatttcttttttttctttcttttttttacacattagccctcaactcctgtgtaatgctacctaacatctattcctacagtaggaaaagacagagacactttccttttgtctgtcggaagcttctttacttaaaagctttttaaaccccagggaatacgttaggtaacaatagcaaaagatgttgattcctgttctatctgtttaacttatctgtccttagggagtaactccagttaaattacagtgaaaggagttagttgccataagtcttctgttttatcaagattgctttattgcagggggcttcctcccatgtcttcatctagaattttcactaggaattaaaatatttgttactagaaagcattagttggcctgaattcacagtgaattaggttttctgatgatttaatgtgcactggtttgcatctttcatatctgtcagttaaattcaacacatttctttttgcacttaacaggtgcttgaagtggcagggtccttcctctaaaacattttaaataacactagtagatgaattccagttaaggggaaaaggtatgtgctgaaagtaatcttcaaggccacagtatgttctctccaaacacatgttttcaccacgagggatgtagatctgtgtgcccttattggctttactttttcacttactggcatctcttctgaccaacatctttagtcagatgtcccactgttaccttagatacaatatggctcaggctggtccatcatttctccagtatttttcaccatctttattctgtacaagtttcttgtttttgccaaggccccttgttcccccagtcacctggacgtaaagactttctctgactctttattacactgcatttattacacatagtagtgagttcctggaactgggttctacttccattttcccaaatgtgcttttacattttttccttccttcttagttcctttgctgtcactttttttgtagattgcttcagaaacctctaactatttattttgcttttacttttatctcttactatgccttaacacaaaccctctcttggaactaggccagtcttcttgccatgccctcacataataacacaaaaatgaagggttggaaaggaagaagcttaaagataatgtttaacttatgaaaagtttcaagcatacacatagagaaatataatgaactcccatgtgtctgtcactcagcttcagtaattaccaaccttttgccagttgaattttgtctatccccgtatcccttggtgctcccccaaccaccaccaccagagagtattataagcaaattccaggcatcgcttacatggaagtacttcagtattcatctttagagattctttaatctgtcagtttacctactgcagaatatctctacagtttccctttcagttggttatttagtttgtttaaatgcttttggcgttcagaaggcatcccattcttttagtggttagttcttttgtactgacctcaatttgcctccctatcatttctcagcagtaatataaatttatatttactcagaaattacaaatttactgagtaaatttatataatacaatataatagtcattaagatatttgaagaagttgccatgtaatacactttttgacacacctttcacagcacacatagcacatgtaataacttttatttgtgttttagagagagggtcttgctctgtagcccaagtggagtgtggtgatgtaatcatagctccatccttgaactcctgtgcccaagcagtcttcccacctcaccctcagagcagccagtattacaggtgcaccaagatgcccaattaattttttaaacagttttcgtagagacaaggtcttgctatgttgcccaggctggtctcaaactcctggcctcaagtaagcctcccaccttggcctcccaaagtgttgggattgtaaacatgagccaccgtgctcagccattcctttaaaataggaatacttggggttcagatctttgacctaggtcttatttgtatcaatgagattaatgagccacagccccgagtttctcaccagacatttttgatttgcatttttagacagcagttgctttaaaaaacttggggacctggcttaaaatcaattttgaaattttgtgcattaaaaaaaaaatgtggccgggcgcagtggctcacgcctgtgatcccagcaccagactttgggaggctgaggcagatggattgcctgagctcaggagttcgagaccagcctcggcaacacggtgaaaccccatctctactaaaatacaaaaaattagccgggcatggcggcatgcacctgtagtctcagctactcgggaggctgaggcaggagaattgcttgaacccgggaggctgaggttgcagtgagccgagatcacaccactgcactccagcctgggtgacagagtgcacctgtagtctcagctactcaggaggctgaggcaggagaattgcttgaacccgggaggctgaggttgcagtgagccgagatcacaccactgcactccagcctgggtgacagagtgagactctgtctccaaaaaaaataaaaaaaaaaaagttattggcagactgttatctgaaacctgcctggaattactttcaatttatcctttacttaatttcctttttaagtttagagctttttagtgatttaagcaaattttcctatgtacactagtatttgtcaagataaatttttaaagcttggtccattttttactataaaagtaattgtggggaaaactagaaaacaagatgaagtatatgcacaaaaactcaagttactcataaattgactaccctaagataactgcttttaatattttgatgtctgtattccagtcttcttcatatgtatttatgcgtttgttgaattatacacagagtagttttttttaatgtgatgtcctttccatactctagggctgtattagcagatcttgatgttctgaagcttgtttattgcatctggcctgcaaacaaaattaattgacacacatgctttattccagattgtggtgctattacatgtattgtcattattatgattttagccataagtgtttggtttgaggcagaagtagtgggatattgctgtcaagtaaactggggccactaaccttgtgggaatcaacttagcattttaaaattatagactcgaggtttttagaagaagctgaagggttctgtatgctgcatggaagattgagttcaaatcctacttctgacaccatatgatattatttttcccatctctgtaggatgggaatttcttacagttagtactacggtcatgcagatttctattttcccagggcctgacacagaatagatgctcagcagattatgacacatgtggcttcttttgctgtgagccagtcatgggatgaagacacattgcctatgcattattaattgattgctataaaacatgttgcctcaaaatataatagcttaaaacaacagacacttattttctcatgtagttcctgtgagtcaggaatccagacatagtttatctgggtggctttggcttaccatctgtagattgcagtcagtatgtcagccagggctgcagtcatttgaaaacttaatttaggctagaaggtccacttccaggatggctcattcacatggctaattggcaggaagcttaagtttcttactacatgggcctttccagagggcttctgagtgagtacatgacagtgtgtcactggcctcccccagagcaaggagagagcaggaaggaagatctaataccttttatggcctagtgtcggaagttgccccctcacaattccacttcatcttgtttgttaggagtgagtcacagtgtccagcccacactcaaggggaggggaattaggctatacctcttgaaaagcggagtaacaaacaatcttatagtcaagattgtgtttgtgtaaggttagaatagagggtccggaaatagacctataattatatgaccgctcgaaaacgccaagacaatttaatggggaaagggccatcttttaaaaaataatgctaggctattcacagtagcagaaacatggaatcaacctcaattttcattaatggtagactggattaaaaaaaagaatgtggcgcatgtacaccacggaatactgtgcagccataagaagaacgagattgtgtcctttgcaggaacatggatggaactagaggccattacccttagcaaacgtaacagaggaacagaaaaccaagtattgcatgttctcacttataagtgggagctaaatgatgagaacacatggacacatgtaggggaacagcagatacaggggccttttggagggtggagggtgagaggagggagaaaatcaggaaacataattagtgggtactaggcttaattcctgggtgatgaaataatctgtacaacaaacctccatgacacgagtttacctatataacaaacctgcacatatacccctgaacttaaaagttaaaaaaaaatggtgttagaacaacttgacgtctttattgattagaaaaaaatgaacactggcccttaactctgcaaaactgctagaaaataaataaataaataaataaataaataaataaataaataaataaataaggtggtggtggtgatatgcccttgtaatcccagccattccaagggctgtggcaggaggattgcttgagcccaggagttcgagaggagcctgcgtaacatcgtgatataagaaaatgagactctttccctgcctttccctgcaaaagagagagagagaaaatctgtgtagcccttgagtaggcaacgatatcttggggcacaaaacatacagaccctaaaagagaaaattgatgaagtggacttgatcaaaatttaaaacttttgctctttgaaagacaccattaagaaataaaaacaagaaaatgatggggagaaaatattcacagttcgtatagctaacaaaaaattggtaatccagaatgtataaagagctcttacaactaggtagtaagaagaccaagaaagatttgagcagatacttcaccaaagaaggtatatgagaggccaacaagcacaccaaaagatgcttgtcattaaacatcatttaatcatcagaaatatgtgaattgaaaccacagtgaggtaccactccacacgtgctagaatggctaaaattaaagactgatagcagatattggtgaaaatttgtagcaattggaatgctaatgaatttttgatggagatatacaatggtacaatttggcaatttcctgtaaagttaaacatacattttttatattacccagtaacttttctcctaagtatgtacccaagagaaatgaaaacatgtctatagaaatatttgtatatgaatgtttgtagcagataaataataaccaatgcctggaaacaactaaattgtccagcaggtgaatgggtaagttacagtatatccacacaatgtaacaccactcagcaataaaatggaaccaacaactgatatatccaacaatgtggatgaatgtcacaaatgttatgctgagagaaagacatcagacacaaaaagaataaatcctatatgatgttatttacatgaaatctagaaatctagacaaatctaatatacagcacgatcagatcagtgcttcctttgggcaaggggtggaagatggggaatgactgggaaggagcacgagggaaactttctgagatgatggacttgttctaaatctttattgtagtggggattgcacctgtgggtgtctttgaaatgtttattattacagttatttcttaatatttgtaggggattggttccaggaccaccccaccccctgtccctagtataccaaaatttgcagatgttcaagtttttttgtatataaaatggcacagtatttgcatataacctacacaatccttatatatactttaactcaccaccacattacttagattacctaatacagtgtaactatataaatagttgttatattgtggggggatttgtatttttttggttgtattgttattactatttttatttttccttgaatattttcagtctgcaaatggttgaatctatggtgctgaacctgtagatatggagggctgattgtattttattgtttagacattacaccttattaacattcatttaaaaacatctgttgaggtttggatttttcagaagttataacatctgatctttagagtcagtgttcaatactatccctttgttatcatttataggtcaggcttaatagtattatgtctagggagaaaaacgccaaactgtggcttctttccacagaataattggctctcatttccttatcctccccatattagtaacttgtcttgattgtagaagcaggctaatgggagctttgtctgggcttctttgtgaaagctttttttttcagtggcatgtgctattatgcctaccatgccatttgaatcctgtcattgtacttcttgaccagcttgtcaaggtaggcatacagaagatagctcatgactcctgttaactgactcatctcttatggttgcagattctcataaacacaaagataaacacaaagatcgagaacaccggcacaaagaacacaagaaggagaaggaccgggaaaagtccaagcatagcaacaggtaagggtggaatcaagcaagtccctcatcattcagcagtgggttggccattgcttggcttacctggaataggtcttaacttgagctacatgtaaagatagcaaagtaagtagaaactgtatttgatcctagagttgctatgaggatggccatgatttaggccttaaatgggatgccattgttcagatcaagatgtataaagcaagtatgtttaattttcttttaatatatacctcattaaaaatacagttgttcactaagataggtaaggattcattgtgacacatgatggcatttaatcaagtctgtagcaagcttgccttgataaaaggtaactggattggagacctgattttttttcttctttctatattttaaagagtttacattaaaaattcttaacttgggcttccatggtctgttagcccctgaaattatatgcaaatggttgagtatatgagatttcctggagagactatttgtagctttcatcatgttatcagaggagttcggctcccacaaaagcctacaatcaccaatatgaatgaaactcaatagtgctgccttttgggatgcaagcctcaagaagatgtttcttttgttcattttgctcccatttttttggtgtaggaggcaagtggttaaatctagttattgaaaatgaggacttgtacttccattctgatttaaagacagttgttggtgagaaagccatatggtattcccattcccatagtggcctgagctaggttagggaatgtaaagatctgtcacacattagaacaagtgtctccattgtagagttcttagaacttctttattaacttgtctgattgtctgtagacaagttaaagtgagaattgctttctaagtctgttctttttcgcgaatcattaaaataaccagatttaattttctctattggggacatttctttgggaatcatgtatcatgcctgtggccttttttccctatccctcacttatctcttatcacttgatcatctagtttccattttcattattctggtaaatttaatctcagtagttgaatctactctacatcttttctagtttatagttgtctagcttatgttaatatctaccgtacagcaaagaatattgccaaggataaagaagttcattgcataatgataaaagggacccattaggagaacatagcagttataaatgtttatccactaacgtcacagcctcaaaatacatgaagtaaatctgatagagctgcaaagagaaataaacattcataattatggtcagagattttactatctttctcaataatttttagtccaaatagaaaataattaaggatatggaagacttgaacagtatcaaccaacttgatctaatcgacatttataggtttttcccatccaacaatattagaattttctcttttctttctgtctacttttccgcttttaatttttttcaggttttattttagattcagtgggtacatataggcaactttgttacctgggtatatagctgtgatgctgaggtttgggtacaaatgatcctgtcacccaggtactgagcatagaacccaacaattagtttttcaacccttaccgccctctctgctctagtagtctccagtgtctattattgccatctttatgtccatgagcacccgatgtttagctcctgcttaaaaatgagaccatgtggtatttggtattctgttcttgccttaatttgctcaggataatagcctccagttgcatccatgttgctacaaaggacatgattcagttctttttttatgaccgtatagtattccgtggtagatatgtacaacattttctttatccaatccatcattgctgggtacctaggttgattccatgtcttccctattgagaacagagctgcagtgaacatgtgtgtacatgtgtctttttagtaaaatgatttgttttcttttggatacataccaagtaatgggattgctggatcagaaggtagttgtttttttaagttctttgagaaatctccaaactgctttccctagtggctggactaatttacattctcatcaacagtgtataagtgttcccttttttctgcagccttgtgagccatctgctggtttttgatttttaatagccattgtggctggtgtgagatgatatctcattgtggttttgatttgcatttctctgatgattagggacgtggagcattttttcatacatttgttggccatttgtatgtcatcttttgagaaatgtctgttcatgtcttttgcttgttttttaatggggttacttgttttttgcttgttgaatcatttaggttccttatagattctggatattatacctgttagacgcatagttagtgaatattttctcccattctgtaagttgtctgttaactctgttgatagtttaattagatcccatttgtcaatttttgcttttgctgcaattgcttttggcatctttgctatgaaatctttgctcgttcctatgtccagaatggtattgcctaggttgtcgtctagggtttttaacagttttaagttttacatttaagtatttgattcatcttgaattgatttttgtatgtggtgtaaggaaggggtccagtttcagttttctgcgtatggctagccagttatcctagcatcatttattgaatagggagtcttttccccattgcttattttggttgactttcttgaagattagattgctgtcggtgtgtggttttatttctgggttctctgttctgttccatttggtctatgtgtctgtttttgtaccattaccatgctgttagtgtttctgtaccattaccatgatgttagaatacattctttttaagtgcacacgaaatgtgccaaaatagctcatactttggaccccactctccttaaaccatcttctttggctttaatgcttccatgcctctccatctttctggccacctttttcacctctttctaatgcacagtcattccttaacagtttttggctgtcttttctctgctacctgttttgctgtttatccttatttcacattccatatttggtcttgtgaacttcttttcagttccttaaacatagcatgttttctgatgccgctaagcctttaaacatgctgttggttctgtaatactctcttgcccctttgctgtcattcttttagttgcagctcagacttgacttgttccaggtatcctttctaccctccttctcatattaaatgccacttttgtgtgctctctggtgccttgaatatattcctagtgtaataattattatatttaattgtgtctttacttttccctatggcctcctggactctaaagtccctgaaagcagaattgggatcttttttgttttttctggggtggggcggggggctggttttttgtttgtttgtttgtttgttttttgagacggagtcttactctgttgcccaggctggagtgcagtggtgccatctcagctcactgctatctccacctcccaggttcaagtgattctcctgcctctgcctcccaagtagctgggattaaggtgcgtgccccgacacccagctaattttttgtatttttagtagagacagggtttcaccatgttgactaggctggtctcaaactcctgacctcaagtgatctgcccaccttggcctcccaaagtgctaggattacaggtgtgagccaccacgcccagccttttgtattcattttgcatccttcaggcttagtatggtacctggcagatagctggcacttactagtctatatttattgaattaatgagtggatgatctatgggtacattaattcccatctctctttcttctcacgtactcttaatcttctataggatagttattaagtcactttggcttatctcatttttcacacaattgtgtgtggtaaaataaacataacaaaatttactgttttaaagtagcatttagtacattgacaatagtatgcaactgtcaccactatctccagaacttttcatcatcccagtctttgaattcactaaataataacttttcattctgttcccctgtcccaatatctttctactttgtctttttttctctttcccttctaccttttatctttatgaatttgcctattctaagtacttcatataagtggaataatacaatatttatcttttttaaatctgttctatattcccttaatatgttttcaaggtttatccgtattgtagcgtatcagaaattcattcttttttatgactgaattatattccattgtatgcctgtaatcacatttaaaaaaatccatctgttgatggacacttgggttgtttccaccctttggctacaaatacatgtttgagttccactttcattctccggggtgtatacctaggagtagaattgctagatcatgtccaacaatgggtggctgcctgctatgtttttactgtgctaattgatgtggtgtgaaaaaaaaaattagataacctttgaccgtgaacagtatcatctgaggaggtgagagacctgcttacagatcagatgaagaatgttgatttttatattactaggctgtaagaagaaattccaaaagactttaagaagaaagaggttaatatttaaaacataagcttttgaaaacttatcttctctaacacattctactttgttttgggaggaaagatacagtaaaagtgacataaagggctttgagacatataagtttggccctgtcctgttttacaaaaatcttctcttaaaaaaaaaaaagggatgtgatttttttagaagaaatcctcatccttgtacatccatttaagtctcgtgatcttggctaggttacttaaccttcttcaactcagtttcttcatcttcatcttgatacatgcttcacaggggaaccatgggagtcaataaatatagaagctcttcagttgtgaactgctctacagatgtgcagagatgacacttttacatctatttaaaagcatacttttccaagatcatattgtaggtaaattcaataatttgttgtatgtacttttgtgcctcttttcttttctttttttttttttttttgagacagtcttgctctgtcgcccaggctggagtgcagtgacacaatctcggctcactgcatcctccgcctcccgggttcatgccattctcctgcctcagcctcccgagtagctgggactacaggtgcccgccaccatgccccgctaattttttatatttttagtagagacggggttttactgtgttaaccaggatggtctcaatctcctgacctcgtgatccacctgcctcggcctcccaaagtcttgggattacaggcgtgagccaccgcgcctggccacttctgtgccttttaatattttcttcattcctataaaaatagaagcctttttgccaagagctattggaaaaacctggcccgagtttctgtttacatatgacatgactaaatctagcccttggtttcttattcacatgagtaaattttaacagtttaatcagatgatctgttgtaagcaaacttttaagtacttcttgttttgatgtctactgacacagtacctctttgcaacaaagcaaggatattggttatattccagtaaaattattttattattttttttgagatggagtctcactttgtcacccaggctggagtgcagtggtgtgatctcggctcactgcaacctctgcctcctgggttcaagcgattctcctgcctcagcctcccgagtagctgggacttacaggcgcctgccaccacgccgagctaatttttgtatttttggtagagacgaggtttcaccatattggccaggctggtctcgaactcctggccttgtgatcctcctgcctcagcctcccaaggtgctgggattacaggcttgagccaccacacccggcctccagtaaaattttatatacactgtgatccttttaaagtacctctgatctttttaaatagtttagggtttcttcgatttcttctgtagcagattaaagaaatctgggggattatttaatcacatctgaaccccagaataattagtatttagcatgttctgttccaaaatgctttcatttattccaatccttgctaatcaattgtagctaattttgtggccatttgttaggagaaaacaagtgtttcagatgtgtttctgtgtcccttccttctctgctagatattagcaccaatcatttgtcatcaggctatacttaggacccaagcccaggaggcatttactgtcctgtgcagtagcaatactgcagacttggagtgggagagtagccattatgtgcagaaacaaaatggggctatggatccacatcccagaagatgccatttggtttcctctttattgtcctcatgcaaggtgcaaaacaagggagtaggtattaagaatcatttcatcttgtcttctctttgtgtggacaggagtctgaggtcacatgctctaagtcccacagtgatgtggtagcagaaagaagaggatgtgagaccaaggatcctgagtccccactacattattccttccagtgaaaaatacctccctgtgtaaaaagagttagttttgtagctaaactgtctgtttaaatacaagcaccccttacttgtatgcatatggtaggcagctcaggtttaaaaatgtcagatcacctcaggcactgcctttatctctctttgtccccaaatccctgaaatctttggcactgaaagtattaatgtcatcaaattctgaacctatgaaaacttcatctctgtctttctcttgtctggcctgtaacatgacaagaacagctcacaccaaagttagaagataatttcatcagtcatcacttatctcttgacactgcttctttctgttagcgttaatattttgctcctcagatcctttttctttttttttggagtcagggtctcattgactgctaagcttgggcgcggtggtgtgattatagctcactgcagcctccctgggcccaaggggtcctcccacctcagcctcttgaatagctgggacaataggcatgcaccaccatgcttggttaattaacttttttgtttttaatagagatggcggtcttgctatgttgcccagggtggtctggaacttctgggctcccacattggcatcccatagtgttggggttacaggcatgagccaccatggccggccctcttttaaaaaatacataaataatctcaaaaggaatactcttctagatgccaaggaattacgtagcttgtaggatctcacgagctacctttcttaaagggttacattcttatccattgtttatctttaatagtagatctcttgtataaacagaatattattaaaagcaatttgggaggggggcttgattttagaaaataagagaatcgtgtgaaatgaaattcctcctagttttcgactctgtgcatctcttgccaattttaaacctggcattcacactggagtgacaaatttgtggaaagcaagggaagacagaaaactgctgtaaaatagcaagggaagtacttttccagccatattggcagtgctattctgtactgtcagtgtgagaaacatctgagaataaggatgcttttggcttctgctttccttttagttccaaatcctacctgaattgtaattgagagaatgtaggattttaggaatatgcacttgaattacgcatctagttctcagattaggggagatttttctgaaattaataaaatttaaaagatatgtttgctgctttccttgtgagtggtttgccaaagccctccctttgtctacacatcactatatcatcctgtctgtgggaaatggacaactaacatgggtaggcagagaagattgaacagtttggaaatgaggaaactcagtaccaccaccattcacatgggagtcagtatgatatattgaatagcacactaagataaaagttaagaggctgggttctgtcatttataagctacgtgtcgtgatccaaggtgcttaacttctctgggtctcattttctgttttggtcaagggttgataacagtacctgctttatcaatctttcaagtttgtttatgcacatgacagctctttgggaactgtaacatactaaataattgagataatgatggtgatgatgataattaccgcaaagcctagtataatatcatgcagataaattggagctcttgagtttggtagttgaatctaattcagtagttattgatagcattcaatttggagccctgatattttcaatattatatttatccctatcatagtacgccataatcattgtttttaagatttcatggtggagacagcatttgagctagccattcaaagatggttaaaattttgctaacggaaagtaatggttagaaagaaaaacataagcaaaacatagaggcattgtagtatatgctttgttctgggaggaatctagttaggtgggttacacagggtggaatagtagaaaatgagacccaaaaaagtggcttgaggcaaaactattaaatgccatttcaaaaagttggaacttgttacttacactaactaaaaatcggggggaaatgttgggactcgattctgagctgagcaagaagccactggaaatacttgagcaaagtggatataagacttagctacaaatgacatgaagggtctaagaaaaagggttcctgtcttggataactgggtggctgttcacgctattaatagagacaaagaacttaagggaggaatgggagttagaatgggtatcggttttgccatctttgggcacatccttttatcctctctggcctgaaaacaaaggattaaataatttctaggaaattacatttaccttgaagttttgatacttctataatataaaacgccggagtccttgtgattttgtttagagatatataatcggcattgtagtgtgtaatgatgatggacattaaggaacccttgtttcttagtgccttttggaaactggctcatttcagaagctgcgctcttttcccagaggcaacttttgaagttacttaaatatttaatttaacaaatatcatttaagatttaactgtctactatccttgaaagggtcatgagtttccctcctaaaccaagactttgaagctctctgtgctgtctcacaggaatccccatgatccaacttcatgtgacctgcagaggtctgctgccttgaggagtagacaggtagctgggctgttagtggctaagtccttttctcagaatatgtggaggctccttctacctttaacagtgcttttttgctttgtttgggaagtaacagagtagtcaagtgcatgaccctggagccagactgcctgagtttaaatcctgtttctctctttagaggtagttccttgggtgagttacttaacttgtctgtgcttcagtttccacatctgtgaaatgaagataccagtagttacctgagttttgttaccgatatcaaatgtgcttagatgagtgcttggcactgggtgctactcaagtatctgttaaatacttttatgggggatagaggacagatttaaatggtttcccatagccaacattctagctttccagaatatcagtattttgttgtggtagcggtggtcttttttcctaaagaaacagtgcttcgccagaagggagacattgttccctactggctccctacttccaccgtttctcccactcttctatataagtgccttagagaaactctggtcacccttttctgtggtctgcttagctccaacaagaatcatagaccaaaggttttgctgtcatcactttaaaaatagtgtaagttatttttttctttcctttttttaaatttttttttttttgagatggagcctcagtctatcgccaggctggagtgcagtggcgtgatctcggctcactgcagcctctgtctccctggttcaagtgattctcctgcctcagcctccccagtagctgggattacaggcatgtgccaccacgcccagctaatttttgtatttttagtagaaatggggtttcactgtgttgcccaggctggtctcgaactcctgacctcaggtgatctgcccgcctcggcctcctgaagtgctaggattacaggcatgagccaccacgcccagccagattattttttctttagtggaattcagccaattgaagcataacacatggcatgaacactctggaaaggtggctttggatctttccatttgttctctttagcgctgacttttgctttctagtccctgctagtgtgttggaatcttaccccatacagatgcaaactatgaaccaagaagtcagcatctatgcctagccaataattggttgttttctcgttcagagttcctcatgcccatggggtaaattcatatttcatccataagtgtgaccattgcagaagttctaggactgctactgtctgtatttttgtccttcagcatatcccagactaaacttactcttaaaatatgtttgtccaacctttggtttccttcctatggttgatattaagcctttcttctactcttagaagacaaaatggggagacaaaaaaggcaaccctgaaggtttttatcctttcagggtatctagcatttttctaatttagccctactgaagtttcttcagtaattaatcatctgtttttcagcctctaacctggctaatattatagcctacaattgtacttttaaagcccttttgtgactttgacatattgtgtctattgtgtatggaaaagtagcaggatcagtatgaagataatacagtatctcttaaaacaggcagccagcaaatgaactttctgcattggtcagaatttccatcatttcactgttaatgaggaaagtacagttctttagctaccatgaaagtcaaacatatcctaagccttttggaaaaagacatacatgttagaaaatctcaaatggatgagtcagcctgactgaccccacattgactccattttatatgctggccaaatcctgtttctgactttcctggcacagccctggacatgcttctgtatcataggacttgttccccagcgcctttgctacttccttcaggcacattcctaggaaagattggcagtggggtttgctctttgccagcactcctgccggtttgggggttatggatgccaggttgggctccaggcactctgctctccatttgtggaggcagggacggtaacagcacctgacaagtagggatgatcacattgtattcagaagcctggtggagctctataaacccaaatttctaacagtctccaatgtaatgccctgtaatagaagctgtccttaaccctcaatcatctgtattcagctagtataaaaatgcaaatctgctcttatgcctaaacagttaggagtagaggagacttggcttcctttggaaagtcaggatgatagcttcatcccattctggtttttgtgattaattgtgacctacaaaggggtttactactctagcaggaactttgaatttcctatatacatctctttctggttagcaggcagaggaaatatcgttgacttttggcttcctggcaaatgtctcatttgccttgtcatttgttgattccttttccctgatctctgtttggtgtgataatgtacagcaaagctgaaaaccgcagggctacatgtacacttgtaggtacctatgttgtgattgccaaaaggctcagaaagccagttttctagtgaaaatggctaacattctaagaaatgctttcactgagaaagagaacgggtcaggggaaggtggaacttaaaggaagatggagtgttcctgaattcagattcctgaattagccatttatagtttcatgggaagacaatgaaaaaaaaaaaaaagaaagaaagaaaagaaaagaaaagaaacaagcaaccccaaaggtttttatcctttcaggtatccaaacatctttattctagaaagtttctcctcgatggtaaaataaagctaggaccttatagcaagtctcagactcaccatggctgtttcttaacaccagtataccttaagcagtaggtatcaatttagtggaaatataagggtattgatatgtagtggaggctgctctgaacttggaggtggaaatactaagtttaaatcccagcttttcttttaacattgcaactttgagaagtcttttaaccattgtctcctgtttgtatcagcatgaggggatagataataaaacctgcctcacaggagtgttgtgagaattgagtgaaataatgtatgtgaaaataccaagtacaatgcttgcttagaaagtagaattttgttttgccatcccctcccccactatagttggcagggcagggggaggcagtatattcatccatcaatattatagatgcaattgttcccagatgttttgcttttaggcaaaaccttgtatagatgactgtataccctcttacagttgatgcttaataaaacaaaactaccatggttttataatggaatggtaagctcaaacattttgctggtagtataaaaaccaagtgcctgtgattacctatacattaactcctgaagaatcaattataatctcagcaaccttgctctttgaccattcattctaaagcttggcgaagttaatgagaacagataataggagtgctaatgcaattggaagacttttttttttttaaacaaagtaaggaagggatacatttttaaataaaacattgcattttggtaaaaaacacagattatgagaacacattgagttagaggaacatcatattgattccaagaacaaaaagcatggtggagaaattttgtaaccatgcaaatccagtgtgctctgttctcatgagttaaaaagaattttcctcctatagaaacttgttatttaaatgtgtgtcacatgtaaataacagtctaatgagagcaatatagagggagaaatatgtaagcaagggaaagtgggcattgttttgtttttttttttctccatctatttcaatacttgggtctttcctaacctatagtgtgtcctgtttctccctggctagatttcttaaagtttctgcctattcatcactcaagtacctatctcaagttgtagctacttttgtgtgcagggtgtaatagcagatgttctcctgatctagattttgttgctctgcctaactgcatgccatcatttgtttctccctttgtgatcttctactgtagtcaagtgtccctttagaacaaacttcatgggatggacatagcctaatgagctcattgctgatgaagtctttttttcctgtgcattggttagtgcagtaagcaaggctccttaactgcctgtcccagtgtactgaaaaataatagtgttctctcaccttaaactacaacttgtggtttttgcttattgcttctttagtctttgaccacatgcatgtttttacatagttgcagttattttattatattcctttttctgtcataaacactttccaaatgtgtttgtggtactcaaattatagcttagcagttaaataatttgatatattacagtttcccctcttgttaggtgtatccaattttggggtttgtttgttcgtttttgtttttttctgttgttgttgttgttgtttaagggaagcaccaaaataaacctctttttaaaattaattaattaatttttttgaggcagagtctcgctctttcgcccaggctggagtgcagtggcactatctcggctcactgcaagctccgcctcctgggttcatgccattctcctgcctcagcctcccgagtagctgggactacaggcgcctgccaccacgcccggctaattttttgtatttttagtagaaacggggtttcactgtgttagccgggatggtctcagtctcctgacctcgtgatccgcctgcctcggccttccaaagtgctgggattacaggcgtgagccaccgcgcccagcccaaaataaacatctttatatgtaatgttatttccctaagataaatttccaggagcttgatcccagggtaagaagctatgaacattttcatggctcttgccttataatgtcatattttgctttttaacctttaacaaagaacattcctatgcccttgctttcagatgggtcttttcttattgtgaggaaagggctaacgtaagtcccatctagaagtgactaacttgcctagttaaaactagaaggaaatatccactgtattgggctgtttactccataaaccctggcttggctacatgtgtggtatgtttcaagtctggcacaaagccaccaaacacatttttggtgagttggttttaacctgctcacatcagatatgaatgctgaagttggagctttcattattgtttttgtgctggtagaatgttgcagaaatacacagggctggctgtgtattcttagtcactttaaaaaaaatgtcctggtgtgtctagaatgatggtttctgttctttgcaaaaataaaaacatcaaacaagataaagtccgatgtagccaagaccctctacttgaaccttctgtcggtactgtttgtttaagtactgtaagtttccacggttcatgttatcttaggatatcttgtgaaacgaatccttgtggtccctactctgggctaacgctttgtgacttaactttttacagtgaacataaagattctgaaaagaaacacaaagagaaggagaagaccaaacacaaagatggaagctcagaaaagcataaagacaaacataaagacagagacaaggaaaaacgaaaagaggaaaaggtacagagttttctagtaggggaggaaggaacgtggatgcacttttgtttacctttgaaagcagatatcttaattgcatagtaagatcccttggtcttgaagtgaaaggtttcttgtcaggagaatttagagcaaactgtagtcttaaactataaaaactaagccttttaccaccatatgtttcacagtggcagatctgtccatatcattaccttttttactttatattgccaatgaatacattgagaatgcattagggaaaattaattgtttttgggagaaggcctaatgccttgatggtcttctgttcattaaaggttcttcccgagtgaaaatttagtgatgctggtgtcttttgtggcatttggttccagcataaccagtgcaagccttctaaaaatgactaggctcacccagctgagaatgaatagtactctgtatagttttaaaaagagattgtttttattttagctttgaaaaagtaatttttgtacttggtaaattcagatactatgaaataaggaatatggtgaagaagacatctcttcacccctgactcactgtctcccatccttctcagaggcaaccgctatactgattatgttttgtattcttccatagatactctgtatatctgtatgtgtgtgtgtatccctttgtgtgtatatatgaagatttttttgaaagataaattttctgacgaatctagaaagcaggaagtcaaaggggagggggtcatgagtatactttgcctaagtaatagaagacagggcatagactacttttttgtttgtttgttttttaaataaagatgggggtctcactgtgttggcggggctagtctcgaactcctggcctcaagcagtcctccaacctcatcttcccaaagtgttgggattacaggcatgagccatcacatctggcccagtttatatgttttgtttgtttggtttttgcttttgtttcctctctgcactgccaatggcaaattcttgagtagtggaatgtatttattggggaaaagagacctgccaccacttaaaagtaaaaagctgccatttttaagggaaacctttctcagtgagttggacagtttcacccagaagaattgttaaaaacgagttttggacacatttcaggacctttagttcatctgttcagttttggtaacataagagccagcttgtgatcatgatgtcccaggaactgatgctacatattctcaaaaagaggtttcttcaaatttagtcctttcaaggtactagttactgttgttttacttttcaggttcgagcctctggggatgcaaaaataaagaaggagaaggaaaatggcttctctaggtaagactttgctgctgcgtgggcttccctttctctgggtggacagcaggccagctgcctgtgttgtagtgttgtctgagttaacccaaaacccactgacctggccatcttgatggttcccagaagctcagcagtgagaagactcggtctaagccaacctgagcctttctacagtgccatatagtgagactgaccagcacattttccagaaggttatttcgaatagagaaggttgacaggagagatttttaaaaattgagatttgacttgcatatcacaaaatttgtattttaatggtatacagtgtaccatttttttttttttttttttttagtatattcacaaggtattgcagcctcttcactaattccagaacattttcatttctctaaaaagaaacttcatattcagtagcgattatggagttttctgaaaaatcacttagtctgatttcatcattagtaatattgggaggcttatatataaaagatcatttgacctacatgttagggatgagtgtagatttgggtagaattatgttatctcttttctagaaggagaggaaaatgcgcaaaatctagaggttacttcctatactgtttttacctttataattttgttttcctcagcctcaatttcctaaaataagcccagaggtcccctctagtttcgaaacaactagatgtttattgttacatattctcacttcactgaatgacagaaaggatttattagaaatggttgtaagtgtttgcattattgactgggacaaaacactttgagagttttgcttccttgaatctttgaactttcagtttcatttgttaaaatttttgacaattgtgcctggtactctggggtcctttagacaaggagaaaagcaggtgccctcttcaggcatgtttcataattgttctaggaatgcagaataatacaattcaggaagcattagagctgcaagctgccctaggaattttgatttctgagataaagtgactgaggaggcactgctgggctaatctctgccaagagactgccttggatttttattaaactgatatgaataaattttttggacttggtgcatagtcatgaattcattttcagactttttgggttagaagattaggaacacagccttctttgaggcagtggtctctatgttcactttgctggactccttgctggcttgtgtatatgtctttgtagagaatccagatgcttcactggaatacagttttcaggtaaattgttttaggacttcttccttcagacctaagtaacccttcccacagtttttgtcttcagtgtgacaaacttaggatctagcatttacttaactagttgggtaaatgataggctttctttccttctggaccctagggtctgtgtcagtattcaggcaggagggggaacagctgtagaagctggcatttggttagggtgctaaaataagttctttaaacattcaaattctatcacaagcaaggggacccagtatgctttttttggtcggaggtactcttgaaaccctgtgaatatactttgcagtggggtcgggattcttaatccttggatccctccacagggggcagctgcatgtaaggaggccatttcttgtactaagttaaggcagtgaggttctgaagagatgtgccaggccagggagcatcccatggctgcagtgattgctgggctctatggtgttttttacttgttccttctctgttttggttcaagatgtttgtctcaaaggattgtctttttatatttatattttgaaggtaagatcttaacaaatagtagtgagacactcttctgtatataaagtaaacctaagttaggacgttgaacaatgaatagatttggcataggataccttctgtttattctggtttaacacgtgccctacttttgttgtaatgttgtcagcttggttatttttccatgtagctagatatacatgtacgttattgccacatttttagaactttaaggtactaagttggggaaatcaatgtttattcctttccttgtaaaagctgtactttagcttttagagtactggaacaatcagttcagattgtggggtcaaatatatggtaggtttccatgtaaggcaagaaaacaccttaggtttatttctggagtggttcgtgccatgctggcaaagatagctaagaaatagtgagaaagaattctgacttagaataaagagtcttgatcccaaatcctgatattgcccattcacctgtacaatgaggacaaatactatctacttcacaggattgaagtgagaaaaagtgctcacagaacatcttcatgatatgtacgtggttatccttatttctgttagcttcttttcaacgaaatgacatattccttctttgtattaatagaatacagatgttctagcactctgaccagcaattttttttctctttagtccaccacaaattaaagatgaacctgaagatgatggctattttgttcctcctaaagaggatataaagccattaaagagacctcgagatgaggatgagtgagtattttcttaaaactttgacttttgaaaacaaaaaggaggagtttaaagaataaatgtgatgtgtttctttataatacatatagaaactgcattaattggcttttactcatttggaatttgtgattaatggactgatttctctgaactatgagaagtagagtttgctaaacaagtagtatacccaaggcttacatgaagattatataaatttttattactgaaaaggcaatagatatttattgtagaaatttcaaataatacagaattcatgaagaataaattatttaagttacttaaaatttcttattgcctaccacagataacttaaagcagtttctcttagacctattcctgtcagacattctaagtgaagtttcagtgtgtaaaaataataaaactgctcataaaacggtcgaggcttacatgtatctctttccccagattcaatgagattaaattatattcattattttcactcttatatagcttactatgctattgttatagtagaaattggatggaaagggagaagggaaatacttagtgaactcatttgtattcattcaatatagaatttctttcctccacattccagtgagttactgctatgtggtagctagtgtgctgtgtgtttggttcccaaactttcatcttttatttttatttattttattttattttttttcccagactttcatctgataatgatatttatttctgcatatatccccccaccctattttgcttccaggccggtgtaagtggtttgttttgttctatatagggctataactattactctttggtctgaccttcattattttctctatttctgttagtcttgaccgtagaatgcccagccaagaataacagtgattactcttgccatggaggcatccaagagtttgtaggtctcctatgagtgagaactcctgaatcataattatgttaactgtgtattcatgttcccctttctagtgctgattataaacctaagaaaattaaaacagaagataccaagaaggagaagaaaagaaaactagaagaagaagaggttagtaaagagacttaggtcctttggggcttgagtttggaagtgggagttttccagtaagcaacttcttaagacaaatgagttttagatatttattggcttgttataacattagggaaaacaaatttaataagtggtggctgtggcactggtagttttaagatctctgtgaatccccacagtgtcttaagttaaccacaaccagcagtgattctgctctcagccttcctgggtgtctgtctacccacagctaggctgccaacagatgttcttccaaaaactatgtcatcttcatatatacagaggcagtgttaacaagaaaccacattttggcttataaccctgaagaaatttccctaagaattttttgctgatcattcactttaggtaaccattcctatctaaagttctttaatgggtacccctttgacatataattgacacccaaactctttactgcagctcctcccaatctggcccctgcatcttgtgtctctcttcatcttgtgcctcttctctagcttacttgtaccagtcacactagcctcctttgtttcttttccacaccagattctttcaaacttccgagctttacgtagcacctgctgttcctctatctggaacacacatgctcccttctttatccttttggcctataaccttcctcaaaaaactcagttccgtttaaatgctttcctaaatgttcttgttgatgcttgtggtagattgaaaatagaatcatatgcttcctccttttgacacttttgagttcttgtaccaaaaaattgttagcaggtaattcaagaaaagatgtcagaaattcacaggggtcttaatgatgccctcccctaagacaagaaggggttgggtgagttcttagctcttatgctacatttgaggttagccactgtcatgggcaaaatgggatcacaaatgtaaagtggacagtttgaagtaccagcagtaaagagaatgatagtgaaggggcagggagtcttaagaggataatctatcataatagaatgatgttaataatcacaattaaatgtaataggtgcttaccatgtgccaggcactcttctatatatgtatcatttcatttaatccttacaacctgaataggttgttacatccctattatcatctccattttgcagatgcagaaatagagtatagaaatatttaatcatttgcctgaggtcacatagctactaaggtggaaaagccagcatttgatcccatgcagtctgacttcagtgccagcacaccagctactatattatcctacctcccctgggactttgctgatgctctaattctgcaaggagggagaagaaaggtctttaatgaaatcatatgaagaccattagtgagtgagttgagccatagagagatgatcaggtcctgaatttagaaggttgccgtttttttgacaactagtctattcttggccgaagttcaaattaataagcactaattcaaggaattgagagtgaaatgttaagtagtgattatggtagccaatcactccacttgcatataccaaatcagtacagactagtcagtaaaggaatataaaacttgagttctccaagtgtttttttttttatgtttatattgcatttatgcaaaaataatactctgagtttgttaaaccattgggaaaaaagaacagttgacttcatttgttattattctatttagcagccctaccacatagggggaaaaatgctggctgaaagactgaattaatacaatcttactgtggcagggaccccagatggcagaatctgtcattaaacctcactcgccaactatagtttttttgttttttgtttttttctcttgtttttgagaattgttctgaggtctcttagtgactgacaccccaatttgaggcttgaaaacatacaatgtagccagtagtttcctgatgggaccagctggatgcctgctcagaagctgtttagagtatcttcactgaaaaacatttccctttcctgtggtgtgtttcaccctaaatagtaaacattatctgaattaatgtgatcctgtagtaccttctcccaaacatacccacatatttatattctccgtgcctgttttaaaatatggatggtactgtaagctttcctcttttttctattcctatcttgattgccatcctattatgaggatctaaaatgtttattccagttattcccataagtcacattctgttatttttctcataaagttaggctcttatcatagttaataacagctatatgaccttgatcaagtgacaaaatatgtttcaaagtccttgattgtaactggaagtggttaaatgaacccatccatacactttccagctgtgccactctttaattgattttaagatggttcaaaaccacctttcattgctatataaaacttgttgaataaagactgaataagtagttaaattatgttgaataggcaggacaaaggaaaatattcttcaaaagagttcagattctgagtgggatcttcacttgttgaatattacatttttgtttgggttttgtgtgtatgttttgagattcatctcctgtattggtgaattgtgcctgtttaggtttgatgcccgtttattgtgtcactgtgatcagctcatttacattcagagttcaaagaagagccataaagaaataccaccataggaattggtgtcattttagaacctatcaaatacttgcttactgcatcatgactttgtgtatacaagcagcagcgatagtactatactccactaaatcaactgggaattttctttcatcctgaatactaaatatctaatgcaaagccccgtctagccgttatttgattgtactggaagaggtttaaagatgagtaggattaaacataagtgaggaaaatacactcggattactctctagagcagtacttttccaaactcctttgaggttaaaaaaaaaaaagtttcccagtctcttcccctgcagagtgttttttaactactttctcaagtagttgtttgtcaggaaattttaggaaatactgctgtagaacagagcaccagtacattgttattcatctgtcaaatgagaggagtactaagatcttctttagttctaatactctatgattacaatttttcttcctcatggctcccaaaaactgcctccagaagtgtgatcagtctttatttaagtgctttctcaccatgtttctttgtaggatggtaaattgaaaaaacccaagaataaagataaagataaaaaagttcctgagccagataacaagaaaaagaagccgaagaaagaagaggaacagaagtggaaatggtaacatctcagcactgggttaaaatgccaccttttttattgcatatccttacgaagcaagagtattgagttattaaaattaatatcctgatatttggggggaaatactttaaacaatttctctagagtaactttctgaagtaagttttccaacttctagtgaaatcattaactggttctaaatctattggatctcaaactggtttccaccactgtgaacagaatggactgtagaagcagacctatgtataggtgggaatttagcatacgaagagagtacagatgcatttaaaaccatacggaaaggacagattattatgtaagtcgtgttgggaaaactgcctgttcaacaacagaagaaacctcaacaagaaaacgtgggtgaatatttttataattgtgcagtagtgaagatcctttgaagcaagacataaccagagccataaggaaaggtgttttacatttgatacatcaaagttcaatttatggcaggtggacaccttcatgccatttaaaaaaaaaaaaaaaactcaaggcaaaatatttgcaatacaaagggctgatattcctaatatgaaaaaaagctcttttaaaacaaatatgaaaggaatgatctaatcagaatgtgaggaacagtcagtttagtaaaatagttaataagcatctaaaaatgtgatcaacttcataagtaatcaaagatgcaaaaaaaatgataaatctttttgtttaatgcctctcagattgggaaagattaataagtgaaaatatctagagttgcaaatgtaagaaaacaggcattcgccttccctataggagtgaaaattcagtctttatgaaggacagtttagtcatagctggttgctcttgagaagtgtatttaggtggagaacttttctacttttgctgtttagaatcttgaaataaacatgtttttaaaaaatacttatttctgttaacatgttctatttaactactataccagcagtacatgattttgtgtttatgatgaaaaaactcaaatgattgacagatttaatagttagaataaaaatcaaagtcacctttacctgtcttctcccattctcattttcctttccagctttccagctttgaggtaatcactgttcataatttgatgtatagccttccaaacctgtttatgtgcctttatggcttttgtaatttagaactttgatgtccacagcacctctgaggaaagggagaaagagcactgaccaggaaggtggcagagggaaggagagccacagtggcagaaatgtggccacacggtgacagctatgtgattcgcatgttgctatggcatcatgggattaaatgggaagtatagaaaaggaatatcacagagcagagcaaccctgcctctttctagaggtcagagtcagaaagtaaaaggccaggcacagtggctcgtatctgtaatcccagcactttgggaggccgaggctggtggatcacctgaggtcaggagttcgagaccaacctggccaacatggcgaaacctcatctctgctaaaattacaaaaattagccgggcgtggtggtgcgcacctgtagtcccagctacttgggaagttgaggcaggagaattgcttgaacctgggaggcggaggttgcagtgagctgagatcacgccaccgcactccagcctgggcgacagagcgagactctgtctcaaaaaaaaaaaaaagaaaaaaaaccccacatgggtttattttcctcatttttatttcacttttcttaagaactaatacattttcagtgatcttgacctttaagaaaatgatttttagaaataaagtgattgtgtaaattagaggttattattgggagttaagagaatggtaggttagtaattcatcagtcagggttctgtggtagttactcaataaatgcttgttaaatgaacaaatacatttccttatcaggagctccctgctgtctcccctttacttcggagctttggctctttttgggatccaggcaagtgcgctgggtccagccttgtatgtgtagaattaggtgcccttgaggggtttaggagcctaattttgcttttgtggttgaaatccttatcagtgttgccacacattcactctgacagaccatgacttttggtttttattcttattttgggttaaaggggaactggctagtctttaactaaaagttgttttttgaggaatgagcagactttgctacagcttctaacgcatgcatttctcaggtgtgatggttaaaccttgcacattcttttcaagcacagtgcttgaatggcacaccgagtttttggtgttgaaaatatgaatgaagagcctcttaactgatagctagaggctgtgtatcatactctgaagtcagttatccagtcctcagtgactgccactgatgacctagtcggggagttaaatggcagatacccttatttttactattccttatgctatcctactaaaagaagtacacactttacaagcttgacaaatttgcagatctttttcttccctcgtaagtccgcagacctgtttgtctttaccagaaaaaaccacttactctgatctttatctccctcctttggtaattgttcagttggaaaaggtccaggtccctcagggtttctttgctatatcacgttatctccatagaaacattgttataagtggtggcagtgtgcttgggttcatacatgaaatcctgtttatcccagatgtcctgatttttaactgttggccattgtagctgaacagggtttcagcactgttgggttaattaagtacacttttgtgtcagggctgacctgggaatataagttgccagttaattctcaacagatgattcttcataaagaattacctggcgagtttattgcaggtgttaggtgtgactttaaatggagttttcaatctcttagcaaaggtaaaatgctgtgatgagtcaggactataatgttttaaggaattagtgttgcaagaccaagactcataaatatatggtcaatgatagtggtaagaaatttatggaatatggattattgacattttgctcaaaccagaaaaacttcccttaatttcaaggattagcattcagaagctacagcatctgacctttatttctaaatttaaaaaaattaaatatgagttttatagcatactgtgaagtgcttgttaactgcaagggaacttgatatcaaacagcacatggagtttactttcctgtctttatatttctagcacttttccacctttcccccttcaagcaaattttattattaaattggtacttgattattcaagtcaagctgccaaagggaagccatttcgatgtctaagtacatgtttttgtttgtttatttgtttttaaattgcggggggcggatatatgcactcatggggaggctaaaaggacagaactgtttgcttttatttgtataataatagctgtcagcccagtcacatgagcttactgaaacagatattctgtctttctgtttaaactgaagtttagtgttgtgatttgctgaatctcttaatttgcttaaatggtaaagaagttgctgtgggtcttcaggatacacatgttgaaataggagtcgtaaaaacagtttggagtcttgatttaaaaacactgtagggccgggcgtggtggctcacgcctgtaatcccagcactttggaaggccgaagcgggcagatcacgaggtcagtagatcgagaccatcctggctaacatggtgaaaccctgtctctgctaaaaatacaaaaacaaaattagctgggcgtggtggcgggcacctgtcgtccccaggtactcaggaggctgaggcgcgagaatggtgtgaaccctggaggtggagcttgcagtgagcggagatcacgcgactgcactccagcctgggcgacagagcgagactctgtctcaaaaaataaataaataaataaaaacactgtagtcgatgagaagaatggtgccaaagtcccaggataagggaaagggtggcgttcggaatctcctcacggttactctgtgactgctgcagacaggctccttgcagatgctctcatacacctacatatatatatattttctctatttggagagtaatagactgtaggattgggtggtttcctgcattgagatccttctattaatatatcaatgactctgccaatttcatacctgaaaaagtggtaggttagttatagaagatctttaatattcctttgaggtctaagattctgttaaatatttttgtttaaattgtgtaaaatacatatgacataacatttatcatcttaaccatttttaagtgtacaattcggtggcattaagtacattcatattgttgtgcaccatcaccatctccagaactctacatcttgcaaaactgaaactctgtagttattaacaattccccacttctctgttgccccagttcttttttttttttttttttttttgagacagagtctcgctctgtcgcccaggttggagtgcagtggtgtgatctcagttcactgcaaccttcgcctcctgggttcaagcaattctcctgcctcagcctcccaagtagctgggattacaggctcccaccaccattcccggctaattttttatatttttggtagagacggggtttcgccatgttggccaggctggtctcaaactccagacctcagatgatctgcccgccttggcctcccaaagtgctgggattacaggcgtgagccaccgtgcccagcctattcccccagttcttggtaagcaccattctactttctgtctctatgaatttgactactttaggtaccttgtattaatagtcatacagtatttgtcctttgtgactgactcatttcacttaacagaatgtcaacgctcgtccatattgtagcatgtttcagaattttctgacttttaaaggctaaataatattccattgtttgtcctgcattttgtttattcattcatcttttgatggacatgggttatttctgcctttggctgttgcagatagtgctgctgtgaaacattcgtgtacaagtatttgtttgaatattgagtatattcctgggaatggaattgctgggtcatgtggcatttctgtgcttaactttttgaggaactgccatactatcttttccacattggctgcacctttttacgttcctaccaggaccacacgagggtgctagcttccctacaccttcaccaacacttgttattttttgttttattgccatccttatgagtatgaatggtatctcattgtggttttgattggtattttcctaatgattattgatgttgcatatttttgcaggtgcttattggccacttgtatatcttctttagaaaaatgaccattcaagttctttgccccacccccacgtgtttttttttgtttttgagatggagtcttgctctgtcgcccaggctggagtgcagtggcgcaatcttggctcactgcaacatctgcctcccaggttcaagtgattctcatgcctcagcctcctgagtagctgagattacaggcgtgcaccaccacgcctggctaattttttgaatttttaatagatacagagttttgccatgttggccaggctggtctcgaactcctgacctcaagtgatccctccgcccgctttggcctcccaaagtattgggattacaggcgtgagccactgcgcccagcccctatttttaattttatcttttttttcccctccaccttaagactgagactttgcccatttttttaattgggttgtttattgagatgtaggagctgtttatatattttgtatgttaaccctttatcagatacatgatttacaaatattttctcctattctgtgagttgtctttcactctcttgaagtgtcctttgatgcacagaagtttttaagttcagtgaagttcagtttatttatttattgagacagagtgtctctctgttgcccaggctggagtgcagtcacgtgatctcggctcactgcaaccttcacctcccaggttcaaacgattcttgtgtctcagtctcctgagtagctgggattacaggcgtatgcccccatgcctggataatttttgtatttttagtagagacgggggggtctcgccatgttggccaggctggtctcgaactcttgtcctcaagtgatccgcccaccccagcctcccaaagtgcggagattacaggtgtgaggtactctgcccagctgcaattcatttattctttttgttacctgtgttttacgtgtcatatccaataaatcactgtcaaatccaatattgtgaagcttttcccctatgttgtcttctaagagttttatatttttgctcttatatttaggtctttgatccattttgaattaatttttgtgtataatgtaaagacccagtttgattattttgccaacactattgttgaaaaaactgttctttctccattgaatggtcttaagcatcttgttgtaaatcatttgaccatatatgttgactttggttttatagtaataccattgttacaatatggtttgatacatgtaatttttatttgatgtttctgaactttgtttaaaatattggacttgttccatggctgaatgattgataataaaataataaataaaatattgtacttggaaagtaaatatgagggtagtaagttagttatctattcgagtaaaagaaacttgaggcatagccagttgcaatttgtgagcctgagttggatcctggtctataaaataaatttagataaaatagggaagtttttaatatggactgggaattagaattatactaggagattattttgttagatgtgataatagttttgtggttatgtggaagaatattatttttatagagatacttgctgaaatatttagtggtgaagtatcaaatctgcaaccaactttgaaaatggttcggccaaaataggaaatgtagcaaattattaaccttttttttttttttttttttttgagatggagtctcactctgttgcccaggctggagtgcagtggcacaatcttggctcactgcaacctctgcctcctgggttcaagcaattctcgtgcctcagcctcctgagcagctgggactacaggtgcgcgccaccatgcccagctaatttttgtatttttagtagagacggagtttcaccacattgcccaggctcctgacctggatcacgacctcctgacctcgtgatctgcccgcctcggcctcccaaagtgctgggattacaggcgtatatggtgtttattgtattactcatttttttcttatgttcgaccattttaaaaatacattttcaaaaagttgttcccactgagctttagattcacttatcagtgtttgctagatagttccaggtaatgcgtaagtaccttaaactcaacatgccccagttaagctatcatttcctagtcgtcttcctttatgtcctttctcatagggttgttttctcctctaccttccatctgacgtcaccactctgaggaggccttttccttacaaacaatgtaaacaatccctctgtcatgtatgccattgtggtaaaacaactgtttacattttcaagtccctcacttgttactgagctccttcattgttgatctcttctgtccagtattcttaaactgagctgttgaaatgtattttcctttattcaccacagtatttcatcttacttgtgagcgttggctttttcaaaatgagagacactggttcttttgatccaggccttgaatgtgaggcccagaagtcattccagagcactaatcagttgagcggataattatttggcatttaatcagtgatgatccccatgttagacaaggcgatcactaaatgaggctgtgctttgtcttttaaaggtgggaagaagagcgctatcctgaaggcatcaagtggaaattcctagaacataaaggtccagtatttgccccaccatatgagcctcttccagagaatgtcaagttttattatgatggtgagttgtttcaaggttcttgattcttggccaggaaaagaaatctgcttctatttagggatagaaaacaaggaaggatcctatgtaatagataatcctttttatttcattttgttttattgccatgcaattttgaggaaggggcatcaggtgttaactcttaaaggctcatttgctgctgaaaaagtgccatggaaaaggggctattcatgtcttccctacatagtccaaaaaaggtttgtcaacatggctaacagtgtgtggtccacaagctgaaggttttgatctgaacttcatttctagggagcaactcttcgcaagagttattagaaaagcctcacttgaatggtagtattttatgttagcaatataacaatgcaatcggacaagctgctcatcactagaaacagtattagtatatggtcgaggattaatagtctgccatccatctctagatagggctggtaggcatctgtcacctattctgtgtagcataacactatgcctttgatatatgtgcaatcaagtctgatgagctgctttaaagaaatgccctgcctgggtctcttagaaccctcagaattgtcccttatctgtcgttggtatttgtatccttgggtttgaaggatttgagggtagcctttgacatgcctcctgttggcagtgtagcagtatgtagatggtaataactgattttcttcattccatgagttttatccagaaatggttagagcattgttcctcatacccttatgtgcttatgactcaccaaagtggatctgagcccatttaacagttgtggggtgggcttcttttccctttccccaccgtccctcttcttctttcccctttcccaaccatccttccctcttctgtcccctttcctgacagtcccccttctcctttccccagcattcctcttccacctccacttgtcttaccaccgtcttttggccactgttatttcaccaccccatttctccaccatttttcccaccctcagccccccactgttttcttctcacccatcccaccgcccgcactgaaaagaaaaagttctggggtgggattgagtacttctgaaccaagtggtctgctgaccaaactttgagaaacactgggcaggataactgctgaaaagcatcagtggtgaacactcaggcattctggtgcatctctcttcccaccagtagtggccttaggtccaccaatgcttgtaggcctaggtagtagtttacactaaagggctgggtctgcaactgaagaaagtgccaaacttggcaagctgaaatttgttttttaaaatgccatatttattagccaagtgtggtggtgcacgcctgtagtcccagctactcgggaggctaaggtgggaggattgcttgagtccaggaggcagagattgcagtgagcctagatcgtgccactcccctccagcctgtgtgacagagtgagaccctgtctcaaaaaataaaataataaataaataaataaaacatatttattgaatgtatttgtggtcagacaccaagacccagcagtggatagtactactgacttagaccctgatcttggggagtttgcagcctaacaggactccataatctcagaggcaaatgcttatgttatgtaaacattttgacctgttgaccagagagcctaagacagttctttcagccctcacgctggtcattcctggagactcttaactataactcaaagccaaaactcctaattaagagaaagggcctagaaccttgaagagcaccatctcaaagcgtaggtattccgtaggcctggtctggacttaccaagagctttaggatgctcagctggtaaagcctcactttgaggttcaaagtgatgggagggaaagctagattccctagtcctgtggtttctcttccttttcaagataggaagcagaggcctggtctagttcacaggttgccatagtcctttcctcccattcttgcccagtcctcctttacaggatcctgctttagggctccagcattttctcagctggtcctctgctgggatttcttctctttgattgtgtgaactcttactctgcagtaagtcaagaagtcatatttgactttacttcaaactgatacagtaagtgctgcctactctctggggaggagaattcttagactcctttagaacttgccagggaggtggggcatgggctagctgaagcagtgaattactgccttctctgaggaccttcagtttacagctttgattcagcagtttccttttcctggagctcagccttttccacaaagtgttaacattgccaggaaccttccagtcatcctcccactactctgatgcagggagccatcatttcatcttttgacagctcatctaaaataggaggagtcacagttgcttctccctctattaggacagaattcagtaaaacagcccaaaatctcattttttttaaatttatttttatatttatttatttgagacagagtcacactctgtcacccaggctggagtgcagtggcacaatcttggctcactgcagcctccacctccaaggttcaaacgattctcatgcctcagcctcccaagtagctgaaattaacaggcacgtgccaccacacctaagttttgtatttttaatagagacagggttttaccatgttggtcaagctggtctggaactcctgacctgaagtgatccttgcaccgcctcctaaagtgctgggattacagatgtgaaccaccatgctcagccacatttttttttaaatggtgttaacagtttacatttttttcttgccattttatttcatttattttattcctaatgacttaatgttttcctttatattggaaacatgttacagttttctaaagaagttcagggaatcttttaatacacagcctatcttccccgaagtgtctttcttccaaagcagaagcttgggggttgatgggggcagctgcgccacctgttggccttttaagttaatggcgtccaaagtgggttctttctattataactgtttcaatattgtgctacagttctctacacccctgcaaagtcagattgcatatcattatgagataagatgtcttctgagttttgaaataaatggatttctggttaaattttagttttctataaagaatgtgggcagccttggtgaattattaatacctgtgtaatagtaaggtggtggaattatagttaacctcattttaagtatagccaaatgctcttagtatagcatggattggttcgaggtgatgttgtaaagttggatttttaagaaagaatggaaattggcactaagagtactgtcaaaagcatttgtttgaaaagtggattaaattcccaagtacttttctttcattgctttattaactaaatcaggtatataaaacccataggccctattcagattttctttaccagttagcagctttcattgtgaaaacatctgagtccctttagacagctttttgtttatttgagacagtctcagtctgttgcccaggctgaagtgcagtggcgtgatcttggctcactgcaacccctgcctcctgggttcaagcgattctcatgcctcagcctcctgagtagctggagttacaggctcccaccaccacgcccggctaattttttatatttttagtagagatgggttttcgccatgttggccaggctgatctggaactcctgacctcaagtgatctgcctgcctcagcctcccaaagtgctgggattacaggcatgagccactgctcccagcccctttagacagcttttacataaacaattggatacaccaggaaccccagtcatcccttgtgctgtggatgcatcctggttccctgaaagaggcagcatcatggtacccatgttccagagcagtgtgtcgcaaactctagtgtgcatccaagtcttgttaaaaatgcaatttctgtataggattcagtaggtctaggagggggcctgggattctgcatttctaaactcccacatgatgccaatgctgctggtctgtgaaccacttgttgaatagcaaagttctagaagaaggtcttattaggcttttcatatgggaaatctgggcttgcctagtatggatatatatttttttattcatattccacccacctaactttgaagaagaaagatgcctatttcttttccccacaattcctttcttccactccctgccctatcccttcctccccttcttgaacagaggctgcttagcttagcagtggcaggagtccctctgaggatttgatttttaaaaaccattgaagaggtgtaaaggaccctgcttgctgaaaggaaaaggaagagtgactgggcctcccccaggtcatccctgtcctgagcaggcacctgggaacaattaactggcatagtctccagagaatgacccaggtaaatatatgctaaagagaaggagaatttgtacaagtagatataaatcagtatgttgtctttgttgttgttgctactatgtgtcaccagacctttatataccatgagaaggcaaaccattattaaagagaattcgctagccctgggtatttatgcttagaacatgaatactatacctcactttttggaaccacttttttctctaggtaaagtcatgaagctgagccccaaagcagaggaagtagctacgttctttgcaaaaatgctcgaccatgaatatactaccaaggaaatatttaggaaaaatttctttaaagactggagaaaggtactgtagcccatgtgttaatatcctagtaccttgcaaaacaatcaagtactaagtaataaattatcattttgcaaaacatttcctgatgtaaaatttgagttgtatggattttgttgtatttaaacttgcgtattttttgtcttcatttactatattatgtagggtttctgtccaacaagagtacttgtatatctttgctattggctctcatgtgatggcaggtaggtgggggttatcagattaggccaaacagaaaacctcaactccagttgcgcacaggaaagtttgtcgctgcaggactgccccgtgtctgctgttgcaaagagaaatgttaatctgatgtccctctcgctgttaattcttgctcatttattttaggtactttctactcttgaaaccacatatactatatttgcctaggtgattttttaaaatctcattattctcaatttggataatgtggacagaggcagcagtaaagtttacttcctgaactagctcagaaaaagcagacttaataaatgaatagaataggggtaatgtttccaagagagaatcagtatgggatttcaaacttgtattcataatgcctgggggctgtgtgccacggagtctaagaaaccacataagaattcatttttttccatgataagtcattttaaaacattttaatattagtaagtacatattttataataaagtaatacaactgtatttttttgttttttcaaaattcattaattgagattggctacttccagaaacctttgactgaaaaaatggtgcttgggtgtatttgcaaagaaacccaaggacttattagtgtattttcgttgtttttctttcatctccccattttcttttgactaggaaatgactaatgaagagaagaatattatcaccaacctaagcaaatgtgattttacccagatgagccagtatttcaaagcccagacggaagctcggaaacagatgagcaaggaagagaaactggtactacagaatttattaaacctctggagaattctggaattgtgattggttcatttaactttcttcttggttcttatgacacaacattaacatcagtaatttcacatcattctatgctaaagacttagagttctcaaagtctaaattttcttaaaggttttagttagactgaaaattgtgaacaagtactttgctcagtagctctgtacaggaatcttggtgcttcagtgacctaaaaaccagtcagtaactccagccaataatatagtaattaaggatgggcagacctgtcccacagtggctactggatattaaggatttaagacagatgaaatcatattggccatgtacctccctgctctttgatctattttactctggaatcttgtgatgctcatccatctccatcttccagccttggccatcctcattactgaaggatctttctggtatccagctgggatgtcatttttcttctacaggctgcctgtttttgtaaaaaaaaaaaaaaaaaatttattggaaccagctgcctctacttgtctacatattatctacggctgtgtttatgcaacaatgacagagatgagtagttgcaaaagagagtagttgcaaaagagactgtgtggcactcaagcctaaaatattttctatctagaaaaagttgtcagcccctgaactaaaggaatccaggctagaatttcatttttaccaatcggaagtccagaagttaaggattttaaggaattctttgcacttcaaattcctgtagtttcagtattttaaaggacttgcgtgtttacgtaattcagaccattgtattgatataactcattgtttcatggtacttatttggtcactagtttaaaaattaatgcattactataagaatgttaattgcatcagactttgtgtctcaggtaaatcttatcctcaatattccaagttagtgaaatttagtatattatttacttcaggggcattttgaaacttaaaagatcactttggagctttgttcttagaatattgatccaaagatagattttataaacatccccttgtcagagcctctgccaaggacacctgctgccagcaaggtctgaatctgttcccacccacaaggcagcacaacttagttaaactgaatcaataagtatataaaacgcagagtcaatagagggtaaggaggctcaaaatctcccccaccatccctcacctttttggagcaaggatcatagtatagagtgtatatacctgtatacctacaaaaaaattagtgacagatctgtctgagcttaaaaacccacgtttttaagctgtttaactgctgtttaattaaatggcttgagctattcttttatgaggctctatcagagactcttctccatttcctgttttgatagtactcagtaaaacagtatgaatttttaaagtacatttaaaaacacccaaataacatttacaaacatatatcctttaagacacaagaatcagttttgaatctagttgaaatcaatccttataggcagatctttttggggaattttatgatatttaagtttgagaaaaccactagaggttttcctttatttgaatttattttttagtgatttttcagactttcctctaccttgacttagtctcccacaagagataaaatgcattagtagagaacagcaatctgaatctattttgagtactttcttgctgtcttccagaaaatcaaagaggagaatgaaaaattactgaaagaatatggattctgtattatggataaccacaaagagaggattgctaacttcaagatagagcctcctggacttttccgtggccgcggcaaccaccccaagatgggcatgctgaagagacgaatcatgcccgaggatataatcatcaactgtagcaagtgagctcgcacttcatcctatgggccaaaaagggggtggagggcgtcctttattgtacttgggaatatttcccaggttacacaggactgtttgggaagggagatacttaagagcaggacagtatttcatgcgtaggtctccagatgtttttgaggtacagttgtctcccctcatccacaggggatatgttccaagacccccagtggatgcctgcaacttcgacccaattgctgtcacttggaacacatttctgttgatgtcttccacccccaaatttaatgtcttttccatgtttattaagtacttatcacatagagtggctataacttttgcagtctgaggcacaacagcaaaactagcacgactttctttttccttcttcacaatttcacagatggaaggttaattcttaccttagatcttagcaacttcaccatacagttttttttattaagtcgataatttccaccttttcatttaaagcactctgtgcagcttctgtatggcatatccaaattgccaacatcaccactttcacactttggggcctttattaagtaaaagaaggattacttgaacacaagcaatgtaaaaccattaaagtcaacctgataaataaggcagctactaggttacccatgggcaagtgacatatacagcatggtatgttgtatatatggttcacgcatcccaggtgggactacaagagatttcatcatgctcctcagaatgatgtgcaatttaaaacttacaaaatgtttatttctggaattttgtattgaatattttcggatgacagttggctgagggtaagtaaaaccatgcataaggtgggactactgtattgactgttaagaaggaaacttggaaaattatgctcagcagataggtccacttggggtcatgaaaggtgaaattattcctcacatcttatttcactatcctcgtgctctgttatttccagagatgccaaggttccttctcctcctccaggacataagtggaaagaagtccggcatgataacaaggttacttggctggtttcctggacagagaacatccaaggttccattaaatacatcatgcttaaccctagttcacgaatcaaggtaaggggatagttgagagctgcactggttcatggtgctgataacctttttttgttgaaatgtaacgttctcgtcctctagaatcactttgacaaattaaaaatcctccccattgaaagaaggcaagtactttcatagttagcattatggtgatcttcctacagtgcctccatttttttggtcacattgtaatcttatttattaattcacaaatatttactgaaatcccaaatgtgccccacacagtatacatttgatgctaggaattatgttggtaaacaagatagacgtaggccctgccttcatattgcttaacgtccagtggtcagaatgtgttgaagtatggtgattgtatattggcctctgcagatgtcttctacttcctcacctctcttggttatgagaagggaatgtagtttctgtatatcctgaaacaagttgtaaaatctaatgtcttacatacttctggcttcctgcagtctcatctgggtaggttcaccagggccaaatgaaatgtgtgtgaaagcacatcataaaactgtgttacatacctatgcactgttatttattgatagtgttattgcaaggagataactgccttgggggaaatcagtttttgtttgccagatagctatgtatatctagctttggagagtcccacgaacttcttccctccaacatactatgaaatataaacctaacagagacaaaaacacagtcaaggaattagttctatgtagactgttaactgttttatgtgcaggagacctgggactaaagaccttcttgatcctcgttcataggttataacatctgttaaaatgtgaaagccacagctgaaaaggctatgtgaataggcaagactaaactgtacattttctggcttgtagccctgtgttcttctgtatatcactacttttctaatgaaaaatacctgtttatatattttctccaattataaaatatacttttctggctgggtgtggtggctcaagcctgtaatcccagcactttgggaggccgagatgggcggatcacctgaggtcaggagttcgagaccagcctggacaacatggcgaaaccctgtctctactaaaaatacaaaaattagccaggcgtggtagtgggtgcctgtaatcccatctacttgggaggcggaggcaggagaatcgcttgaacctgggaggcagaggtcgcagtgagctgagatcacgccactgcactccagcctgggcaagagacttagactctgtctcaaataaataactaaatacataaataaaaataaaatgtagtttttgtagtttagataagtacaaaatcagaaagcgaacacttatgttgagcagactagtcatttaaagaaacatgtattcctcttctgaagtatcgcaaagctgtatatatggctacaaaagcagaaaaataatagttttagcccttaaggaacttataggctggtgggcaaatcaggtaagaattcagttgtattagaagaaagataaaagtaaaatgcattagataaacagaggagttatttgcagcaccttagagatcaacaataactttatgaagaaaagtaggttatggttgggtcttaaaagtagtatttcaaacaagagagaactgtgtcgtggacaaaggggagggtggtaagcagagtatgttgaggataggggttgagaaaaggtgtgataaaaagaattatcaagtggtgacagttgcacaacattgtggatatactactaaatgtcactagtggtaaatggtatcaatgcatattttaccacaacttaaaaatgatcaaaataacagagttactattaaaaacatttgcacataagttaacatttggatcttctaagcataccgcacatacatatactaatgccaccatttatagatgagtaaatttagtctctgggaggcccaaaaatttgcccaagattcagtggctagtaactctaacttagatcttcttagaatgtaacttagatcttcagtctctgcatgctttcctgtgacatccactgctaaatgtggccagctttaaatgccatgttaaagagactgagcccttaaaggactttgaacagtggagtgtcttgaacacagcttcacttcagcaagatttacaggcattatatgtaaatcacatcagtaaatatgaactgttataaatgctgcaaaggaaaaagtacagggtgccatctgagagtataccagggtacctgatccagcctctggggttcagggatggcctttctgaagaggtaacatttaaaggataatgtaaagaaaaaatttttttaaattagtacctgaagatctggctggcctcactatatagcttcctctcctgcctctttcttccctcagaacgaccaagctcttgctcacctctgggatttcaaaaggctactttattttctctattagaaacacccattctcctattctttccagggatacaatcctattcatcctgtaaatctcatcttaaatgttaactcttcagaaaggccatccctgaatcctagaggctggatcaggtaccccggtatactctcagatggcaccctgtacttttcctttgcagcatttacagcagtgtaaatctactggtgtgatttacatataatgcctgtaaatcttgctgaaatgaagctatgttcaagacaactccactgttcaaagtcctttaagggctcagtctctttaacatggcatttaaagctggccacatttagcagtggatgtcacaggagagcatgaggagcatacgctctaagaagattgaagagttactagctgttggatcttgggcaagttttagggcctttaagtttaaaaggaagccaccaacctgggatttaaagagggaaatgacaccagatttgtattttggaaactcgttacataattgatcattctgactgctgctctgcggagactggattggacacaaacaagaagtagagagatcaatgggaagctgttgcatactccaggcaagaaacagcgatgacttaagacaaatgatggcaatggggatggagagaggtgacagatacataatgtatgctgagtacttgtacaggtaaggattagagttaattaattgttggagcctctctgagggctgagatccttgttagatagaccaggtgaaatgcctcaagagcagagagccagtcaattttattccagacaatatccagctaactgctatacacaatagacatttgtgcaagtttctggatgatgatcatggtagtgaacctaaaagtcacccagagttagactctgaaccttatgctcaggagaaagtgcctgacttgaactgcaatgggatcccaataggagtcattaaaggcctggaaaagtggtgccattaggagaaaaagaaatgatttcttgagcttgctctcagttctcttttaggctgtcttgtactcagcagaatagtgagatcttcaaaggttggggtttgatagtgccttgaataatttttaactttatattgccagcggaagaagcattctctttttagatttaaaaaatgtagatacaaatattaggggttttatttttagtgaaacatttcaaacatacaggaatagataattatgtaatgaacactcgtatgtccaccatctggctttgtaaaatcttaaaattatgtcttatgtgctcaattgttttatttcataaaagatactgataaacatagctgaagtcacttgtataccattcaccttcttccctgtagattactatgaactcggtctttttattctcatacatattttttgtatttttgcagtatatttatgtgttcataaacaatatgtaattttacaatatgtaacacactagtaacatactaatttaaaacttgtttttagtttacaatatgttgtaaactattgtaagctaaagacatattgtacaacctattgtaaaataaaaacaggttttagttttaaattaggtatgttactgggatcattctgcaacttgtttattcctctccagctttgattttgtggttttattatcttaacctacacttttaattaatccattttatttgttacatggtattctattatatcataaaaacttatctattctgttggtttttgttgttggtcatttgagaccatgtcttcgctctgtcacccaggctggagtacagtggcgtgatcttggctcactgtgacctctgcctcccggattcaagtggttttggtgcctcagcctcctgagtagctgggattataggcgtgtgccaccatgcccagctaatttttgtatttttaatagagacgggatttcaccatgttggccaggctggtcttgaactgacctcaagtgatctgctcacctcagctgcacaaagtgctgggattacaggtgttagccaccataccctgcctctattctcttgttaagaggcatttagcatggttatacagtctcttgccctcataaacagtgctggaagaaacacatgtttcttgtgtatatgaatgaaaatttgttttatacattagatatttccaaattgttctcttaagtacttcagtttacatcattactctcctcctccctcccctcccacccccacccacaacagtattcctctttttccatatccttgctaatgtttctaaagttttgctttttacatttgggtcttagatccactagaatgtatttttgcattgggatgaagttgaaacctaatatattttccaaatgagtaaactgttgtcacagaactatttagttgtattacctcctctcttgtatatcagatatatctacatatatgtcagactgtttctgggctgtctgtcctctttaattagttcgtgtatctgtttctgcatcagtagcatactgtcttaactactgtagctttataaagtctattgagtaggacaagtttgtttcattcttcaaaattgctttggctattcttggccctctgctgtttcatattaactttcagataaacttgtcaaattctaatgaaaactgttgataaacttgttgattaacaaattctaataaaaactgttgagatttttattggaattgcaatacatttatagattaacggagaaagatattgacaatacaattgagtttccaattcacgaacatgttatacctctccattaattcatgtcttttgaatgtatccaccaatatggttttgtaattttcttcataaaggttttacatttaaaaaattcttatttttaagtgatcttatagtttttattgctaatgtgaatgagatttttttccattatgtttctgttggttattcctgaagtggtaatgcttataattttggggtgttggtcttgtatctggcagcagatacaagaggtgctcagagttgttcagggttgctgaactcttagttctaaaagtgtctgtcatttggggtttctatgtagataatttaattatctataaaaacagttcttcattttcagttcatatatttcatatttctttaagttttaatttttatttttaaacacaattatccataaaaccctaaccctttccctagtcaacagcagtcacagccaaatgttttattaattgctatactcagtgtttcttgtatctcataccttctggggtttcttgtcttgttgaaatacaccctttaatgtttctttagtgaagacccaacagtggcactcactcacctttgtttacctgaaaatttctttattttcatcttaattcatagtctgtcttttctccagtcaaggaagtgtcttatagggaagattctggtttcactatgctgtatccagggatatatatgtatttatagatagacttttaatctgaggactaatgtattttatcctacagtattaccaatcattatttcttccataacttctagaccattccttttgtacttcttttttagagtcctattagatgagtgttgacacttttcaatctagacatcttttttaaactatattttcatactctttgtctctttaggtctgattttttaagttcaggggaatatttcattttgggtgagttgtagcactcacttccaattcactaattctaattatatttaatctacaagttattccatctataatttatttcaattaccactttttgttttcaaaatttctaattttatatctgattttgtttcatttttgttttataatttcatgttctttctagattttacatctttttatgcatactaaacatactcacttgaaagtctttgtaagattgttctataaaatgttacctgaagtgaattcatgtgctaattactgttggcagtttttctgagccattttccttgtgtcttttgaaatttctgtttgtaagcccttttaactgggaggtgttttttgcttatgtactgttctcttttcttccccttcttctccttctctgttcattactttttgtcttggagggagtctcttagcccagctcagcccaagctaataaggcccctgacttcaagtccccccttcttgcatggagcaagaagtgatcctcctgtctcagcctcccaaagtgctgggtaggcgtgagccaccacatccagcctagagcacttacattgctacatatttggagcaaacataattaaagtatgacttactgtgacccagcagtcaataacagatacgtttttgtaatagaatgttgaagggtggtaactggtggttttacttcatggagggctttaggtcggctatatgggaagctgccatcatgatgcttttgttctacacatttctgctcagcctccagagatgtctcctattctaagagtcgtctttgtttactcttgtgtctatattttacttacttaattccctcacataatagtgtatcattgtatcccatctgtgctctatcaagaaatgtagcacaagcatgatgtgaactatgaattttcgacaatttaaaaaattaaaggaatcattcaggggtaaaaagcacaaagttgtagaacagctgaagtgtgttctttttatgtatcctgtctttgccccctttctggaaacttggattggcctacttgcagtcactgtcacagttacactacttctagcctcaaaggtcattgaaaggattgggatttttgagaaccacaataacacttgctctaggtactgaaaaggttgtcctgaactcattcatatctttttatgttcatcccagtttgtttttgcttttccccccaggattttgattacacagacatcttgcaagcatatttccattctttctctcccactctgtgcctggtgcccgtaggatctgaaatagcattggaatgacagctagccttctggaacctgcagtttcaaccaaagaaactctgattccagataacccaggagtttcttatcctgcataatctaggagtttacaaaaaggctgcttatgggtactcactgctaagtacaatccactgccaagtttggaagcattacctgctctcacaacccagggaaagtagcccttagtaaaattcaggttttttcaaaccagccttaaccttacaaacagaatttatcatcatgatttttctttcaaatgcagtacagcaaactttaggatcaatgttgacatcgtattgcgtttagtcctgttaaaatactctcagtgccaaatacacacttctgccttttttctctttagagtctagaattctgtggggttccaaaaatgtatgtgcttacaaccttttatatgtaaccacctagggattaaagggctaaatgtgaaggaaagtatctttacaatattcatcttgggaagctctcattttggtgagttctattagagaaaataagacacaagctcattaaaaatatatatatattctgagcctggcatcttggtataaaattcaaaacgttttaaatctatttattagtaagactaacatagacctaagtgtgaagactaaaatattaaagcttgtaggtgatatcatggttgaatatgaccttagagtagattccttaggacagaaaaacaccaacaagagaaacaattgactaaatggacttcattaaaattaaaaatttatgttcaacaaaagacactgctaaaataaatacagaatttacagactaaaagaaaatatttgcaacatgtttatctgaaagggcttatatccagactatacaaagaattcctgtagctccataataaaaaaacagacatcccatccgcataataaaaagagcaaaagacttgaacatatactatacaaaagaagatacaggaatggtcaataaataagcaaatgaaagagtgctcgacatcactaattatcagtggagtgaagatttaaccacagggagatacgaattccagttctaggtatttttacctcaagtgaaataaaaacatttatccatgaaaaaacttgtacaagaatgttcatagcagtgctctattcataagagtgcaaaactggaaacatcccagaatagataacacattatggtatagtcatagaatatactatatttatcagcagttaagaagggaactacttatgtattcaacaacatggatgaatcttaaaaacatggttaagggccaggtgcggttggtgcatgcctgtaatccaagcactctgggaggccaaggcgggtggatcacttcaggtcaggagttcgagaccagcctggccaacatggcgaaacaccgtctctacaaaaaaatacaaaaattagccgagggtggcgcacacctgtaatctcagctattcaggaggctgagacatgggaatcgcttgaacctgaggggtagaggttgcactgagccgagattgcatcactgtactccagcctggtgacagagcgagacgctgtctcagagggaaaaaaaaaagttaaaaaggcagacagaggagtctatattgtatgattctatttatataatctagactaggcaaaatttatccatgatgatagtaatcagattgaaggatcagtggttgcttggtggaaattgactgagaagggaaatagtcatgtaagaatactggcaaatgtcctcttccccattacaaacgtctgagaaagttactagaaaacagaatccaatttgccttctcacccccaactttgtaatcttgaatccagatcctgattccacccaaccactctgctgaatggatagcagctatattagagagacaatatagtgggcctactagttttaaaaagtcatccaaagaatgtcatctacaatcagttaaattagatttttacccattactgaagtgtgattgaattagggaaagaggagaggtggtcaaaggcagccttctccagtggattccttgtcttcttgagatggttttgtgagaccttgcctggaagacctaggtggatagtttattttctaaaagtagtcaagaaagcttgttcagggcattgaacactgcagggacaagcatacttcttggaggccagccatctcctgctggatctaagcggggtggcttctgcctccacctccatctcagcttatttgagagaatcctagatccttggtgcagaagcccagccagcctgtgaagaaaagttggtctggtagtatcctgtgaatgacgtgcgggttgggtttttctaaatctcgtttacctgactcctaccttacattccagtggtgtgactaaggaactgagcaaacgtaaccctaggggactttgagacaggctttggtagtccatgtgcactagagtgaggggaaagaggccactccagagttgggtactctactgttgaaggtgagccttttgtgtccaatttttccgtgcatgtgtaagaacagttgtcatggagatttactactgacttgtgcatgaggacagcttatatctcaccttttcttattcaccctgttaaatgtcaaaatgtactaagacttaggtattttttctgtgtcaccaactactaaatcacccacccatgatagcaggtagttactgaaactcttgtagccaaacaagtgcataacactggtacacatgatgtgagagtgcagatgactccttagcttaactgtgtaagcttttaatttctgagtacttttaggattgagaagtggaagacattcttgctctaggtatctcatgcttctgcacacccagaaggctggttgcgcccccaccccaccccccgcccccttttttttttttttgatagggtcatgctctgttgcccaggctgaaaggctggttatcttcaccacaggtcttatgtctcaaggaccacgggtccacgtcatagtcaggaaccaggcatgtgtgggcagaaatcactaccactttcctttgttgcgggtggggaaattaagagcagagattcttggattcttaaattccttctctatgtttatgtcatctagtctgttttatgctgttttatgtaattccctgcttctggatttcttgaatttttttccccttctcacttgtcataattggctcttgcttgtgagtctattttcattcagcttggtagcagaagtcttcttcactattgtttagattcagttttcacatggttttagtaacccttcattgggtttagaatcaacttttaacccttccaccaaaagctcttatttttttaaaggcttcccagaaacatagtttctctcaatctcatcaagaaatgcttttaaatgcagaagttagaaaatggtgaataattatggctgttcctggaagtcattgtgtccttagtaattacatgttgtagtctttggttctgcttctttgacagctccaccacactgtaatttaatggaattcacttagatttaatggaattcagtcctggtagaaaactgctattgggtcacagagttggcagcaaggctgtgaaattgatgtgggaatgggggtgattatgtgctttgtgttgacagaagttagtttttgggacatcccatgtgggtttttcccaggaacataaacattttagagaattagagctagaaactttcttctgggaaagccttagaagtcagttgtgcttggcagtgagatgggacaatgtgcattcttaacaggttaaatgtgccaaactctctcttcagtactattcttttttacgtttgcttaaggtcaagttcctgctcttttgttcaaagtcttgctttgtcacccatggtggagtgcagtggcgtgatcttggctcactgcaacctctgcctcctgcgttcaagcaattcttgtgtcttagcctccctattagctagctgggattataggcttgcgccaccttgcctggctatattcaaagtctgtctttactacactgtcccaaagtaatctacatttgggtttgggtctttacagggtgagaaggactggcagaaatacgagactgctcggcggctgaaaaaatgtgtggacaagatccggaaccagtatcgagaagactggaagtccaaagagatgaaagtccggcagagagctgtagccctgtacttcatcgacaaggtgagagcatcttcccatcggcattgtctagtgttgagcttaacaaagggagtttctgctctgccccaggccctgtgccacatactgtatatcacaactcaacatacatatatttgtatgtaaaactgaatcaaaagttgcacaaaacaatgcttagccttactgtgagcagtagattctgatctttttttaactctatttcattcctttagaaagttggttataacttataaaattgtttaaataaaccatgcaggtatcaccattatatagttttaaagaccacgctctagaggagatcaatttcttggtactcacgagaagaaaaaaaagttcatgtttttcccccagtcttgtattttaacataagttctgaattgtctcaaaattcacactagctttttgagtttgattgcccagagtagcagcactccctcatttgctgccttatttaattttttttttccttttctccatccctatttcagaggacagaatagaaagaaaaggagcatgaatatttaacatccctatagatttcatagtgagtgggggaggaagtaacactgcagaatccagagttcccaggccatgctgactgatgctgtggcttcaaacagaattgggaggcttctgttttggatgcctagaaattgcataagggtcaaaaggctgggcgcagtggctcacgcctgtaatcccagcactttgggaggccaaggcaggtggaacacgaggtcaagagaccatcctggccaatgtggtgaaaccccatctctactaaaaatacaaaaaaaaaaaaaaaaataaaaattggcgtggtggcgggcgcctgtagtcccagctacttcggaggctgaggcaggagaatggcatgaacccgggagacggagcttgcagtgagccaaaattgcgccattgcactctagcctggcgacagagcgagactgtctcaaaaaaaaaaaaaaaaaaaacacagaacgaaattgtgtaaggatcatgtctcttccattcatgctcatcttttctttctttcctgggcagcttgctctgagagcaggcaatgaaaaggaggaaggagaaacagcggacactgtgggctgctgctcacttcgtgtggagcacatcaatctacacccagagttggatggtcaggaatatgtggtagagtttgacttcctcgggaaggactccatcagatactataacaaggtccctgttgagaaacgagtaagttaatgtacctgtactgtctgacttgttttccattattcaacaagcatgggttgactgcttttttgtgtgctttgcactttgctgggcaccagcaaaagtgacttgagacaggcaacatggcacatgcctgtagacccagctattcagaaggctgagacaggaggatcactggagaccaaaagtttgaggctgtagtgtgctgtgatcacacctgtgaatagccactgtactccagcctgggcaaaatagtgagaccttgcctctcatattaaaataaataaaaataaatgacttgaaagaggggagaggtattatttgatatcttgtgtacctccttttagtcactgttccgccctgtgctaccttcctggtaaggagtggccttctcctatagcagtattcaatggagcatgctgtagaataggcccttagagcaaactcagcatatgatttaactatatcttagtatcccctggtcatgtggtacatttgtcacttttcatctttgctcagcctttctccaactcctgactgagtgaaaggttaatgttagtccccagatctctgagcccatcactgaagagggtactatagctctgtagtcccaacctaatcttttccatagtattgggcttgaaccagagacttacagtgtgcaggatcctaataatccagcccaccagcagtcctcttcttataaagacacctcttctcataaggacaccataatcagtaatcaggttttgctggctgtggaagtactctggacagattagataacagtatgtatcaatgtaaatttttgaagctgatactgtgtaaatgtaagggaatatctatttttagaacatacacactgaaatgtttaggaccatattataagtaagtacttataaatgtactttaggaccatattataagtaagtacttataaatgtactttaggaccatattataagtaagtgcttataaatggctcagaacaaacaattatgtatatatatctgtaaatatacacatggagagagtgagcatacatgcacactgtgcaaatgatgaatggggtaaaatgttaacagtgaatctcggtgacggatgtatgcgtgttccttgtgcctttttctttgcaagtttctttaagtttggggttatttctaaagttaggatttttttcaagagtaataattaggattcacttatatcttttaggtttttaagaacctacaactatttatggagaacaagcagccc

SEQ ID NO: 1197 - DNA, 3740 bp, Homo sapiens
caaatgcgaacttaggctgttacacaactgctggggtctgttctcgccgcccgcccggcagtcaggcagcgtcgccgccgtggtagcagcctcagccgtttctggagtctcgggcccacagtcaccgccgcttacctgcgcctcctcgagcctccggagtccccgtcccgcccgcacaaggccggtcgccgtctgcgtctcccccacgccgcctcgcctgccgccgcgctcgtccctccgggccgacatgagtggggaccacctccacaacgattcccagatcgaagcggatttccgattgaatgattctcataaacacaaagataaacacaaagatcgagaacaccggcacaaagaacacaagaaggagaaggaccgggaaaagtccaagcatagcaacagtgaacataaagattctgaaaagaaacacaaagagaaggagaagaccaaacacaaagatggaagctcagaaaagcataaagacaaacataaagacagagacaaggaaaaacgaaaagaggaaaaggttcgagcctctggggatgcaaaaataaagaaggagaaggaaaatggcttctctagtccaccacaaattaaagatgaacctgaagatgatggctattttgttcctcctaaagaggatataaagccattaaagagacctcgagatgaggatgatgctgattataaacctaagaaaattaaaacagaagataccaagaaggagaagaaaagaaaactagaagaagaagaggatggtaaattgaaaaaacccaagaataaagataaagataaaaaagttcctgagccagataacaagaaaaagaagccgaagaaagaagaggaacagaagtggaaatggtgggaagaagagcgctatcctgaaggcatcaagtggaaattcctagaacataaaggtccagtatttgccccaccatatgagcctcttccagagaatgtcaagttttattatgatggtaaagtcatgaagctgagccccaaagcagaggaagtagctacgttctttgcaaaaatgctcgaccatgaatatactaccaaggaaatatttaggaaaaatttctttaaagactggagaaaggaaatgactaatgaagagaagaatattatcaccaacctaagcaaatgtgattttacccagatgagccagtatttcaaagcccagacggaagctcggaaacagatgagcaaggaagagaaactgaaaatcaaagaggagaatgaaaaattactgaaagaatatggattctgtattatggataaccacaaagagaggattgctaacttcaagatagagcctcctggacttttccgtggccgcggcaaccaccccaagatgggcatgctgaagagacgaatcatgcccgaggatataatcatcaactgtagcaaagatgccaaggttccttctcctcctccaggacataagtggaaagaagtccggcatgataacaaggttacttggctggtttcctggacagagaacatccaaggttccattaaatacatcatgcttaaccctagttcacgaatcaagggtgagaaggactggcagaaatacgagactgctcggcggctgaaaaaatgtgtggacaagatccggaaccagtatcgagaagactggaagtccaaagagatgaaagtccggcagagagctgtagccctgtacttcatcgacaagcttgctctgagagcaggcaatgaaaaggaggaaggagaaacagcggacactgtgggctgctgctcacttcgtgtggagcacatcaatctacacccagagttggatggtcaggaatatgtggtagagtttgacttcctcgggaaggactccatcagatactataacaaggtccctgttgagaaacgagtttttaagaacctacaactatttatggagaacaagcagcccgaggatgatctttttgatagactcaatactggtattctgaataagcatcttcaggatctcatggagggcttgacagccaaggtattccgtacatacaatgcctccatcacgctacagcagcagctaaaagaactgacagccccggatgagaacatcccagcgaagatcctttcttataaccgtgccaatcgagctgttgcaattctttgtaaccatcagagggcaccaccaaaaacttttgagaagtctatgatgaacttgcaaactaagattgatgccaagaaggaacagctagcagatgcccggagagacctgaaaagtgctaaggctgatgccaaggtcatgaaggatgcaaagacgaagaaggtagtagagtcaaagaagaaggctgttcagagactggaggaacagttgatgaagctggaagttcaagccacagaccgagaggaaaataaacagattgccctgggaacctccaaactcaattatctggaccctaggatcacagtggcttggtgcaagaagtggggtgtcccaattgagaagatttacaacaaaacccagcgggagaagtttgcctgggccattgacatggctgatgaagactatgagttttagccagtctcaagaggcagagttctgtgaagaggaacagtgtggtttgggaaagatggataaactgagcctcacttgccctcgtgcctgggggagagaggcagcaagtcttaacaaaccaacatctttgcgaaaagataaacctggagatattataagggagagctgagccagttgtcctatggacaacttatttaaaaatatttcagatatcaaaattctagctgtatgatttgttttgaattttgtttttattttcaagagggcaagtggatgggaatttgtcagcgttctaccaggcaaattcactgtttcactgaaatgtttggattctcttagctactgtatgcaaagtccgattatattggtgcgtttttacagttagggttttgcaataacttctatattttaatagaaataaattcctaaactcccttccctctctcccatttcaggaatttaaaattaagtagaacaaaaaacccagcgcacctgttagagtcgtcactctctattgtcatggggatcaattttcattaaacttgaagcagtcgtggctttggcagtgttttggttcagacacctgttcacagaaaaagcatgatgggaaaatatttcctgacttgagtgttcctttttaaatgtgaattttatttctttttaattattttaaaatatttaaacctttttcttgatcttaaagatcgtgtagattggggttggggagggatgaagggcgagtgaatctaaggataatgaaataatcagtgactgaaaccattttcccatcatcctttgttctgagcattcgctgtaccctttaagatatccatctttttctttttaaccctaatctttcacttgaaagattttattgtataaaaagtttcacaggtcaataaacttagaggaaaatgagtatttggtccaaaaaaaggaaaaataatcaagattttagggcttttattttttcttttgtaattgtgtaaaaaatggaaaaaaacataaaaagcagaattttaatgtgaagacattttttgctataatcattagttttagaggcattgttagtttagtgtgtgtgcagagtccatttcccacatctttcctcaagtatcttctatttttatcatgaattcccttttaatcaactgtaggttatttaaaaataaattccatcaacttaatggaaacttaa

SEQ ID NO: 1198 - DNA, 2298 bp, Homo sapiens
atgagtggggaccacctccacaacgattcccagatcgaagcggatttccgattgaatgattctcataaacacaaagataaacacaaagatcgagaacaccggcacaaagaacacaagaaggagaaggaccgggaaaagtccaagcatagcaacagtgaacataaagattctgaaaagaaacacaaagagaaggagaagaccaaacacaaagatggaagctcagaaaagcataaagacaaacataaagacagagacaaggaaaaacgaaaagaggaaaaggttcgagcctctggggatgcaaaaataaagaaggagaaggaaaatggcttctctagtccaccacaaattaaagatgaacctgaagatgatggctattttgttcctcctaaagaggatataaagccattaaagagacctcgagatgaggatgatgctgattataaacctaagaaaattaaaacagaagataccaagaaggagaagaaaagaaaactagaagaagaagaggatggtaaattgaaaaaacccaagaataaagataaagataaaaaagttcctgagccagataacaagaaaaagaagccgaagaaagaagaggaacagaagtggaaatggtgggaagaagagcgctatcctgaaggcatcaagtggaaattcctagaacataaaggtccagtatttgccccaccatatgagcctcttccagagaatgtcaagttttattatgatggtaaagtcatgaagctgagccccaaagcagaggaagtagctacgttctttgcaaaaatgctcgaccatgaatatactaccaaggaaatatttaggaaaaatttctttaaagactggagaaaggaaatgactaatgaagagaagaatattatcaccaacctaagcaaatgtgattttacccagatgagccagtatttcaaagcccagacggaagctcggaaacagatgagcaaggaagagaaactgaaaatcaaagaggagaatgaaaaattactgaaagaatatggattctgtattatggataaccacaaagagaggattgctaacttcaagatagagcctcctggacttttccgtggccgcggcaaccaccccaagatgggcatgctgaagagacgaatcatgcccgaggatataatcatcaactgtagcaaagatgccaaggttccttctcctcctccaggacataagtggaaagaagtccggcatgataacaaggttacttggctggtttcctggacagagaacatccaaggttccattaaatacatcatgcttaaccctagttcacgaatcaagggtgagaaggactggcagaaatacgagactgctcggcggctgaaaaaatgtgtggacaagatccggaaccagtatcgagaagactggaagtccaaagagatgaaagtccggcagagagctgtagccctgtacttcatcgacaagcttgctctgagagcaggcaatgaaaaggaggaaggagaaacagcggacactgtgggctgctgctcacttcgtgtggagcacatcaatctacacccagagttggatggtcaggaatatgtggtagagtttgacttcctcgggaaggactccatcagatactataacaaggtccctgttgagaaacgagtttttaagaacctacaactatttatggagaacaagcagcccgaggatgatctttttgatagactcaatactggtattctgaataagcatcttcaggatctcatggagggcttgacagccaaggtattccgtacatacaatgcctccatcacgctacagcagcagctaaaagaactgacagccccggatgagaacatcccagcgaagatcctttcttataaccgtgccaatcgagctgttgcaattctttgtaaccatcagagggcaccaccaaaaacttttgagaagtctatgatgaacttgcaaactaagattgatgccaagaaggaacagctagcagatgcccggagagacctgaaaagtgctaaggctgatgccaaggtcatgaaggatgcaaagacgaagaaggtagtagagtcaaagaagaaggctgttcagagactggaggaacagttgatgaagctggaagttcaagccacagaccgagaggaaaataaacagattgccctgggaacctccaaactcaattatctggaccctaggatcacagtggcttggtgcaagaagtggggtgtcccaattgagaagatttacaacaaaacccagcgggagaagtttgcctgggccattgacatggctgatgaagactatgagttttag

SEQ ID NO: 1199 - DNA, 60327 bp, Mus musculus
  misc_feature (1949)..(1968): "n" at positions 1949 thru 1968 can be any base
  misc_feature (8743)..(8762): "n" at positions 8743 thru 8762 can be any base
  misc_feature (14521)..(14618): "n" at positions 14521 thru 14618 can be any base
  misc_feature (18936)..(18955): "n" at positions 18936 thru 18955 can be any base
  misc_feature (25819)..(26117): "n" at positions 25819 thru 26117 can be any base
  misc_feature (38774)..(39110): "n" at positions 38774 thru 39110 can be any base
  misc_feature (48067)..(48086): "n" at positions 49067 thru 48086 can be any base
gagagagatcagttctttgtctcaagcagacctttggcttactggattaggcttgtccacacacttgagagtggtggtctcttcattcaaagtctgtcaattcaaatgttaatctcatccccaaacatccacacacagaagcaagctgagtcacatctgctcacacatctgcccctggcgggcctgttaacaccgtctggggggaagatggcactggcttcaactgaaggaagagaaatctgcatccttgtaagcaggctgcagtgtttgattttggacttctaggttggggatagagtgtctctgatgagcatgtctctaaacatctgtcagcattgataccctcaatttccctagaggtttctggccgtttttgtctcagaagccctaaggtctgggtggataagtgatgactgtcatttgaatcaggacacttgccctaaaaacccaccttcctgagtgtctgttgagtaccatcgcactgagtgtcagatacaagaatgcgtaaccaccaaggactcaatagaccggtccatccttctccaggccccgtgatagtcagtttgactcaagacagatctgagttggataacatatcttccacttgtatcgactccttgccttctgcattctcacatatatcctttctaagccaggtattaagaaattaaaaactcaaaaaacaagtccagtgctagtcagctttcctttgttcctgtgacttgatgcctgagagaaacaggctaaaagagaaaggcttgtttggcaggtggtttgactctaccttgttcctgggcctgcggttacctcagaaggcgctcacctctttgtggccaggaaacaaaaaagagaagacaaaaggaactgtcacaaaacacttcttttaatggcccactcctagtaacctacacactccaactagactccacaccaacaagtttctcccaccttcaggcaataccttaaacttctaaggaataagagagttaatctggataagaggtcaggacccctacaatccaatcacctcctcaaagctcttggccctccaagatcagaaaacaaaagaaaagtagacaatttttatagagtcaatttaaggaaccctgtaggctgagagctaaggacaacatccacaaaatcacacagaggatgaactacacagcacaggatgctcgcgggcagttggtcttatctcggggtcacttgctggttctgctgttttctggctgaatgcgcttgggtagaacactttgtctttgccgatcccacatcagtcttcagaagagagctacttgatctctgatgctaaggtggagatttaaatgtctttgtttgtaaaacaatcacatgctgctctcagcccagagaaaggaggaagtcccatcaaacttcttctccacaccctagatctttagaatcaggtagtgtcttagtcagggtttctattcctgcacaaacatcatgaccaagaagcaagttggggaggaaagggtttattcggcttacacttccatactgctgttcatcaccaaggaagtcaggactggaactcaagcaggtcagaaagcaggagccgatgcagaggccatggagggatgttctttactggcttgcctcctctggcttgctcagcctgctctcttatagaacccaagactaccagcccagagatggtcccacccataaggggcctttcccccttgatcactaattgagaaaatgccttagagttggatctcatggaggcatttcctcaactgaagctcctttctctgtgataaccccagctgtgtcaagttgacacagaactagccagtacaggtaggttgataacttgcttgtaaagacaacagagcacattgaggcatactgggacatcctaagagtctgctatatctgcatcccaagcaagagttgctaagattacatttgcaaatttggagaannnnnnnnnnnnnnnnnnnnccacccccacccctagtacacatcaagtcccttcagacaagatgcatcctcccccactgaggtcagacaaagcagtccatttaggagcacaggatccataggcaggctggctggtaggcaggcaacagactaagagacaacctctactgtttttggggaaccagcatgaagaccaagaccatctgctacatatgtgcagagggcctaggtcaagtcagtggtcacactctgattggtgatcagtctctgggagctcgtaagggtccatgttagttgactctgttggtcttcctgtagagtccctgtccttttcaggtctctcggttcttcccccaacttcccccaagctccatctattgtttggctgtgggtctctacatctctttcatctctttttggctgctaggtagatcctctcagaggacagttatgccaggttcctatctgcaagcataactgagtatcattagtagtgtcagggactggttcttacccatggcctggatctcaatttgagacagtcattggttgggtattccttcagtctctgctctatctttgtcactgcatatcttgtagacaggacacattttgggtcaaaggttttgtgggtgggttgctgtccttctccctccactgagagtcttgtctagctacaggaagtggccactttaggatccatgttccccactgctaggagtttcagttagagtcagccccatagaccttctggagcctctccccatcccaggtctctggtatgtcctagagattgtgtccccctccccccacccttccttctccctctcctttgctccacttcctgttcgctcatttgtgtatttatggttaactatgtgagctctccactttctgttcctgctaagcctgtggcttgcttccatgcctctctgttcaccacggtggacttttatccctttggaactataaacccaaatgaactccactcttctgtaagttccctccgtcatgctgttggatcatagcagaaccaagagggctacatttctttctttactgtgtgtgtacacatgttcacatatgggtatactcattcctgagggatgtgtggaggtcaggagtgaacacttgggttattattatttttaaaatatgtgtatgggtggtgtgtgtgtgtgtctgtgtgtgtgtgtgtatgtatgtatgtatgtatggcatgcctggaaacaatgaagcccagaggagggcagtggattcccctgggactgaagttaggatggttgtaagccacactgtgggtcctgggaatcaaatccaggttctctggaagagcagccagagttcttcctctttggtctctgggatgccatcttaaatcctttctctaccttactttttggggtagggtctctcactatctctccagctcactgcttcagttagacacactaggaagtaagcctctggattggccagtgttcctccttcagcttacacagtaagtgctttcacccactgagccatttcctcagctctcaattacgattcttaatttttttttttaaaaagaatatgtgtgtctttgtgggagtatgcgcatgtgagtaaaggtggtcttggaggtcagaagaaggtacctcagcatctggaactgccactaaatttggtcatgagctaatgaaagtaaataaaacttgagacatgtgattcatgtaatttatgtcaaatagcccaaagagttgtttgtgagctttaaaacctggggctgaaaacatagcagaacaggccaggacatgcccgggcaggcccgttgttacatgtcctgactggcctagtgcctccctatctcctgcccttctgacagtctgttgatgtttaaatggaccaatcatgtgaaaccgagccaattcctcccccagccccaccccttttctataaaatcccctagcttccaaggctcgtggtcgaaaccactgtctcctgcgtgagatacgtttcgagccagagctccgccattatggctccaccatgtggtcgacacctctgtctcctgcgggagatatgtgtcagcccggagctccgtcattaaactacctcatgcttttacatcaagatggtcgtctgttcgtgattcttgggtgcatgccgaacggaaattgagtgggggtttccccactaggttctttcactaccacgtgtaggtgctagggacagaactcaggccctctgcaagaacagcaagcatactgtagcaactgagccattgcttcagttccctcatctatgttttatgtaaaccttatacatataaccttaaagatttatttatatatgagtacattcttcctgtcttcagacacaccagaagagggaatcagattccattacagatggttgtgagccaacatgtagttgctgggaattgaactcaggacctctggaagagcagtcagtgagtgcttttaaccgccaagccatctctatttttttaatactttttattagatattttcctcatttacatttccaatgctatctcaaaagtcccccataccctccttcccactcctctacccacccactcccactttttggccctggcgttcccctgtactggggcatataaagtttgcaagtccaatgggcctctctttccagtgatggccgactgggccatcttttgatacatgtgcagctagagtcaagggctccggggtactggttagttcatgatgttgttctacctatagggttgcagattcctttagctccttgggtactttctctagctcctccattgggggccctgtgatccatccaatagctgactgtgagcatccacttctgtgtttgctaggccctggcctagtctcacaagagagagctctatctgggtcctttcagcaaaatcttgctagtatatgacatggtgtcagcgtttggaagctgattatgggatggaaccctggatatggcaggctctagatggtccatcctttcgtcacagctccaaactttgcctctgtaactccttctatgggtgttttgttcccaattctaaggaggggcaaagtggtctttgttcttcttgagtttcatgcgtttagcaaattgtatcttatatcttgggtatcctaagtttctgggctaatatccacttatcagtgagtacatatcacgtgagttcttttgtgattgggttacctcactcaggatgataccctccaggtccatccatttgcctaggaatttcataaactcattgtttttaatagctgagtagtactccattgtgtaaatgtaccacattttctgtatccattcctctgttgaggggcatctgggttctttccagcttctggctattataaataaggctactatgaacatagtggagcatgtgtccttcttaccggttagaacatcttctggatatatgcccaggagccatctctatttttaacatacctgcatttagagatttccattggtaacatgatattggtgctcaaaatgcgttgaatttggaagcattttgcatttccagattgagaatgttcaacgcctgtttagacctgaagtcctgggatggttagcaatgtcacacagtgcttgtttcccttccagtaccctacctcagtaagatcacctgcagctccgagccagaccttggcagtgacttctaaggttgaaactcagtggttcggcttgttgggggggcaggaggaatgtggacagcgtttagtgtggcaacacatcgtactcattagaagccatcagttcactatgaactggctcatacgttaggcattatcaagaccgttgggcctaccagaatgctcttctgacaaagagcagcagatatttgtgacatcacaaggcagtggcagtccacggggcaggagcaaagacagcttcagagaaagggtcttgctgcctaagtgaagacaaggggactgggcctcacctgtccagccagtcacctctgtgcggccaatggaggtcaggcttgagttttgaagagatgtctgggccaagtcctgtatcaaacatggtttgggcttatgctatctttatctctgggcctctaattgatctcaaagatacacagacaatacagatggagctgtcaggctctctctcttatgacaaaagatggctttgtggtctcttgagtaaaacatgcccctggcccccatctgtagatctatatacctgtgagggagtaagggtgtggtcatatacagctggtctccactcccagtcacaaggccccacttccttctagttcatcttgtcagatagcctagagggcctctgaaatcctagtagagtggttatcttcaacatccaagtggcttcagatgaaagcagccgtggcaggttccagaatggtgtcatccagcaaaaatggagtaaataaatcatcttaggcgctctcctagtcacatgtgaactaaaagatgagtgaaattgattttaatgacatgctatgaaacctagtatatcaaaaaacataagcaacacagacataatatcctttatgtgtttcacaggttttcaaaatccaatgtgtgttctagacttgatgtgtcttggttccaaccaatcacatttcaggtgttcaaagtcacatgtaaatggccaccattctacactacaaatgtttgctccttacaggtagtagtgaagataaacactcctgcctctagggctacaacttactcctaatgacagagtgcaagatctgacgactaattcagtctcagcagttaaaaacagaacttcacttcccagagttcttgagtctgaggagacagattaaggcctctggtgagggcctagcctctgcttccaagatgcactgtcaccgtgtaactgggaagaaatgaacacgacatatacacagggcagagaggacacaataattcccttcccagttccatctgcaaaggccctgccctcatggcattaccacctcagacaagtgtctatcccttaatactatcacactgaggactgaagttcaacatgcgagtggaccttcgtggcctctttctccaggggctgctcctagcccaggtctaggctggcgagggttgtgaagtatttcccaggcgtactcctgggacttcatctcctacttcctcctttctattccccagtgccttccctatttgctgattgaatgccaccttacctggggatttaactttgccaaactccctttccctaaccgaatccgggaatctatcttggccttcagggctattgaagacctcaccattctgccaccaagcacctgacttaacctcttgaacatgccctgtatcagtctgttttctgtctctgatcttggccacaattagctttgtccttcagctctaacacacagcacaaggatctggtagaaactctatgctcctttcagtagcaacaaagtcacagaccagcataagtgcactacgtggcccaagggcagtaaagaggctttactctttctctgggacaaaaactaaacagcaaggtgttcctgggtatccgattgtgttcatggccctttgctgactgactgatcccatacatttaaacttaagggctaagttttagaaagtatttttacattatgactccaaattagtaattgaaatcacctcccttggcacaaaagcatcctggagtagtgagtggaaaaacctacctggaatctgacttctttgagtatagctactcaaactgctgcctaatttaaaaagcctccggatctttagcatatgttaatggctggtaattaccatgcatatgttaatgacatggaaattactcaatgcttcgggtttgattgatgagtaattttgtcagttttcccaatttttcagcctggatgacagacttttagttaacagaattactataacttattagtctgaaactataataatcatctcattaaatgagttacatttctttctcacattgccggcatcaggctttgtgaatcacaatttacaggttgtcagtacctttagacagaggctcctccagcctaaagcaaacacaaccttcccaaagccttcggtcaatagagaacctcgctctactataccccaaccacttccacaagcatcttttcatctttttcggagcaaggacgggagtttgctgtttacaaatgtacacagtgatgaacacagcaaatgtggctggacagacaagcatcagacctaatacctagaactcaaaccgtaaatgggaaccccagcatacatacatccagtaaatattcagggatatagataacctacaaaagtgctctgggaaattcttttctgggttccacggaaaatgcgcacagcctacctcctccactagcctgatcctgctaatcctcaaagatctaaggaccaaagggtgcgacctggacactcgtgtgcagacattcgggtgtgggtgctgtgtatttgggtgtgtagacagaatggggctaaagaaaatccttttccaaccccagtgtgcacttgtgtagaagtgctcaactcaagggagatcatgctgaatcgacagagctagtcagcgaaggtgatgatggttggacaccttatgatcctagatcaacagcaatggtgaatgtctggggcctaaagcaaacgcctcccatcattaaggacatctgaacctgccacggagctgataatgttttattccacttcaattacttcacattttggtcttcctctctgagggggtagggaggtataaaaagctctattgctttaggattctttaacgcaannnnnnnnnnnnnnnnnnnntttctggcaaggtcgctagcaggcttgctcagcttcccacttctcttcaccggtgacataccccgaccagtagtgacccctctgatggacaaagttcggggaatcgggagagctggcgtgggcccttccatgctcctcaagcgccgctcattctggctgttcaacccgagctctggctccttcccgccggcgcttgctgttccaggctggcgctccttggctcgccgagggccctgcgccactgagggccgggggcggcccagcaccggggggcggatggactgcgggctccaaaacatcgcacagggggaggtggccgcgggagaagcggggaccgcgttgggaggaggtcggtgcctgggctgcggggcttgtggggcgttcggagggcccggccacgcccagctctgcgggacggcgcccacgctgcccttcaacaccggcccccagtggctgctctcacagagccaggcgtcctcctccgagtagctctccggagtgccgccttcgggatcggagtcgggctcctgagaacaggttggggacggcggaggagtgacagggtcacggaagtaggggaacaagagcacggcgcgcagccgccgcgcgggagagcagtagggcagccggaggggcagcgacatctgcgggccgggccaagcggggctgcggggaggccggccctgtgcacgctcacgtcccgcgcggcgcagccacagccatggagggacccggcttcgagtcgtctccggcctggggaaagttggatggacactccacctggagtcaaaaggcggaatggagaccccgcgaggctgatgtcctcaacagggggcgggggagggtcagaagaaccagtttcagccggagcgaccagagcaagccattgacacttcagtcccaggaagggttaaccgcgtcctgctgcctaggtttacatgtaaatagagagccgctgctccaagcgggcccgggctagcacttttaagtttttgattggttgccaatgacatcaccacccgcgcgttctaacacaccaaacccactagcgggtccgagccggcctccctcccaaggcgaggcctcgcccctttctccgccctcctcggcttcttattggtcagagaccactgtgatgtagcgggcggcagcctctgggtcttcattggcgtatcgcgccgtcgctcggaggcaaccccgccccctccaaagcttacatttacgctgtagcaaaagagaaagtaactctgtgttgctgctggggatcaatgaagctgagtgaatgggggcgcactgcgcgagcgcatagctggagcgggcgccagatggtagagggctacgcttattgatgaagtaagtggaagacatcacgggtcactcagagccggagggtggagggttccgtgtgtgtgtgtgtgtgtatgtgtgtgtgtgtgtgtgtgtgtgtgtgtgtgtgtgtgtgagtgagagagagagagacagagagacagagagagagagagacagagacagtgtcagagagacagagacggacctacgtcaggtaaggaagatcctaaggtttagtcttttggctctgcttgccctgggatgaagaggggaaatgagttttggtttggttaagatgctttatggcagttttcaaagcccaaggctttgctcatgatgctcagtggtggcacggaatagggatgctacgtgccccaggagtggggaaggagcattctttaagcacttggtttttcttcagtccctgttagtggtggaaggaagattagcgagaaagggggtagggggttcgtgctatttttgtgggaggtttcccgggccagactggctttggagctatctgctgcaaggatgcagatctcagtgcgctctgtgcccgtgtgtgagcagcagcacagtgaagaggtaccggtcccagcctgtgtctctggaaagtcgttcccgggttctcctcctagggaataggctactaatcctggatgtccccttaccaggtagcaaaatagcaaagactttgactgcattcatgttccagctgggacacagttaacagtttttggaatagtactcgctctgaaaaaaaaaatactacgcaagggagagggaaggagggagggaggggaggggaggggagggagggagggaggcaggcagaaggtttgatcctttgctcccaaccaaaggtgggtgagagaaacccgagtcagtggggatatgcctacacgggtggggacgtgctcctgggtgcgcgtgtgtggattttgctggtgacactttggctcggtctcagagaacagttacggtcatgaatagaccgatgatccttgatgtttttccagtcagctcttaaagttcgtttagatgagtggctcttgcttggggtttgatttctctagtagaggagtcagaattgctatgttatagggtggccttgtgcctaccgggaggaggaaagtgatccattgcaggcacccttggaggaggcaaaggcagcccccgtgggctctaggtctgagcttcccaattagcctaactgtggtaaagggacgagtgaggttgccctcttggaatccacactgtttccaagaagaatatcagtatagggttgaaacattttttacaaagttgccactccagtggagatgcaaagtctgtctgtatgaccagatgaaacacatgctcttttttgcttaggggcacagcatagagaagtgtaaggatgagtggggtcacagaggaacgggccatgggtcagcctggggtggggttcctagatctgactccttggaaacttggtttctggatagttattcgtagtgtaagtgtgtgtgtgtgtgtgtgtgtgtgtgtgtgtgtgtgtggtaatggcttgatttgatttggaagagtctaatgtgagctctgaataggatgacgttgagcttttcaaaggacccaccagaatggaaaggaagattagctcctagccatggaggctgacttagggagacacattccttctgatatgcagaaggttaacatccagcccccatgtaaatatagctagctgccaagcatctccgtgcatctctgtgagctccaacagtgctcttgcttgtctctttgccttggctctggggaaagaaatgaaatacagtacatgccagggtggacagatgcatccatcacaggtgaaatagacttctctgcacaggagaggaggctcagaataaatctaagagcctccctgtctgccttcactgtttttcaggcctctgtgcctttacctccactaaggctgaacttggatgcatgtctctaacattatgtgacaggaggtctcttaccgtttctaatgtcaagtctaattttaacctttgacttagcatcagaatggatggggcccctcaggtatgcatcctctctgaacagatcaaagtgaattttagcctttgatagtatcacaacctagggcacctagaaggactttgactttgctcagagatatgcagaggtcttcccccggggattggatgagactggctttgttttcatgtgactttatttttttctttcttccccttctttccagactcttgacttcttgaattgccagttttcagcctcctcatgcctccatctcctttagacgacagggtagtagtggcactatctaggcctgtccgacctcaggatctcaacctttgtttagactcaagctaccttggctctgccagcccaggtagtggtagccacgctcctgtccttgccaccgccgttgtgaccctcaaggctgcgaatctgacgtatatgccctcatccagcggctctgcccgctccctgaattgcggatgcagcagcactagctgctgcactgtggcaacctacgacaaggatcatcaggcccagactcaagccattgctgcaggcactgccaccaccgccataggaacctcgaccacctgccctgctaaccagatggtcaacaacaatgaaaacacaggctctgtgttaagtccatcgggtggggtgggcagccctgtgtcagggactcccaagcagctagccagcatcaagatcatctaccccaatgacctggcaaagaagatgaccaaatgcagcaagagtcacctgcccagccagggtcccgtcatcatcgattgcaggcctttcatggagtacaacaagagtcacatccaaggagctgtccacattaactgtgccgataagatcagccggcgaaggctgcagcagggcaagatcactgtcttagacttgatttcctgtagggaaggcaaagactctttcaagaggatcttttccaaagaaattatagtttatgatgagaataccaatgagccgagccgtgtgacaccatcccagccacttcacatagtcctcgagtccctgaagagagaaggcaaagaacccctggtattgaaaggtaatgactctcccttccctccccacccccaccccccacattccttcctcaaataatgtcctgatcagctaggtttccctatgagattctcttacaagtggcagccttcttctaaccccaaggcaccatgaaccaaaataaaatagcctgtcttcttgtctctacttcgaactttttcttactctcttggtacattaagaaagtccaagtagcaatgaattgatataagatctgagtcccagctttgatctggctgccactttgggttgcctatgacattttacttgagatggtttgcaaaaggcactttgtacaaccaagatggtatctcaagccatgccttctctggtagctctgtttcagtcctcgagtgggttggaacttttttgatctctcaaggcctgacaaatgtcgatggatcagaggaagctgcgtctacaggtgccagtactttgtgggagaaactcttgctgtttctcacctgattgtcttgatgttcttattgcttctagtcatcttcaacaaaggcatgcatctttatcttaaagcctcattgaaagtgtgaattctccaaatgcatccattcctctgaggaagctgcaggggatagagatgtgaaccgcctacaaccatccttcctggtatcacctgacaagagttagcttctgtctcttccctagaaggagtcatacatcattttcccctagtgtagaataactgatgactggacaccccccccccccaaaaaaaggaatagatgacccagtcttctctgagcttctaacatacagtgttgtcctgaccatgggcacagtccacttgctcatctttgtccttttgggctttgagcattactcttctgataatatctacctagtcatgatggagagtgataactatcttcgtttcgaattttgagccattgtgtgcatggtgggtggggtggggtggggtggagtccagaaaaaataaaggacctgggtagtcatctgtccacctcactgaaatactgactcttttctaaacattgaaacaagaagatcctggaagcagcgaagattttcctattgctttagtactgatgtcagatcactgtatggaacaatgctacttaacaatcctcattaaaaaaaaaaaaaagaagaagaagtagatggcttattactataaattattttgtattataattatgttgagtttttaatcaatatcactctttacaggccagacatcatttatagtacttaaataaccaactatttaatttatcttcccttggccccatcccttgcccccaccccacgtgaacatcgtcattatctccatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttagcctgttgcacttcccttggtcccatcttgtctttcttttcacagctgagaaaacaccatctacaaatccccacacctgtaaccaatagctttgtaggcatcttttctgcctcctgaagataggataggtttggtaaaaatcaaccccttttgtctgtgtcatctaagaagagtaagcagacaacgtagtttatgatggctctaaactcgaacacagggctgattacgatgcatagatcctatcctagctcttgctgtggagcttggtgggtagagggatggcccatcagttgctgagaaatgtctctcttgggcagtgctgaggaagaagaagggattcctgtactcttctcccataggtacatctgaggatccctgcagcctgggtttgctcatgggagtcagtgtaaagactgcctcagtggggcggggctgctgacctcaccaccaggcgccctgggcagctgcgctgagggctcatcatttcggattggttcgaccctggcggccggctgggaagacgctctggtggtagaggttgggttatttgtagttttcgggggggttgttccttcaactatcttggaatttggttgaaaatacatagttcaggagtaaaaggtctggtcgtctactttgttgtcattattaagtggtacctttgtgaggaatggcctaaaatcaggatcaagttagggaagagctaaaggagatgggacatggagtcccctgttagcctcttctctgctcagaccagaggttaatgtcagagcgcccttgaggtagagatgagaggtgcttttctctcaacaagtatggtgtgcagcttctcctaggttcttgagtggatcaagcacaccatcctgggctggcttctcttctgaggtttattttaggattcaccttgttggtgagctgagattgtatttcagctagtgggggagtggtaccattttggagtgagtgaattttgtagggagcctgtgtctgctggggtggggtgggggtagatggtttgactatatggttgtaagtccccaggccttcttggtttattttcagagatttttttttttttcccaaaagatgcctgatccgtctgaggttctggttcatgtttgtaaacaccggttgctaccctcccgttccaacttttatgtccctcagtttcaatgccacggtctccatttttggagctgcctgtcgggcccggtggcggctgggttgccattttagttaagcagtgtcaggttgggacgaaactgatcggaggcacagaagcccctgggattaagttactgttctaatttatagtccccgccccgctgtgacctaggtctgagacggtgtagtctctggcttgttcttacccactgaaggatatagagcaccaggcccttgtttctggtcaacctcctctgagtgagccacatgaatagctctttagagactcagtctttgaaaggattgtaacctttcccaaccagtgttgattgttgtgatcatctgtaacttgctctccaacctcaaggctcgacagtccttgaccttctaagacgagaggtgctgttctgttgtcacatctgtcctttttcacatcactggggtcagggaacttatttgtcctttatatatgtgggaagggcatgttttctacaactctttcttggtagccgtggcctttaaaccgttatgatcacaattttcaaagtgaacccctttattcccaaccagattaagtatatgcttcacctattggccttcccttccttgtttttgaaatattttatgtcttatgctatagtctactgtttagagttagtgttatatatttaattgagctgggagtattttacagagtggtgtagacatttttttgtttttttgcccccaagttaaacatgtagtgtcatatacctgcccaggagtgttctccaaatgtggaatgccactgttagtgactgggtcttgagtctcaggagaggcctccctccccttcctggagaccctgtttcagggcctgtctctgcctgtgcaattgttatgtcagagtccaggcctgtacttgctgcatgctctcacatgcaatggtagactgtctgctctgggtttccagagttctgctctataccagaggctttttgaaggggttgtgggggtaggggtaaggatgaaaaagacggtcagggaagtagctttgaaaggttgatgcagaggggagaagtcaggcaaaggagtgagatttacactaaaaacttccccctgatctccactgtgcattttcgtattagaaatactttctattaaaatatgcaaacatagttgaactattttcactgtaaagacggcatgaaagtaaaaatatgtaagttcatgttatatacccacccggagctcccaaaccttcctcttaattcccgaataaagagcaaatgtggtctaacagtttctcttaattaaaatagattctgaaatattcattagaaagcaataccgactctcacgacagcgaatggctacgccaggaaactagagaccctgggaaagtctcctttgtctgctttcttctgggggagtaatatatccgtctttgctttgtctgctcttgtaagacacatctacactgcaaacttattttattcttgtaactgtaattccaaatagatctgtaagaaaaagcagagaaatgtagggagaactgcagatcagcaggcctgaggacactgggtccctccattcagtgtccttgggcaggctgcctaagtttgcctaagcctttagttctctggcttcctcactggtcacaagaaggcgcagcactggtgttgcacttgggatgttcactcaggaattcaataagcggaggcttgcagagtgttcggcagagcaccctctccaccgagctcagcaatatttctgtgcattgaaatgtgtcagtcaaaaggtagtttgtcctctttgctcccaggggtacaacaacctcggtctagctgtgtgcctgcctctgtgtgtgtgtgtgtgttgctagggcctaaaaataacttgatgactgttacctaatttaagtagcatacagttgtgccaagtaattgcaaaaacatgttaggtcaaggggctgagtaatttgggcataccctagaattattcatttgtaggggagcttaggaaaatgggatgataaatctgtccagctaatgtcctggataggataacaaaagtctaaaacttttcaactttgtcttctctggcctcgcttcggatttatttttggaaggaggattgtagtctgactataaaagggtaggtggaaggaggaggggtgtgggctgctgcaaccctgagtgccagagaggagctggagtgtgagggaagaagaggagctgatgcttgctcatttgagtgggtcctgaatgctccccccgaaggactacaggcttgcctgccctccttccttcattgcaatccaagtgaaagacaaagggacttgagcccgcccctttcccatccctattcttacccctctgctcctcataggtagcttttccatgacactacagtgcatatagcccctatggctttgagatgcttcgctgcttaaacagaggggaagggcaaattggtctgaacccaggactctggatcattaccaggtcagatctatgagccaaactgggttgaaatgaactgggatcagccagctgggttgtcaaagatgagttcaggaaactcttgacagtgtggtgggtagtagtcacggattgcaaaccgagaaactgacaggaaagcagtcctcctcgttacatttctaaagcacatttctccaggaggcatgagtcgggagaagggtgactgggtgtttccccgcttagtctgtttgtgccaacccatcaggtggtctgatgagatcacgagggcagaagaggttcctgggcggaggcctctgtagcaggccgtgtttctctatatcttgttggctgtgatcagcagttatctccattctccaagattcctggagagcagtttgagtgtaaattagggccacacgacagtgcttaggcaactttatccactttggtaccaaataactaactacacacttaacgatattctgtttgttttgagatgggggtgactgtggagttcaggccagcctggaacttgtaacggtcatctttcctctgctgccaaattatggccaagtgctactacgtccagcttaaggatagaaattctgatcctcagagcggtcttctaatcaattctggaaggctgttgattctatgctgtcactagtggatgattgacactctctggnnnnnnnnnnnnnnnnnnnnccaaaagattttgattcatttggtctaaggtacaacctgcacacatgccaagattttgaaaagctccccaaatgattctcctgcacagtgaaattggaaaaccattgatctagttcgagctcgttatgcagttatggaaatgaggcctggagaggtttatgactaatccaaggtcacacgcgtgattaatttcagagccttggtcctttgtgctaaaataggtcttgttagggctatagactgatgtatgtgtggtacattattacctcagagcctcccatgtatagtgtaagacatgaaataaaataatacacgtagtcattttgaatactagtacctttttggttttcaggtttctattcagaacaacaacaataaaatagacttaagtcaaaggattttggaaagccgtccctgatggtcgagattttacctaggtcctggaatatgggccaactattagcatcgatttaatcccattttcttaggaacctaatattttaagggagagctaaaaagtaatgccaaggtacatccaaataaagggttggggaagggctatctacatggaaagtacttgctctgcaggtgcaagagcctgggcttgatccccagagccacgagctaaaaaaaaaagacagttcagcatctcagatgctaacagctcgttggcaggtagcatcatggagtacaaactggtgggtagagaggttagaccataggtcgcatcactgctaatagtcccgtctgtgtgtggtgtgtgaagcactgtgtgagtctggagactgtgttctgtcagtgtttggtgagcttgtgcttcttttcatccccccacccccacccccacccccacccccagcttgtttagagaatggcttatcttcaggagatgttattctgctaagtatctttgtgccatttttctctgctttctttttcaagaatgtttctagttttctcgacgttcactaagggcctacagaatttctttccagggctgcagtaggcaaaggaacgatgtatcattttgaatggaaagggaaatatcacatgttctttctgcttctgcagttgtggcagacagggcccccctgtgtagcagagtggaactttgtcatttgagcctcaactgtttggacatctttctgataggaacaagacctgtgtttaatttcacctcgtgtcccttgtgaggaaatgggcaaaatgggcacacgaagtaaacagaccactcaaacggtgcttcagagactaggtttgggcctgttttgttttatcttttaattttttaaaaaaaatttatattttaaggaccattctgaggtatgaggctaggatgaaaacagttctcattggttccaaagcctttgctctttcccctataggatgaaatttctctgtatgagtttctttgtgctgttgctgtgagaagatgctccagccagaagccaggaagggtttcttggtactcacagtttaaagggaagatgtggtggccagtgcgtgaggcagcgggttccatggtgtctgcagccaggaagcagagagagatgcttgctttctcgcttttctcctggggcccagccccacaggaacggcgatacccacattgcatcttttcaacttaaccgagtcaagtaatccttcactcgcatgcctggacacttttatttccttttgattttaggtcccttcataacccctctttggtaaatttccattggctacatttaccatataccatatgtgctatgtgatcttactaattgagaaaaattaaagaggtgaacaaacaatgaatggccatttattttcaaagcctcttgttgatggctgagcccctgccttaaaacaaacttttattgtaaagtaaatgaaggcacattttgcattcagcttgctagtgctttctaatcatgaagggtttttgtttttgttttctgtagatgttttcatccagaactcaagaacaaaatctccatgttatgtttgttttcggaatatatctatgtcagatatcattacttaacagttagcaaatctgtattcccctttcaccggcaagacccgtattttatgtagcttaaagaaaaggaagggtgatttgtccttgcataggaaatccgctgtgcctgcttgaaacttacacaggagagaaaggcagtgccctctcaagtctttgctacccttcccactgctgtgctgaaattcccagtggaaagcaggctaagggaagaaggttttattctggcttagggtttgatggggaaagcccatcatgttgagcaaggccatgaggacgcttactcttgtctgggctcaccagactttctccctctttaacttggagtggacctccagcctatgaggcaggacccttacaactttttgcagcattcttatagacacatcagaggtatgactcctactgagtttcaatccagtcaagttgacaagatgagagaccctaccataggtctgtctcttgtcagctgggcatccaaacacatccctagcaaaccatcagtccatgttctgccctggtaaagtaaaagtgcctttacaaagagaaagttggtgtagattcaatacattatctgacttctttaatgttttatttttgacaaaagccgcctcacagccccaccccagtcttgaatttcatggaaaaacaaaccgagtccagctgttctttgtgtttccagaaaggctttgcttcttgtcttacccagggagtagaatcccactgggtatctgctgcccactcctaatatcaagtatgtagaagaaacacacctgatccagggatggtgtcaggcccatgtgactttaccttgtgtctgaagtaagcactgtgaggggtaggacactgctgcccagatcaataccttctattttattcattccatggaaggaatcatttcacaccctttgaatcatggccctgagctccactaccaaccactgcactaaatagtaccagatgttgctactggaaagagagaagaagaaaaaaaaaatcagatgggaggaggggccaggaggtgtgggggcgaggggggtggcaggagggaggcagcaggaggagcgcagtcgtaacctggggatcaggtgacagctgcagactccaccctcaggcaagggttcagttccagactgctttcactggttccctcttgaaaccgagagcagacttcatggaggacagtgactgaagaaaaacggaccattttcttgggttttgtacttccatgcttataaagaaatcactttttttttaatgctaagattttgaaaagagtgagtcatacgattctctcaatgtgatattttaatgcaccattccagtcgttgacttcaggaaaaaaaaaaaaaaaaaaaagagcaggaaagcccaggggtgggatgtgtgcttgttgaaggagcacctggcccagtagcggaggacccagaagatgggcagacataaaaactgatcttttgatttcaagtctaagcacctttcaggctgatcacattgctatttaaagatgggccttgggtctccttgatgagtgcattgtcctggaggtgcatcccattaaatacaacttcccttcccccaagtccttggctgtcttcaagtgaaaattccattggtttttaagaagagtgtcctgctctgtccttaaagctgactttgcaagtgatcttaaccccgggttgtgtctcagactctggaaactttaacgtatgtataatgtgtcagaagttttgggttttctgactgttttgtttttagtttaattcaattagagaaacctttgaaaatggtgatgttatttctggtatttaggaagcatttccgtactgtcagtgtcttgtgtcatcagaataccggtggcttagaatcagagattcaggcctttggcctggtacacggtgaacccgggcatcttatgatggagcttgttgttagtatatatttaaatgtctggaaccttaatagtagagaggtagaggtgttatgtattaatctatcccactctccgtagtgggagctagatgcaggagaagaaaggcaggtgtaaatctaggaagagtgagtcagcagaagatgtgcttggtcccggtgactccatccatgagtgctcacatctctggcttttgcagtctagttagtggggattgggatgttaattacacatttcccatccttcctggctgtctcgtaggccttcgttttgctttgagaaatggaatcctctgagacaagcccacagacccaccatcggtctgttgcctggttgctgggttttgacctctcctttcctgttctgtctggcctgagatactgcgaggggttggagggggtaggtagttaagtgacctcaggagcctgttatagggagtagcatgctcttaggcaggatcaggtacccagtttcacctattggaaattcggaaactcaaaagcctaaggtatcgcctcaccccaaacatctcaggtccctctcctcccttctctccccttcactctccctcccccactccaagtcttcttttttccattctctgtctttttgacagggtttcatgtggcccaggctggccttgaattcagttactgaggatgtccttgtgtttcgacgacgtcctgtctaccgaggccccagtcatgcaccaccacaccacaccctcctgggctgtttggtgaatctgtgattctgccttgccttataacatactcgtccttcctattataaatagactttttctcttagaggaagtggacgttggtcactcggagacaagattccagggcggattgatgacttggaattttgatcttgtcatttcaacacttggacaagggaactttgctgtgcctcagttcccccagctgtgagaatggagataatgacgatgttcacgtggggtgggggcaagggatggggccaagggaagataaattaaatagttgcttatttaagtactataaatgatgtctggcctgtaaagagtgatattgattaaaaactcaacataattataatacaaaataattatagtaataagccatctacttcttcttcttttttttttttttaatgaggattgttaagtagcattgttccatacagtgatctgacatcagtactaaagcaataggaaaatcttcgctgcttccaggatcttcttgtttcaatgtttagaaaagagtcagtatttcagtgaggtggacagatgactacccaggtcctttattttttctggattggtgctatgttggaaaaaaaaatacatgcaattcctctcaaagaaaactgcagaaaattgagtgctagtaaaagctgttaatatacacttactgttagaacatgaagaacatttcacaatggaaaaaaaaaaaagatgtacgagccctgccctgcccaccctggtttcacttttacataacctctccatcccttacccatatatgtgcatgctttgcagagtctcatatagaaacttgagctgattttcactttgtgctgcagggtcggtcccttgcttcctgcatggttattacagattttcttcttcaatgctgtcatttgtctagtggccacattctgctcaaccgacgacctcctaatggacattacacttgcacccaggatcttaaacccgagcaaggtgtgggggggtccctgcttcagaaaccactcagtcttcctctgaccccctttagaagaatgaatgctggctgtcagcccgttgggagttatcttttctgttgtcctaattcactttcactttttagatcctgctgccaatcaaagtcctcagagttaagggaagtccctgtccttgacccactgcgccttggctctgacctgtgtgtgtgcgtgctatatatgtcattcgatacatgggctgtgatcctgggtttgttctttggttggggcacgatgaggcagtttggaaactccaagcagccagatattctatggaactagaagattagccagggctacaaacaatccactctctgaatcactcacagtattacattgttgataaaaatatattattacctttggggcgtgtgtgtgtgtgatgtgtatgtgatatatatataatatataacagcaccagtgtggaggtcagaattcaacctgtgagaccctgttctcactttccaccatgtggctctcaggatctcacgttgctgagcttggcagcaaataacctttgccttctgtgatatctcactggccttgataaaacacactaaaacatcagtaccaacagaaaaaagctagaccctgtaagatgctaagtatatacatttatttcccccatgtcccatttttaggtccactaaggtccccaaaatctttaagcaaactcagaaacacagggccatgatataatcagaatgggaagaactcccaccagtcctttcctgcaaaggtaaaacaccctttaaataggagttaattctctagcagataactagcttgtcttccttgataaagtacatattgggttgaaattattataattaattttgcatgtcatataaaagtccactatgcctgcgcttattccatggatctctttattcttagccaagggagagctagacgcccagtccactgtggtgagctttcgtggaactagggagatgcccagatgatgatgcctggcaggctccccacaagtaggggatgtgactgtgaagtaccaccatcaacgggcattgagctttcagattgatgagggtgtgtgtgtgtgtgtgtgtgtgtgtgtgtgtgtgtgtgtgtgataaagaccaaaagccaacattgcatgtctatctgtactctcctatagttttatacatgtaagtatgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctcttctgcttgcatttgactactgggcggtctccccagcccaccttccacatcttctataaaacgtttggaaaacgttctgaggcctgagaaccagatgctccaaagttgtccaaatcatgaccttgacattcatctccgagggacctctgctttcctggttctcagtgaacagcttttccacactgtggagtgggattcctggctggctgggactgactggtggtggctggtggctctgacattaacccttgaggtccatggacatcattttgtgactcagcaggtcccagctccttccttccttcagcttttcttccttaccttcccagagctcttcagagctctcaaatctttcagatctggccacatggtgtcttccaggggtctttgcccatcaaaagccattatccgtggtggctttgttttgttaaggattgcagtgtgtgctgatgtgatgtacaaacttgggaacagaactcttgtcagataatggggtggagtgttcttttctggagaaaagtggctatttcatctatggggagacagctcactttctggtgcaatgcagcttgtagaaccatcattttctgttactggttgctaactctgtccatgtgaacacatgcttgcacatacaaacacatgctcctttctgttaacatggccagatagtaatgactttggcactcagcagggactccttgaatggggacatcacctttacctgagctgttgtctcctggtagctatgccctgcctgattctggtcgctagagctagttgaagcagctctgaatcatacttatcagatttcagaaacccttcttgggttgcagtgtgaaagactcagctgcatgttgaaaccataatttggtcaaatatgttattagtgttaattttggcctgtttccctttacatttcagggtagtgactagaaaaaatagtcttgccatgtagtatcctgctgacatttctatccagtgaggccaatctttgtataatgataagttatcatttctttctaagatgagaaaatagaggctgagagtggttcacagaatcacttggagtcacaccgaagtcgcctgaagtctaggctgactcccaggtccacaacatttatggctatggacttgtaaattgattttttttttctgccctctgtccctgagttgtgggagatgatctctcaccctctggaatctacagagagataagagtgcctgagctgctcctgcagagccccttggctcacacctgagtttatgttaatgagatgactcaggggacaagctggtcatctatcagaagggccagccctgtgactggcccggaagcttggaatgtagccagcctccgcagaagaggcaagctggactgaggattaagttcagacacggggctgatgatgaatcaagtccagttgcacctagtgaaacatgatcctgaagaacacagaagcctggccctcgaagctcaggcaggcatcctccttgcacacagggacatgccagcagggtaaatagagtgtcttcatttcacacgactgaacagagaagtgcacggtgtggaatactagggcctacgttgtgcagctttcattttgctggccctggcttgcatcctttatagtgaagccattaattagcacaaacaaaagtgctttcctgagttcagcgaatcatcctagtggattcttgaaccccgggtattatggggaagcaaagaactagtgacaatttagtcagaggtgtcagaggcctgagagacaccacacttacaactggcagtgaggccaacgctgttggggattgtggtggctttctgtaagagtcaatcttggagtcgctgtcagagctgtgtcagagctgcattgcagtattctgagatgaaagcacccagtgtctgcttgaaggccctggtggtgagagaacaccgtagcacttggtaagatagcaagacttgtttccctaaccccatttccttggagacaagaggcagccttcactctagtcttacaaaatgatgtggtcttgggaagactgctttagactgcaaggcttccaggtcagcaggaagacctgtgatatttctaggcccaagaccttcccacctttggaggccccctctatttcaactcctaggtgtcacctgagggggtgtggtggcccaacatgctggcctctttcttacaagaaattcttgaatattgatgttgagattttgttccagtaaggaaagcactgtgtgggaaaaccctaagtaagggatttgcattacttggtcatttgcattgttaggattcatacttgtggcgtgtctcactttgtttcaaaaatatggtgtcatatccaacagcgccttttctgtggacacccctgtttggatattttagccatggtcttgtatggttatttttggtctattttgttttgctttctccttcctggcttaaaatagacaaggtccccccacccccacccccacctccaaggccattagtttttagctttgctcagactagtccagtccagcaaagccttcttaggtcaccaagctcctagaaagtttgactcctcaaggcacgtgatagggccaccctggaaaatgggtttctaagaaaagaaaactgtcattacttggtgggaggggttctacaagaaacgggaatgaagcaaagagtatgaagagttgtgaaatctcctgaaatctgtttaacctggtctggccctgggctctctgcactctgtcaccaacgcaggcttgcttattagaagtttaatggtggcgatagtccagccaaataactgacagtagctttcactgagggtgtcaagcagctccctgccccctcagtaagggtgaggatggaatgtcagcctcagtttctaaaagagatagaacagatgcttagaactgactgccctagagttgggtgctcccttcccctgaggtacttccaaatgtttgcctgtggactacagggttcagagtacacctttcaagacataagtatgtgctacagccctgtgagagagcgaaggatgtaagaatccccttcaggagagaggaaactctcgccatttaagtcaaaactattaggggataatcccggtgtcttatttacttttatttttgtgtgtatgtgtgtgtctatatatgtccacttgtacatgcctgctcttggctgtgtgtgtgtgtgtgtgtgtgtgtgtgtgtgtgtgttcctgtgcttacctggtatatatccagcgagccccttggattctcctgtttctgcctcccaaggatggctggattcttctgtgggcattggatctgaactcacactctcatacttacccactgagtaagcattttacccattgagctgtctctccacttctttgataatgtgagtttaagtgacctgaaatgtaaataactagcctgccagttcagagttaataagacaaataagagggactcgagaatgcctgattgtagagctggtattgtgggagaaacagagccactgggtcagtgaagaccctgtccaaagtatctgtgattgttgatcctatttagatggaagggctgctgccaggtctaagggccaaaccagacctttcttaggcatatgcctgggacagagctctctatcccactgtgagcacttcttgaatgcatgctgacctgaattcaggcagggcctgtttccagacctctctccgcctgggtgtccctcttgaccatttttcctcacaactctttttcattcacttctgtcaacattgctcataagggaagtacagagatgggagcatgtgagaggagggacaggctagaggccgccaaatgtgacagatcttattctcaacctcacctatgggcctatttgtcacatgtaaggtccagcaactgttctttgcctcttcctcagcctggtaccagcagagttcatcttccctgcaccagcttccatgagctgtgacccgtggtgtcatccaggcgagtctcccagtgttctcagaacattctggcattgatacttcgctacagttttttctaatgtttcctcgtcctcatcccttctttttctctccaattagatttatctttggggactatttttaatctcccaaatccctaccataatgcggaacaacacataattaatggctctttctggctcattctgatgttcatctcatctaaaaatatttaacgagcacttgctattcagagcagacggtacagcctgaatgaatacaatttctctgaataactcatttagtagtggttcatttaattattgtatcaactctgctgcccattgatgctctactttacccagaagtaaactaggatctaaagatgccaaacaaccttccggagcctgtaccgcagaggcgcagggcagcctgccaccatttccctgagcagacatgccttgccacctaatagcacctttgctttcctgggctccacttttttttttttttaatattttttattaggtgttttcctcatttacatttcaatggctatccccaaaaatcccccataccctcccccccctcccttaaccacccactcccactttttgaccctggcgttcccctgtcctggggcatataaagtttgcaagtccaatgggcctctctttccagtgatggccgactaggccatcttttgatacatatgcagctagagtcaagagctctggggtactgggtagttcataatgttgttccacctatagggttgcagatccctttagctccttgggtactttctctagctccattgggggccctgtgatccatccaatagctgactgtgagcatccacttctgtgtttgctaggccccggcatagtctcacaagagtcagctatatctaggtcctttcagcaaaatcttgctagtgtatgcaatggtgtcagcgtttggaagctgattatggaatggatccctggatatggtccatccttttgtcacagctccatactttgtctctgtaactccttccatgggtgttttgttcccatttctaaggaggggcaaagtggtcttcgttcttcttgagtttcatgcgtttagcaaattgtatcttatatcttgggtatcctaagtttctgggctaatatccacttatcagtgagtacatattgtgtgagttcctttgtgattgggttacctcactcaggatgatgccctccaggtccatccatttggctaggaatttcataaattcattctttttaatagctgagtagtactccattgtgtaaatgtaccacatcttctgtatccattcctctgttgaggggcatctgggttctttccagcttctggctattataaataaggctgctatgaacatagtggagcatgtgtccttcttactggttggaacatcttctggatatatgcccagaagaggtattgcgggatcctctggtagtactatgtccaattttctgaggaaccgtcagactgatttccagagtggttgtacaagcttgcaatcccaccaacaatggaggagtgttcctctttttccacatcctctggactccattttttagcaataataaaaaactaaggatgacattgatgatttcggatagtggcagatgttctgatatgtggtcaaggagttagctgagagaatactcataatatcaggaagagcccttctgggagaccacagtcactgagccctgcgtgctgtctgctctgcaatggttaggataggatggaatgtggccctcaagtgtctatgttttggaaacgatgttttcccgacatggtgatactgcaaagtttgatacctcataggaggtcaacttgtcactgtccctggtagagcatgagactggttttgtggaaacctgacagcagagttgttatttaaaaaaaaaatgatgagaaaagaagtgggtagtccagcccagctgttaccctggttttctgtcccccctatttcccatcccagctgtgatgccacctgtcatgatgtgacacagccaaggtgaccttcaccaaagttagcaccatactgtaagagctttagtctctgaaactaggaagtaaacaaatctgtctttgtatcccgcctcaattactttgtaatgggaacggaaacagattcctgcaccctccccatatagaataatcctgtggaggtttcttctactccttgaatagttcctcagctgacagcagcagcatgtcctaacatttcacttggaaatcatgtaagattctcccaggccaaaggctcaaatgcagcagaactcccaactcctggtactggttgcaagtcccagggtgtcactgcacttctgaccaactagctggcaataaaagttctagaactcattctctagatttgattaatttgccatgacagctcacagaaattggagaaacatttagtgaatttgcttaatataaaggatattataaagcgtgcacatgaacaggcagacagcagagccatgtaagacgatgtgcaggtcttgtgtcatatgtaggcatgctatccctccagtcacttccacatggcccagccatctggaaactcaccaaaccttgttcttttgagtttctatggtgttttcattaagtctgaatgattgatgacatttttggccataggtgagcaattcactttcatcttctctagatcaagattgagggctagagccgaaattccctagcctctaaccctgctttctactttctggtatcacttccatctggaaggtgttaagggctcccagactgccactcaccttgttggcatacaaacagtcactcttatctctttggagattgccagggtcatctgggtgtgcgttgcttagtatcacagtatcacactgagggaatgacttgaaagagtggttaaacacagagagccttggaatagatcattgatgtctcacaccttaccaacggactgttcttgctgtgactcacctctgtctgctttgtgttgtagtagggctttgttgagcttaaggagtgctcgaggggtggggtcaggagggaagaatgaaagaattaaccaatgagcttgcatccaagaggttggcaataaatgtcataagcaagaagccgagtccctttagtgtggaaagaagagctactctgtgattccctgccctcaggaggtcttccccccgctgtaccatgttggatatggccttcagggaatgtgcctaggaagtccgacggtgccagaggtggagtgcaaacagggtcaggtttctgttcttccctcctgggctgcagggatggttactgggatggttctccagtaaccttgagcttatgtttataatctatgatcccactccagaccagcaggctgtattggttggaccataatgtggtctaccagatggggacacctcagcttttgacccgttactatatcctggcactacaacaaccacctccagaggtttccagaccctttctcctatctcttcgtgggaatggagaccatgcctggtttcagtttgaccttgcagagctcagccattgcgggtgatttgactttggcatgtggctgcagaggcagctcctgccttcccttccaggcagttgatggttaatatacttatcgttgctaactattcttgccaaatatagacttatagctctgacttacagaagtcagaagtagaagctgttgcgatatattttttgcggactgaaaacattggctaaagaaagcattccaaattgtgataggagcagtggcgcttctcccatctcgcttcctgaattccccaggccaaagccctttgacctgcagatcattacaaaatccatggctgtaaacgctgttgtttgagtgtggggtttccttcaaaacaagttgagtggcttacggatttgactggccagttctgttcatcaccattaggcatgggtcccaaccccagtctccattgtaaccctcgtcttttcctcccctctcctgaccatagatgacttttttgtttgtttgtttgtttttttgtttttttttttttgtttttgagacagggtttttctgtatagccctggctgtcctggaactcactttgtagaccagactggcctcgaactcagaaatccgactgcctctgccttccaagtgctgggattaaaggtgtcaccaccgcccggcccatagatgacttctgatgactttctctgaatataatttccagtgggaatgcttcatggtagaagaatgtagtcttttgaagcttgcccttgatgtttctagagatttattggattttacttaaatcccattgggaaacatattttcgctgtgaagttgtgatgtgtttaatttggggtataagataaatatggtcctggggtggagggatacatggatagtgaagtaagtttttcttttgtgccatgcgctggtttaatgagtagctttatctgtttgcttagctatgtttgattatttaggcttcttctgcctgaaaagtaaagaatatttgccctgccttcagagaattaaatgagcagcatagagtatgtggctcactcttgggaaaaatatgactttgtttaatagcactacactattaacattcttcctcttcagctttgcagtgccatctcagtgtgtccccccatcccttcccctcttgattaaccagagaatgtagggtttcccaaacacacaaaaggtctccaaggaaaacagttcttggctcagaaagatacctcagggtgagcttgagccaggtcttgtccataatgaggttgagggattcttctgagaaaggataacttttgtgagtgctgccggcgaagagaaggttctacatgcttgcttcttatggcttgcctggtgggttaggcagcctcccacccccactaccatctcaaccttggaccatatctggcttgactataaggtaatgatatccttaggttggctctcaggagccttgtcttaggtagcccacaagttctggcatgactcttgaatagcagatattctaatatacagacacttatatggagagagttaaactgagaaataaaatgtaaagtggctctatattagcttgcttgggttacgtattagtcagttttctgttgtgataacaaaagtcagtgctggatactttataaagaaaatattggttgctttcgtggttttagaagtcaggagtgtgagatccagtgcctctctctgttgggcctctggtgagggctttgccatggattacgtggataatatttcagctgtggaagtatgtgccaaagagatcagatgtcaagagtggaatccagagacactcagggcctagacctgctctcattggtactcacatgggtcatataagaaatgtgttcaccccttccaagcccagcacctgttgaccttacgatctcccactatgccccacctgttaaaggttctaacatctgtcaacatcaccaccctacaaggctcttagtatttgaacttttgattccttgctcaaagaacatccaaaccacagcacgttgctataacaaaacaccccaggctgggtaacttaagcaacaggaactagctctcccacagctaaagggcccaaactgtaagacttgtaagattggagtagccagaacgtaactgtccttttaccttctctcacccgctccttcacccaacctatttcttgttgtttgtgcggatggcaggcacgcacatgtcacaatataatgtccatgtcagaataggggaaaggggtgaagcaggaggcagaagccagctgcaggtgcatgggaaggagcccggggctgctcccccttggaatcacactgatttgtgcaaagcctaagccggttcctggcacgggactcaaagatcttacagtttgaatccggttcacataaaagtcataagcacgagaaagcaggcccagagcgctttaattgtcatcgttgtggaaagttacatgactgtcatcagctgttgcttctggcagtgctttctggactaatgtaaataaatgagctaacaggtttaaagaagcagcctgtatttacatacttgtgaagtagcctcaaacaatcagtctgtgctattcaaacacacacacaaacacacacacacacacacacacacgcacgcacacacacgcacacacacacacacacacacacacacacacacacacacacacacacacacacacacgaaatgtgtggcttcctcaatgcaggctcctcatgaaggcctgaagtctgaaggttatgatgagtagtgtgagtagtggaagccctgcttttccccttcatggggttttgacctgagtctgcctttttgatgagaacaggctctcctcagcaggctgaagtttaatcttcagccatttctatagcacttctttaaggcatggacttgggagagccccggactgcttcagaggaggggagagtgaagtggcaggggcagaaaggaatcccacaccctctgataaaacactccagagtcaccatgtcttggaagtcttccaaaggaagctagattttcattttttttaaaaaaatcataaggtccttttgactcagtttgacattttgtagataaatatttaggcaagcatattttgggtgtgtgtgtatatgtagctctgtatgtgtgtgtgtgtgaaggtcaaaggttgacattttgaacattttgtgtctgattcaattactccacattactgagacagggtctcttgctgaacctgacgctcaccaacttagctctctgtttgctagccagggaactctggggaccctcctgtctctgtctgcccagtgctgggacttggggcatccagccatgtttcttacatgggtcctagggaatccaaactcaggccctcatgcttgcagagtaaggactgtgtagtgaccaagccatcactcaacaccccaggcatgattgtttaaaagcacattcctctggagggtactaatgatgctatcaaaggaaacagctgaagaatcatgaacaaaacataagcaactggccctctaactgctcgtggatgagtccattgcaccacagatttagaaagaagcctcttactaagggcacaaggaaatcaggagggagcagttactggtttggagtctctcagtgccttcatagtctgggatagcttctttccagaaggctaggttttgtttgtttttcaacacacagcatgattcaggcagaggagtggtaggcaccaggagggaagcagaaatacccatgcttagaagattgtgcagaggtgtctacttcctgtaagcatctatggcctgtcatattcttttgtccaacacaagaatccaaaaaaaagattcaatgagttccaaattcaagcaaattctggtataggtttaccagatttttctccctttacctctctaaatgttatgaaatccaactgagtcagattcatgaacacaaagaagagaaatgacctttagaccgaggtccaaagatagtttgtgatgggttttgtttttctttctgaaataggatttcatgtagcttaggctggcctagacctttctatataactgaggctggctttgaagtcttgatcctcctacctccaggctccccattgtgagggcaaatattaggtaaacatgcctggccatacatggcatttttgaagtggcctctacctaggatttgtcactaaagtagacagggagagagaggtttactttatgttttagtgttcacaaatggttttcataaactcaaaccatagttccctacttcttctgtggctcctgtggtaccatctcaccaggttccatgccccctgtgggagacccatgtgcaaggggacttaagagtccctctccccaagaacagatcttccaccaaagctattaacctggaaatataaacatgaagtgataaattcaaaactagaatattctagcattgttttagttcaaagttacacacaggcatgcatctggttgctaaaacttttacagagtagttctgagaaaaattggtagtcatcatcaactattgaggcatatactacataataaatactttgtatatgtaaatagtgtatttttgtttaccctttctatagattaccatttccttaatgaactgaatttatcacagaagtttttaattgttggtgtgtgtgtgtctgtgtctgtgaagttccgtttcctaatttcctgtgtttgtttgtgacagagtcttatgtggctcaggcagaacttgaactcactctgtagcaaagaatagcttcgaacttctgatcttcctgcttccacctttcaagtattgggattgtaagtatatgccactatacccagtttatgtgctgtcgggtattgaacccagggcagtgtgagttctaggtaagccctctagcacctgagccatctccctaccccatcataatcttatttctggaatttctaagactatatatcatatccttacatatcatttctacaaatacacacatacttctttcatatagtctgagcaagtttgtcaggattgcactttttttgttgcttgccaatctgagctgtcttcccctttccttggtttctcggaaacaaacagtcagacagaaagggctagctggtgagagagggagggagggagggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttctttacctagtactcacaaaaccactgggactcagccccttgcccctcctttcctttgccttggcctttcctccatcccttatgtgctagaagacagcaccttcgtccctcttctctcttgccaatatagcttcccacagggctggatcctaagataatttaatccatgcctccttgtactaaacttgaagtcacttgtactgtcaaatggccactctcatctatggggtatgtggataagttcataggaaatgaaatgtagaagccccctttgatggctgtagcggctgttccatgtacttctcatattaaggtgctctgtccccatctccggacattttggccttagacacttgacatcagctaggtcttattctttcgccttatctttgtgcctacagaacctcaggatactgcttgatatagtatcatttccactgggggagctataaaataatatttattatatgccaataattctgtcgtttgtgagctatattatatagaactgtgtctgtgtggaagtctgtggatgaatatgtccaagttactgatatgggaactgagatgcgggtatactaaataacccactggaggtgatgcagatggtgagggctaggaccagaccgcgttttactacagacttgctccatccagtccctatattcactgctgccaatgccctgcctgcctagtaacccaggaggaaagcaaggctgtcactagtcgtcatcagcattcttgcagcaagcagtaagagtgcccttttagagtaggcaacacccccaccctcctgtagatactaattctatctgctgacagtgttctccttacacttctaaggccacttctgagcttagcatgaagcctgtgtctgcaaggttcctctgtaaaacaccggcgtttcctgcttatgggttaggcatgtgaatgttcgttctttagccccacggccagagaatcagatcccagaaggcactgcggcagctagcaaggactggggcggaagtgtggctacagacaggggtttctcctgagaaagtctggcacttccagaggttgccattgaactcatttggtctctgcagatggctattaaactgtgaaaattctagaatgttcacttgccaaagtttttgtatgtctaaggcttttcttttctggttactaataaagcgttcatcatgtaccccatatggtttcagcaaactttatgtttgttaacttattttgttcttagaatagtattgcataggcactattttctactcatcggtaaggggaaaccaaggaagagacgcatgagaagcctgcttaggatctcatggcaagggtttatcagggccggctcagcctccagcagcttctccattactgaatggagtgtaggtggggtcatggtgctgatgaggagtataatggggtgggatgtatgggatgccatgtgatgtatctgtaaaccttcatgtaggtgtcctctaccccagccctgtgcatagggtgtattatgaatgattatgtattatgtaagacagtaaacggagctttcctaagggagagggattcaacaagttcctcggaggctgagatctcactggaggctgggcccatgtgtctccacccatcattcctcttcctctactccaaccacgccaacaatgtgttaatgatgcttttattggggtgtgtgtgtgtgtgtgtgtgtgtgtgtgtgttttgtttatttggctactctggctggccagtgcggtaccaggaatctccccatctcttcctccccagtgcacatatcacagacatatactattgtcccttgctttctcagggacactggggattcaaaccctgatcctcatgcttgtgaagtgggccctttactgactaagccatcttcccagttcccacccccgtgtagtattcttctgttatcaggccaaacaaaattaccccctcccctcattaggtaatcatttgatatggtctgcagggccaaaaatgacctcatgagctctactcttaccttctgctgctcccaatcccatactcacccctaagaggtacaaacaacccctacgcagatccctctgaaatatccctgtcagatactgctatttcacgcagcctccgactccacccaggagagtctccgtttcatcgtgacactgtacagcactcttgtgtgaggacggacgcctgacatgagcagacagagctggatgctgtctcttctgaccctcagtgagaacttccttgtccagctgagatttcagtcacatgcggcctttctctttccctccctacagatagtagtccacaagggtctttcccacatggctcagacatataataacacacatcatttcacatagataggcacacagcaccccatggtagaagcgttcggtgtgtcagtctcggactctctctgatccacccttcccccatgttttttccccccactaggcaaatggaaggccccttgccacctgttagcattacgtcattggctccccagaacacagttgtacccaaggccttaaacaaagtagttcttcttgtattgtttgcattcaaagagctgatatcatgccagctgatgtcattgtgtgtctttgtgtgagtgctatggcaactgggcaggtggggagcctccggctgatgtcattggggaaggaggggcagagactgaattttaaaaagctctctgctgagttgttttgtgtctgggggtgggagggtgttttggtatgcctttattttttattttttcaaactagctgctttaagacaaattacagctcgaacacactaaataagaacagagacgcctcttcccccttccagcctcttttgagtttagcttcccagtccttcctcccatcttacatggaaaaaaaaaggttgcaagtgcctttttccttcagaaagaagggaattcggttcccctggcaggatcagcatggggctgtttactgggggctttgtggagcccaggagattgccacacagctcctccctgtgtcctctgtggagtttgccacagtggcagtgggtagttttgcactctagttgttaagtgttcactggtgacgtggttttcctcgtgtcttgcatttttctttgtagttggaaggcttcctttgggctagccacccggctataatgatttcaccacagaagacaacagcaagggcagagtgtaattacagaaatgaattcaaatgaagtcaaagctctgacatgctctcctaaagacatgtttgtcccttcccgtatctcctttttgactggtagactagacacaggatggccctccctaccaagtggactgtgaattgttgctattcccttctgaaaatatgatctgtgctctgttatacagctggctgtgtgcatcggttcggggacacactgtgttcaggtcacctgctctagtggtcaaaaatgagactcgtggtttgaaaggatgtggtttcagttcagaagctggtggacaagtgaacttcctgtcctggtagcagagcctcactcactctgttcaggctttgtgcttttagccttaggctttgggacactcaagacctctgttactgggaagacatcgcttctaggaacttcccagggtctcacccttttctagaagaccccacgtgtcccacactcctttggtgaccccttcccaggtttcctaatgtctctctcatatacgtagtagaatttgagctccacaatccttcaggtttgtttgtgtataaatatgtgtagcataagtaacaaactctgacccgtgcattcccttaaccgttcttttttgtatggctaggcattttttttccagaaagttttaaattagctctttttcctttagcattaaatagaatcattttctttgattttatagttattcctttagtgggtacataacatcccatggatgtatttaatagttttatttttggtatttactcagccttttctttctttttaaaaaacttactgttgttgagtgtttgtttgaggtgattgtgtttgtgtatgtgtgtgagtgtggaagccagaggctagctttgtggagccagctctcagcttccaccattagacagatggagttgcgcgaacaccccacgtagctgactgcacagctgtgcttgtgcgagttccttgagtgactctgtacttatacaaggccatgtctgcatgctaaatgtgggaaaactggtgcggctttaacctcaaacctttaagagttccaaactcaagccttgaagttagagcggagccttgagctcggagtgtgccttgttagatccatcaaaggtcactgttaatgggttagtgtacccacaatcctctaaaagctaagtacaggaaaatgggccactctcagatgccactctcttggaagtcaagatctacaaatgtcaaggacatgtatggaagaagtgaaaatgtagatcctgagtcactcttccaaccctacgctacattagccaagccgccctctgcgttttctacctttgggcagtcgcagaaataagatgaatagaaatagcttgttcttgcatagtggccatgcaaggctgggggttgggaatatactaaacactttatctgtgtttatctccatctcggactcacactcagagagacatgcttgtgcaactcaggtcagtagtgcaagccgaacactagcctgtgtaacctggcttttccacaagccctgctagtaaccgctctgctactgagtcgacttgtccttctgtaaagtgagtcatagaggggacatgacatgtgtgcacagtgccaggagacaaacggaagtcctctgcagggcgatatcatccctgattttctcagctcccaaagtacgagttctatataggccagggaccatatgtctgttagaggcaaatcagattttcagttgatgaaattacggggtgctgtgtggaacttgttcccaggcaccttggcccagttttgcaataggggtcacagtgtcctctgaagctggctctgggtatccaaacaggcttctggctcttgtgttttattttagaaatgttaaagtacgcacatagccatagtgacacccatttccatgggaaagccgacattttttagcccttcccctctcctccccgactgtgggcttcactcatatgtgatttctgtgttttccttctagggggactcagtagttttaaacagaaccatggaaacctctgtgacaactccctccagctccaagagtgccgggaggtggggggtggtgcatctgcggcctcgagcatgctacctcagtctgtccccaccacccctgacatcgagaacgcagagctaacgcccatcctgcccttcctgttcctcggcaatgagcaggatgctcaggacctagacaccatgcagaggctcaacatcggctatgtcatcaacgtcaccacgcaccttcctctgtaccattatgagaaaggcctcttcaactacaagaggctgccagccacagacagcaacaaacagaacctgcggcagtactttgaagaggccttcgagttcatcggtaactatctctcacagcagggcgggcggagagcttcctcttggctctctcttccctctacttctggttttgatataaggtctgaagtgtattcctatgttagggaaaacaacaacaacaataacaacaacaacaacaaaacctacctaatgcatagtccttcctgttagtctcagaactacctggatgggcataattgagataataagctttctgttgccatcattgaaacacctgaaaggttgtcttaaacggaggaattatcttgacttatgatcttggaggtttcatgtcttggtgctttgattcttggcctgaggtgagacagaacatggaagggaaggagtcaaggtcagctggaaagttcctatactcagcttctcatcagagatgccaactgtcatcagtgaggcctgtagagtactggtctacctcatggccctcggcagcagtgtttcactcctcacttccacataccctgaccctccatggccatcatctggaaggcacggttcccaagtagctcagaatagagagcaccagaaagtgttgagtttcatattaaaagctttggatgcctgtgagcactggacaacagtttttgtgacatttctagattaaaacacatcccccaggaagtgtccccagaggaatgcaggtcaatgataaggtagaggagaagggagtaaagagacttgtcccttagctttaatcacccacactggctgcttcccagtagacaaagaaacaaacaggatgtaactatctctctcaccagtctgtagacaagcttgctttgagagacccaagagtaatgcttcaggaaagtctccctttgtgaacactaaatgacctcccacaccaaggccgtaggacatggtggataagaatgagtgaggtgcccactgccatgttctgtgtcaccccatgaaggctactgactttttggcaaataggaagggagggaccgggacagcatttagccttgagtggcacagtgtctgacctacttcctcaggcaagcctctaccttctaacattttagaaacctttggaaacagtaccaccagctggggatgaagcatttgacacatgagtccgtgggaccatttcacattcatattaaagcaataatcatcctctttgtccaacatctgtcaactggaagtccctatcctccatcctcccgttaacaaagacgccatggcggaggttggcacttagacactgtatgaccagaagattaaaagggagagtgcagaactgctcagagctattcctgctgcctagtctatgtcctccaagccctgaaggaagcaccaagtagagacgtgatgtcaccttaattattcctaaaccttcacatagcaaattggtcagctttattcacccagcataggggaagagatttccattgggcacagtgagttatagtgagtcacagtgtatggcttattcacttgaggttgaggcaaaggcagcatcgagaaagggctggctctgaagaaacttcttcagaagcaggccatgctgtggtaagtttctccgttcactttatccttgcagaggaagaatggaaggatggtgtgaattgtctgtcatcttccacccaagtgatctcagttcttaaacactgagtgacaaggactgatgttagtgcccatgagaagaaggtatatgtttcctttgccagtttgtctcctgctgagagaagcaggaaagatcaaccccccccccatagggcccatgaaggaaaattcttgccaagtaggctctaacctcagaaggaagcaatcaccagctcaatgctgaagttagcctttgtagcctttgtggcactgtggctagactcaggataactaagacaagaagagcaggtggcagatgttcaacatcatttccaacaaactccagcctttatcagcacaaagaggtagcccaatgctctacacattagcacctcaagttgtcacaggtctctgtctcaggaagaaagcatccatggttgttgctcgttttgccagaaaaaaaatgtcacaagtttagcagccaccagggtgatgggacttttttttggcaagttggcagctctgaactgcctgtgttcctttccagcttgtccttcatagctcggccatcccatggactctctggcaggacagccagagcggtctctgaactcagaagtaaagtaacctttccatgtcagaaattctagtgtcaggaaggaactggggactgggaggagacacaatggggaaactgtttgctgcttaagactgaagacctgagtttgaatcccatagaatccatggaaagtcagatgcaagagtacacatctgtaatgccttctcttccgtaacaagacaggaggcagagcacccctagacactcacaggacagctagcttggcaatctacagcagcacaggaaatcccatctcaaaggaggtagtaggcaaggccccacattgacctccacgtgtgtgtcacggcatgcctatacctgtgaaaacagaggacctagtgttcttgacttctggccatgactctttcccgtgtttaccatgcgtgccccactgattagttcctaacactgggtacaaagatgccctgggttctttattcataaaatctgagccaagccttgtgtcctgagcaagaaatgcccgtcaccagggcgatgaagttcctagttacttgaggctgttataaagaagagtcccacctgcttaatttcaggtggaggaagttgggaatttgttttccatttagcaagtggcatgggataggcttgttctaagagattacagccacagtgcttacattccttctggattattcaggcttacctcctcttttagaagaaaaacaaaactaatgacaagcaacatttatttagcctgcagaacaactcaggatcacgtgggtgggcatggttttgttctctgattggataaactgaaattttatagtgtggctttcagggggcacacaacaaggttcacagcataataacattcacctgagtttaatataaactaagcaatgttcaggtttagagtttaacaatgccagtttaaccccagaatcaaatgacttcatctccaaagatccagaggctggctagctagtgtcctttgcattatccgagcaggaagactgaagttctgggggggtcaaaggactcacaaggtcactcagctagtgtgttagtggcacagatggtcacactcagggtgcacctcactcattctcacccaccatgtcctacggccttggtgtgggaggtcatttagtgttcacaaagggagactttcctgaagcattactcttgggtctctcaaagcaagcttgtctacagactggtgagagagatagttacatcctgtttgnnnnnnnnnnnnnnnnnnnncagccagtgtgggtgattaaagctaaggaacaagtctctttactcccttctcctctaccttatcattgacctgcattcctctggggacacttccctgggggatgtgttttaatctagaaatgtcacaaaaactgttgtccagtgctcacaggcatccaaagcttttaatatgaaactcaacactttctggtgctctctattctgagctacttgggaaccgtgccttccagatgatggccatggagggtcagggtatgtggaagtgaggagtgaaacactgctgccgagggccatgaggtagaccagtactctacaggcctcactgatgacagttggcatctctgatgagaagctgagtataggaactttccagctgacctttaacccttcccttctatgaagttttagtaaaacgccatgcattaaatgctaactcttatagagaacaatctgtaggataaaggtgtgtgtgtgtgtgtgtgtgtgtgtgtgtgtgtgtctagcatgtggaagatattgctaatagcactgcatgtatcatgtagtcatatagcctggaaagtggtatgaacattgttaatcagaagacctttttcacatgcccatttctgtgcatggcataatctccattccttctctcctcctttccctactttttcttccctttatgccagtgttaagaaaatagaaaaggaacaaggttgtccagaaagaggtccgataactatggggtgcacagtagcttgcttctcctgagtgtgtcctgttgtaggtatagcttctgccttccccatctcctgtgacatgtgcttttcccacccatgacttccttgctctatctttctaaatgtagagctgtaggggactgggcagatggttcaacagtgaagcactcatgacacaagcgtgagaatcggggctaggatccccacaactcacgtaaaagccacatagctatagcagcttgcctggaatcccatggcacaagagactgagatggggtgccccagagcaagctggctatcctgaccagcagaaataatgagctccagatccagcaagagatgctctgtcgtgtaacatggagggtgatcaagtagacacatgatacggaacatggtcttccacagacacacgtgaacatgcatcagcacttatgcaaacatgcatccatacccacatgtacattatacacacacatatacatacacacacatacccttcccccctcaaaacagtaaagggccaatgagatggctcagtgaataaaataaggtacttgctgccaagactgacaccctgcatccagtttctactaattcatattgtggaaaaacagaactgacccttaccagttgtctgctgacctctctatgcacacagtggcatgtggaccaaccctgatttttctttttttaataatttaagaaaatgtagaccaacagctccaatttctgattgtggcccaactctatagctcgagatttgaacatgtagaatccatcatgctttggaaccattgaaatccattctctctatgcaaaaggaaccactgttgactcaggcagaagttaagcttcctctgtccccctttcttaccacctgtctctctgtcccacagaggaagctcaccagtgtgggaagggccttctcatccactgccaggccggcgtgtcccgatccgccaccatcgtcatcgcctacttgatgaagcacacacggatgaccatgactgacgcttacaaattcgtcaaaggcaaacgaccaattatttccccgaacctcaacttcatggggcagttgctggaatttgaggaagacctaaacaacggcgtgacgccaagaatccttacaccaaagctcatgggcatggagacagttgtgtgacaacgggcaggacggaaagggctgtgctctctcaggagacgaaaaggagggaaggtggattctagcttgtcgctcttctttcctttccttttcttttctcttctcttcttttcttttcttttctttttcttcttttctttctctttctttctctctttttttttaaggttgggagtgtttgtgaaagtaaacaaacttgtctaaagactctatttttaataagtgtaagaagactgtaacttttgatgcgaatgagacccacttctcttaaactggtattgcagttaggttaaagaggtcttttttgttttgttttgtttttttaagccaacaaataaaaatattataaaacttgtttcttcccagtttcccttgtaagcttattgtagagttttgagtaaatagtctgtgcgggctcatagaccgaagataccacccttcaattacaaagaaccaaaaggaaatggaaaagactccagacctggaactgactgcacaaccatgtcaaaagcaaaccctgccaaaccgtgcccagttgtgctcactggtgtgaagaaagggccggcaagctcagtggactcggctcgcctcacaccttctctggggagacaggctagtgtcggttttgtgtgttctatgctccggatatcttttccccttctgtgggtctgagagaactttttgtttgtttgtttgtttgtttgtttggcagaaggaaactgaccattctaccatgtgcctttgctggcactcgtgcaataaaaatggtgtttggagtgtgcagctgagggagagctggcagctgagtgaggagtggcgttggagacaggcattcaacagtaccagtggcttcccctccctcctttctccttctcccccccccctttcttcctcatccccttttatttgtctttcttttgatttgattctggttacagtgccatacaccttgttacatatgtatatcagaatgtaaaaaaacaaaacaaaaaaaaaacaaaaatttatttaaaaaatatttttcgcaaaaaaaaaatatccttggtgtgtttttgttgatggtgtaagaatttattttcattatataaatgaacctcgtttggggatgtgtcattctttgtacgtgcctgtcttctctggttaggctcatacctctcagcacgggtttgtataaagagatggggatgagagtgtaaagcgggagggaccgctcacggagggaggctaaggatcccagcactgatgcggtcctctgcttcctccccatcctctttctatgagacagcagactcatgattgagcagcttccgccagacctgataaccaaatcacagccaagccgaggatttagaatatacagttgtctccctggtaactacatgtaaatatcagtgacaatctgccttgtatggttttcacagtcccgtctcaattgacactagctcacatgacactttttagggacattcaccctatagtaacaatagtacaagctgcaaaagatgtactcttccagtgtttttcccagtcagtagaaatcagctctgtgtgcacacggactttgacagtgctggctattcagcccacagacagttggaagtggtgtgggaaggatatataatcctacggttttgtacgttttattagagaatatgtatctagagggacttagccactgggaagatttgtagtgccccaaagtttgcctggtgcgagtaagcgctgaagaattctggcatgtctggctcccagtgactacatttgacataaatatttttgtgaacatttgcttacaaatgttacaccagaaatattttgacattgatttctttattcaaatagcttgcctgccaagagtcatttaaatttttctttcattagaaaagtggaaattgaacataataggaactgagagctagctggaattacgttagtctgatatagaatatgaagtagtcaaaaagtaaatctctttttttggcatttccgtactgtcaacagtctttttgttttgttttgtttctgtcaactagagcaaactgaaagagtctgatacacagtgacttgggatgcctggcaggcttgtcattttctaagtctaaaagttggagtcctggtggggtataaaattctctctctctctctcccctccctcctcttctttctctttgcttttttatcatgtcttctgcaaacgaagggaaggactcaatagctacatggacatgatttgtgtgtttggaagtttatgagcttagaggagaaggtctgccttggggcaacaggaatcctgccaaccagcataccaagaattctgagagggactccagtcttttctcctaatctgctctgagtcacttcaccttcgtttcttcttgaggaatgttaatcacttcatgaacccactggatcagcagagccaaggctctggaaagcagagtccccagcattctgagcctctcactagctgcctgcaaccttcaggatggggttgggaagtgactgtgtcttctgagaatgcacagtctatccacctcaagagtcatccccagggcctgtgctgaaggaatgcagtgagctggtggaatgaatccagagtctatctaatgcccagtagagtaggcgtcactgccttggtctgaacagaacaacaactccagattgtccacatttatttcaatagctgatagttgcttttccagtgtcaatgagtctagacagcttagttcacagatgagctcctgctggtgacatttggaccaaggtagatggagtggagagcgaggacggaagctgacaagaacgtgtatgcaaaataatagaggaaacattcttaggctgcagccatcactgatttctactgactgggaaaaacactggaagagtacatcttttgcagcttggactattgttactatagtgtgaatgtccctaaaaagtgtcatgtgagctagtgtcaattgagacgggactgtgtgggcaacaaatgagagatgacccagaaaagctaaagagaataaacagggggaaatgggaaagtagagtaacgagagaatgagtactcgtgttgaattgggatccaaatcatctgaaaactgagacatagagaagcagtgttgatctctttgggtcttctgaggggtaagcatggtgagccaaacaaagatcagactgtcttaactttcaccttatttgaaacctgtctcttggacatgaactatagagatacatgtggaattatttctaacctcaaatctcagctgttctggggcagggcacagtagaagatatcgaagctctggtactccaaagaatgaggaatagcatattctagaactatagtggtgccagttttacccacctgccctttggaggcagcagggactgacagccatattgtcagttgttcctgatttctgtctctggttaccttcatcaatggtgtgaaataaccaggctttggaaacattggaagactcactggcagagtattgcttctgtgtgacatggcctgaaaactctgtgtcaataaggccatgggagagaaaagctgcacatgaaatagaggggtgtaaagatgaaattacaaaggtgctgatcatgtgactggacggttgaggaggagaacaggggagagcgtaagagctgagctcatggctcctgctaagtcaaggtaagtcacagggtcaaggcaaaagcatgctcactataattctccccattgcccttctaaaatgggatggctgctatttgtctttgtttgtttgtttcccccacaacttgatgcaaatttcctctcagacttagtaacccaatgtgaaacaggcaagggaaatgtgggaaaggcagttcatgtctaggatgattttgtcatcgacgtcatcgcgtttggaacctccctttctcactgttcatgctgttcctttgtcctcagtaagcacatccttcatcatggttctttgccttctgaatggcccagaccttgacaactgggcttgtattagattgttttccactcattttattatagtaacaaaggcaactacaaagcacagcaatctaagcgacactagcattccaaatggacttttccttaacccagtaccagcccaggttactcgtgacaatcacaaccatgtcagtcagtatagtaaaatatatttttgcttgtttttgaaaaggtttatttccgttttaatgtgtgtgtgtgtgtgtgtgtgtgtgtgtgtgtgtagtatgtgtatgtgagttcaggtaccttcagaagctagaagaatgtgttcgatgccatgaagctggagtaacaggcagttatgagctggctaatatgggtgctgggaaccaaactccaagagcgggatatgcttgaacagaggagcaatgtcactagcctatgtctgattcttagtgtaaggcacccaaggaagttttaagtgtcaacttctagcacaatggatccatatagcatcccccagtagaggtgtctttaccttaggaactaaaacttctacattccagggtagaaagaacaagctgtgtaagtggatcattaatgacatttgtaagagacgtttgtcctgtttctgtcccttgattcctgcatttaagtattcttagataagtgttgggggttggtctggtgctgctatgtattcaaatgataaatactggccccaagatctggtttataccccccagctgatcctaacatcaaatgatgctatgaaaaccttgctccccaatttaaaatattggttcagtaaaaatggctacagtcagttactgaggagaatagaaagaggcagcgtttccatttactggggctggggggtagcaggtaggagggaaaatgagtaagaaaatgaagatggagaagacagaaggtctccattagatgtgatggaccaggagcaggtgcctgagtgaatagtccccctcccccgcaaaggacagattgctggagcagaagtaactcaggagagactcaaacaggaagtatttggggagaggtgatggggaagtagccagtctagcatttgaaaaatagattaggggtaatcccccactaattgcgcaagagctgattaaataaatccataggactctgcctcagttactggcaggctgagtgggtcatattaataactaatagagtttattaaactccattgacaaggagaaacaacaacatatactgactgatgactctgactttattgcttcttaggggacattactctagccctgtaacatatttccattcgtccagcatagcagtagacttgttagaactctctgcctttctactgcttgaaagtgatagataacatggtaggactaatgaacatgaatctgtttccatacacaattcaccacaaaggaggttccttaaaggcatagtgtggtatgtcgtggtggtgtataagaagtactctctgagtggccaattgctgggtttggcaaggtgtttagtaggaaagacaaacccatatgaaaagtcagtttctatgaaatgagaagaaacttgccctccaagatagaagtggttttgtcatcagatagctgagtaattcccccagagggtggtttgctagtccaggaaatgagtgctgcctcatttggagttggttggacatgtattagttgctataacccaactagactttgatgagtagacaatcatgtgcctaattgcaaccccatgttgaccagcatggggactttgatcagaagatcattgatcaatagagaagggaggctgacagaatggctaagcttatctagtcttaagatacttctatcctaaatccgtgtcttggtgggcaggcaacaatccatcccactaggagaaactgattccttgcattcgtttcaaaactttccaatctgatttactctgccatgtttctttaaagtctttaataagcaatgaaaactgtcactgctgcccataaagcaatgtaggttcatattgttgctcctctctgtgtttagaaaaaaaaaatcaacaatgagatgcaaagttctgcctactggaatgtctttcctttacctctttttctggatcatcacagagtagagatacaatgatgtagcctttcactctggatgacaagctagtatgcaaagctttctttaaacagggttaatttgtttttcaatgactagtccccaagaagttcccatgactctagaggtataggttctaagacatattggagcagacaatgggtctgtgggtcagtgcttattgattggcttgggcttgagagagtgtattccatgcccattgataatgaaatgatactgttcatgctctatgtagatacatgctgggctcaataatgcttagctcataatgggaaatttgggttatattgtaactttatggttccagatcaagcttccagtatcaaatgatatctaaagaaaggatagattttctgaaaaaacaaaacaaaccaaccaaacaaaactactgccatagtattgctcctgaattctaaatatctattctggcatctattttgtgatttgcttacagggaaatggctccatgcagtattgctgtcacacagagagacctttagtgccaccagatttactggatccgggtgttaaaacatctaacatggtaaccttgagccgcaatagagactccatagttctggattttactcaaaaaaatgataaccttttatcacagtaaatgaattaattttcctaaatctaaaagggcccttatgttttcttctctgtggtaggaagtaccacagatggtagaaatttgttactttgtccttaaagaagatgtattagcatacttattttaaaaagatgtatttattatatttatttatttttttaaaatttatttatttattatatgtaagtacactgtagctgtcttcagacactccagaagagggcgtcagatcttgttacagatggttgtgagccaccatgtggttgctgggatttgaactccggaccttcggaagagcagtcgggtgctcttacccactgagccatctcaccagccccttgttatatttatatgagtacactgtaactgttttcagacacaccagaagagggcatcagatcctattatagatggttgtgagccaccatgtgattgctgggaattgaactcaggacccctggaagagcactcagtgcttttagccatctctctagctccctactagcattcttaaaaccactagacgtctatacattcactggtgataagcccctgagtgtttcagaatgtgtttctcaaccttttcattactaagtagaagatagataggttaagagccaagctaagctcattgagaaagagatgactcaggtacccatggtctctgacaaatccctgtgttatctcagcagcatatctacatcagttatttcattgtgctcatcaggcacagtgagtgctatcatccatgcatggtgtctgaggggatggatacacacctacgatccctgtgtactcaattatgatacagggatatcaagttgaaatggacctaaggtaggatagtgatggttacaatattattcattctgaaggcaaactgcttctaatggccttaacttgtgcttcagaaacattttatgtaagggaataataagtaatgtaggattagaaggtgatataggctggctagcgaggctactctagagttggagtacaattacagtcatagacaatatgtagaggaatgggagtaactatatactgtaaatacagccatctggatttcgtccatgctctataaatagctagttcctggtctttttaaacaggtatacaacagccatagagagctaaacatttgctttaccaataggtacttatgggttaccagagccatgttgagtggctccattaatcaaaccatgtctggtataacatctgtaacagaaaccaacaactgaaagacatctttaaaacctactgttccttaaattcatctctttttttgtgtaggacaaattattgcaataaaggaggaacatgtaaggaatgccatctttgcgttttgtctcagttcctgtcgctgtcactaatctgttccattctttaagagatcagcattgctcttgtgtttgctaccttagtaacttgtagcttcataacaaactatatcaaaacctagtggcataaaagaattcaaattgttgggtttgttaatgaatttgtttcaagtgtgttcaacagacaggtcacttgaactataaactcagaaccagaagtgaggcagcttgttggggctggagaatgtgtttccaaggccttgcaagtgcttttctaactgactgggaattcagccagggttgtccactaaataccttggatcctctcctcgaggatgcttgggctttctcatggtagctgctttccaagtgactgagatgaaagttgcaaagcttctaaaatcgtataaacacggatgtctcagatcacttctgcaaaatcctgttactaaataatttacaagctcaagttcaaattcaaggagaaagcaattggattctacctcttaatagcaagaatagccaaggatctgcaaacattcttatcacactgtagccccctttgcacaaccaaatcagtatgtgaaaaatagtttacaggaggcagggctgttggaatgacagtaagtcaggcaatgacatcagcttcctccaaatattgcttcaaatagtgttgtaattcaaagctaaagttgaactgtttttttttttttctcctcccaaaccaagccctgaggataaggataaagatcacaaggggaaggtcgcatcagctgatgactgccgccctcctgcttctgatggtatgccagctctcaaggccacacgactcacagtcttgtctcatccaaattgtatttggacagtatactacatttttaaagttactgatctaagaggcatgcgatactccataattcgtgcccaaatccctgggcatcgttgtgacctttagcttgctatatttcaacgagaaacatgaatgcacccaaagacagacagacagacagacaaacaaataaggaacattatgtggatctgtcctgtctctacatatcatgtgatgcctaaggatttgggaaccaaaatataggtctgccattggcttttggattgatcccttgccgtcactgggagataactgtcagatgtgtcttctggcgggggggagggtgtctcaatttttttttattaacccattgtgtgacagttgaattaagctttaatttctctttgtcttgttttgttttttgtttttgtttttctgaagcagatctcaaggtaggggttttaaaagaagcagctgatgaaatgatccaataaaactggcaagggagagtagaactgaggccaagatggagggaaagggatggataaacaaattggaaagtaagatcttgtttccaatgtagaaagtgaaagaattatcctagtgagggtgggagctgttgcatttgttcatcaaggttccttaagtagacagatgatggatgccagtcccagtacttccagtcttcttagagggaagccacagaggccagaggaagtcctcagggaatcagaaccacccacacttcgtcctaggaatcataagtgatacaaaaatgaactgaacatgagtgtctgggctataggccttacagcaagtagagttcctctgagcccttcacttctgaccactttcccagtcccattgaaaaggataaggagaggacttgtgggaggataaggatgggttgtgtaggaaacagatcttgtctgcttctttcctttcttcttgaactcaaagacatgatttcttaccagctggactctgaaccctttattctttcatgtcctgtctttttcaccctctcacttttcttttttattgaaagagttaaacttgctgaaaacccagtgggcttctgaagagtctctagtctctagtgttgccttcctacgttcccaccctaggcctcagattcttcagtttctcactcatcccacacccattcccttcgtctggccggtgtgctttcggtaacttagatgtctgtttggcaatattgaaagagggtaaatggggaaatgggctgaaaaagaattcatcagaaaaaaacactctaggtttggtactaaactcagaccgaagtcttgctcatcaggctgctgagcactccacaggcatgcatatcagattgatgattactttaagaaatgattaaattataattatttcctcatgactcaagtgtggatgaatgtgaagtttaaagagaagcatgaaaaccccagtcaatgatcttttcttcattatcacgtt

SEQ ID NO: 1200 - DNA, 1977 bp, Mus musculus
aaagtaactctgtgttgctgctggggatcaatgaagctgagtgaatgggggcgcactgcgcgagcgcatagctggagcgggcgccagatggtagagggctacgcttattgatgaaactcttgacttcttgaattgccagttttcagcctcctcatgcctccatctcctttagacgacagggtagtagtggcactatctaggcctgtccgacctcaggatctcaacctttgtttagactcaagctaccttggctctgccagcccaggtagtggtagccacgctcctgtccttgccgccgccgttgtgaccctcaaggctgcgaatctgacgtatatgccctcatccagcggctctgcccgctccctgaattgcggatgcagcagcactagctgctgcactgtggcaacctacgacaaggatcatcaggcccagactcaagccattgctgcaggcactgccaccaccgccataggaacctcgaccacctgccctgctaaccagatggtgaacaacaatgaaaacacaggctctgtgttaagtccatcgggtggggtgggcagccctgtgtcagggactcccaagcagctagccagcatcaagatcatctaccccaatgacctggcaaagaagatgaccaaatgcagcaagagtcacctgcccagccagggtcccgtcatcatcgattgcaggcctttcatggagtacaacaagagtcacatccaaggagctgtccacattaactgtgccgataagatcagccggcgaaggctgcagcagggcaagatcactgtcttagacttgatttcctgtagggaaggcaaagactctttcaagaggatcttttccaaagaaattatagtttatgatgagaataccaatgagccgagccgtgtgacaccatcccagccacttcacatagtcctcgagtccctgaagagagaaggcaaagaacccctggtattgaaagggggactcagtagttttaaacagaaccatggaaacctctgtgacaactccctccagctccaagagtgccgggaggtggggggtggtgcatctgcggcctcgagcatgctacctcagtctgtccccaccacccctgacatcgagaacgcagagctaacgcccatcctgcccttcctgttcctcggcaatgagcaggatgctcaggacctagacaccatgcagaggctcaacatcggctatgtcatcaacgtcaccacgcaccttcctctgtaccattatgagaaaggcctcttcaactacaagaggctgccagccacagacagcaacaaacagaacctgcggcggtactttgaagaggccttcgagttcatcgaggaagctcaccagtgtgggaagggccttctcatccactgccaggccggcgtgtcccgatccgccaccatcgtcatcgcctacttgatgaagcacacacggatgaccatgactgacgcttacaaattcgtcaaaggcaaacgaccaattatttccccgaacctcaacttcatggggcagttgctggaatttgaggaagacctaaacaacggcgtgacgccaagaatccttacaccaaagctcatgggcatggagacagttgtgtgacaacgggcaggacggaaagggctgtgctctctcaggagacgaaaaggagggaaggtggattctagcttgtcgctcttctttcctttccttttcttttctcttctcttcttttcttttcttttctttttcttcttttctttctctttctttctctctttttttttaaggttgggagtgtttgtgaaagtaaacaaacttgtctaaagactctatttttaataagtgtaagaagactgtaacttttgatgcgaatgagacccacttctcttaaactggtattgcagttaggttaaagaggtcttttttgttttgttttgtttttttaagccaacaaataaaaatattataaaacttaaaaaaaaaaaaaaaaaa

SEQ ID NO: 1201 - DNA, 1452 bp, Mus musculus
atgcctccatctcctttagacgacagggtagtagtggcactatctaggcctgtccgacctcaggatctcaacctttgtttagactcaagctaccttggctctgccagcccaggtagtggtagccacgctcctgtccttgccgccgccgttgtgaccctcaaggctgcgaatctgacgtatatgccctcatccagcggctctgcccgctccctgaattgcggatgcagcagcactagctgctgcactgtggcaacctacgacaaggatcatcaggcccagactcaagccattgctgcaggcactgccaccaccgccataggaacctcgaccacctgccctgctaaccagatggtgaacaacaatgaaaacacaggctctgtgttaagtccatcgggtggggtgggcagccctgtgtcagggactcccaagcagctagccagcatcaagatcatctaccccaatgacctggcaaagaagatgaccaaatgcagcaagagtcacctgcccagccagggtcccgtcatcatcgattgcaggcctttcatggagtacaacaagagtcacatccaaggagctgtccacattaactgtgccgataagatcagccggcgaaggctgcagcagggcaagatcactgtcttagacttgatttcctgtagggaaggcaaagactctttcaagaggatcttttccaaagaaattatagtttatgatgagaataccaatgagccgagccgtgtgacaccatcccagccacttcacatagtcctcgagtccctgaagagagaaggcaaagaacccctggtattgaaagggggactcagtagttttaaacagaaccatggaaacctctgtgacaactccctccagctccaagagtgccgggaggtggggggtggtgcatctgcggcctcgagcatgctacctcagtctgtccccaccacccctgacatcgagaacgcagagctaacgcccatcctgcccttcctgttcctcggcaatgagcaggatgctcaggacctagacaccatgcagaggctcaacatcggctatgtcatcaacgtcaccacgcaccttcctctgtaccattatgagaaaggcctcttcaactacaagaggctgccagccacagacagcaacaaacagaacctgcggcggtactttgaagaggccttcgagttcatcgaggaagctcaccagtgtgggaagggccttctcatccactgccaggccggcgtgtcccgatccgccaccatcgtcatcgcctacttgatgaagcacacacggatgaccatgactgacgcttacaaattcgtcaaaggcaaacgaccaattatttccccgaacctcaacttcatggggcagttgctggaatttgaggaagacctaaacaacggcgtgacgccaagaatccttacaccaaagctcatgggcatggagacagttgtgtga

SEQ ID NO: 1202 - DNA, 59817 bp, Homo sapiens
  misc_feature (8546)..(8660): "n" at positions 8546 thru 8660 can be any base
  misc_feature (18044)..(18090): "n" at positions 18044 thru 18090 can be any base
tacatttttagtaatacaggacaggattgcaggacacttggtacaattctcatcttttaggctatgctttgctctgtccaccaaaggggaaaaagggtgtattaggattctctagagaaacagaaccaacaggatgtgtatgtgtataaatggagatttattctaaggaattggctcatgcaatatggaggctggcaagttcaaaatctgcagggtgggcaaatgggctggagagccaggaaagatccaatgttgcagttaaagtctgaaggctgactggcagaattcccattgctcaggggaagtcagtcttttgttccattcaggccttccactgactggatgaggcccacccaaattatggggggtaatctgctttacttaaagtccacccctttacatgttaatctcattcaaaaacaccctcgtacaaacaaacaccttcacagaaacaagcagaataacacttgaccacatatcccatgatccagtcacgttggccacagaattaaccatcagaaaggaagattgcactagcttaaacatacaaaggggaagttctgcatccacacagagagagacacaaactactccttataccatgggactagcggaacttgtctttgaggttctcctgggtttaaaaagaggggccccaggtgtgtgcttgacatccctcaactgtacaaaagcagttggcgcctgtctaagccagtgcagccttccttaacatgcaccaacacagacagccctattctttcttttctatcccaggaggtggtggggcccagtgtctgctgaagtcaatcagaatgagttttagtaatatcacattttttttttttgccagcaaacattcaacaacccctctgtaaccagatcctattctatttaatagcttgtgaaattgtaaatttctggaaatagcaaaataccctctacttgtctgctctttgccttctttctgcccaaagttacccttcccaactctggagtcaaaatacaaactaaattttaaaacaaaagcaaacaaaacaaaacaaaaaacccagtcagcccactgttctttttgcctgcctgccttacttctttcagtccttctttaacatgctgggcaagtttgatgagttaaaatgtctgcctttaactcctctaatccatattcggggggactcatgtattacatgaagattaggactgtgttgaaaagggagtccaaatctattggcatttctattctgcagaatatagaaaagacacttcattggactgtttgctattattaatccaatttaaggtttagaatggcggttcatagagttgcttcagttttcctaattactgggaataggaattgcaaactgaagcatgaaggagctaagagtccttgtgaattatacatcttagtttactactgtagaaaaatgatacagtttttctgtcaccatacctgcgatggtgagcactggcagatgaatgaagcacagcgccagctctctggctactttctgatccaatctatttatctttcttgcattctaaatttttgtgacctgcaagttaatggcaaaaataacatttgcttcttttctaacatttctacttgaactaaaattttagccagttccaataaggatttttctcttacctgttgaataactcgaattgactagacctgacctgatttggattaatttgaatacccctactatatgcctgagtggtactgtgggctcagtatttagcatagcatagacacttaaattcacccagaaagggtttcatccaccatgtttgtacattcttggcccttgctggtcatgagtataattacaaagtgtttgctttatttaccagctagaccagggaaaacactgaaccctccccctgggtgtgaaatccaggtggacttgggcccattcacagagcattagaaacaggacttctcggggtgctgctccccacctaacccagaatcagtagtggcatttcctttcagagcacaaccaccaggaagacgaagaactcactgatgtccaggctcaggtccttgattaaatgcctttctgaagaaagctatttattggcatcagtcacatgctagagaaaataaacactggacaatccgtctgtcagggagataaacaccaggaaatgcatgcctttgagaattacaagaaggaagatgttgaacgagaaaaggaagataccttcatcctcctgaaactcagtgaacaagaagaggaattttttctaaacattgaagacaatcataattgcaaagagcattgaccaaaacaaaaatcaagtacggtatggagtataatgagatggattataatgagaaagatgctgatgttttctaaattctatgggaaagaaatggagttaaactgtaaagagggaaatatgatcacaacaaaacaaaacaagtggtgtgtaaacaacgtagctccccagagatagacacttggttaatatctgcataaataattcaaaagagtagtgaatttagggactttggaggtttctaagtttccagctattacagaaggccaaaccagtagctagaaagctatcatcagatggaccagggtatgcctctagaaaaatgaataattcaaaggtacgttcttgctacaacctgaatatttgtgtccccccaaaattcatatgttgaaatcctaaggcccaaggtgatcatgggggcagaaccctcatgaatgggattagtgctcttataaaagaggccctagagagaaccctcacactttccaccatgtgaggacacagccagaagttagtagtctgtaacccacaagagagtccttatcagaacctgatcatgctggcaccttgatcttggactttcagcctccagaactgtgagaaataaatttctgttgttcgtaaggcattcagtttatgatattttgttatagcagtctgaatggacaaagacagtatgtttaaaaaacattctcagttcattcattcattcagtcactcactcactgaaccgaagcttaatgagttcaaactacgtgctagctcccgggccaccggctagggatgggacggcaaacaagacatggtttttctaatagaagtgtcataggctcttccttgaatttaccagtccaatccgcagtagcaaccaagccattgacacaatttagggcaatatttgagactgttctggaaataaagtggaggtctggatccattccccaatgtggaggctgcggttgtaagagtgagaccacatggagattcacgtcatgatggacttagaaaagttcagaagaaaacaaaagaaaaaaacagcaaattcttatgaacaggcaattaaaaatatactgcagtctggagactgagggggacatgatagaagtttataaaatcacaacaagagtgaatgaaataacacaaaatggttaaaagcagatgctctggtgccagattgtctgggtttaagtgttgactctgctgctttctagttttgtgaccttgggcaaattatttaccccatctgtatttctgttttctcatctttaaattaagctaataaaaaagtacttacttatagatcgatgtggctgtgaggatttaagtgagttaatgcatgtaaatcacttacagcagtgcttagcacagaacaaaacacttagtaatatgttacctatgattattttttcccaaattctagatctttaaaatcagttcagttaatattcaattgtaaagataaagtacgttatgatgcactttgttgtctaaaggaacttcttatatgtagaagtggtacagtctgaacctactaggagatgctgagaacgttagattaattctttagtgttagacctgaaacaagtcttgagggggtttatgaatgctttgcgtgcatgtttaccttataactttgcatccttcagtaacacagttggacccagcctcctggggttgagaaactggcgctgacagcatatcgtaatgataaaacatgattgctcagtttagtgaaggggaaaatgttaacagtctttgatgtagcaacacataataataacaggccatccgccacagaggagggcattgttggagacccaaggccagtgaatgttttgtgtgtgttattttcataaagaaaataagtttacatccatggtccacacacttgggcctgaggcaaaatcctcttctgagaaagagcagcagatgtttgtggggttacaaataggggagcagtgaaggggaagaaaaaactgaaagggatctgcttgcctaaatgaagacagggagcatattaattcccctaaccagccagtcacctctgtgtgatcagtagaggccagagtgaaccttgaaaagaggtctgagatcaatcatgctttggccatgccatccagtgaaattgctttacaggaaaaaaaaaaaaaaaaagagagagaaacaggattaaaaaacaaaacagaggatgggcgtggtggctcacgcctgtaatcccagcactttgggaggccgaggtgggtggatcatggggtcaggagttcaagactagcctgaccaacatggtgaaaccccgtctctactaaaaatacaaaagttagctaggcgtgatggtgcatgccttctagtcccagctactcaggaggctaaggcagaattgcttgatctcaggaggcgtgggttgcagtgagccaagatcatgccactgcactccagcctgggcggcagagtaagactccatctcaaaaacaaaaaaaacaaaaaacaaacaaacaaaaaaaccagaaccaccacaacaaaaaaatcccaaccaggatcctttctttaactgaaattttactttggaagcccatgaataagacatatatctatccatagctatatctgcatctgtcaagtgtgaaggtgtggaggacaagattgtggtcacagaggctccaccagttcacccctgctcccatttctattgcctcccacttgcactgatgtcttttaccctttgtatataaagttttcaagatccaatgtgtattttaatcttatggcacatcttaattcagactagccacacttcgagtggccgacacatgtgtcaaatgaccaccacactggaaaatacagatatagagccttaaatggctcagagccttttcctgagtcacaagcacacctgcccatgaattttgtaggaaagaactgcaggcctcttgtgtccaaactcatagatagtgggacaagcacatggccctgcctctgtttccatcattacagtagccactgtcttagtccagttgtgccgctataacaaaatacctgagactggggaagttgtaaggaacagaaatttattgctcacatgagttctggaggctgggaagtccaagatcaaggtgccatctgcaggttcactgcctggtgagggtccaatctctgatttcaagatagcaccttgttgctgtgtccccacaggggaatggaagaaaactaactcactccctgaagcccttttgtaatggccctaatcccttccatgaggcctctgccctcatgacttaaccacctccaaaaggcctcatctcttaatagtgtcacactggtgattaagtttcaacatgtattttgggggaacattcaaaccatagcagctccttccttcagggaacacttcttatcagcccttccctaggcctggagagtgttgctggatgttttgccaggctggtctcaatgacctcaaacacttaccatgccactttcctattcctcagcttattccccactccttctggtataatatcatctttatcctggatgatttttaagttttctccaagccattctctgccttaattctagtacctccagaaatctatcttgaccttgaggattattttgaaggccccaccttctgccattaccccacacacttaaccatttaagtgcacaaaaaagaagtaatttaattaatacatttgctaaatactatccatattatatcttatatgttggcctaagttattgtcatcttttgactttaatacatagtacttcagctgaaacagtcaatatttttcttatgatgtttgtgggaacaaagatatgctcaatacaatcatgttacaacatccagactgaatgaagatgcttcactctttctttgggactgaaactaacattaacgctctgctgctggttattgatatacagatcagatttgtagccattggctgactagcattacgaatttaagtctcagggcattatatttcagtgtagtattttcacatttatcgctcaaaaacaggaataaaatcacttcttcttgtccaaaagatgttctgaagagtagtgaatggaaaaaaattccatctataatctgatttttttcaccagtcttatgacttgaatataaacttagagatgcctaacttaaaaaataactacaactttgcttatattcataatctggtaattattccacatttcaggcttgatatatgataaggaattttgccatctttcccaatgtttcagcctggatggcttagattcttagtcaactaaattataataatctactactttgaaactataataaaacaatcatctcattacaagagttacatttcttcttgaaattacttttccattttgggccttgtgggaaaagctgttaagaactcttctgcaattgtataaatctatactttgggcttagatgttgaggcattagaaatgaattcatcatttatagatcatatatacctttaaagataggcaccttatttcctaaagcaagtaaattaatttttttttccactgaatgccttttatcagcaggggatcttttttcccccctgagcgcttgaatgagttccctttttcttctgagttggggtattaccattctatggataaatgaagacagagactggatgaacagatataacagatagagtcagaatcagaacttagaactctcaaactctgagttaatgaaaaattttcccataattgtctatgtttagggaaaggtaagctttcagccttccagctccagatagatcaagggtagaacctctgggaagttcttttctgatttgtatagaaattacccagaacccaagtttcctgaccataacctgttgatcttcaaacatttaagaaccaaatggtgtgccctaagcactctgctattatcaggagggtgaattgacgtgtgtgttggtgtgtggatggagagaggtgtaaaccaaaaataaaattctaagcaccccccacgccccaccccctgcccaccccgccttcccaggcaaccctctgaacggactaatttgtcaaccagggctcttgtaaaatttatcctgaaagactggttcaggccatgaagggatgtgagggtgggacgtgccccattcattatatatcaaccaacggactaatttctcaacccaggctcctgtaaaatttatcctgaaagactggttcaggccatgaggggaagtgagggtgggatgagccctgttatatatcaacatggagttcaagtctgataagaaacattttacaacctattctctctgaacctgctgcctggagacttcatctgcataataaaactttggtccccacaagctcttatcttaacccatacgttcctttctttgatctcaggtctttagacaaactcaaccaattgtcaaccagaaaatgtttaaatttacctatagcctgaaagcccacccgctccttagagttgtccagcctttttggaccaaaccaatgtatttcttaaatgtatttgattgatgtctcatgcctccctaaaatgtataaaaccaagctggaccccaaccaccttgggcacgtgctcaggacctcctgagggctgtgtcacaggccatggtcactcatatttggctcagaataaatctcttcaaatattttacagagtttgactattttcgtcaacagacgttacacaaaatcctctcctatgtaagactatcggatgtgtacgtgatgcccgtcgtaacactggtgtgaaaagctggactggggggtatgtgcctgcatgtaagtggaggtgcccaaggggatttctcttcacagctcattgagcatagctgacttgctagctatggtctgacacctcctgatttcagatctgccctgaaaacaattacatgaatatgcccctgctactcagtatactactaggcttggagtctgaagtagacctccaaaccccatccaatcaggtaagggagaaaaacgatagcccaacattccctagtgctcataatgtattattccattatttcactttttatcccttctctcacagataagaaaagaaaaagctctacttctttagggttcttggacgtagactctccacagttcatctggggttgttcatctccacttctttttgtatcccagggcaactttcctgcagtttccctaatgagaatattttccggactaggcaaggggcggcttgccccgccccctactcttctccctgaacaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggagaggcggcgtcacctcctccacgctcctccggccccattcaatctagctatttgcactcggctctggctcttttccgccagctgcggctgttccagaagcgccgggctgccggtcctggcctcggcaggggccgtgcgggaccgaggggtggcggccgaggcatgtggggcgggtgggttgcgcgctgctggcacggcgcggggacccagcgcgccaggcgggaaaggggggcggcggcgggcggggacccagacccggaggggcagcgggcgcgtagcgggccccaggacgcccggccaggggattggcctctgcaccgctgctcagggcgcgtcccttgccgcctctggcgtcgactcaagcctcctcctccgagcagccctcagtggcgccgccttagtgctctgggtcgagccccgggagggttagcctggggacggcaggggcgtgaccggggcgcggaagtaggtgagcagcagggcggcgcgcggcggtcaggccgggacagccagaggggcagcgacatctgcgggcgggcgcttcccgggcggagcagggccctccggaggacgcaggccgcgtcgaggctgaagggcctccctgtccgggacggtcagctgccaagttcgggcccttagcgcgtggccccgggccgcggctcggagcggaagcgtcgcccctggctgcgcgctcatgctggtcctagcgcagaagacccggcgaggtccgcgaattttggcttagcgtttgtcaagtcacctcgagcgactcggagagaacccggctttcccactagggacggtgatcgcagtctctttcctttagaaagttactccgatacttttgatcatctgtccatagtaaggaggaaaaatagcgtggtttgtccccgggtgagggagtgttggaggatcccgtccagtgggaagagccagttttagcggagcagcgcgtccagcccgctgacacttcagcctggtaaagggttaactgcatcctgccggttcggtttacatgtaaatagagagcagctgctccgcgcggccccggctggctcttttaagtttttgattggttgccaatgacatcaccgcccgtgttttaacaccgaggacccagagcagcttcggataaaccctccttaaagagatgaggccacgccttcttacccgccccctaggctgcccattggtcgcggggctctgtgaggtagcggtcggctttctccggattcttattggcccaacccgccgtcggtcggcggcgagtccgccccctcagaaccttacatttacagtgtagcaaaagagaaagtaactatgttgctgctggagatcaatgaagccgagtgaatgggggctgaatgtgcgagtccatagctgaagaggagcgccagatggtggaggaatacacttatttatgaagtaagtggaagtcaccgcgactactcctgagagcccgggactggaggtggaggattgtaaggcggtgcttgtgtgagtgtgagtgtgtgtgtttgtgtgtgtgtatctgtgtgtgtgagagagagagacagagacagaaagatagagatgcgatgctgacggaggagctacagcaggtagggttataaggttccggccgttggctcctgctaccctgtgcgtttactccctgcagtctacttggatttggggcgaagaaaaaatgaggtttgttgggatgctttgcggcagttttaaatgctcggggctcattagtgcgctgtgtgccgaggagtgaagcggggggcggggggatgttaagtgctccaggaatggggaagaagcattctctaaccacttaattttctctccagctcttgcctagtggtggaagggagaggggatagctcagtatttctctgggagattttctgggccagactggatggtttcacgggcagtatgtacgcccgaccctctgctgcagggatgcaggtctctctatacactccgtgtgtgtgtgtgtgagccttgaactctgtgtggaggtgggggtcccagcgcgtgtctctgtgaacacgcttatgcgtccctctcagaagaaatggtatgttgatcctggacgtgtcctaccaggtaacacaatagcaaagactttcaccgcttggtccaaccgggaaacagttatagcttctggaatagaactcgctcttcagaaaaaatactacgcaagggaaggggggttgactccttcgctcccatccaaaggtgggtgagagaaacccgagtcgttggagatctgccgacgtgatgggtgcgtgccccgtgtgcgcgcgtgagtgtggattccgcctgtgacactttggttctgtgtcagagaatggtgacggtcgtgtgtagacggatgagaatggtgacggtcgtgtgtagacggatgatagatggcatttttcctgatagctcttaaagttcgtttaggtgagcgtctcttggcgtggggtttggcgtctttgctatgtgcatgtctaatagaagaagaagagttagcaagcctgagttgtagagtgcccctgtgcctacaggaggaaggagctgtctttttgcagacactctgaaatcagagatagatccggtgggcaacaattcactgtccctttcaacgagtacaggctaattgggaggtcctctttacggaatgagtactcttgaaggggggatatctgtatgggattgaaaccttatacaacgtggctgcctcccattgagagaagctctaggatgcacagtctgtgccagccagggagatgaagaggggaggagagcccaagttgtcctttccaggcaggaatgagggcgggggcaggtgagagagcaaagggtgagggatttgccggggctggggtttccaggtttccagatctggctccatggcttgagatttcgttttaggacaccagttagtagtgaaaaggggaaatgcagattaatttataagaggccaaaagacaacatgtgaggttttagtatgactatgttgtgcttttcaaaggaccccaatagagaatggaaggcaagaatagctccaagttaaagagattcacttaaggggatttgcagaaagttgacatccaccctgatgtatatttagctgctgtacctttctgtgaaccatgccagtgctcttggttacccctttgcctttgcagcgagtgagggaattaaatggcaagcatgcaagggtggacaaatgggtctttctcagatgtttgcagtgtacttctgcccgagagctgaggttcagaatagatgcctcttaagagcctcccttctgtcttcagcttttctaattatttgtgcttataccttctctacagctgaacttttatgtaggtccaggaaaggttgttcattaacatttacaacattacatccaaatttaaccttagacttagcaaccaaattgattggagccctcaggtttgcatcctctttgaatacataaaaatgaatttcaagttttgataatggtatgataaagggcaattaggacgactttgctcagagggatgcaaaggtctttcccagggattggatgagactgccttttgtgtcacgtgactttattctttctttcccccttccccttctttacagactgtcttgagttcttcttgaattgccagttttcagcctcctcatgcctccgtctcctttagacgacagggtagtagtggcactatctaggcccgtccgacctcaggatctcaacctttgtttagactctagttaccttggctctgccaacccaggcagtaacagccaccctcctgtcatcgccaccaccgttgtgtccctcaaggctgcgaatctgacgtatatgccctcatccagcggctctgcccgctcgctgaattgtggatgcagcagtgccagctgctgcactgtggcaacctacgacaaggacaatcaggcccagacccaagccattgccgctggcaccaccaccactgccatcggaacctctaccacctgccctgctaaccagatggtcaacaataatgagaatacaggctctctaagtccatcaagtggggtgggcagccctgtgtcagggacccccaagcagctagccagcatcaaaataatctaccccaatgacttggcaaagaagatgaccaaatgcagcaagagtcacctgccgagtcagggccctgtcatcattgactgcaggcccttcatggagtacaacaagagtcacatccaaggagctgtccacattaactgtgccgataagatcagccggcggagactgcagcagggcaagatcactgtcctagacttgatttcctgtagggaaggcaaggactctttcaagaggatcttttccaaagaaattatagtttatgatgagaataccaatgagccaagccgagtgatgccctcccagccacttcacatagtcctcgagtccctgaagagagaaggcaaagaacctctggtgttgaaaggtaatgcccctgctcccttcccaagcacggtcctgattagccgggttcactttgggttttctcgtagagtgacagcattctccttaccctggctaccaaagaccaaaatagactttattcttctcttcccttctatgctctttattgttttggtttagtaagaaaaacccagcagcactgaactggaagccagaagatctgggttctacccttcatttgggttctaatttgcattgtgcaagtcatttcacctctctgggactgttttctcatctttctaaaaaggggctttatacacaccagatggtatctcaagtcatgcctggtctgctagctctattccaatcaatcactagttggaaagttattgtctctcagacttaaccaatgttgatggaacagaggaaggagcaactatggtgaactacaagtaaacctacaggtaccagttcttactgtgggaaattctttctctttctcacctttctgaccagcttgacttttatgtggtttataaagtgaccttgaagaagggcagagcttcttattctaaggccccatataaagtataagttcaccaattacatccattcctctgccaaggctccaagggaacagagacgtttttatgaaacactccccaacccattgttttttctggcctcacctgacaacggttggcatcatggctcctcccaagatggagtaatgggtcacttgccccagtatactgaatgcagaataactgagattagcagaactgagctctggcagaaggaattattcaccactcttctcggagcaccttccataccgtgttgcctaacctttccaagtagcctgcatcctgtgcccagcctagttgcacctctttgccctcagatactgacttttggggcactgtacatcactctcattcggcatcttttacctggtggtggtagtgagagatagtcgtcttctctcttctctcctcttgtgttctgagccaaggtacgcagtttctgggtcacatctccaaccagtctcctaaagtgtgttgaccaaaggtgttgctgagtttgaacacattgcatatttaaattgcaataggacatgtgggtgagcaagttagttattttgtctctatgggacagctttgccattctccttcttgtcttcccagtggggcattctgccttttgttaagcagtgttctgggaattatagttctgaattccactgacacaatctcctcttcccaccctccgctctcctcaaacttgccctcatggggctacactaccacaaaggcacatctctccttagggctggtgggctttgctgggaaggagaacatgaaagaattgtatgtagagagttccagaagcttctagacatttcctggtcgtggtggttgtggtgggttttcttgaggtcacaaatatgttcagatttcctccatatagctctgtattttattgtttctgtattcttgtatggttgactttgagtgattcccaggatatttaccctgctattgtcttaccataatcttgatgtgtctagcctcttacaaatgagaaaatcctaccgaggaatttcccatttgtaatagtttgtcttggggagcaaagaggaggatagccaatgatcatgatgatctcctcttttctcacgcagagcaggtgttcatgataaaaagcaagtcttttgtgtcttcatgatctgaagagaggaaacaacacggatcaagatgatcctagacctcctaatcatggggatgattacaaggagttgcagaccctactctctattttgcagtgggtggagttgtggataggggtgacccatcagtcattgagaaatgaatctcctgggtgctacttgtgaaagtgaggatcctctctccctttcctgtggatgcagctgagattctggacagcctagacttcttcctcagtgtcagagtaagattgcctcaatggggcggggcaggacacactgctgacctcaccactgggcgccctgggcagccactgcgaggcctcgtcattttcgagttggtgagacaccgcggcagtcgacttggaagatgctctggtggtagaggttagattatttgtagttttgggggccttttcttcaaatatctgggaatttcattgaaaatatgtagttcaggagtgaaggggtctatattctactttataattatcattatcattttggtatcttttgggagaatggcctaaaattgggaccaagatggaaaagaagggaaaggaatgggtcaatattagaatgcccttcgttatcctttcaacttggtaaaccagagattaataccatagcaccactgtggtgaaagacggggtgggcattccccaaaggcatgaccagcagacttctctcagattcttgagtgggtcaagcagaccattctggtctggcttctcctctcagatttatttgagtaatcccctcccttggtgataagattgtgtttcagcaagagtggtagtggtaccatttcggaaggagtaatttttgcagggaagttggtgggaggggggcatagttagaacataaggaggaaacttctaaaggcttgttagtttattttcagagatttcagtacaatcttgggtaatttatggctggcccatctgatgctctggtttatgtttgtaaacactggttgctaccctccctgtccaagatccttgtccccctgtctccatgccatactctccatttttggtgctgtctgtcaagtagagcggctgctaacttgccattttagtaatgctgtgtcaggttgggaagaaaccgatcagaggcatggcagcccctgggattaagttactgttctaatttacagtgccctccctgttgtgacctatgctagaatctatgttttagtctcatcttctaaagaataaatggcatcagacctgtgcttctcttcaacctggtgaaaatgatccaaatgaataaatatttagggatttgtgaggtctttgaaagaattatattgttttactcaaagctgatttttaatcaactaaaacttgctttctagtcaaactgagtaagaaagctgaacaattctagaccatccataacgagagctaccgtttttgctataaagtttttcaggctccctttcttttcagtaaagctgggtccagggaaataatttgtcatttacttaggtaggaagaaatagtctactgcccctttttcttaaagacagtatatgccttcaaaaatgttattataaacattttcaagcatatagaaaagcagaaaagtgtgtaatgaacatccatacacctatcaaccagattaaacaattatatttttcctatttgctttctcttttctgttgaaatatttaaaaatatagataatgttttaatgtatttaagtatgtttaatgtgtaaattaatgtttcaaattcaataaagctggaaatattttatagtatactatgaacattttcactcgtaaacacttgagtgtcatgtacccatttttaagtgcttttcaacttcgaatccctctgtgactgactggcagtcaggtctacagaggagcttccctccctgggagtaggagggctccaggtgcctccttggggtctgtgtgtcccccttcctccctggtatgtcagagcccatgcctctacttgctctatgctgttgtaaaacaaggaatgaccaactgctacaatctttataggactgctctgtaccaaaggcctttactgggggaatgtgagaagaagagggaaatggtttaaaaggatgatccatggggaggatttgatcatgcaggcagttaggcctttatactataaaacttcatcactccttagaattgagcaccatacattgcacacttttccctagttgaaaagaattctgaaatatactcttattggcaatagagttctatgacaaagtggatggctaggctcagaaatcagagacctgtgaaaaatattctgtttctgcccttttttcgggggtggggtggggaagggaataaaagtctccccttttctctcagagatgttatgaggattttaaaaaatacctgaaataaagacatatctacattcataaacgtgctgttgttattctgagcctctggttaacatccaaggctaaaatgtcaaacattagccttgtagcaaatgatggagaaatcaaggcagaacttcggatctagtcagcctgaatgctagccttggctcccctctaactaggtatgtgcccttggggaaggaactgaatccttcagttccttagttacctcattaacaaaaagaggatataacaatagctatctcaaagtgttagtttctgaaataaatgaattaatgtgtgtaaagtgttcagaactttatacacatacatggtaagcactccataaatatggtagaatgtttttattgatattgattgaaaggaaatgatagtgccagtacaaaggcaaattttgttcctaaggagtacaaataacaagctaggtatagtagagtgtgtgtgttgctatggcctaaaaataacttggtgactgttaactaatttaagttgcatagagttggagtgccaagtaattgcaaaaacatattgggccaggaggctggagtaatttgggtatatccagaattatttgttttagggaaatttgtaaaaacatgataataattctgtccaaataatgtcccataacaaaagcataaaactttttagctttgctttttgttgcctctcatcatctcatcaggaggatttatttttggaataaggattgtggactgactataaaagggtagatggaaggaggggtgcgctggttcctgagcctagggttgtgttgagttagaatgtgaaggaaaaaggagggaaggagttnnnnnnnnnnnnnnnnnnnnnnnnnnnnnnnnnnnnnnnnnnnnnnnttcttgcttttctgttcctcattcacgatgtgctcagcagagtgaaattttgctcacttacacctgggttcaaatctaggcatttccattgaccaactgtatgcctttaggcaaatcagggggcctctcagaggccaggttttcttcattgtaaaacagggacagctccagcatcctaggttgaaacaaggtgatacaaagtacctggcatttgatggctgtcaataaatcaagcctctggaccctgctctcctactctcatgcactaatgtaagaacctcttacattgcaggggcaggggtattggggaggatgggcaagtcgttctaagcacagtactgtgggagcctgttaagtatgaatactcttgcccttaccaattcagaacagttaattaacttaatcatccagcttgtcatggacaagttcaagaaactcctctcctggcaataggagacatgatttcacattagaaaagcaaagcaggggaaggaaactgaataggtaaagcactttgcctatttctgttttcaaagcacgtgtgtataggagaaaggagaagggagaatggtgaatatgtacacttttctacttggtcctttgggcaaacccatctgaaggtctgacaaaattacaggagcagaaaaactttccgtcacatactcctggtgcatacaccctcagggactaagtgggagcttttgaccagtagcaaaaatctagttccttaaaccctgcattatcagaagccagaacctccaagccccagcattgctgaagagcagtttgggcatgaatgtgtgatatatcggagtgcttaggcagtttaatccaagttggttgaaaaagatagactacatattaaggagagaaattctagttccaggagaggtcatctcacctttttggaactaaagaatcccagctttgagaagagcaaggaactttagagggcccctaatccagtagttttcactgcaggctgttcattggtatcacctgaaggtgatttataacctatgatgcccagttcgtgtgtccagaaagcctgattaaattggtctggggtgcagcctgcacatcaagatttttttaaagctcccaaagtgattctaacaggcagcaaagtttgagaaccattgatctagtccggtattctcattatgccactacaggaatggggcttgtccaaggtcacatgcatgattaattttagagatttagtccttaatgttaaagtaggtcttgccaggttcaacagattcaatagatatcaacagactgaggtattcgtatgtatcattatttaataacaacagaatctaatatatagcataaaatataagattttttgagtactgatgccttttttcttgaattttgagatttcagttcagaactaaaaagaccaaagtctgaggactttcaaaaccagcagttcatggtctatatatttacctggatattagaatatggaccaaatattaatgttgatttaatctcttcatctggggaacctagtggtttaagctgttaacctagtggtttcagctgttaacagctatcaaaacaggtatcaaagaagcccaaccatcttaggcttctagggactttttggtaggtggtctccacagctgtacaaacttgtgggcagaggagattcatttgtttgttcaataaatattgttgaatgcctttggtgtgctaggcactaatctgcaggctgggcaatctgcatcacaatgcttatcattcaaatgcaagaaagacaacatatatggatgggaccagtcttccagatcctttccatcttggaaattgtgttcatgtttctattcttcatcttcttctgccacacaatcttatttagggagtgtttcatcttcacgaaattttgttctcctgtgaagcacatgtttgtactttttttttctttttcttttttaagaaatagccagccgggtgtggtggctcatgcctgtaatcccagcactttgggaggccgaggcagatggatcatgaggtcaagagattgagaccatcctggccaacatggtgaaaccccgtctctactaaaaatacaaaaattagctgggcatggtggtgcacacctgtagtcccagctactcgggaggctgaggcaggagaattgcttgaacccgggaggtggaggttggagtgagccgagatcccgccactgcactccagcctggcgacagtgagactctgtcgcaaaaaagaaaaaaaaaaaaaaaaaaaaggaaatagcctagccttttctaaatatgtcatgggccaataggatttctttccaatgtcttgatctgaaaagaaatgattcattggtttttaatgaaaaaataaatatatatgccctctgtgcctcaaaagctcagggctgacaagtctcctctgtgtgggagagtgaaactttgtaatttggaccccctaattttgtacatgttgatgataggaataagggcttcgtttattttcactgcatgctctctatggaaagaggatgtgctaagcaaacaagcattgtaaacaatatttcagaggcaaggttttggcctgctttaaaaaaaaaaaatgtttgcaagtacaattaaaaaccagtataagggacaggggtgggatgaaaacctgtctctaagattacgaagcctgcgttatttcccctaaatccccttcgaggaagatttgaatccctcatcaacaaattttcattgattatgtttctattatatatactgtagactctatattcacgaatgtaatcatactcattcagaaaaatataggaagagaaaatgagtatgacctgtagcctgaatttcattataaaagatttaaaaatatacattttatattaaaattgatgtaatcttttaattatgaagtctttgattctttagatgttttcatccataacccaagagcaagatcttggcatcagttttttccaggttatgtctatatcatctattattacttaaaagttggagttacatatagatatatagatatatagagagttatagatatatgtaattttttttcattccagtcccccacccgagcaagacccatattttatgtaacttaaaagtaaagaaaagaaactttgagcgtatgtttttggataaggaaatgagctgtgcaggcctagtactttcatataagataaaggctcttacctattctctgaatctggcaaagtagagaatcacttacagaaagaaaaggatttgtggatgcatcaaattatctgcattgcccttaatgttttatgtgtggtaaaggcctactcaggccaccgcccccaaccctggcccccgacttgaatttcatagaacacaaaacaaagcgcaactcttcctgagtgcttccacaacgggattttgctttcttgccttaccacttcagaatggaccaccatcaggcatctgttgtccattgcacacatcaagtaaacagattaaactgcccgagccagggggtcgcatcaggcctgtcctccctttgaggagcttaaacctctcgtgttataatgcgaactcgactgatcttattttgtgtcctgaggtaaggaggcagtcaccgttttgcatcagaacatcactatccggttccttaatatcttatatttattttatggaagaaataatctcacattctttgtatcacagccctgagcttcactaccattgagctaaatattaccagctgttgctactggcaagagagaagcaaaaaacaaattgaaaggagaaagaggaggggtgggggagtggacagaaaagaataacatgagggttgagggtcttagggtgacagcaacatatcttctagctcccagacctgagttctgggctccagtattgaagactgtgagtcattttcttcaatcattacagtgtttcttcctgtcttaaaagaataagactagacacaaacttctaagagggccttccctgaagagatagaggacattttctattgtttcttttaatttctatttttattaaaatgctatgtttttatgataagactttaaaggaacgggtcttatggttctcatgaggtgatattttaatctgccagcagaacatcagttaatcacatagaactactctggctctgtgaccaacctatcatccctgaaattagaaaattattttccagatagtttggaagaaaaacaagttaaaagctattgaatgctttctagatgctgggcattgggctgtcatatatgtgtcttatttagttctcagagaagctctgtgaacgtcattttatatcctgacttttatagctcaggaatctgaggaacagattaaatattttctcccttgttattaactagtaaatgagagaataaggattgaaatccagttcttatgatttcaaagcccaaattcttttcaggctggccatatctatttgcaagtctcattccttatggtggctttagttgtgctttacctctgtggtgccttagttataatgccatcttcctttccccatttttcttgtatatcctcaaataaaaattccattgctaaggtgagtagcctattctgtgtccttagagtagactggcttcccagtaaccttgcctcaaattatatcccagcttttggatactttaaattttggtcatgacagttttttaaggaataaaaatttgagcaaaacaaacttttgaaaactgtgataattctaacatatatgaagtatttcttacatgccagactctatgccacaagtgttatgtctcatgatccctttccaatttacatacgagggactgaaactcggagaggttcaggcacttgtccagtgttactcagctggtgcctagtggatcctgggtgtagctctggtatacttctgctcagtttgcttttgatatctggaaccttagaattcattctcctagtagcctgtggatagaaggatgatatttcctgcttttgcacacattaataaacccactttctggagtaggaagtagatgaacaaaggtaaagaaaagtacaagtacaaagttaggtaaaaagaacaagaaagaatctgtgacgagtatgatgactacatcctaaagactctaatgccaaaggtatttgattgtttatgctttatattcattatctgtcctattagtgtggatgataatgaaaactatagattgttttccctcaagtaggtgaagaaagaatctctagtaggttatgattgccctttgggaaggttagttatcagggataagtgaacagatcctatcaaaccatttactgtttagtttctctcctctcctttcctaatctttcttatctctgttcttcccttctacagtctaagcctacaaatatagctcaggtaatctggaggtgtggcaaggacagaccctgggaaaaataataatgaacacatttgaaggacagcaggatggactccttggaatcctgtgttaggggcagcattcatagaggcagaatctgtcttctgacagagcacccagcttcacacagtgaaagtatgtgactgtcctctcagatatcaactataaggtttcgtcactaagttcattttatgctgctaaaacagaatacctgagattgagtaatttacaaagaaccataggttatttggcttatggttctggaagctgtgaagtgcaagagcagggtgccaacatctggcaaggtcagcccatggtggagggtatcacatgatgagcaagtgtgtaagacagtgagaaaatggaggctaagagttcatcctttttattaggacccacccctgtgatgatccactccatggaatggccatgcaattatggtcttaatccactcttgagagtggagccctcatgacctaatctcctcttaaaggccccatcttttaatactgctacagtgacaattaagtttccaatacatgaactttgggggacatattcaaaccatagcagtaaggtcaccccaaacactcaggtcctccagtgagaggggaagggagggggacatgggtgatcaaggcagtagaattagtgaatggagaacaaaatttaaaaatctgagcattttttattctgaaatataaaagtaatcaattttaagaaagcttaaaataaattcaaggagattaacttcactgatcataagttctcacatttacatggcaaggtgagttttctgaaccacaacaaccccaggatgactttagaaatgttgaaaaaccacagaattatagtccattgcacagcaagcattcacttactctatgttgaattagaaaggaaagacatttttcaaagaacatggtgttacagaattgtgagagatgttatcaagcatttgatctaaccatcccattttacagacatagaaactgattacttatccaggaggatataaatagctattagcagtactggcataggattcatgtttcctaactctcagtttagggtgtttagaagcccaaccagtatataatcctttggattagtatctgagttgttgttaaataagcaaatcttgtgggttcaagtattcagccaggtcattccataatttttctcattacctttcttaggagcgtatatagtgactaattgaatgagccggctgatgctcccttatatttgtattcagtttatatattttcttgcgaagggagtatagtttggaggttaagggcacagattctggaaccaggctgctgagtttgaattctgattttgccaattattataattttggacaaattcacttttctgtgcctctgtttgcttgtctataaaatggggagggtaatggctcttttctcatgggctcaattgagaattagataacatatgtagaagtgctttgaacaataacgaatgcatactagctaacatttattgaaaatcaaccataattataatattgaatctctacaataataattcataatctgcttatattcaactgatatatgagtggtatagttcagtaaaatgctttgatgtcaccactaatgcagtacaagtaggagatacttttctgatgcttggtagatctttttgtttaaaagtttggaaaaacccagtgtttcttttggggtggatagataactacatagggtttttttttttttttttcctgaaatagtgctgtgctgaaaaattatatgctatttctatgtaaggaaatcttataaaagtcttagcagaaacactttatgtatacttattgttaagatattaagaacattttagaaagaaaaacataatattactaatcccgccctgactggcctagtttcatttttacatttctttttgttctctacccatatatgtgcatgtttttcagggtttctcacatagtaactgaaattcattttcactttatattgcatgtacttttgcttcctgtgttgtgatcatagattttcttctttaatgctgtaacctgtcttattaccacattttacttacttgcctattaatataaattaagattgtttccaaggttttggtatgacaagagaaacctcttgaaggaaacccttgtttggaattttctccaccttcccacccaactgcactccccatttagagaaatgggtactagctgccattttgggtgctagttgccagtttgagtttatttttccccccaattctctttcactttttaacttctgcttttctttcctgagtgtaagatccaaatacctatcaaagttgtgagtttttagggacatctttatccttgaccacaggtcttgatactgatcctgaatgtgtgtgtttaccacatgtcctgtaaggcacatattgcagatcttggacctctttggtggatagagtgaggacatgaggaagcaccactcagcgctattaaaaatcagaagctattgtggaagtgaatgatctggcaaggctaacaacggctccttatttcataaatatgagtcactcccagttttacactgtagataaaacactctgaaagggacaataaaagcagcaagaggtagatttagtgagatgctgagtagatgtgtttgtgtctcccttcctctcaacttttctaaatcctgaggttttagtgcagtgctgaagtcttctaggggcttaagcaaacacaggcagcaaaaacacatcagaatggaaagataattcccattagttcattttgccaaattgaggtaaagtgccctttaaataggagataattctttgacagataattagcttgtcttccttgataaaatatgtgaattggttgagtatattataattaattttgcatattatgtaaaaatctattcatgtacacttactaggtgaatctcttaattcctaccttgaggatggctagaaagccccatttctgctccagtgaatagaaagaactggaggaatgctgtggttatggagtccaggaagccctctcttacaaagattgggaggagctgaatgtggtatatcattattaaaagacacagagacttcatattaatatatgcatttattaaaacaaactttgagaacacttttaggcctgagaatgagatgctacaaagttgcctaaataattaccttgaaatcaatctcttgctagtgacattcttctggcttcccaatgtggagctttttccagggagtggagtgagtgattggctgggtgcagctagctgttggctgggcggtggctgtgggaagtagcctgagagggcacagaacagttgctcaatgactcagtgagtcaaagctcctctctgcagtttttcttccccctactccttaagccattctgagctccttcaggcatccccatgtatctgcgcactgcttttggggtgtcttttctcattcaaagctattgtcgtggctacttgatttggctcatattaaaacgtgcactgggagatgttggagtgctgaaataaaagagcatgctgtagttaatcgatcagagagcctctcttctccaagttgaagtgtttcttttcctgaaaatagagtggctatttgatgttccatgggagccgaatgacttcctggtgtagtgtggcttatagcaccgtagattttagtcattggtcactacccctccatgtgcatgcacacacattcacatgcaaacaaacacatattttagttaacatttgtagaatgggaacaattatgacactgagcattaactcatttaatggggatagcaatagtattaaatctatctgcagcgtccaatatagtagccttgctgcaagccaaacgtggccattgagcacttgaaatggggccagtccaaacagagatgtgctgtaggtgtaaaatatataccagatttcaagactttatatagaaaataatgtaaaatatttcattagtaattgttttaatattgactcttgaaatgatatttgcacatgttaagaaaaatatattagcaatattttacctgtttgtttttactttcttgaatgcagctactagaaaaaaaaaatgcttgttattatagtagcctgaattccatgtctatcaaatgttgccgatctcaatgtggtaataacagtattattatccccactttttagatgaggcaattgaggctgagagaggttaggtaagttgcccaaggtctcacagcacaatgccaaattcagacctgcctgactccagagcccacacccttcatcactaagaaactgttgtataatagagaatttgtctggccgttgtcctcagttcctgggaaataatttctaaacccttggaactccccgagtgttaggagtgtctttgttatgcatgatgagccccttggatcacacctgtgtttatggtaatgcgatgactcaggataagagtttatcatcagaaagacatccacatgattagaaggtcagggctttgtattagttcatcttcttcagcagaagagagtgggactgaagattgagttcaatcacaaggccaataatttaattatgcctaagtaatggaacccaataaaaactctggacaccaaagctcagttaaacttcctagtgaacacattgctgtgtcagcagggcaatgtgtcctgattgcacaaggagagggcctagaagctccatatgcaggaccctcccagatattgccctgtatgtgtctttatctggctcttcctgatttgtagcttttataataaaaactatcatcataaagatagggcttgtgttctgtgagtcattctagtgaattatcaagcctgaagcattgtagaagccacagaatttataaccagttggctagaagtgtgggtggcctgggaacccctgaacctgtggctagcatctggaagtgaaggcattcttatttgagactgtggccttaacttggggagtctgcactgactctgcttagtcagtttcagaattatattgcagtattgcaagaatagactgccttttatttggatgtatgtattaggagaacagcagctgagagagctaagtgctgcagcttaacttgcttatctctgtaacaccatttccttggtgacaatggccatttgcattctagacttggaaaatgactcaatctttgagcaactgcttttgaccactaggatcagttgggaggcaggcaggcctctgagaccttcatactcaaaacccttcacgctgtaatctctggggcctatttcatctcccagttggcatcatgttagcggtggtgacaaacatatgtgttggcccctctttgacaccagggattcttaagtattggttttgggattgagatgttcatgggaagctgacacagggtgatactatgggtaaggagtatttcgattttttgttgtgttttttaatcatttgccttgtctggaattacgcttttgtggtatgtcctattacatttcataaacaaggtatttagctcaattgttgctttttcttttggggcttttgtttggatttttaagccaagatccatgtgttttatttattttggtttagtttcttcatccctgcttaaaatagacactgcctcttgtctgtggtcctggtatccactactcttctgtttcctgctcaggcctggcccatgttctgcaaggccctcttaggtcaccagctcctagaaagttgactcctatgagtatctcttggggccaccttagaatgcagatttctaagaaaagtccaacataaactctgcagttattgggagaaagtttccgtcaccagtgaaaactaggaataaaacaagattttggaatgtataaaagaagcctctttcaaaaagaaatcaatatgacttgttttttcctaacatgggccagccctgggcacttttcatctgccaccacaccaggcctgctcttcagaggtgttcagctttaagactagggacagttcacaccagataactatgaggcagtgttctctgccactcattgactgtggaagtctcagtcccagtttctgagagggggagagcaaattcatcagaaccaactgaagaggtacagaacatgaggcattcacttctcacacagtccctgagcatctcaccttccagaataccagaggcttcaaggccctttttctacctttcaagagcgttatagcgtgctattgctctttgagagatctagggctgtaacagcccttatttttagaaaagagagaactcctgtgtttgaagaaatagctcttatgatatgatcgtgtggtttcacatggtcttaagttcaagtaacttgcccaaaggtgcacagttattaagagggataagaggaactccaaattactgatttcagatccagtgttgtatcccttcaaaaggagatagaagaaacagggccacccggggttggtgaagatactgtcagaatcatctgttactgcttaccacatctaagtgagagggtcagcaagctcttgagagggcccacctagatcttagcttgtgtataccctatactgagcactgtgcccccatttcatatttagtgcttaataaatgtatattaaactgaattgagggcccctcctgctgctcagtgacatccctcagggtgagtttccctcctgagccttcttttccctttcatgactaccttccatgcatctctaccattcatcactcatatagaatgtccaagaagtaggggcgaggagagaggagaaaggggtaagaggccaccaagtgtgatttgccttggatttcagccctccctggaaggtgcccatttgtcacatttaagggaggcccagcacccctgtaaattgcctcttcctcataagtgtactcagccctccttcccagccttggaatgccaggatttctaaatccttgtgctgaattcacctggcgagtcctgcacctgactgtgtgagttacagctggatggcattgttcagctcaatcttcagtgtgttctgaaaatgtttcttcttccagtcctgtcactgaatttccctaaagttccttcctcctttccctcattagatttctctttggggactatttttttcaatcaaatctcgcaaatccatagcataatgctgaacagcatataatagatgctttacaataaactggtcctatctcatctcattccagtgttcaatgaatctaaaaatatttaatgagcacttactatatacaattcagatgctaaacagtgaatacttagaatttctattaataactacaatgtagtagctgatttaattcttgcaataactattgttgcctgttaggactattattagctccatttcagggtacaaagaggtgaaacagctttgtcaatatcatactggaaagttgtggagacagtctggccctagtgcaccaaaccattacactctatttcctctaagagaaagaacatcttgactttcttggggtccacactttaataagaacaataaacagggaagaaataaataggtaacttcagatagcgataagtgttctgaagacaatgaaactcttaaaaacttcatgatatgataaaagagatttggaagggtagctgtaaattgaatgtcagggaagacttttctgagaacacatctggtctgaggtctgaatcatctatgtgagtctaaagaaaaataaatttttatcctaccatactttcggaacacctctgtggatttatgccccctacacacagagcagtcttccagcagacactagcagaatgtcttgcaacttaattttgactctacctggtgttagcttcagaccccacaagttgtggctcagtcctacaagattaccccaccttccccacactgtttataaatcagtatttctgcaaccccctccctgagtcccattaattttctaggacagttcgcagaactcagggaaatgtgtttacacatttattataaaagatattacaaagaatatagatggacagtcagatgaaggagatggatggggtttatgggggcttcattacataggcatgattaattacatcattggtcattggtgatcaactcaaccttcagtccctgtctcctccctggaggttgggggatgcggctgaatgtcccaatcctctaattaagctgttttaattctggtgaccagctcccttcctggagctatttaggggcccccagccactagtcatctcattggcattcagaaaacactcataacttcagagattccaggggttttagaagctatgctacaggaaccaggggcagagatcaaatatatattttttcatatcacagtatcacagtgaggatctacaggaagggagtttgcggaagagggaacagcaaatgcaaaggcctggaagtgggaagcagagcacccaggctttacacaacctctgacagctgattttgttcttgccattgttcattcatgtcatatcgtaccatatcatatcatatatatggtttatcaaggctatattgaagttatagaacaccagagttgggagaaacttaaagattaccctaagtcctgattgtataggggtggcaaaagaggtcacagagctagaacccagtatctttttagtgtggaaggaagggctgccctctgagtccttgctgtcagggcttttgttaccctgtgcaaagttagacatggcttcaggggaaatggtcgaaagtctgatggtgccagatacgggatgcatcccaggtcagcgcttcattctgcgtgccccaggttgaactgaccattacttggctggtccttcacttagcctcaagtccatgttgacaatatgtaattccagcccacctcctcagagacaagcagtgtttttaattgttttgttttccccctaatctcagaaggtggtcacccaggcagggacatgctagcttttttttttaacccagtgtaattttgtatgtctcttagtgcatggagacctcaccttgcttcaggtggacctgtcaaagctcagccctcatggtacggtgtgatcattggacatggctgagtccatgtttaaggaaagcccatgccttttctttctgcaagttgatcctttagtactcagccttgctcattatattcaccaaacatagaatccagctcagtgacttgaggaagttgttgctatgccttttgtgaagtgaaaacatcggttcaggaaaacaattcaaattttgatgctgacatttgatcctttcccctaccacttcctgaattccctaagccagagctctttgacctccagatcctactgaaatacacagttatacatactgtttgttggacatgggggttttattcaaagcaaactcagatgcagcatttttggctgggcacttccatacatgattttagcaatggaaccctatccaggcttcacctgtgtaactttgtcttgcttactgctttcccccacccctcctgtcatggatgtttctagaggaccttttgtgaatgtaacttccaatgggaatgtttcacagtagaaatatgctctcctgtgaggctcgcatgtgacatttctgaagatttatttaattggactttacttaaatcccattgggaaacatacttttgctgtgaagctgtgatgtgtttaatttggggtctaagataaatgttggtcctcggggtggatggttgagcaatagttttccttttgtacagtgggtttgtgtaatgaatagctttactgggctttcctctgtttgtttgtttagcaatgcttcattatttaaacttctgcactgaaaggcaagaatgtttttagacattctttagagacttaatgcagaatatctggttgagctctcgggagaaatatggctttgtgttttatagcactctcctcctgttaacattcctctctctgcagcttcccaggatgatctcatggatttttccccctcctttaatccgtcttgatggattaaccagtattaagtttgagaccagtgagcaaaaaaggtggagccctaacatggtatagagtagcctccccagtacgcagaatgtctccagctaaaatattcttccgcccagaaggatgccacatggaggtcatgtgccagtgctgatctgaaagggcatatatctaatgaggagggaagtgtctttgggagaggagtgggcttctgtgcgtgcatgtagctggttcatggaactaaggttctacaaggcttactgcgcttgccttttataggcatgctggtcctttcagcacacccccaccccctgctgcccccgcccccacccccaccaccctgccacccccattctgaccttggaccatttttggcttggctttaaggtatgacaccaagttgggttggctctcaggggctttgttctcaggaagcccacaagttttagtgtggctcttcaaaagtaagtattatacgttgtatttctaaaagtaagctacactgggaattacaagtggcactatattcatttgggctgctttaaccaaatgccgtagactggatagcttaaacaacagaaagttattttcttatagttctggaggctgtaagttcaagattggggtgccagcatggttgggttctggtgaagcctttcttcttggcttgcagacagctgtcttcttgctgtgccctcacaaggcagagaaaaagagacagcaagctctgtgttgtctcttcttataaaggtactactcccatcacaggagccctaccctcatgacctcacgctggggattagggcttcagcatacgaatttgtgtgtgtgtttgaatatggggaggagagatacaatcagtccacagcagccacaaaaaatgcattcagaaaaggaaagggtatgaattttgcccaggatttggagtgtatgtaaattacaccatttggtaaatcagtgcgttctctctctctctctctctctgtttcttttcccctcccccctcttttcttttcaaacacatattgatcacctgttgtggactttggaacactcaggagcttcccactgaactcagaataaaacctgcctaagaggccctgtgaggagggtccctgcctcccttccttcccctctagcccttctcctcacccgcctcttgcccagtcattgtgcctccccacatttggctcccttgagtcactcagaggttccctgagttccctgcctttcccagtgtggtgttccctccctatgttctcctggattccgtcccctctcatacctcagagaggctgtccatgaaccccaatctaattagtcccctctcatagcacccaggaactggacagcgtcttccgttatgacttatcttaatttgtgactgccttctggaatctgtgtttatggttgtcatatgtttcctcctgatggagtggggaggggcagggaaggggcctctgcagcgtgtcactcacctcctcaactcccagaatgtttggggagggtttgatcttaaatacaagagattataacagtgaaaaatgtgttaatgtaactggcatgtctgttaacaaatcccagacttgatctgagtgtttatggtgtgcatttctccctgggaaccagttggtctgtgctaacataggtaaagtttagacacgtaccagaaagaaaactgaacttgcaagttttcaggaacatgggggctggaacttggctgtctttctgtcggcccctgacccctcacccccagactggatcttggtaggcacccttcttagccattcacttgattgaagcccaaaatcctttcttggaaagcaaaaatacttactcttattttctttagttggcatttttgttagtgagaatggagttcaatagaagtagacaaaattctggtggaaaaaaaaatgagactacacaggctgggaggaaggtctgtggatggaggggacaactggaaccaccagaaacatctgttctgacccttctattccagactaggattaagggagagcagaaggcacttccctgcccctctggcagagggactgacttgaagtcaactatgcccacaacctgtcttcaggtggttcttactgaaacctttgtgagacagaatggggagggtgagttaaagatggtattctctgcactagcagagccttactgtgtgtttggctggcagggatgagtgctcaatcactcttcccagcccacctttgactttttaaaaataggtctaacaaatattctgtggattcgtttgaaattcaagcatcaaaatgtattccaggtagaagtctctctttcatgttttcttcccatctactgctgatggatttatgagagacagagaaggtgtagggagagggagagaagggtagaagaggggagatggcagggacagggagagaagagggagaggggaggggaggggagggaggagggatcagggtagaggagcaagagttggggaggagaggtgagggagagaagagtggagaagggggcaaaggggatagagatagagaccaaacccaaggccctggtggggaagaaaccagagagagtcatagagtctcactgacttctgcaaaacctgaggggcttcctggctctgggaactcttgagatcttaacagttcaaatcctgctcacataaaagtcatctgctcattaaaataacacaaagctgtttaattgttgtctttgtggaaaattacatgactgtcatcagctgttgcttctggcagtgctttctgttctaatgtaaataaatgaggtaacagatttaaagaaacaggctgtatttacatacttctgaggtatcctctcaaaacaatctgcctgtgttattcaaatacacacaaattaaacttgtggtagctcaaacattagttattcattaaagccttaaagttgaaatggtaggaggggggcaagagaactgcacctcccttcagggggtaggaaccagaggctgacttttctgtgtggactgagctactccagccggcggaaatccaatccccagctcttttctataccaattctgccctgaggcaacttctgagccaggaggggagggtggtgagagcagaggggaatctttaaagctctgacaaaaactttccagggtcagcatttcttggaaggcctccaattaaactttattttcaattttcataaatcacaattcctaaatcattggatgtttctgactcagtttacttttttgaggtaaatatgtgggcaataattttttaaaattcttcctattgagggcatggcaaaggttttatcaaacaaggaaggaaacagtatattcgaaaatataagaaaaatgacaagagacccctccaataaacaagttaatgactggaaaatgtagaagtatatggaacaaaaaatggagaagaaagcacactgctaattatacaaagattaggaagtagcgaaagtgactgttttagttcttggtaagtgtcattgtcaagtattagcttctttctggaatgctgggttttttttaacgttggggtgggagggaatggcacatcatctgagagaaacaatagtaactattgaagtggctaccttgtctgggttaaataaccggggttcgttgtctcacaccaagaaaatttaggacatagacacacaagaggagtttagaagcagaggtttaataggcaaaagaaagggaaaggaaaacagctcgctctttagtgagagagaggtgacttcccagaggaaaaaggccgactggtggtggatgtgccagattttatagtctggcttgaggaggcagtatctgatttacatagggctcacagattggtttgatcaggtgtgaggtttacacagcactcaggggaggctggtcaccccaccctaatcttattatgcaaatgaactctccccttgcctggcgccatcttgtctgctccttactgtacacgtggccggcagagaagggaagatggagccgccattttgaacatgtctagtcgcaggtaattctttcctgctggcatccacacgtgcgagctctcagtttgcttgtctgtgtctgcagctcaactttacaggctgctctctgttgaaaatgatttggggctgcttttcattaaaaggaaaacgttacggaggacttctgtaccctcactatctgcctaagtaatttcttcttaactcctgtatcactatgataccaaagttactatacgatgacaactcaagcaatgtctatttcatgtaagcctcagtattctatattatgttgttttgtccagacaatccaaagaaaagactattgttaactcaaaattcaggcaaattctggtatcaacttttcagaatttttttttctcttaaaacattactaaatactacttggttagatgaactaaataaaaatgaacaacttttattattggaagatagttttgggagggctattctggaaatgatttcagcctatcatttatcactaggaaaacaccaggaagatctttttattttattaagtttttgtaaattatttccaaaaagaaattgaccacctatctcaatacctctttccctgtagctcctattggtatctaacatatcagcagtcacctgtcttcatgtgacttggggctaattcctgtgtacaaagggatttaaataagactagtcctgctctccaaggacctaaattctattaaagctcttaatctggatatacacagaaaggaaaatacattttaaaagaatatgtattaataatgcagttatagttgtagaatgaggctgcatgtatacatataataagttgttgaaactaagtttttatagaatgactctgagaaaaactgtaaacacctcaacttattgaggaaattgaggtatgaaaaagttgtgtgtgtgataacttttctgtacgtccatttcaaaaatttctagaagtatgcatatatttttagagaatataccagaaatgtatttttggctattcgatatgcctaaaaaatgtcttttttttcaaggcttctgaaaatcgtagacataaagaactaaatataatgaggttttcaagggagaccacactaaccaccagccccaacccccactctgcatgccacttcctccggcagtgatggagtgtagactaggctaacagcactgagtacacttttagcagagcagagctacagtgggctgtcctcatggctcctgctttgtcctccctctctggtgatgcccttgcatggggttgcctctgcaggatggtctccttttcctactgctctgaagcaactgtaccagcatcaaaagttcatctctagcaacactgacattgacccctgtagtctctggtcatcttcctgcatctgactacctccagtgctagttagctttgctgctccatttgacagtcattcaaatagctgcagggtttgaatgccttcttaaaataccaggatggctattgtacacacaaaatcattgaatcattacgacagacctaagtagtagtatcctattttatagttatggaaagatagcccagaatacttcaataactttcaaaaagtcacacacttggcatgtggcagacccactattctaaatccaaggcaaagctctttttttttttttttttttttttgctgctttatatatcatccactgtcttttctagagttggcttttaagatatatctgtagataactgtgtctccttcacacaggaaaaacccatgaatggagggactaacttatttttagatatatcttcctaaaagacttaataatatagcaagccaaataatgtggatgggtactcaatgggattcaagatcccattatgttatatgagtatatctgaagttttatgtatatgtgtgtattttaagcttgtgatacttccttgtttatgtcttttcaaacataaggcatctcacatgtaagccagaccacactggtttgagggaagcagtcaaatgacgtgatcataagaagacttctctctgactcatagtcagcctcctaaatctctttcttcccctgagtaagataaatacttctttatctcttgtttcataccttatacctagtgagacagcactcccattcaactctctctgcctctgtttgatagggcctccctttactcttcttgggaaagaaatacaagttccctgggggcaagatcctaagacaatttaagtaatacttccttgggtattttacagtaggaatgattttcatcttgaacttgaaaataccctactgtaaaatacccaattcctactgtaaaatacccaatcacatctatggagtataaagaacatttcatagaaaacaagaagtagaaataatctttgtggatcgagctggtacccaccaccaccccacatgtttctcctgttaagataggtgatattctgccctgaaacttatgaagtgactctgaccctgtctttgaagaagatttcagccttggcagcctgacatcagctccagttcatccaggctttgttcttccacagattcttgtgcttatagaatcttgagtggctctgatgttctgtttccatggagtatatcatagcatccatctgttcctggtataaacaaaatagtatccaacttacagcaatgtctctcccacttataataaaacacctaactctcatgtagcattttatccatattgagagctctgtgagatagaaattattatattacaagtcacagatatgtaaactgagatgcagagacatcaataacttgctcaaggttacaaggtaagtgataggagtcaggagttttaactcaagcaatctggctccagtctatgatcttaaccactatcatcaaggtactgttttactttaaaagactggttactcagtaagaaaaactaggcaacagagaggggtgatcaatatgcttatagcaaactgtagaagagtccaattttagcctacacccctccccctggtctttggacattacttctgtttgctgaccttcagtgagagtgttccttaaatttctggaaacagctcactttctagcttagcataagaccaaaaagggctgtccacctttagagtataaaaatctcttgcttatagattctgcatttggatgtggtttctttaactcacaacccagcgcattgcttctgaatcacattacagaggactcttctgtttctaggactgcagtcgccaaaacagcaacaggagctgaaatgcatctataaagagaagtttcccactaaaactagaatccattgcttcagtaggactgtcactgaactgaccgtgtgttagaagaaactggcaggcagtatttccacatatagttctttaggggtgctaggtattctttgttgctgccatttagaatcaatgtactgaccatactcattttggcagagaacctacttttgacataagctttgaaaatgtttgctgcccccccaccccgccttgcctcaccctaccccagcattgttgctcatggctacaatatgttcgcactaataactgcaggctcttgtgcacataaggaagttagccaccttggtagaaattagaggaaaggaagaaggagggaagaacagttttattttcaaaatccaattctgtggaaaaaccagaaatgcaaagacagtgtttgttaggaaagctaggaccaacaaagtgaaatcagatatatttgtttaggaaaaatagggagctgttgctttctttatgttaaaagtatgttttgcaaactttaaaactgctcggataccttggttcctaattcttttttgttaaataaaattttaaaagtaaaaactcaggaacattagtttacttatatagagtctttatattaagcagatttttttttttttagatctttaaaatggtagtttcccaaagtgatgaaaagaaaaagcacttacaatgtgctggacattgttttaaggtactttattaaccactttaatcattacaacagtacagtgaggtaggtactattgttatccctgttttgtatacagggaaactgaggaacagacaggtgagaaacctgcccagggtctcatagctagtgtttggctgtgctggggattcaaacccaagaagtccagcctcaatactccttctctgaatcactgcactgcacttagggctctcatggactatgcgtgtgcatagatctgttggaatttagaacaaaggtgatgatattgggggtaataagacattatttatcgaatacctggtcgtgtatcaaaacctttacataggcttcctgaactatgaccctgatgggtagatgatattacatccacttaatagattggtaaactgaggcttaatgagggaacctgacttgcacagggtctcacagctgctaggaggcagaatcataactgcagctaggtgtggtttgtctctgacctttgctcttaacctccatgctacactgctcctgctttgtttgttaattatcatgttctaatattcttaaatagtaataaacataacatcatcagggttcctcattaagtgatcagtcactttggcctctggtgatacttgatggggtagggtcggaggaaagtaactggaaaagaaaaaccagattagctttactcttccccctcccctccagatttcaatttcaacccttccccaagagaagaaaacaatccttcctgcagacttctctggaaaaagccaccactgtgagcttccactcgttgttttttactttaagcaccgtccacagagagagtttttaactgcagtacagagctgtgcataagccttatggaaaactgatgcccaagttgattagcagagtggcagttgaacaggagactatttcttcagacccctcaaggagaatttccttgtttaccttatatgtttaaattgtaatatctccttttctctccacccccacccctcccacctccaaatattataagaacagagttcctacatggcttaaacatacaatgcacccatacttttgcacataagcatgctctgtgatttggagcattctgtgtgtctgtctcaaattccctcctccccccactccgccacgggtttttttccccccattaggcaaatggaaggcccatgccacctgttagcattacatcattggctccccagaacacagttgcaccaaaggccttaaacaaagtagttcttcttgtattgtttgcactcaaagagctgatatcatgccaactgatgtcattgtatgtctttgtgtaactgctatggcaactgggcaggtggggagcctccagctgatgtcattgagaaaggaggtgtagaggcagaattttaaaaagctggacgctgcttttttctgtgtgtggggttttctagcatgtgttggtttttttttttttttttaaactagctgcttttaagacaaattacagcttgagtaccctaaataagaacagagaggtttttcccctgcttttagagccttcttttgaatttgttttattgttcttccctctcatcttatatggaaaaatgtaacaactgccttttttgaagaaaaaagtgaattaggttcccatcacagaatctgtgtggaatttgggtttttgtggaggcgaagctgagcagattttaactcttcagaatcccttttgtggaggctgtgatgatgacaatgggtagtttttatcttatttattttttaagtcttcactggtgaagttattttccatattttctttcttctacttcagaattatctcttcaggttcaaactttattgtcataattgcctagcagaataaactatcatatgtaagggcagaggttaattctagaaatcaactgaaattcgtatatagctcttgtttttcttttcaaaaagctagggtaggttttgacttcttactttcaatgagtaaagtgaacataatattgccctttgagttttctttggatcataaccataccttaaggaaaatatgatttctctcttttacacagccagctccgggtccattggttgtgaaaagtcatgagactcggtctaggttatggtctggagtttcccgctgtggtttgtcaaagatgagacttgaaatggagaagaacatatgccaggctcagaggctagtggacagatagacttcctgtccttattgcaacataaccgtctcttgttcatgctttgggttttctgccttatctcctggaactatcaagacagccacaagccatctgtctttgagggtagatgttgtgttctggtggctttcagctaataggacttttccacttccccctcttttcaaagggaaagccagagtgtatctagttctgtttgagtagggttagagctcagttggcactaataatgtcaatccagattttatagcacttacatgtatattattataatttgagctttgtaataatcctttgggtttatctgtgcatgccattgtgtgtaaaaatattagcagaaaatttaaacaataaactatgatccgtaaattccctaatttaaacaattgttcgttttttgtacagttcttcagcttttggtcaatgttttttacttagcttttaaaaaatttaatattaaaccaaaatgttttatttattttcacatcctttttgcaactactcttttaaaggctacataatactccgtggaatgaatgtaataactttttttcttttatttttgtgttttacttggcctttttaaaatatatataaaacagataacattgtagtgaacatctccatatatctagctaactatctttggttagatgatttccctaagatccattcccaaaagtgagattgcacttgttcaggggaaggtttgcattttaaaaatggagaaataagcacagtttataagctttttatactagacccataactcgtgggaggcagagcagagccgtaagctcaaaagcatgcattcacacatccaaaagaggtttcttgatgggtttatgtgcccacaagccttggaaagtcgaggagtaagcaaccgcgctgctctcacattctgttctactgaaagtcagggttgataaatgtcagggccctacgtggagaatatcaaaaaagattataagagcagtccttcacaccccaccctggcttgtcttttccaagtacttctctgctgatttcacctgtgggcaatcatataaataatataaattaaaatagtgaatgcctgctgagttctactgtgtgccaggagatgtgctaagtattttacacgtattcatttatctcaggctcacaattgcactcaaagggagacaccatcaccctcagtttacagatggtggaactgaagcacagagataaatgaacttaagtaatagtgtcaggaaatgatggtacccagattataatcaagataacctgtctcttccaatgttcctgcttgtaaccactctgctgtattgggagcaaacttgtccctctgggtgaggtgagctatgaagggtgcaagacatgctcctgtggtgctgagattccacccgaggaggtcatctgtgcctttcttggctcccaaagcacagggttctatgtaggccactgagcatatggctctttgaggcaggtcacatttgcagctgaggaagattgcctgatgccgcgtggaactcttgctaggggaacatgccctcatttgtagaaagagcacatttccaaagtgttccatgcagtgatactccccgaagcttgtcttgggtctccaaatggacttttagtttttgttttgttttgttttatttttatttttattttttttgcttaaatacatatttatatatgtatttaaaatatgcatgagctacaatgcaaactcattctaatggggaggtggcattctctgccagctctgaaatctcagtcacactcaccttctgtgtttgtgttctaggtggacttagtagttttaagcagaaccatgaaaacctctgtgacaactccctccagctccaagagtgccgggaggtggggggcggcgcatccgcggcctcgagcttgctacctcagcccatccccaccacccctgacatcgagaacgctgagctcacccccatcttgcccttcctgttccttggcaatgagcaggatgctcaggacctggacaccatgcagcggctgaacatcggctacgtcatcaacgtcaccactcatcttcccctctaccactatgagaaaggcctgttcaactacaagcggctgccagccactgacagcaacaagcagaacctgcggcagtactttgaagaggcttttgagttcattggtaactatctcccatagggaattttcatccgctgccttccttttccctccagctcttgctttgatatcaagttcaaggtttattcctgtgttggaaaagaaaagctgccctggagttttggagggctctgccacctgaaacagcctaagcattctcctaagtcatagcctgtcgagtgtatccaagccatcaggatggatataaaaggacagtaattgaatttgttgggatctgttcaactagaaatcctcatccctcaagttctcagtgaaatagtggtaggggttagcatttatgtgctctgtaaccagaaaagtggatggaaagtaaggaatcggaggtcagagctggtgctactgctacttgatctactagcgccgttgagcaccttggaagcaatatctagtgaatatgacaccccttccaaacatacctatgccttccggtcaccctactaagccttattcatccagcataaggggagatggtactaggtttcctttgacagtctgccccaaactcattgaactaggaaagatcaggttgtgtagacggagtagttcccaaggaggaagttttagcaacagcacgctttgatccccagaaggaagcaactattagcctaatcctaatcttaatttctgcaacttctatagccccaaactgctataagactcaaaatatcgccgggcgcggtggctcatgcctgtaatcccagcacattgggaggccgaggcgggtggatcacctgaggtcaggagtttgagaccagcctgaccaacatggagaaactccatctctactaaaaaaatacaaaattagccaggcgtggtggtgcatgcctgtaatcccagctactcaggaggctgaggcaggagaatcgcttgagcctgggaagcggaggttgcagtgagctgagatcacgccactgcactccagcctgggcaacaacagtgaaactctgtctcaaaaaaaaaaaaaaacactcaaaatatcattttgggagcacctgcaatatagcaaaactcaacatttatttttttttacgtaacttcaacttttattaccataaaggggtggcctagtacttttcctaaatattacagcaggttgttattccaggaagaatacagttaagtggagtggggtgttcctttgtcagagaaagaaaaaaacagcctcaggtttaacagccagtggggtctggtggatttgctgtagtgttgacatctctggtcattttgccaagctgttttccttgctaattatgccgtcagcacaggaccatggaatattgagtctgaaaggaaattcagggtgatcactgaacttagagaagtaaagtgacttcttcaaggtcataggaattctagtgtccaagaaggggccagaatccagggtttttgactcccaagcctgaggccttttcacaacacactaaggcaatgtttatgatgccctattaagtaattcccaactggcaacactgaggatgcagagatactgcagattctttattaataaaatctgagccaaacctggagcgctgaggaagaaaaatttctcaacaagcatatgaggaacttctggttgatacatgatgtgatgttatgactgagattccatctgacttaactccagttggaggaagttaggaaattgttttctatttaatgagtagggtaagatatacttgttctaagaggatttcaactaaagctccttctcacattccttatagattattcaggcttacctgcctttttttttttttttttaaggaaaacaaaaccaataacaaatagcattcagcccgaagaacaactccatatcacaacctgcataggcacaattttattttcattgttatattattggataaactgaaatcttacagtcttgctttagtaaaaacacagcaggttttataaacataatagctttcactgagagtgtaatataagctgagcagcatctaagtttagtgtttataccagtttatttattcctgaatcaagtgtgtgtagtggaaccggtggtccagccaggcactcagaagctcattctctcaccaccatgctttctggtcttgacttggagctaaataccgtgtgctgaagggaaaaagttgaaaaagagagatgcttacttttcttgaaatactgttgactatgagaagtaaacttcatctgtaaatttttaagatgaaaatttacatcaggttttttttccttggtccactggtgggtagccagtagatgtagtttaggtgaaatcactactctctctaccccttctccttccctacctgtttatctaattggtgttccttcaaggaagctttcttagggatgtgttagagtctagaaatgtcattaagaatctgttcaggtagtgcccacatgctattgtcctgagcttttaatatatttgaaaacttagcaagtcttcctctttcaattgctctggattttgagccattgctgggattcctccatcttctgcattattgccacactggaatgtcatacatggaagcaaacgggattgaatgcttgagaggtgacaccctcggcctgtatactactagcctttagttaactttgcaacaactggattttctggggagaagctgaacatagtatcttcctagttaagctttattcctttaaccttaatcagggtttagtaagactaaaactcttatccatttaatgcccgttcctgtacagagcaattctatagaataaagaaagtgttttttctctattacaagtgagagagttgttactagcactaggtttgttaagtcacacaaccgaaaattggaattaacatccttaatccaaagaggaactgcatatatatatatatacacacacacacacacacatacacacacatacatatacatatatatgtgtgagtgtatattttcatgtgtgtgtataatttttccccttcctctctccttttccttcattctttttttttctttcagtagtgtaattccagaaaaaaagagaacaagacatttgagagaaggttcagtgactgttagagtcgacttgatcagtagcttgttcaacgtgaaagttaactgtgttataggtctggcttccggccactgctgtcacctgtgcagcaaactgttcctatgagcaattctttcatttaatcttctctttaaatgtagatgtatagcttcttgttcgtgctgatatcaactttagccagttctggaagttgtgacataagtatacgtaatgaactagtggattatacttggctttaaaactgttttaattcattatttctatacaaaataaggcattgcaaagttgagatgaaagtttctctctccgtgcctctctcttccatcttcccttcatctcttgtctttctcccttttttcagaggaagctcaccagtgtgggaaggggcttctcatccactgccaggctggggtgtcccgctccgccaccatcgtcatcgcttacttgatgaagcacactcggatgaccatgactgatgcttataaatttgtcaaaggcaaacgaccaattatctccccaaaccttaacttcatggggcagttgctagagttcgaggaagacctaaacaacggtgtgacaccgagaatccttacaccaaagctgatgggcgtggagacggttgtgtgacaatggtctggatggaaaggattgctgctctccattaggagacaatgaggaaggaggatggattctggttttttttctttctttttttttttgtagttgggagtaagtttgtgaatggaaacaaacttgtttaaacactttatttttaacaagtgtaagaagactataacttttgatgccattgagattcacctcccacaaactgacaaattaaggaggttaaagaagtaatttttttaagccaacaataaaaatataatacaacttgtttctcccccttttccttttaagctatttgtagagtttatgactaaatagtctgtgcaggttcatagaccgaagatactacacactttaaaccaattaaaaagaaccaaaagtaaatagaaaagacattgaatcaccaaggcctgggatcaacctgggctgtccacacagaaaacaaaaacccaaccaaaccaagccctgttgtgctcactggtgcaaagagaagatcagggcagcttaagtggtctaagaatccttcaggcattctttaaggagaaaaaggatacctttgattttgtgtgtttcatgctctggattttttttttttttccttctctgggtttaagagattttttttgaaatagtgaggaactgaccattatatgccttcactggcttcttgtgcaataatatgatgttttaagtgtgcaaacaagttagagctggcagctgaatgatagacaaatagtgcaaatttgccagcttggagatagaaaggaattcaacaatatatcaaatactttccttcccacctttttccttttttttttttttttctgatttgattctggttacagtgccataaaccttgttacatatgtatatcagaatgtaagaaaaaaaaatttatttaaaaatatttttcgcaaaaaaaaaaaaaatcttggtgtgtttctgttgattgtgtaaaaatttattttcattatataaatgaaactggtttaggatgtgtctttttttcccctctcttttaccttaactcaggttcaagcctttcttaagctctggtaacttgcatatacaacaaagttgaaataaaacagatttttatatagggaaagagagatgaggaagggaacatatccagttttctcactgtgaaacagagttagcaaggaagtggaagagctccagtattgatctgcccagtcactgtcccttatattctcacaatgctgtcatcctctcctgcaaatatcattccttttgcatcggggaaggcttgcattaaggggatcccatctgcctttgcgccttggtgaccaaatccctgccagattgattggtgagaattcagtgatctccctagtggctatttgataaatacttaggacaatcttccatttagggatcttgatgttcctccccccacccccccaccccattgtcacttgctcacttggcatctttggtgacattaaccatgtaatgcgttgcagcaaattgctattgcctactcttttccccagcaaactgaaactcagctccatacatgtgtacagcttccttataacactgggttaatgcatagctgggttcccaattcactgttgatggagggttgggggtatgggaaaaacacaatgcaaatattttctgtgtttcattaaattaaaagtctagtgggacttggccataaggaagatttatggcaaactgaaatttgcctggggtgaataaaagagttgaagaatctggcatgttggattctatgtgacaacatttgacataaataattttgtgtatgttggcttgaaaatgttaggaaatatttttgacatttaaaaaaatagcttttctaccaaaaataatttaaatttttcttttatagaaaagtggagactgaatttaacaggaattaacagctgttttagattattttaatagaaagtgttaatcaggtgaaaagcaaatctctgctttgtgctttctactcctcaggctaacaatttccttggtgttagagtatttaaggagtgaggttgatatataattagtgatttaaaatacatggtaatttagcagacatttctttttgttattttaagtctaagtgttaaatttctgatagcatgtaaggtatattgcctccctctgtcccttccttctttccttctgctttttctttgttcccctcccttccttttccttccctccctctttccttccctccctcttcccttccctctcccttcccttccctctcccttcccttccctctcccttcccttccctctcccttccattccctctcccttcccttccctttcccattttcccactttgcctcattccctctttgcctctttccctctttccctctttgcctctttccctctttccctctttctctctttgcctctttccctctttccctctctcttttttctttctttctaacaaaacagagaaaagtcaatacagtttctcatctttatccacatggaaatgatttatgtttttggaagtttatgattttgagagaaaagcctatcctggggcaaacagtaatcctgccaaccagaataccaaagattctgagagggactcaggtcttttctactaatctgctgtgagtcacttagcctccatttcttcataaggaatgttaaccacttcatgaaaataatacagattaaccaagccatagctctagaaaccagactccacatgttgctgggcctcactagctgtctgggagctataaggctgccctaggaaataattgtgtctccccaagaaagccaagtccctgaccaacgcatgaaccattctcagaatccagcaacggttgttttatattaaatgaatctaattacttagtagagtgaacctgtaactaatttaaagaaatacagcaagcattgttatcttaggttgaacaaaacagtagctttaggtttctatatatattacatttatttcaatagttaatacttttccaatcaatgcatgtgaaccatgatagggagttttcatttcttgaaagagtttgtgccagtgtcttctggataaggaaaggcatcatgggaggtagggcaaggaagctgacaaaaaacatgtacaaggggaaatattcaagaaaaaatgtacacaaccacacaatcacatgctggcagtaaaggggaaacatggcctttcgtaatacgggaaacaggagaaaatgggaggctaaaatgaaaagaaaaaaacctatgtcagagtaaggaactaggacctgaattacactccagaagctgactaagatagaatgctaataaattgctcaactagatattctgatggtaagaagtccaatgagccaagttaaatagagatcaatcaatgatggccttcacattatttggggacaggctcttgtaaataggtcacaacacattttattttatgcttttttccccaaacatgaaatatcaggaaatatagttgctgtttggtttcaagctctgattggagacagttgttgcatatgaatggaggtcagatgaagggtggtagaaaatgactattttagcactggcacccagaaggatgggtcataattcagaagtgccccaaatcacacctatctgtagaagacttcctgcctttttgaggtggtggaatatgaacaccagtgctttctgtggttcctgatttcttccttcgtgacaacctttgtcagtgtttgatacaaggtgcatgtatcggtgtttaataagaagcagaaacagtgacatagaatgaggggtttattccagggattagacctcaggcaagtgtgggatctggtgaagaagtcaatgggagtgtgttgcatctgtctgataatgggctgaactctccgggtcagcacagccaccagtaacaaaagctgggcatgaagtagagaagaacaaagaattggaattaggaggaaaaactggaacccacatcagccttttaccaacctcaatgggggtgacttccagaaggatctagtgccctctgccatggagctgaacatgtacctagcataggacttggcaaagctgaagacagagctttgggagcttcaactacagctgctgcgctaagtccaggtgagtcaccacatcagggtaaatgtgtgcttgccatcatagagtttggtgcccccttcaaatggttgctgcttcaattctgcttttccaacctcatgcaaatttcccctaaggctaaccttaactcagtgtgaatcaggagaggaaattctggaaaatatagctcctgatttagccaatttgatactgtagaaagctaccaaagtccatcccttgccaacttggcatccatgtccacttctcttaactaaatataacttccaaatgaagacattagcaaaacgatgcttctatgtagtatgatgcaactatcagttctacagatgaaaacacatttaaaagacgactgggtgcagtgactcacaccagtaatcccagcactttaggaggctgaggtgggtggatcacttgaggtcaggagttcgagaccagcctggccaacatggtgaaacctgtctctacgaaaaatacaaaaattagacaggcatagtggtgcatgcctgtaatcccagctactctaatcacttgaacccaagaggcagaggttgcagcgagccgagattgcaccactgcaccagcctgggtgatagagtgagatgatgccacagaaaaaaaaaaaaaaaagatacatagcctcataggttactttgtccattttgggatgatattcagtctttttttagctaagatccactttcccttcgatgtcatgtcatttgaatatactgagatataatgatattatgggttgaattgtgtctgtcaaaaagccatgttgaagtgctaaaccctgaaccttgtaaatatgatcttatttggaaatacggtctttgcagatataatcaagaagaggtcatattggattaagatgggctctaattcagtgactggtgtacttataagaggaggggaatttgaacacagacacaaagaatgtcacgtaacaatggaggcagagattggacaaaggaacatcaaagattaccagcaaccatcagaggctacaagagactcattgaacagattctccctcagagcttctaaaaaggaagtgaccccactatcacattgatttaggacttttcgcatacagactgcagtaaaataaatttctgttgttttaagccacccaatttgtggtactttgttatagcagccctagggaactaatacaaagactattattaccccattttatattagatggtggatggggtagaaaaaagaattggttaatatacaaccaaatatatttatatcaaaaaataaatattcataattcttaccatcctaatttctataactgatcttgtggtcatagctggtatttataacttccttctttcactacccattccatatacttgtgtcctcagcaagcacatcacctagtcatggtttcttgcctgttggggtgatgtcagttttcatttttgagggatccaagcttttgcaattgagcctgcattgggttattttccacttactttgttcgttacagcaacaaaagtaattacaagacttgagagtataagatatgatcttgaattccaggcacactttttcttactcctataatctggtagtaatccaatttccccagtcatcccagccaatacaccaatatctgactttgcttgttgattctttagcataaggagcccaaagtcggcagcagggagtatcaacttccatcttaatggaatcattgctgtatctcctagtagaagcatctctcccttggggaccagaacttctagaccagcagagtctaaagttgagaatagaaagaataaattttgctgtggatcactatgggtaacagtaagaggagccctttccatttttcccccttgattcctggatctatgaaatctggataagagagaaacagcaacatgcattgattgatcatttagagaatttactgcatctttcaggacattatcctagccctgcaaagtgtttccatccatctagcacagtaaatagttaaaagaagaattccacctttctactgctttagagtgatgaataacaagttaagactaatgaattccatgagcatgagtctgttattcttcatttgctgcaaagtaagttccttggtcaaaagcaaagcactgtggaataacatgaagggaaataagatataagaattctttaagtccacagatactgattttggcaaaggtattacaggtagggaagacaaatccctataaagagtaagtttctatggagcaagaacaaaatactgccctttcaggccttgtgagtagaagttcatgttgctgaattcatgcataccctccatgtctaccatcatggctattttgttcacgagctcattggtcaagaacagaagaaactggaaagaaaaacctgatagaggtctgcagaatgtgttctcttgtccattattaagattcttacatgctgaggttgagctttgatcaacattcacatgggcccatttaggaaagtctatccatttacttcttccctagattttcctgtcactaattttccagtcatgtttcttctaagtcccttattatccatctaaacgttagcaactgcccatgaagcaatgtagatttatacctctggctgtctttcctttgaggcaaaatgaacaattaggtacactgctggaagttcttattactgggaaaatttttcttccccacaccaccagtatagggccacaatgatttagtcattcggttttggatgataccagaatatcacacaaaaatttctgtaaacaatgccaaatatttttcagtccactggtcactgagtgcttcccatgaggccatgggtgtaagattctgaagctattgttgcacaaatagacaccatgggtaactgggtcacttgcttatttaatatacttgtgcttgatctcatatattctacttccatttgatcattgaatgaacaacttagaggcttccatttgatcattcatgcacaacttagaggcttgatggatcaacaacacttagttcatcatgggcagttcaggttgcattataacttgatggcccatgatcaagcttccagtttcaaactggtattctaaagaagaattttgaagagaaaagaagaatatctgaattaaaagaagaatttttctgaagaagttgttatagttttgctccagaattctaaatgtctgctctatgattcatctatcaggttaatggcttcatgcaagattcctgcctaacagagacatttttagcaccatggaatctactggatctagatgtaagagcagtttgtatggcagccttgtattgtagaggcttttcttgttttggacctcacacaaaactaatgaccttacatcttacttggtaaatggattgtagtagcatgcccaatgaaatatatattctcttcaaaatccacaaaggcccattagacattatccctctttcttaatagtaggagaggtcagatatagcaacctgtcatcatgttcatgaaaggaatatcttggaatgctcaaaacaagtagatcactacaaatttcagtaacattcagtggatataaagtgaattttgtggaatttatcactctctggtatgcaagtatcttaacatcatatctagaactagttactttatcctatttaccaggtacagtaatcatgatataatatcattaatataatgtgcctgcatggtatctgatggaatggatagacaattatggtccctgtggactagattacaacacagggctgtaaagttgaaatagccctgaagtaggacagtggaggtacattagtaaccctgttggctggaagcaaattgcttctgatagtatataccagaggttagcaaacattttctgtaaaaagctagaaaataaatattttagaatttggaggacatatggtctctgccataattactgaaatctgctgttgcagcataagagcagccatacctaatatgtaaatagagaaatgtaactgtgttctaataaaactttatttataaaaatccagtagtctgaatttggcccatgagctgtaatttgctaatttctggaatttattaacaggtatagagaaataagcatttgccagctcagtggctcctgaccaggtgccaggagccctattgatttgttccatcaatgaaactacagttggaacaacagctgcaattggagccaacatctgattgagatattaaaaattcactgtcattcttcaaaattcatctgtgttctgcataggataaatcagcaaaataaatggggaatttggtaggaatcaccatccttgcattttgtttcagttcctgttggtggctctaatcttcatactcctttaagaattcaatattccttttgtttactattttggcatgttgcttattgctgcataataaactactacacaacttagggacttaaaacaataacaattgttttgttcactaatctgttttaggcaggttcaatagggacagttcatctctgataaactcatgcagataagaaatgtcttctgggaaggcttgactggggctggagaacgtacttccaagatagcttgctcaaatgactggcaagtgcttcttatagttgacttggaactcatccagggttatccactggataccttggatcctctccacatggacctcttcatagggatgcttgggcttcctgaaaacatggcagctagtttccaagaacaaggattccaaaaggcatggatgaaagttgtaagtcttctaaatcacttaaattccaaagttctggatcacttccgccaaattctatttattaaatgaatcagtaatgcaagcccagatccaagggttgggtaattagacttcacttctcaatgcatagagtagcaaagaacttgtggccatctttaatccacgatagttcactttgcacaacaaagccaaaactaggagactgacaaaggttactacccccagaggagagtttttgtaagaaaataatatcgaatttcacagatctactaaaccactgggggctccactgagcagtatttcaaatggattacactctaccaagtcaggaagataagtaagagaggtagagaaaaaggcccaaagaaaagaacagaacacaagtatttattcattagtccttattccttatatatgtcaatttcaaggaagtcatcagaaagacatttcctttctcctaatctggacatgagtctctgggattctcttgaaagtcatcttcccaatgctaggcagcactgcaccttagcatttatccatttatttgttcattcaacaaacatgtgtttcattgatatctttcagtggcccaaaccatggcaagtgtttattaagaagactctacccttgaggggcccatagcctcccatgtatctatttagactataggttaaagacatacttggtcttccctataacacttacgtcagtgtcttggttgtggtattgctcagtattttattattgactcatcagagcatttttactccattggcttttgacatctaaaacagttgtcaacttataaaactccaaaatatttaacaatcagctctcataagctggtgtgtgggatggtatcaaaaagctctcctctacctcgtaaggttgtcactgcagacagtacttcaaggattttttttttttttatctttagctaatttaaagctgtcactccttattttggatgggagggagaaaatagctaattggaagcagaggaaaaaatagtttcaggatcaatggtggaaatagcagcaaaataattattattacagtcgtaatgctctgcatttatatggggtttttttccaaaggtctcagaacacttttctgaatatcacctacaaattcaaaaacaattatgaagaagtcagagtaaagcataattataccagaaatttactctgaaatgtaattcaatactctaatacaattttactctcaaatataattcagtgaaaagtagacttattgtaaactgaattatagacatacatttggatttttttttttttttttttttttttttaagacggagtctcgctctgttacccaggctggagtgcagtggcgcgatctcggctcactgcaagctccacctcccgggttcacgccattctcctgcgtcag

SEQ ID NO: 1203 - DNA, 1909 bp, Homo sapiens
  misc_feature (1891)..(1891): "n" at position 1891 can be any base
ccacgcgtccgcaatgaagccgagtgaatgggggctgaatgtgcgagtccatagctgaagaggagcgccagatggtggaggaatacacttatttatgaaactgtcttgagttcttcttgaattgccagttttcagcctcctcatgcctccgtctcctttagacgacagggtagtagtggcactatctaggcccgtccgacctcaggatctcaacctttgtttagactctagttaccttggctctgccaacccaggcagtaacagccaccctcctgtcatcgccaccaccgttgtgtccctcaaggctgcgaatctgacgtatatgccctcatccagcggctctgcccgctcgctgaattgtggatgcagcagtgccagctgctgcactgtggcaacctacgacaaggacaatcaggcccaaacccaagccattgccgctggcaccaccaccactgccatcggaacctctaccacctgccctgctaaccagatggtcaacaataatgagaatacaggctctctaagtccatcaagtggggtgggcagccctgtgtcagggacccccaagcagctagccagcatcaaaataatctaccccaatgacttggcaaagaagatgaccaaatgcagcaagagtcacctgccgagtcagggccctgtcatcattgactgcaggcccttcatggagtacaacaagagtcacatccaaggagctgtccacattaactgtgccgataagatcagccggcggagactgcagcagggcaagatcactgtcctagacttgatttcctgtagggaaggcaaggactctttcaagaggatcttttccaaagaaattatagtttatgatgagaataccaatgaaccaagccgagtgatgccctcccagccacttcacatagtcctcgagtccctgaagagagaaggcaaagaacctctggtgttgaaaggtggacttagtagttttaagcagaaccatgaaaacctctgtgacaactccctccagctccaagagtgccgggaggtggggggcggcgcatccgcggcctcgagcttgctacctcagcccatccccaccacccctgacatcgagaacgctgagctcacccccatcttgcccttcctgttccttggcaatgagcaggatgctcaggacctggacaccatgcagcggctgaacatcggctacgtcatcaacgtcaccactcatcttcccctctaccactatgagaaaggcctgttcaactacaagcggctgccagccactgacagcaacaagcagaacctgcggcagtactttgaagaggcttttgagttcattgaggaagctcaccagtgtgggaaggggcttctcatccactgccaggctggggtgtcccgctccgccaccatcgtcatcgcttacttgatgaagcacactcggatgaccatgactgatgcttataaatttgtcaaaggcaaacgaccaattatctccccaaaccttaacttcatggggcagttgctagagttcgaggaagacctaaacaacggtgtgacaccgagaatccttacaccaaagctgatgggcgtggagacggttgtgtgacaatggtctggatggaaaggattgctgctctccattaggagacaatgaggaaggaggatggattctggttttttttctttcttttttttttgtagttgggagtaaagtttgtgaatggaaacaaacttggttaaacactttatttttaacaagtgtaagaagactatacttttgatgccattgagattcaccttccacaaactggccaaattaaggaggttaaagaagtaattttttttaagcccaaccattaaaaatttaatacaacttggtttctccccctttttcctttaaagctantttgtaaaagtttatgag

SEQ ID NO: 1204 - DNA, 1449 bp, Homo sapiens
atgcctccgtctcctttagacgacagggtagtagtggcactatctaggcccgtccgacctcaggatctcaacctttgtttagactctagttaccttggctctgccaacccaggcagtaacagccaccctcctgtcatcgccaccaccgttgtgtccctcaaggctgcgaatctgacgtatatgccctcatccagcggctctgcccgctcgctgaattgtggatgcagcagtgccagctgctgcactgtggcaacctacgacaaggacaatcaggcccaaacccaagccattgccgctggcaccaccaccactgccatcggaacctctaccacctgccctgctaaccagatggtcaacaataatgagaatacaggctctctaagtccatcaagtggggtgggcagccctgtgtcagggacccccaagcagctagccagcatcaaaataatctaccccaatgacttggcaaagaagatgaccaaatgcagcaagagtcacctgccgagtcagggccctgtcatcattgactgcaggcccttcatggagtacaacaagagtcacatccaaggagctgtccacattaactgtgccgataagatcagccggcggagactgcagcagggcaagatcactgtcctagacttgatttcctgtagggaaggcaaggactctttcaagaggatcttttccaaagaaattatagtttatgatgagaataccaatgaaccaagccgagtgatgccctcccagccacttcacatagtcctcgagtccctgaagagagaaggcaaagaacctctggtgttgaaaggtggacttagtagttttaagcagaaccatgaaaacctctgtgacaactccctccagctccaagagtgccgggaggtggggggcggcgcatccgcggcctcgagcttgctacctcagcccatccccaccacccctgacatcgagaacgctgagctcacccccatcttgcccttcctgttccttggcaatgagcaggatgctcaggacctggacaccatgcagcggctgaacatcggctacgtcatcaacgtcaccactcatcttcccctctaccactatgagaaaggcctgttcaactacaagcggctgccagccactgacagcaacaagcagaacctgcggcagtactttgaagaggcttttgagttcattgaggaagctcaccagtgtgggaaggggcttctcatccactgccaggctggggtgtcccgctccgccaccatcgtcatcgcttacttgatgaagcacactcggatgaccatgactgatgcttataaatttgtcaaaggcaaacgaccaattatctccccaaaccttaacttcatggggcagttgctagagttcgaggaagacctaaacaacggtgtgacaccgagaatccttacaccaaagctgatgggcgtggagacggttgtgtga

SEQ ID NO: 1205 - DNA, 72732 bp, Mus musculus
  misc_feature (3522)..(3541): "n" at positions 3522 thru 3541 can be any base
  misc_feature (19836)..(19911): "n" at positions 19836 thru 19911 can be any base
  misc_feature (43636)..(43770): "n" at positions 43636 thru 43770 can be any base
  misc_feature (47357)..(47376): "n" at positions 47357 thru 47376 can be any base
  misc_feature (57087)..(57120): "n" at positions 57087 thru 57120 can be any base
  misc_feature (64787)..(64806): "n" at positions 64787 thru 64806 can be any base
ctgtgtgtgtgcagcctgagattagaggggacaaactgaaaatggctgcagagcgtatgatccctgcagtcagtcaactggagttgtcattctggagctgaggaaccccaggcaagtcctgggtctctttaaggtttggtttccgtcttggtagcatgaggacccaacttacattttaaagggttatggttacaaaattgtcttgggaacatcaaacaatagttattctagctttactttttgacacagatcttgctaagtaacctagactgggtcctcaaactctggatctgtctagccttaagcatccccaagcgttaggctacaggtgtgagccaccaggcctggctatttaacctgtctagtttaaaagtgtgagttgggggagtcgggggtgggggagtacacacctttaatcccaacacttgggaatcagaagtcgaaggatctctgtgagtttaaggccagactgctctacaagttccaggacagccagggctacagagagagtctctgtcttgaaaaaccaaaccaaccaacccaccaaccaaccaaccaaccaaccaaccaaccagccaaccaaccaaccaaccaaccaaacaaacaaacaaacaaacaaacaaaaaatggtccttgtctgtttggtgcttggctttatggcaccggagatgaacatagggttttactaacctaggtgaggactgtgtttctgagctacaacagctgttgtcacctgatgtccattgtgttgtcctttccagagagtaattctacaatatagtggttagaggagtttatcccaacattgattccctttcactgtgtgaacctggaatagttattctctgtgcctcagtttctccatctggtccatcctggtaaaaaccacagtcaagggattttcaatcaccctttgagtatggattttctagcacacacacacacacacacacacacacacacacacacacacacacacacacacaaatgagtcccaaactcacagaggtccttcagcttctggtttccaagtgttggggttaaaggtgtgcatcaccactacctggctcacacttttaagttagaaaggttaaatagccatgtgtggtggctcacacctatagcctaggcttgaacgaactacagtggcccccatccactctatttaatggtttgctgttataatctggaggtcagttctggctggtggctggtggctgatgaccgtaggtcctctctgtgtgtgcatgtggtcctttccatgcagatttagtaacttctttggacttcctcataacatgatgctgatttgtaaggactaatatgaagtgggtggaggcattagtactttttatcatctagcctctgaggtcaagcaagagaacttctatgaccctgaatttgttgacgcaaccatgaaattccatcgggcttcaggggtataatggttaacttgcattgtaatttggatgatttatagtcaccatgggcgtgtgtctcggggtgagtctgtggagatatttctgaaaaggtctgactgatgaaaaatgctttaacttgaatatgaatagcaccatctcacgggccgggatccgactggagaaagcgacctggatgctagcatttgtctttcttggcaacgtgaccatgaatgcagtgtgaccagccacctcatttctactgccaccataccctgcccaggatgatggatgggatcaccttaaactacaaatcaacacaaacacttccctctttaatttgcctcctgccaggtattttggtaacagaaatgagaaaagttgctgagaaaagggaagagaaatagaatctggctcttaatggaggagataagactgtacatatggagatagccgttaaggggaactggaattaagtttagtaactggtgactgacaggtgtttcacatgatcctccttatcctactttccattaaattatcttctcattccttcttcgggaatcagaaggctcgccctagagcacagcggggtccctctccgaagttcatcgcgccctggagactcccactctaggctgatgtttctccctgtgcagaatggttcccaaagcaatgaaggcagcaagctctgctcccaagaaagctgtcagcattttgtatgccctcaggttgacaagagaaggaagttcatgtcgttatgaaaagaatgcagcaaaatgccaaagctccggtgttgcccacggtgaccctgaggagcggatatgccagagattagctttgcagagcactagtctgggagccgctctgtggtccccctgaacatgagaagtgacgggaaacttgacattccttttccccatcacctccagcaacattcatcagctactgaaattgtcctttcaaggtccagggcaggacaaaagcaaaagagggatgggtctttgggaaattactgcctctttgccccacatcttgtgcccttctctcagaaaagaaaacacagcttaatagggctgagaatgagcaggaaatccaggacttctcttctgtcttgtttcaatctcccagctcatagaaggatgtgtgaggaaaatttctttggaatattcctgaatagagtgtagagatagatcgccaggcactctggatgtctgtctttgcctctctggatgtttttccgtgtctgttttagctaagctgtttaagagatggacttggtggctcttccttcatcctatgacagtgtttattattcttcatctgacatggaaagcacctactaacctaactaaggacaacaaaaggtagaagatatatttgtgaatttaaaaggaataaatgggtatatgtatatatgtatgaacacacacacactcatatgtgacaaattcaaaataagtgaattttagctaatgaatcagatccctgcatggctttttctgtcacttgccaaatccgtattatgtaaacagagtatatgcaagcaggcactaccactactgtatccattactttggccatggatgcctcctacgttggttgtggagccactgaaagagccttgtctctgccacctagaagcccaaaatcaagctagaaaggggaagaagtcagggcctacggggaacagcatccatcacttgaaatgaagattggaaatgcggaatagtaaagcactctgcttagaagaccagcatattcttgtttcagaatctaacagttatcaccaactgctagatctctaacctttgaaaaatgatctcttattttatgtcagtttttttaaaagaataccagtcttatttccaatggctcctggccatgtaagactcactgagcatccggcaagtaggatttattgggtggagcgtacttcttccctgcttcagacaaagccaaggcaaagagtttgccaagggcttctggtcagcattgggagaggtaaggcatgaaaatggaaggcccaagccagtcagaaggaggggtggaaaggagggagataggaagatagggagggaggagggagaggaggagggagggnnnnnnnnnnnnnnnnnnnnagagacagagagaaagagagagagagaactattcataagggaaggtgctgtcagagaaacagcatcgaccatgggaaaagaggggaaaagataaaatagtagactttaagatgatgcagtagacttacagatgaccatgtcctttgctcaggagagtagcgattgggtgagaggaggacaagtcatcccaggagctacttgattccctcttgcaatgtttctctacaaggactataaatgatatcataagtattgtggggagtcctgaaaaatggccacccatggtcagagagctacatcagattcggatttagctgcttgcttcccaagcaggtctactgagctttcttcgaacacctgctacctaatccatgcatacagcagacactcatcgagcaaacgagtgtctaacacgctgggccctcgacagcactcagaggccaccctggtaatgaggcaaaggatgcctgctcccaggtacttccatcctaatcctacataatagtcaaaggagttctcattcacatgtctctttgtctccgtctccccccagcccccgactcattcattcggagacatgtgttcattacctactaggtgccagatgctattctaggcaaaggacttgcatggaatgatgccatgtcccctaagggtttaaatgtcatactcaggagattaacaagctcatgactccatgggcagtgatggttcatgattgggagtctggtttgacgtcactatgggaatgcaagatgactgcagctgtgtgtgtgtgtgggggggggggggctgttgtgatgcaggaatcctagaaaggaatcggcttgttctaactgaacatttcagagcgtgcttctccatgcagggacaccgtgcccagtactgagggattgtggttaaagtaaaatagaagggacactgaggatacatagggattctcctagaattgccaacagagtctctaaggcctgacgtattcctcattctcaggggaggaatctagccaggttctctggagctagctgcccatctgaattagggattccagaacagcaggactgttaggagccagaggttgatgactagattatagataggctctttaggagaattatctaacatgcttatggcggcttggaactttccaaatgcccatttgcagactgtaggaccaaggaagttagtactgtggctgagaaagatggtcgagtgctgctattgtaagcctgcggctactgccagcccagcagtcccaaggccacatcctgggccctgatgtctaagggcagcaagggaaggctgtcccagatatgacaatgatggtgatggtggtggtggtggtggtggtggtgatggggaagaggaggaggaacagcagaagcagcagcagccaatcaaagtggcctcttttcttgaacatttagggaaaaggcacagggaagaaagaagcattgctcaggttccatccggtccgtccctgtctcatcatctccaccccaaacattttcaggctatctcttggtactggctttaaaactaaagatgtaattatttactctgtcccaagaacactgaatagacaattaggcagtttacccagatgatgtcattttatcttcatttacgccccaccaggttagggcttgttggcatccccaagctacagatgagaaaacggagctcctacagtataaagtcattgcactgggaactaaaggaacagaggatgaagtttgggttggcacttagagcctccctggctccaaagattgtgcttgaagttctaaaacccacaaaaatcactttcaaagggccaattgtctaactggcaaaacaaaccttctcagtgagtggtagtgggtctgtgcccaagcagagggcatggatggaaaccccacatcatcttcattttctgtgtgcatgaacaagttacttcgcttctccgaatatctgttttcttgcctaaaaaaaaaagaggtgaaaacacctctcatatcacttggatggatgaattagatgtttcgtgtaaacataatttcactactagtaagtgctttgctaaattgtctactgtttctatttatttctataatttaagacccagtttatttgaagtgatatgggaacgttaccttatctgtactaggaaagcaagctagttttcatcggagcctatgtatcagtcattgatagtatacatctcctagctccagcagaggatggggggaagtgttgccctaggccttagcagtccactgctttgtctcagagctcagcccgctaactcaagcagtccctctgaaaggactctaaggaaaggggtcgccacagagtaccactgtgctagaatatttgacaacttggggtagggaacattgtaccaccttctaggtctgcagctcaggggtgaggcaccaaggcatcctgactaggggatgcaaaggtgcttctagtgaaccaactgttgagcttgttctgggctcccttgtagtgatccctactggggtgctaagaaatcttataggtgggcattgtacagaggtaaagaacctagttttaagcagcatggaaccaacaggtctttccaagaatagcctgtgttttctgaatgaaatcatcattgccccacgttcatgggaaatgcaaactcattagagaccaagaacagtggtgaaggtgaatcccccattggtgttccttttatatttggtctgccgtgccaaagacgggtacttctcaatatctcgccactagagctgctttgacagcagcataatgctcattcctataaagagtttgaagtacccgttaatagctttgagtttaagcattaggaattttaaggttcaagtatagagctttgaggagcacacattaagtagcaacatcagctcataaagctacaagagagaggcagtgctccctggcacactcactctcacctgtctgccgcagctgcaccttggtactggcttctgcatctcattgtccatggtcttctcagtccacagaagtgacacaaaggcctgccaccactgcccagcacccatcccctcctctgcactctcccactctcctgtttccatcctggatgtctgttatctccaaagcagttttgaaagggtcctcactctcgcccggaagcagcagggcacccagggcatggtctcaggcttgaatgacaaaaggggtcctatttcctggcaggtgtggcaagaatgtcctccccaactgtaattttcacatggggaaaattaaatcagcttctttggcacctcagcccccaaatatttttactgcattgctgttggcaacttatcctaactaggttgattttcagattcagtccaaaagccaaacaggaaacaaacctttttcttcggttctttctttccagcctcactcatctacagagtctgctttccacactactatgtgggcagaaagccctttgctatcaatgattgtaaatacaataaatcccccaactgtgtgtgtgcacataaaggatgcatgcatgctgtatggagtgtgtgtgtgtgtgtgtgtgtgtgtgtgtgtgtgtgtgtgtgtgtgtgtgtgtatgtgtgtgtgttttaaaagatccagaaattcaggacatttttcaggaaggttttcattgagttaaaaagcaccccagtgaaccagttagaactgtacagaggttgtagtggcaactcgcaaatggtttgacagatagggcaaggctgggtaattgaaaaccaagtgactgagtgtaggtttttccatggtagaaatacagcaagttcttgggggaagaattgacgggtacaagctgtattcacagcctttggaggaatgggatctgtctgagattaggcacaggagattggggaagggtaagagcagtgtgaggagagatctatcagtgtacgtgcacctggccgggtcaggggtcagaggtgtggggcatttggggatgaatcgggatactctcttcctgtgatgctgccacttgactaaatgacctttgattggctctttgttttaaataaagtgtttatcctaaaatgggttctaaggggatccatcccttctgctcttgtgccagccccatgctgtgctgctgtttcttctgcctgcaaatctcacttccttaacaagcctccaagtcttagctctcccatttgttccctggtgcaacctctttgctctgcgtgctgtgcatgctgcaccatctgtatgtcctccttgggctcagcattcctgccttttgctgcttttgacctcctggttggatggcagtgatgacaagggccttcccttcccccacagcatccccatgtccatctctgcctcccagatcgcctcaactctgccattgtatgattttgctggaactctcaagactgactcatgactaactagaggcatagtctgttctctgccgcagaaatctgcttagatgacatctctttcaacaacagatctggggcttgttctgcattttttttttttttgtcaaagagactctgatgaatctttggtgacacccatataatgtcaaagatttatgctcagccttctgaacagccataacttcacagttttcaacttggagttaaacactaagtgtctatgtaaaagtttaagtttgtttgagacacaaagccagagcagaaccttaaccgaaatgaagagtggatctaagaaccaaaatacaagtagaccagagccacagccttcccctgaccctgcccaggggcagcaggtgaagccagaagggctccagcagcctttaggtctgaatgaaggacgtccagacatagcgagggtatttgctttagagaaggcattccaggcagagatatgaattatgtagggagagtaggcaaacctcaagatttaaaagggtctcatcatctatcattctgttcttaagtaaaggcagggttgccatagcaacacaccacaggctgagtggcttaaacaacataaatttatttgctcacagttctgaaaactggaaacccaaggtcagagtgccagcagggctggcttcctctgaggctttctgctctggcttacagataatctgtctccctacatgccttacatggtcagtccttggcacacagccacccttagggtctttgtgtgtccaaatctcttattataatgagtcagttgagtttagagcccatcttcacattctaatttcaaattaatcatatccttaaaggtcttattgccaagtggaatcacattctaagttacaggtggttagggatttgatatatagatttcagaggaagcggaattcagcatagaacaagaacccaacagaacccttgtttgaacacaaatggtcatcactgctagtctttctggagttttgtgctgtgcctagtgttgctatagctatttcccattgattagtccatctttccttcacagtcgggttacatggaatagattatgtagatgatgaggcgattatagatggctgccatttcttctgaaacatggtcagcttgcttttgtgtactgcgtggccctggggaatactgtcctccagccttgaatccctgctgctaaatgtgatttggaatagtggggggggggggggatcttatctccatgctttgatcaacagacagtctctggaaggagtaagactatgtttctcaacccattaccaaaagcctcccctgagtcaggagatggtacagtatgaattggtaaaccatggtctcttacagagaccttacactaactgccttttctatatatcagagcttcctcctgaattatttggctgaatcatcaacactaagatctgcaggacatactcattcccgctagccagtcctcagcacaccactgttcactcttaccaaacacttgaactacagttgctaatttaattcacctagtaagccagaagggaaaaaaaaaacaaacaaaactattcatcctcactgactgggtatactgaaatcgacctagctgaagttctggattccctgattcccttacatagcttaggtctagacaagctctccggtggctctccatgacctcacctgtgggataaattctcattttcatctctcctagcaatgtggctatggcacacagttagtaaaatgtgctgctgtctgtgtctggaagctagaaccaacactggtatcacctcttgcaactctgtgtttagccaccctgtctccattctcctttgtggggcttctagctcgaacactcaacaagtacacctgttctagtgttcttccattccaatgttcagactcctttctccccacgcaggggtaagcctgtgctgacactgtgaatctattaccttgaacagttacagcttcatgagaggactgccctgtgccactgtgatatctgagagttggggtgtcgctggctcgggtgacaattgatactgaatgtcctatctcttctcccctcttgcaggaggctctgtctgtggtgagtgacgatcagtccctttttgattcagcatacggagcggcagcccatctccccaaggcagatatgactgcttcggggagtcctgactacgggcagccccacaaaatcaaccccctgccaccgcagcaggagtggatcaaccagccagtgagagtcaatgtcaagcgggagtatgaccacatgaatggatccaggtgagcctgccagagttggccagtcctcatgaagcagggaagcctgggcgcaattcctcctaggaccaccctgtcaagccgatctgcacaaagcagcagatgggtcaggccccaaggccctactgcagtactcagtgcgtttgctgtcaagcttaggccaggtccagtcctgcaaggaaaacgcatagcagtaagatgctcttcctgtgctcttgaggatgttttaaggtcctctgggtggcactaaccagagcaaaggtgacccaaaaattcttcaagtaaaagtggaaaagtggtgagaaagacagactgtgtgccaggaagccagcctcacacatgggaagtgtgggggtggagtggggcggggtcattaggaaaggccaggtacagccttgtttatggaactgggaaggggaactcagggataaagagcacacgaaccaacccattgtcaggcagccccagcgacaggcactacctcaacattttggctaaattatctaaacccatctgaataccagctttctcttgtctaagccagagtcagaacaccaaacatgtttatcaagtgtgttgtagggaaaggacccaggacattgtctagttccaaagtgctcaatgagttagtgaccacagacacacaagagggaaaactttagcctagtttattacctgataattcccagtggattcccaggtaatccacttagcctgaagcaaacagacatgaaagtaaaagcaagtgagtaaatacaagacaagaccttggttgataagctaggaatccagtttattccaccaacagaggctgaccctcaggactgccaggacactaagcatcatcggacccatgagacaaagctgatgaggtgacaatcattgtcctgcagggattgtggacaggagtgcaaaaagataagaagttactgaaatagcccagataaggaatcgaagttctgggctagggtgacagtaatgatgacagaagcccaggggaggtgcataaagagcatatcaaagggatggctacaagagctcggacttaataaacattgagaggtggggactggatgctgctgagtctggacctttgaaaggggatgcagttagtggcgacaggcaggtgggaaggggtgatgccttgaggaggggacgtcctttagcaccctttgtgagcaagtggtacagtctctagattaaaatgtctactggatttaggaagccaaagcccgtaggattgggactggaattgaggcttaggcatcctctctgggaggcttaactgaaagtgagtcatgagggaaactagtccagagaggcaagaggaagcagggagggggctactgtggctgctgtaagggagttcctccttgcagctgtctcagagctgccctctagaaccctcagccctgccacgcttccatcccatgaactaaaaccaggaagtgggaccttggccatccctgcagggttctagggttaggggagctcagagaacctgagccttgagccctccatgcagaatgatgcttataccatgattccggtcagtccattctcagcagagtgtagtttatcaaacacttgtatctagtcttgtatcactgctccctactaatctagaaggccaatattctcatcctgttaccgtatagaaaggaagtcgagagaggctaagctggcgccagcccagcctttccgattgcttgggcatcttgctgcctctccctctctgcctgtgcgtcatggttctgtaccacgatcccattctgccagcaccctctggtgatgaggccagttcagaaaggactcccaagctgcctgcaccatcacaaggtgttcctgatccctactgaaaaatctagatgctaatattggagagtctatagtcttgatgtaccctgtatctagttatcattgcctgccaagcccacagtgtctctcccagctgccacagagacatctgtgctccactcttccccttccctgcctgagacctattctctcaacaggcaacagtgaaagtcatccatcctttcacaacagtaaccttcttgctcaaaaacctttagcatctcatgtcagaatctaaagtcttagctaagtcccagattctccctggctcctgccttcctctatgccatcacacaagactctagctgctcctggaaaccatagcacaccactaccttggtttatcttccccaagtcccttctttctaaaacatttcttctccatttattcatacaactctctcgggtttttgcccatataccacctcttcagaatccctgacactccccgaatctgaaagagcaccctatcgctcgctctccctggtgggttattcaagttgtcttctccctcactagaatatgggcagggcttttgctcactgggcagggttcatgtgtttcttcaggaaaaagctaaatgggggcacagcagagcaggccaaagtcaagttgcttcttcaaggacatgccatgtaggtatgagttgagtctcccttacctgaaacatttgacatgtgtttcaggctctttcagattttagcatgtttgtttgcacacagtgtaacagatatctcagtatgataatggctgttttgtatgcacgtgtgctcagtgcccaacagtaagactatagcctggtgcatttgcattgggactgtgggctctcttgtgcatcaggtatggaattttccttctgtggcctcatgctagtacccaaaccatatttcagatggagaatccgaggaacagatgtccatatgggtgatccccaaggtcacaatgcccaggcaggacagcccaagctctgctgagttcaccctgtacttttgaagcatgggttcccttctaacatatctgtatcactgagctacctgttcccatccctgccacctgggtactgctgggccctccaggatgctgtttaagagctaagagaatccttcaaggaaaaagactctggatccatttccaggtcatgcctagcattagtcacccagacactagctggaagaagcccgtgtaagtattcccataagctggctgaatatttacctggctttgggtgtacagtctcacctactgtgctgaagtaaagatctagtggagtctagagccacccaggtaggcatagccatggttttcacctaatcaataccctcaaagcacgcacaataaagagccaggatcaaagactttcagaaagatgcttttatttgggatgaaaccatacctagcattaacttagcattatttaactatgtgagagaaataacatgtaaaaacaccaggcatggtggcatgctctggtgatcccagctgctgaggaggcacacagctggatctcctaggctcactggacagacagcctgctaggcaagctgcagatcttatgccacaaaaaggtaaatggtttctgagaaacaaaactcaaagttgtcctttggtctccagaggtatgtacaccagcatagaactgcatgcatatatttatacacaaaatacagagacaggcatagagacagacaggcagacagacagacagacagacagatttagagagacagagaaaaaaacaggggcagagacagagaagcgggtaaagagacaaagaggcagaagcagagggctaaagaggcagagagagagagagagaagacaaatgaaatgaatacatagatgtcagtctgtttaaattactcatcctgaacagtgcaactttcttattttctgagtaacacgggactttgttagttttgttagttgcatgattttaagatacatatatacaatgtattgggattcatagatatatgcagtgtattgtgattctattcgcccattactctcccttgctttcactccaagacccttcttttaccagctcatcccccaggcaggaaacaacactcccctctgcagcaactaacagttaatatctccttcagatggggcagtgtctcatgagcacttcctctatcagtgaaggaagttgacgggttcagtcttccaccagtatccattgcttctgtgtctctgtggttggaatggccatgttttatctgtgggtcagcattttatgacacccctccccactcccagctcttacatcacttcatctcttcttctgcagggttctataggcttagggtgtatataatatagatttcccagttagggctgagagcttatcggtcacttagcctcagcatctgatgaggtatgagtctcgacactatctgtcactctctgaaagaagctttcatgttctagactgaaagggatactagcctatggatataaatataaatattctggagacttagcagcatgtccatttagggaaacaacagcattatgttctcattgggtccaagactccaccagccacaggctttttaccaggtttatggtaccagatgtgtatctcctctcatgcagtaggcttccaatcacagagtggctggctacccaccatatggtcaagccaccgttgtaccagtggatttataatgcctgtcaagttgtattgtgcagcaagcatgagcactggtacacttcctcctctaggagcctgcatagagcctctggcaccacaaatgccagccagcagggagaggattcccaactcaatcccaactatttctttgtgtcttgtgaccaaaatgtgtgtcatcttcatcaatagggtcataccttctatatctggtgggtatcaagagttgcatagcatttgataattttcagaaagtccagttatcataacacaaaatgtagaggagggccaatggagacggttcagcagaaggtgcctgacagacaccatgcctgacaccatgcctgacgacctcagttctacccccacagagcctacatgaaagaatgaaagaaccaacttcttctagttgtcacctgatttcaatgcccatgccatggcatgtacccacgcatgtagtttgctcaagcacagatgcacacaatactatttaaaatgtagaggagggtgtgtcaatgctccaaagaagaaaacagagcagggcagacaacttggaagttcttggcttatggaccaggtctgtggcacccagcactctgatgcagtggccactaactagccccatgttgctgagcactgggactggagctactctatgagttagatgtgctataatgtaatatgcacattggacctaaaagtcttagtatgataaaatgtaagatatcttggtgactgttgattctgctgaaataataatcttgtggctgtattaaaatattaatgcatttatcatattatcatatataatatttaatatatttaatatgtatttcttatcaaaatatatttaatataataatcaataacataatatattgatatgttatgttaatgaatttattcaaattcatttcatcttcttagatttatttatttacttatttatttattgtgcgccggaggagttcggtgtgcaaatgtgtatgcgcttcacgtgcatgcctgatgcctatagaggccagaaaaaggcatcagatagatcccctggaatggaagttatgcatggttgagagtcaccatatggccctctgcaagaacaagaagtgcttttaactgctgggtaataatatctctggcttctcactttttcaattttaaaaatacacctactagtaaggtgaaagtgacccttgtgtctcaaatatgtaactcacaatctacttggagtggaccgtgatgtagcagaacatttccgattgctcagtgattcacagcacatccctacaaagttctttcagaagcatgggtctctgggttccttcttcacgcttatttacactccatagatgtccgtgtctctggcaggaaggaagtactccttgtctctgaagctgcaatacgctcttcccttttaccctagcagcaagccctctagaccagggtcaaagggtcattcagaggggctgagatctgaggcaagagagattgtctgggttgcctgggtcgtaggaggtttactctgtctcccttccactcctgttgtggttgaatctggtgctctgggttgccctccaaacagcacagcccataggttctgtgttggatataaacttcagaaacttgatccaagctgtggtttgcaaataactctcagctgcatcctgtctcgaccatgggaattggagaaaacagtgcatgagggaaacactaacagtttgtgagggagaaaacagaactagttttaatacctggcattcaggagctaaactcagcatcactgccctgagacaggctggactggccagcgttatcaggaggcatcgaacatgcagagaaccctgttccactctcaggaagatgagcctcccaggtaccttcctaaatttctaattctaaaccttgcatggggagtaagacacatatcatctgtgttgaaagcccaggtagtggggtttttgtatgggttttgttttgttttatttcttgaaattatacttctatatcaaaagcaacatgccacttctacacatggaagtttctcacagaaaccctaaaggcggcctagattcctcaggtgtgcagtgtgcatgctacatgaatgacacacagacagattctgtgaccgtgatgctcagtggtcccttgctggctgcgtgggcatcgggtggtccttggctctcaacagacctgtgatctctccaggcactgtgatcaaaacgggaaggtaactttgggagaagtttgagatcccagttaacccctctcagggtttcacatctccctttatattgccttggagtctgaagacacttctatggacccctagcagtcttaaagcagtgctcaataaacacacagaatagatgcttatgtctaagacggttacgctgtactgctgaggcctgctgcctgtagcctcccgggggcctgaggtggagatgctctgagttatacccatcacttcctcctgctctattgtggcagccttaggccctcctgtcacctgccccagtacagtcagctgtctgtgggcccaaacctcttgctctctgtaagtgcgggtctcaatacaaattagctgcagccgtatgggcaaaatgaatggccaaacctcttaccccgccagggctcccgcctcccctccctcttgttctccttaagccctcttcacaggcaccagctgcctcattaaagagcagcttttatgctgggcttcacctgggtaggcagtggtcaccaagcccatggctgggctggctcgctgaggcaaaggatagagacaaacctggcaggcaagtgtgcaagccagtgagacatggctttctcctttatcaccctgagctagactaggagggtgagctctgtaagggtaaaggataagggtatcaggtccttgtcctaaggaagtccctttgaagaccttgatggaaactgtttgggaccaagaaaggggcctcattccaaagaaggccaggagggacgctcaggcaggtaatcaaccaccaggggtcatacagctgaaggatagatggaggaggctaggacttctgtgggctagtgatgctacttactggtcagccaggcactgccagcgatggagcccagggggccccagctcctctgcacctgcttcttggccatgcctagggcacccttgttgccattcatccccaccaagcacgcttggttttatgtctcatcttttctttgttatcaattttttttttttactccagggagtggaagcaacctttccacccatggccaccgtacacagctccaagtcagggagatccactagtttgggtgcttctgaggttctaatctctgcctggaaagaggccaattttaaatgcagaaattccaaggccagacacctatgaaaaagaacatttaaaaaacccttctctccagtatccgtaaatgggagactttgaagtaggcacctcctcttttgctaccattgatcctggctggctggctctgggcaccctgcatggaaagtgtgtgtgctgtccactctccccacccccaccagccaatgaaaattccagtatcttggtttcaggccaacttaattctccaagcttctctggtatttggatggtttctcatctgacaagaatctggggaagacaaccagtgtgtgtgtgtgagtgtgtgtgtgtgtgagtgtgtgtgtgtgtgagtgtgtgtgtgagtgtgtgtgtgtgagtgtgtgggggttttacacacactagcatataggtgcacatctgtgctggagggtgtgtatttctctaactatatgtgtgtgatagcctatggatgtgtgcatgcatccctgcatacattatatgcatacattatatacatgtaagtggtagagtatatatgcatgtgtgttttatgggatgattgtatgtatgtacatattgtatgtagaactatgtgaatgtgtgtgtggaacatgtgaacatatttgtattgtgtgtgtagacctatgtatataagtgtgtgtgtgtgtgtgtgcgcatgtactgtgtgaagtagtgtgtgtgtgtgtttgtgtgtgcatgcacacatgtgcatatctgtgaatatgtcttttgatggccgagtacatacatatatgtgtacatgttatcactgtgtatatgatgcctgtggtaaagtgtgtagagcatagtgaattgtgtgtgtgtgtatgtgcatatgtactaaagttagaagctgaatgttttcattatgtatgtgtgctgtgtgtagtgaaatgtgtgcgtgtgaatgtgtatgcgtgcgcacacagtttcctgggggacagcagtatgctctggccagctcagcttagacacaggcaccagggtctgactggggctgcttcatctccagccaagtccttcaacagcagaagccaaagggctgagcgctggtgaaaagccccgatgtgctactgcctctcctccgactgccatggggacattaaaccttcaacaatctgggactctgacggctgggtcttggttctttgcctggaaaaacagtaggcaaatagtaaaaccttaaattctaacatgtgtaagttatacatcttattttcattttcagcccatgttctcctcggtaagacatcaggaaaaaattaccgtctgacttctaatatctcagtggagcatttatctcccagccatgataagtgatctgcaatatttttttcctttcagattaagaaacaaattcatttaattttctttattgaatgtgttcaggccctccctgctctgcctgactctcaggagccctgtactcttctccttcttcctgggctggtgactgtctccttgctgtgggatgggtgactccctagtaggcaaggcctgttccttaagggctctcaatctgtccctgcccactgcagaatgacggagagcagactgaccgagggcagcagccaggcgaggcacgtagggagatgttagcgtgcagagctggcagactgtaatcaaaacctcgtctcatccccttggcctgaaggccggtttggcactatcaggagaactggccacttcccaggctgttaggatgatgcttgctgtctggcactaccatagtgcagtatccannnnnnnnnnnnnnnnnnnnnnnnnnnnnnnnnnnnnnnnnnnnnnnnnnnnnnnnnnnnnnnnnnnnnnnnnnnntgctcagtgccagatgctgtgaatatccactgctaactgtgcttagtcttagtccaggatgggtaatgtgccttcttcctcttgcacgtccatattgcttcctatgtgcacttccatatgtgcacttcctcttgcacttccatagtgcttcctatgtgtgtttactactcagagctgtaaaaatgctacaagagtcatacataacaggtcacaatgcattccaggggttactcttctttgcagcacccagctcctctgtatgtggcctttagttgagaagtttaacactgggaccttgggtcctgcatccatctttactagccatgtgaaaccagtaagcacacctttcctttggtaaccacaaaagggacgtagtaacctttgctccacacatctgaaagggttatcaggaaactcagataaagcaaacagcttatgaagatgtattaaaatggtacacatgcagtagaaatagctgggctagcaagtactgataccatctcaagaaacagaagagacagggtaataggctgcacagagcatctcatgctggactcactcagtcctgtaaccaaggtagacatcagcgtctataggtttgtggagaaggcctatctattacaaggactagtgaaggtgggtaagtgttgaccactggcaatcaggttgaaactggacacagcagacagtggaggagggctgcaggcccctgaaacaggaacacctaggacacacagggtatttatgacaggatcaggataggttccacgaggaaggtggcactaagagttcattgtcattgttgtcatcatcccagggatgtctaagtgactggccaattctgttgaggctggagtgacatgtccccataatgatggcttcttttgacctgtttcctctcactccagggagtctccggtggactgcagtgtcagcaaatgtaacaagctggtgggcggaggcgaagccaaccccatgaactataatagctacatggatgagaagaacggcccccctcctcccaacatgaccaccaacgaacggagagtcattgtgcctgcaggtaccttgggagtcagctgcctggccaacgcccacacttccattattcaggggctgtaatggaaggttggcccatctcttagaacatgaaaacccagcaccctagtctttagtggcagactcaaaccagggaaagttgcacatcatacgtagctaccctccaaggcaggatttcaaatgtcacccgagccctggcatgctgattccagaagccccactgtcaaacataacacaaggcagattttcagtgagcagcctggtacccccaggatgaatcttgggcagaggcaaggctgctcaccccgccattccttcttgtgagaagtgcagctcccgatgtccacccttccctcaggcatgtacttcctgccttctgctagattccaccttcccaaaattacagccaactctttcagttttaaaatagaaataactatatttaacaaacagaacgcctccacgtgtgtgccacaagttatgtcattatgtagaaatagccttttttcctaggtattggtgctgttggttacggagtggggggccggggggatctattgttaaatcctctagcctattggctggatgctgcctgggccaggcccagtatgctcagctgcctaggtatggagggaattcaaaaactgccactttagagtgggtgccaggtggaaggggcagaatgtcaggagtttgaataaagtgaattacagggcgggagctaaaactaaccttaaccaaaataacttcaccagagaggctggatccttccatttgtaaatgtgtaaatgcagttgtgtcttagaacgatagtttgtcttgttgatctgaaggatgatttttgtgatgagcaagtctgtcctgtccctagtgtttgtttccatgggaagttgtatctgctatcctagtgtgacagtcacatttctgagctctgggctaaattccacatgggaaagagtgcagaaggtatcagaaatgaaggcagaagaggaagggctcttgcagctcacaggactaaaatctgcctgggctcaatcttcttcaagcataaggggctgatcgcaaggaaggcgtcacctggtttatttgtttgtttgcttgtttgggctgtttgagaaggggcttcactgtgtagcacatgccgtcctagaattcactgtgtaagccaggcagcaccttgcggcaatcctcctgcttctgccccctgagtttgggaactaactataggtgtgcaccacccactcctggccagaaggtctttattcagccagatttcacaggagccaagtgctttctcttctgtcacatcatctaattggtttgtcaccaccctcaggagagcagctggtggtggttagctcaggtgcgtcttctctattttgaggccgtgattctttttaagcagacgtggtgagagactctctccaccccactaggccaggagaggcctttgctatccaaatcgcctgctctagcctaagaaggaactcttaggggatgaaccattagaggaatggagattacctcaggaccaggtgattgtcaccaccttgctttggtcgtcataaggcagactgttcggttgtctctctacccttcaggtagttaaaatgttcttacggggattggcaaaaggtggctcttccatgaaccgacttaatcatagcagtaaaaaacaaaactggcatgtttatatcatgctgtttcaaagcatttggcataaggaagtcatgagctttagatccgcttggttattctcctactggttagatctgtatgcattactcctagacgctctggcttcctccaggtcagcctcctggacgcacgggaaagtctcacttgggcaagtccacaaatcaaggcaataaaacattagtggaacaaccgattgaatttatgacgggattttaagacaagtataaatgagggttctagttaatcaccatttccacatcgagatgggaaggaacaagggctaaatcgtccaggaaatacatttggaagagtttagcatgatccagagtggaagatttataattccttttactggagagggagagaattaacattgtgacagagcccaaagcgaagagcggaaataataaaataaataaaatatagggcataaaattgaatgtacagtctaagactctagtaagttcctacaagtaaggaactaggggaagctatggatgaaatgatacaccacataatccaagcccctgtgggacatctccttttgaattctcagatttccattcatctataacccttgcttgatggtttctgaaaagtagagggttggaaacagaaccaggagtttatctgatagacacaaaccccaacatgagcaagagggctagctcggggagatcttccgggtcctggaacaaggccttgcagttccaaatgagttaaggcgggatcctgacaagacaaagctggggcgggggggtgttcaaggggcctgcttctccaactatgtgacatctttgaaggcttctgtaaaaaccctagcagtagtcacgaaggcagaacttccacggttccttagccatctacaaaatgggtataacaagacccatttcatagattctcatgagagaaaaaaatgggtcagatagagagctggcttgtggtaggatctcacagatggactattactcagtaggtacatcttggagtcttagtatgacatacagaagctgtgacatatgacagatttttttctgtgctccctctcaacctctcaagggtttcttttataacccctagagatcacagcacctcactccctccccaccaccattgctggccatttagaactgagttctcttagcctagatcttttgcagcctctagaatgagaggaatatgagttggtttaagaggagtacacgtttttcctgctaaataagcatgctaaatgaaacaatcaagcagaaaagcagaagcaggagcaaccagacaccctgtaatataaaataccatcccttctccaggaagccttccaggactctccaaattcaccctagacccttcaacccaaggttcattgaactaccagcacaacccattgcttaggtattgctctgatggctgcatatttatgcagatgggtgtgtgtgtgtgtgtgtgtgtgtgtgtgtgtgtgtgtgtgtgagggagagagagagagagagagagagagagagagagagagagagagagagagagagagagagtctcaaatactcaaccctcctgcctccgcttcccgagtcctgggattgcttgaatgtatcagcatgcctatggaagtctgtcatttatagcatctcccaccttagactgagcaggttgagaagatgcttcagggaatgatgaaacagagggggctgggagaaggcaggtttggagcagaggcctcagtcctgtcctgtttccgctcattcacagttaaagaggtttctgtctctagagccatttctcatctttaagtatttaaatatcctaaaaatgtttaggggtggtctggtagaaatcttaacacagctgtccccccccccaaaaggaggaaacccagattggatttatgtcaaacagtaacgccattgggttttccagctgccaggacagaatcacaggaaaagcaggcttgtgtatatttcccttccggagagtccggagggataagtgtgccctcctgaattcactgctagtcttaagatgcaaatgggtccccttcccagaaacgttagttactggggattattttcattttgatgtcaccatttcttgggccaagctatcacttgacctccagaaactttaaacaccatcctgtcagggtatgtgttgaggcagctaagaacctttctcagccctaagtggttcaggcagtgtcagaagccatggaaccagacggagagttctgaggggacgatctggaagggaagagagaggaggtagaaagaaaagagaagagggaagagaggggcataggaaggaaagatgggtgggggtgggggggttaaagataccatgaatcaggagtgagagaaaaagaagaggaaaaaggagaagacggaagaaagaggagagagcaaaaaaagaggagaagaaaagagggggctgtggggaaagaggacagaggtggaagaagcaaagaggagaagatagagaagagagggtggaggggagcctaggctgctgggcaggcatgcatgctgaccgttgttatctctccactgcagaccccacactgtggacacaggagcacgttcgacagtggctggagtgggctataaaggaatacggattgatggagattgacacttccttcttccagaacatggatggcaaggaattgtgtaaaatgaacaaggaggacttcctccgagccacctccgcctacaacacagaagtgctgttgtcgcacctcagttacctcagggaaagtaagtaccatgtacaccccagggcttgggagcaggtcctgccaggtccccaagagccagcccaagggaaggataccctaataccagtcatggaagacctatgccaaggaacagtttccttaggacaggaaccccatcaaggtcacatgtgttcctacaaagcctgcaagggaaagatttcatccaggagtggagtgtccaaaggaaacagataaaaaatggaaaactcacagagacctgggacatagggaggatgacaccagctactaggtaggctctgggaagatctctctcttcagaagcttctgctaaccaaaattgtacagagatagaatctctggttggaggctttctaaggaaatgttaagagttcttaccggaagttctgaacatagatatgagatctaagattgtgggagctgacagactactcctcctattctggattcacattgatgcccaaccctaacctatggggctgcttctgcccactgccacgaaacaacaagagcatctagtggcccaggtctgttaggaggcactgaaaactttcccagacagaaacccagggaaagcttagtaaagaaagatctacccaataggaggctccctagtaccacgccccgcccaccagttccatgtgaattttgatagatatgaaagggaatacctatggacctgctagtgactcagccttaactctccatcagaaatccagactatccccaagcctggaagtgagctcagtggtctgcaaagatgaactgaagccacaggaaggcaggcatgggctcattctgcatgagagcatccctacagccagccacgtcaatgattagcggggcagaacaagatgcactgtcctctatgaacggcctagtttgccagaggtatcgtaagagtttgagaagatttgattgttttaaggcacctttgaattctcagacctcggccaacactgtggggctgccttttgtgggttcacgggctctggaatggttcactttgtataggatctccattgtgctttcagttgttatcagtaaaatacatcgtctcagtgcaagggagttctgtagagagcagggcaacactctactcacatgggctagaaaatgaaaagttaaaatatttaaaaatgcatttggaagtttccatgggtgcctctgggctggctatcttgccacctctctaaggcatctggtcgtgctgggagaggacacattagctccactgcaatgacctcatgtctgagttgctgcaccatgaggtcagtccaagaaataacactctaagaaggggccattttctacttagtctctcctgactttcagatgcttagcatttaataatgatttgtatttctcagcctttaattgcttggtggaaggaaagaacaaaaggatcttttaacggagttctgccatgatctgcacaagcaggagaggcagtaggcacagagcatgagtgtagaaagcagaggccaggagcatagcgccatcaagcctgacttctaggctcctcccgcatcatctatgcaagaggttgagtgatccctaaggaaggagaaatgtcagaagctccagtgagctctacacaaagggtccaataatcttggctttcacagtaaatgctttgtgaggaccatgtccaagaacgtttggacttcataaaagagaagcccattaagaccatgtgactttcaggcctggatttctgaccaacccgtaaacagcgcaagtttctatttcttccttctgtcaccaaagaatctgagccacagatactgacatgaggcatatatctgctgctcagaaggtctaggaatactgttaatcagtcactgcttcctatcaagccttggcaagcctgctagtagacaagggcagataacaaggcatgatgaaggtatgagcagctatagagggagcagggaatagagtttggtgtttggaggctagtgagaaaaaccatgtagtctctccttttaagaacacatgtaatcactatgaaaaatgtcatacaacacacgaagtttccagaagggggatttgctatgaaggaatttccagagttgagaagaggtagtacatgtgtatgtttggaaagcctttgaaagggcagtaagcatgtggtgataacagttgggagttctacacagggagagttttcctgccaccaaaatggaggtaaaacataagtgttgcatgtacttttatgctctaccagcctttgctccaggaagtgaccatgctaccagccccctcccagcttcccatgaatctgcagataagagacacagacactgggctggagagatggctcaatgattaagagcaactactgctcttccagaggtcctgagttcaattcccaggaaccacatggtggctcacaaccatctgtaatgggatctgagtccctcttctgatgtgtctgaagacagcaacagtgtactcatatgcatggacggaaggaaggaaggaaggaaggaaggaaggaaaggaaaggaaaggaaaggaaaggaaaggaaaggaaaggaaaggaaaggaaaggaaaggaaaggaaaggaaaggaaaggaaaggaaaggaaaggaaaggaaaggaaaggaaaggaaaggaaaggaaaggaaaggaaaggaaaggaaaggaaaggaaaggaaaggaaaggaagaaagaaagaaagaaagaaagaaagaaagaaagaaagaaagaaagaaagaagtaagtcttaaaaaacaaaagacacagacacacagttgttcaatttcaacttgccttcttgacataattgctggggattactatctcctgcctggaaaatgcacacttctctatactcttagctctgtacctcccacctgccctgaacttcagtggctagttccatctagcccctgccaaacatccctgaccaaccacctgtagttgtggccacaggccccagcttctcccaagacctcatatggctgctccattcttctccctccaaggcttggcaaaaactccccctctccttcctttcctctcccttttaatccagcgacccggaagtcctacctgtaccttctgtctagcgattggcccatggctttctttactgacagatcaagaaccaattggggaataggacctcagtatcagacctacccttacacataagatgtgcttatgacacaaagttgagtctgtgggccaaaacaaatatgataatggttgcattaaatttaaattttcttgaaatgtaatacagattgtaataaccttctgaggcacctggatttaaaatgatcttcatgaaattttttctgactttttttttcaaattatggtttcttttttaggattctaacctctaagaccctggttattgggtactacttggctgtatcaaccctagaggaggccatttgtcagacattgtctgctctgtgatggctgaaaacttttgcctgctaacagacatgccttcaagccttctctgtttttgtttttccagactgaattacatgagctatttcatgataaagagagagaccagggtttggctgcaaggttggggccagaggaacaagtgtagattcttagcatcattgtgttgggcttttgttggggagcagctggggctaaatgattccccttttggcaagacatagagggaaaagagctgagactcacaacatagatgtagggcacagcgtagagtaaagggagatcaatacagaaaaactggggactagccaaagcatggattgatggaagtcaaaattggctcagcaagatgggtcagtgggagaagatacttcctgctaagactggcaatcatagttcaatccttgggacccatatgatggaaagacagaaccaactcccattagatggcctctgacatccacatatacactaaagcatacaagtacacacacacacacacacacacacaatgtaaaatttgattgcacttttctaatctcttatttctgagttttgttttttgttttgttttgttttgtttttgttttttgttttttgtttttttgttttagattccttgtagggcgctgcattcttgcatcaaatttactttcacaagagacagttggctattcttgttgtctgggaagaaaggtctactttaagttctcaaagattaatcataagttaaagaggaatggccaatgataaggaagaaataacaatgtcctcatggatgagccctgcctagagggtctggctcttcacatctgggcctttcttttggctgttccagatggggtacctgtgtagcattaggaaagagatgaagggactagaactgactagggtacctgcagttattggagttcagctgaaatatctgagacacaagcagacaccagcccaggtgtcattcacttcctgtggacagaacacccccttgtggacaccatgaacaaaactttgattcccatttcttgaccgaagcaactgaggctggctagtttcaggagcccatccaacggtatctggcatgtacaaagcacctgtccttacctttagtcctcggaccactgaagctttcagtctgagctaaggtcactgctgcagaggacttgatgactctcatgcaggatgcttgaatatgcctgaattaagatgctgacacaggcagaccacacctcatttgtctcccttctcatctccagggccaatctcttctccagcctccaacttgagggcaaaaccaatgtccccatatggctttccatttgtgttgcaccaatagatgcaggctttgcaaaactcctctgcagcctccaggagtgaagccaatcaaaccaaatccctcctctcacgcaccctgacctcctcgattcccccagactctgggtgtgattggcagctctgccaggatctcccagatatgcccactggacagagacactgttggcagctgagaatgggcaagtgagatcagtcccttctcaggccaaggccaatgaggcaacgctatctgtctccaactaacagttcagtcacagagccactggggggagtttggggatgtctgggagcccaaaagctcctgggatgagtggcccaaagcagaagaaaaggggttttgttgttgctcctgttcgttttcaaaggaagtgagtggaatgtccatctgggcctgagctgggaaaccttctaagaaggcacactttcagacagtggcaaccccagaggatgaaatacatcaagtatcagggacaccacagaaaaggactccagcttgattcccatttttaatttaaacgtaatggaaaacacattttacactctgtgctatccccatctgcaacctcagatggccatgcaaaggtgatggcccagtcattaagccaaggaagtgttaaactttccatctggatcaggccaagaaaagaaggcaggcttccaataagataaagtgcccagttgcctgaaactcagtagtcagctggcctgttgtttagcgtgtagagccttaattccctccccagtgtgcatttagggctggggctggctgtagcacaaagaaagtgagctaggaattgactggctggctggggttgggttggggtagatgctgctgggttctatggtaacatgaatggagccagagacaaaggctctggcaccaggtcccctgtccacactgctccaggtgtccagtttgaaaagcaagttagagagtccgcagagctaaaggaagctaaggacttcccatctgcaagtcccatcctatgttcactttactaactcctttcagatcccaaaacggaaaacgaccttgctgggctagggatgtcactcagttggtagagcacttggctagcatgcaggacactctggttttgatcgtgtgcaccctagaaactggtgtggtggtgcctgcctgtcatctgcagcacttgggtggtgggaacaggagtatcagacatttacgatggtcctggggctgtgtaatggctgctaagccaacctggtatacatgagaatctgacttaacaaagaaaaaagaagaggagaggggggaaaggaagagggggaggaaagaagaagaagaaaaaagagagcagaggaaagaaaaagagaaaacaaagtaatcttgtcctcgagctcttaatcttgaaggaccgggtcactaccaacattttagagcaaaatgtgtctcaaatcaacagacacatatatgtgcacatgaatgtatcctgtctcacacacacacacacacacacacataacagagtgaacaacactttaaattaggtataacatgcagggagttatgaaaatcacaaggtacaactagcccccaagacacctgccctcaccttccagcaccttttctttcccttcttccttccctcccctccctcccttcttcccttctgcctttactaccccccttactatttgtttgtttgtttataatttctgggacagcctcattgtgaacctcagcctattggaactctcggtggtgctcttgccttagtctctggagtgctggaataaacgtgcatccgttcttgcccatcttgcctgcattgatttaacctaaaggatgctcctgcttctgaactgaggacaggtcttatagagcagcccatcagttgatcttgtctcttggctctggttcctctggctgtgtgatcgtaagccttgacttccctaaaggttgatctcagctgtgggaggagactagcatacgcatgctttgggtggccccttcaaggactaagtaagagagatagtgtctgggaagaaggggggatggtttagtcaagaaagagccaggcatgctagtgtgaagacttgactttgatccccagaacccacgtggaaaaagccagttgtgacagcatacacttgtctcagttgtccctgcactgcggaagtgaagacaggtggattcctgaagcttactggacagccagccttacctatcagctggctcaggtcatagcaatagactctgtaccccaaaaaaccaaggtggatagatagatcttgaacaagggcacatactcctttcgtgtataggagtatacacaggtgtgtgtgtgtgtgtgtgtgtgtgtgtgtgtgtgtgtgtgtgtgtcctatatagccattgattgtggcccttgctttcaggaaattcctcaggactcagcagcaatagaactgcttaggtcagatcctcagagcaggaggaagaaactcaaaacctccaatgggagaccagactccaggaaggacttccctgtaacagggcaagttaacgtaatttaaaaaaaaaaaaaaagacacaaggggcacccttggcatcctgagaacctggtgaaagaaaacccagtgaaaagaaaatgtgtctccctggggagaaaccagccccacccccatgtaggttgcccctcccctgtgaaacttgaactaagacagtcttggggcaaaatctctcccctaggttaccatgaaatatgtatttcatgcaggctttcaggaggtcaagcgaccctttctcttggcattctgggagtttcctgtggcttcacgtgtgcccagagaggaactctgaccatggggggaaatttaataaatgtggtttatctgagctccgtctctgtctaactttgtactaatgactggagtggtttgctgcttggagaccattatttttctttatttgctctagcagcgaggttctgcctgagggagaaaatgcctgggactgaggcacagacattcttgctcttacccctgagaggtttggggtattctcttggaacgtttgattccatttctgaagctctgtccagtcacggagaattatccctcactgcggcagaatccatccctagctggaattccagccggccagcaaggccagtgcccgcaagctctgtgtaaagggtttccattctgtgtaactgaaagcagtcatgataagtgctagcctctgctgaatgtttaaaacaagctaggatctctgcagcacaccttctgagcttagttttattgaagccacattctgtagatgtcatttttcgcccagtatagacgagggacatgtgaccaggggagctatacccaaataaacttgttactttgaagtaggagagcttagactaagatgaatttgtcactaatattcttggaagatggaatgttgccttcgggtggctgtgtcccttatgtaatctacatatctgcactttggcatatagcagtccctaaatggtacccaccacctcctggttttcacctaggaactgctgagacctagaagtgataggtacctaagccaaaggtcttatgtcccataagaggtgactttggctgccctgcttagacccatattttctgagtattcaaccagagcatccgtagctaaaggggacacccctctacttcccagcccctccttgactggaagctaagcagaggcatggctgacaagccattcccagcctgaccgtcagtcagttcccttggccacatgtcgcaaggagaagagttgtgcttagaaaggctttggtagcctcaaacacatgtgttgagctcatggcgtcctttgtaaaagcagatcccagccctcattttgaaggcttaaaaaaaaaaaatccccaggagaatcatgagaggaatcctaaaaatgcctccaatttataaaataaactcttgggatcactttaaacaaaaggacagatctagtctgaggaaagagaggaacatatgttttacatgcaatcacaacagaaaaacaatcgtctatcccaagtagctccactggacctggtgcagagacgtttccatcaaagcttccgtttagaagaccacacaccagcgggttgagatctgctgttctagacactgagaaaattgtctgttatagtatcgacatcccagaggtggggtcccacaatccacggcccacgcaagggtcagcagcctcctactctggccccatttctaaagtttcctctacatcttaattctaacatgctgggaaccttggctttaacacacaggccttttggagaacgttctagattcagaccgaggaagcttgatgtttctgtttttactttcatttcaggttcactgctggcctataacacaacctcccatacagaccagtcctcacgactgaatgtcaaggaaggtgagtctgtcctctcatgcgcccaggttccctccactctcaccaccgcacaggtccatacttctcagacaggtgggggatgctatgtctggacaccaattccttcctcgggaaactatttttctaggacacaagataaaacaaaaaacaaaacaaaacaaaacaacaacaacaaaacaataacaaaaaaagcaaactttttttttctttctaaagaccatgtttttcttcctctgccaccatttcagaactacaagggaggctttgaaagatctcataaaaacatcacaagaatataaattaaagtcacccccacccaaagaaagggggactgtccttagagaacaatgaatcggctgactttccaagctgacactttgggggctctcctggtgaagataatggaatgtatgtctaccttataaagttttgtttgtttgtttgtttcctaaaagaaaatttagcattttcagttcgtgtttaaagtggtgatctgaggatttggtctaggataagttgacctgttctggtttgggttggtttagtcaaacagttcatttgatataatttggttttgatcagcgagaaaaaaaactgtcttgaaaaaatggttttagtgaggcgccacaaggatgcttctcagagtcttcattggtagggactgacgctccagctctctggtggagtgcatgcacaacatgtgtgaggcccggggtttgatccagcaacacacacacacacacatacacacataaaaatgcacatacatataagtacacacacatacacacatatactcacaaacacgcatatacacatacacacaaacactcgcatatatacacatacactcacatatacacacatacactcacatatacacacatatgatcacacacacatacacacacatatattacacccaaacacacaaataaacacacatacacacacaaattcacatacacacacatgcatactcacatatacacatacacttacacactcacacacacacacaaactatcacccaacctagtcttgttttggccaccgagtccccaaatcagatgaatgatatttttgtgtgtgagaattgaagctctgcccactcattctacagtctgatgatctcctgccccatcatgttacacatgcctatagcagagaatacctatttgcatgatgaatacactgaggtctggttccctggttttgtcacatctctgtcctcagactcacgtcaggttcagggttcttccagggagggtcaagtcttgactgtaaagcaatcagcttctgaggatggctgacaatggggccatggcttgcaggtttagaaagaaacaaataagccactaaacagagggagaaaggagaggaaggatgggaaggaaaagaaagaagaaagatggacgtgaagggaagagcaggaagggaaggcgagttttgaactattgaattaggatttactgtacagcgtgctggtaccatcagaattaaccaatgagacttttgggtagacagaactaatggtctatctgctctgttcgtacaggtttaaatactggtttaggttgagaaactggtctgcagacaatgcagtcactaaccaagtcctccttgctgctgaggagttcagtgcagccctggccctgggctctacctgccaggctgagcccctcctccgctggcccttttgtgttgagagtgcatttgtctccctgccgcctcattcaggctgctcggagccgccagctcctactgggtagcaaccctcttctgaaatgaattgactgtagcatccaggcaaacgcagcaccggctgcccccattcaggtggtgatgggcatttatctcccagcctcggccctggcctctagagacgattaagccagtgctttgcaggtgcatcttttgttcccagtaaagctctccacttaggcgactgccttcccccttttgaggtagtctggctgaaggagccagcctgccacaaaataaagtacattagcaatacaaagctaacaaactcctcccccctttcaccctcttcccacctctctgcctctcttcttccctaatagctatctttatttttttaatattaaatggaaaaagaaatagaagacatcaatgccaccttgactatgtctctctttgaataagaggcacacacggcactcaatcagagctgggtgtgtgcccacgggtgcctttgctccctgctttgcaaagggcaggtgctagctggcatcaggcgcaaatgggagaagctgaggagatgaagtctattaatgtatcttcatggtacttatcaactagagtgctgctttagttcagaatggcatgatcgtcctttctagcctgcctacctcctaaaacactgactgaagctatctcagggttatttgtatgtagaacgtaagacaacatttcaaaactcaatttccacagacctgtaaatgtgttgtgagtctcagttatacccaattggaaccattgaacattttctaccttatttgtcaagtttaatgtacttaaagcaggaagacagcggttattgtcaaccatttccatagcagcctcggctgtcacttaaacaggattttggagtgtgcctggtgcgggtacatactttgttttggagctttgcaccattctgtgagtcagtccgctgtttttgtttcctttctgtgcagagaggtgggacaacatgaaagtgacccctgaatggtttgtagcccctcagagtatggtaaggaaagttcccctttcacttaagccactgtcataagagagaaatggttgttaccagagtctgggaaggccatgaatggaaaggttatagagggtgaggggccagtggggacctcatgcagctgaaggaacagcttctaaggcagagtaggaaaagaatgattgacagcagtcaattcaatattttcaaaacagctaataggattgtgtgtgtgtgtgtgtgtgtgtgtatacatgtttgagggcgtgtgcatgtttgcatgcgcacacatatctgtgtacatgcatgtggagactataagctggcgtcaggtgtttccctgggttgctctccactgaacctggaagccatccattcagctatgctggctgtccagtgagctccagaatccttcctacctctccctccttagctttgggatttgagagccacactgtggcaggcatatggcttctagaggctgccagggatcccagtctggactctcatgcctggtccacaggcacttcaccagctgagctgtctccccggccccagtgattacttttgtgacgtgatggatgtgtctgtgtctttcacctgattgttacacattgcagataagcttagtaacatcactctgagttctcaaagtacttacagtcactatatatttgaaatattttaaaatatgtatgatttaatggcccttattgccaaggttcctcctcaaaaacacagtcttttccctctagctatcttttcctaagtgtaatttggtgcagaaatttgaatttctgcaacatttttctctgcctctgtagtttttcactgctgcctccagctacatctctgttcccttttcagaaacaaatgtatacccagcctctactagaccttagccttccgtcttaagggcacagagagccccttgtagactttgtaaaacaatgacatccaaggacaagtcctctgtaacttccttctctggagcaacctggagccctggagctcactggatggaaatgggggctggctgccagaggctgcaggtagagagaagtgctttgcgttgactgctgacagagagagagtactgaagctggaagctggtgacgatttcactgtctttgaatgtgcagagtgtggctaagttatacacttgaaagtggttaaaacggtaaattttatttttaaaaaattaaatgcataaataacaacaaatactgaggctaaggcccagacataatgtgttaattctaaatctctactgggtacctacgggggccttggggatttttttcttaagttctagctggacaagccctgcttcgttgtactgaaggaacgtaaccggcacatccagggccactccaggtctttctggatccttctgaccttctctgtccccaggtcatcctagacaaagacctgtggatatactgattgtaagcacgggtgggtgaaatatctcacagttgatgatgtcattattactgttattgacaactaggtatgagtttagcatcttacatcttagaaactccctgctcccatgccttcatttggctctctaaaaacagatcatgtgttgctaacttgggtatatgggggagcactgaggctcaagagactaagtggcctttccacataagccttctagagccaagcttgaccctactcccttcttccctgtcctgcacactgaaatccagtgtgactgctgatcctgggtggtagatccaaggtcccagctttctctttggttttctgggcagctcctgccccagggccctctgcaagtgctccttgcccccacaataggcaagagtaggcacctaacttcagagctcccctacatgcctaaggccctcatttccttagccctcatcctgcatctatctcaatacctccagctctccaacaggcagcggatatagagctccttgttcactaacttctggacctcatagctgacaaggcctggcggagctctgagcttctaggcccccacctagagcctttgagacttgatgccgaaggtgaaaaactgaaaaccactgccctagctgccaagggtagatggcctgcagaagctccattactggcacttaccttgactgatggataaaaagtctgtcttcatacttgccaaggattgaaaagagaggggctaaatcgccccatgacacatatgctggatgcccagctgcccatttatggatcatgcttaagagagcctctcctctcaagaattccaaggacaagggccaagcatggaatagcaacccttctgtagtatctacttaccaaatattttcacatccattatccattatccacacaccatcaccatgagatcgcagctgctaccttcttgtccccgtcctgcagttaaggataatagggccaagagctcccaatgttccttagatgtcacccatatttggggcaaagcaagactacccgtgctcgcttcggcagcacatatactaaaattggaatgatacagagaagattagcatggcccctgtgcaaggatgacacgcaaatttgtgaagcgttccatattaaaaaaaaaaaaaagactctacccaacataggtttgatttgctccccataaaatgtgggaggggtgcttcccacattttaatctcaacatcttaagtatttgttaatgaatgttttccactcacctaaggtaagcacccagctcctctttcaatgttatactaatgaagttgcagtgtgattttgggcaagggtttgccttttctgtctcagtatattatttgtatggctgtcacaatacctgacagaaacaacttgacaggggagatagaaactttgcggttttggagagacttcagtccattgtggtggagaaagcatgatagagggagtgtttcgcagagatgagaagaatagaacatttggtagtgggcgatcccatggtggtggaccaagattcaatggttaagctatagcctttatcattagcctacccctagtgatccacttcctccaaacagtctctatctcctaaaggttcaatgaaattgtaccatccagtgggcagcgagcatccaaaagctcggagcctgtgggagatgtttccgattaagtcagaacactccatttcatcatgtataaagtgaggctaatttccatgcccttgtaaatcagcatgatgtctgacatgccaaaaatgcttgataaattatattcataacagttcattattatgatttatgacccgaatttaatagtaattaacattattgttggggaaatatatttgagggttaccagaggctaacaatgtgaagatattgtactctaatggatggtatagcgctgtgcaggatgctccaccatagctgagaagccaagctgctcaaaaccttcctagggagagacccctataggcgatgtcaggaagtgctgtcaaatcacattcataaatgcaaagtcacttgtcacattcaagatctccaaggggaaggaaggaagagccacagttgaaaatacctactgaatatcttttatacaaaacaaaaaaacaaaacaacaaaaacaaaacaacaccccccaaaagaatcaaaggccataaaatggttgagaccagccaaagccaccctaacctgaaagatactacagaagactgaaaatacgtcagaccacaagcatttagtatatgagagatccaagctgtataggactttttagtattatattagtttaccttttgtgtggtatgggtggtatgccatagctcaagggcagaggtcagagacaacacatgcagagttggtttcttctaccatgtaggttctgtgatttgaactcagatcttcaaggtttagtaacaagtgacttttctcactgagccatctccctggcccagtgtgttcatgcaaaggatgtaggtggtcagtgccttagtaaagaatggacctgaattctgtgagtcgttctgccttctcccagttgctcattgattctctgacttatggaggatttgctccatacaataaaccttccagaatcttggaaatatgatagccaaggggcgccaatcacacctgcagatgagcagtagagtctcagaaagtcgtcctgctgcctcctgcacacaccctctccatcggagttcagaatgacatcatccgagaggttatggtgtaatgtgtgtgggggtggggggaggggtgtattctggaaaagctggatgtggctatagaaatgtaggaggggcaactctgattctggggtgtgtgtaggcactgccatatgcctccacgtgtgttctgggtggtattttgaaaaaggtgagtccctatacacgtgaacaaagtgtcagcgggtggcatgtgtgacccttgggtaggtctccagcactggagacaatgtgcttaggcacttcatggtgagactggaatctcaggtatggagcccaaagcaggagccaggaatttgcctcaaaatactaaggcccagtggtagtggggtggagctaaagtgagattggccatggcttttaattgttcagcagagcaatgggccccagtaaggcttcactggactttttcccttttatgtatcttggaatttttctgtgactgtaaagacaatgataagttttatctgagtgggaggacagttaaacgagcagaatgtctgcattccacacctgtgtacagtgaacgagggtggcgtgctcttgggaggcccacattcagactgtgagtctatggggaggggagagtaggtgaacatagaaacaagaatagaaatgatgtggtgtgtgtgtgtgtgtgtgtgtgtgtgtgtgtgtgtgtgtgtgtgcctgtctgtctgtatgtgtgtatgtctgtgtctgtatctgtgtgtgtgtctgcctgtctgtgtctgtgtatgtctgtgtctgtatctatgtgtgtgtgcttgtgtgtgggtgagggtgtgtaattgtgtgtttctcagctatttctgtggtccagaggcaagatttgtgattatagataaacagtagctttctctctctggtttgtatttggttttgtttttaacttaaaaaaaaaatccagagttaatgtcttgtctgtttcctatctgaccctctttaagagatgtgtttgatttttaaaaatttttatttttacttacttattttcgagaaaaagtggcagagaaagagagacagagaggcagagaggcagagagagacacacacagagagagagagagattgagaaactggaaacaaagaatcgttgtctctgagccctggcaggcaggaaaccccaatctcaggggagtccagccagccagcccggccctggagtcagactccaagtttctgaattcaatttgacagcttgtctgggacactttctaagtaaccattatccttcctttctctaagtaaaagaactgttattcctgtcccagggtgtgctgtgtgctctgttattgcacacgtgtggccatacgatgacgagcacacggtctctaaaattactggaaacagttttcatgttccctaagacaagtgtaaatttgttccaggctaatgagcaaaagatttgaagtctcattccccaacctggtgagaagtaggtagatgggcgaggggggatgaggggaggggagcatttgccctggtgttgtgcatgtacacactattcttactaggatttctttgaagtacacacacacacacacacacacacacacacatccttcactgaccactatcctcagcgtaagcataagttctctccctctctcgtccacactcacatcagcctagagctgcaggttgcaaggagatgactcctctgtgttcaatctgcaggccctggaagcaggaccacactgggttctttggatctttgacatggtgttgtgagggattaggcagcagccaccccctctgttcatacttgaaatccaggggcaacgtgtaagtttatgtcacagcaccttctggacaactgtggatgcttgctctcttgggtctgccctcgagtctgaatggaactgtacctactatgccttcagtcaagcttgggactgtctctccacttaccccacccctacccagggacctgccgccccttcagaggccttggccctatagctttgcctggttctagtctcctctgccccttttatgaggtgttttgtttgtacccactctttctccaatttagtagtgtttagtattggacagattccagaggacagttttttcctctcaaatgactaaagcaccctggagctagaaaccattggatgggcagatgaaagtcacccttaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccttccccttccccttccccttctcctcctccttctctttctttctttctttctttctttctttctttctttctttctttctttctttctttctttctttccttccttccttccttccttccttccttccttccttctttcctgtttctatcttttttcctttataacatatttattaaatacttagtcatggaagatttttctatgccataaaaccttattagtttaatgctatcattattcccattttatagatgagaagcccaaatcaccatgttggtttgaagcagggcagaatctgttctcacagtctcctccccagccgaggtagaagacaggctctgaaatttcctcttgtatttcgacccaactatgtcttaattactactgatgctgagggggaaaaaatgccttgacaaaagcaacttggggaagtaaaggtttctttaagctcacagtttaagattcatcatggtgagaagtcctggaggtaggagtttgaggcaattgttcacattgcatctccagttaggagttagcagagaagagcgactgctctgctccactgcctttctccttttaatccagtccaggatccaagcctagggaatggtgctgcccacttctacctcaagtaacctaatcaattgttcctcacaggcatggccagaagtttgtctccttcatcttgccaagttgacattaataacatcacagcatgccaaaagacccatttctttcaggaagctgggtttgtctaattgttaaaaccatgggactgcatcgattcctgcaatggttcaaaatttctcaatgttaccggcatttctggaggcatattagtttgtttcacaaatttttctgtagatatatttttataatttgcatgatgatacatgattaagcttttgagcttaattgaacacttaagagaaatgaaaaaaatgagcttcagtaaaaggcatattacactgagtaaaaccatttccatgtgttgcaatgaacttaatctgaaaaaacgagagtgagacacagacatgtcattagaaatcaggttgtcatgttccccttggttgatatgagcatcaatcatgaagaccttccaggatcctacctcacctaagctccctccatgaagttaacttttcctgcactggggcactgaggaaggaagctgtagctgactgttgggtccttagaatcgacagcttccattgcttctgcagtgttttcccacctcaacctttacagcccacactttgttctcacacttaatgacaactttagcttcttggtttacatcagcatcctttctgtcaccataggctggcctctcatgtccctgggccagaagacagcactcccctcagatagtcagaagttctcatttagatcaacatgactttcttgtgcctgtctttgcttttatgcatttcagagctgttcttagaggcttccagaagaaataaatgaggctgtaggtacccatgtatgtgttctgcgctgctaatgacggtaacggggaatgcacgtgccctggtgcatctctataaaggaatgtgattcctgtaaacacttgaaggtagagggccaaatgtacaaggctgtgggaagatatttgtgggtaatgacatcctggggaactttccaacctgactccattcctcctccttccataccagcagagagaggccttgactgtagtgctctgtggctgaagctctgaccatatcacacatttcttggtagcaattcacacttgctaagtaagcttggccttccttattcctctccagtcttgctgttactatatcagtcctgccgcctctaccaagctgcttcttgcgttaaagatctgtctcactccacagagtgaagctaaaactcagaatgaaattcattttagttcttaaacatcttcaccatgtgctctgatttgtgatggaaactaaaagtggtcctgttagctgatgttgagaagggtttcaagttaactggcaagaaaaggggattgtctacaagtgctgttgatgctcactggtggctacctcagcacagggtcgtccagatacgtgggctttgcccaatgtactgatttagctattccaggaggtttgtttagctatactggaaagtatagctggcctctcccatccagggcttccacatcggcagttttgaccaaccattgctagagaaaagagcatcctcttggacaagcaagctccctgtcatttcctaaatgacacagtatagcaacgaattacattgtgttaggtattttaagtgatcttagatgttcctccagcagtgcagtgagttagtgtgccttacttacacagcagtgtgtatgcatggaagtgataccccagtcgtgagatagcgtaagtggtccatcaatgactggaagtctttgggaggatgatcatgcgttctatttagcactgtaccatgagaatttgagcattatgggtcatggtgcatgatagagactctgaaaccatttaccctcacatgcaaaggaaagactatgcttacaaaaaaagcttattttcccaagcctttatctatcttatgtctgtctgtctgtctgtctgtctgtctgtctctatctacctacctacctacctacctacctaccatccccgtaaagaaaggtatagatctgtcttttttttcctctctatttgaagaaggaagaagagagagaagcacagacatggaagcccctcttgacgcacagggaagaagtgtatcttctagttaaaaggatgggctgtaagcagcaccatttattattttaatatgaaaatcttttatagatgtaacaaattcctctctttggagaagcctcaacttaatatcacaaagaaatcatttctcctgtagaatccccacggaagagaaggtaaagtctttcaggaagaaagtctgaggctggcatgggggtgtgagggctttcccctcttttgggaatccgcaggtctcacaagtaaattctgagacgcttcttccgcctctttggtacagcttgaattcatgtcaggcagaagccacagagagaataataacattatgtaagataattacttatatgtcaaatcccaaatcaatcctacctgctcagtgtgtttaccttactccgacgaactgtgtctcttccctaagccctgaacccaggagctatttctgaacctaattgcagattatcttgtcatctttaattgtgacttttgtccattattcttttctcccaccccaaagattttcagtaaataaccttgacagttgatggatttgctgggaaagaaaatctaatctttttcaattgagttaaatatttactcagtcttgctctactaaaggaagaatcagaagaaattatcttagcacaagaaaaaatttatttctagccaggcagtggtggtgcacacttttaatcccagcatttgggaggcagaggcaggtggatttttgagttcgaggccagcctggtctacagagtgagtgccaggacagccagggctacacagaggaaacctgtctcaaaacaaaaaacaaaaaacaaaaaaacaaaaaacaaaaannnnnnnnnnnnnnnnnnnnacctgtctcaaaacaaaaaacaaaaaaacaacaggaaaaaattaagttcttatctcctatgaataaaaaaacctggaaaagaatagtttggggaaatgtctaatgggtaaaatactgcacaaaggtgaggttaaattcaggtctgcgttacccacataattaaaaaaaaaaactgggcaaggtggcatgcatctgtaattccaccctgagaatagagacaacttgaacctaggggctcactggtcagccaatcactggccaaaacagtaagcttcaggtccagtgaatgaccttgtctcaaaataacaacactaatcctactaaataccaataatgatatagaatgcagtaaataggaggaagatactcaaataccacctctggcatccacatgtgcataccaagatgagtgtacaagcacacacacacacacacacacatacacacacacacacacacacacacgcacacacgcatgcacgcacatgcatacacacacacacgcacatgcacacatacaccaaaatgctgactggaaaagattaactacaattccataggagactttggcgtgtgtgaagggtttgtgtatacatgatcttatctattctccaaagacccttgtgaggattaaatatactgtttgctcttgcatggtctgaaatttacaaaatagtcaattgtttctcacaagagtatacttttcagagaggggaagtcactcaccaaggtgcacacagcacataactgatgatctgggaagcagggtgcagagttggagtgacggagatcccgaattctttcctttgcagtgaatggctttactgtttggaaaccatgagattgcttcccccaaatagctttaaagctttaaatgacaccccaaaacagtccagttcttgataagattcagttattccaaagaaacacaagcttctcgggatataattttgaaaactctttgagcctgaaagcgttggctggcccagttactcaccagtcctgcccaatagcctaagatcagtttaaagaaagtcagttttgatagtctgagtcatattttcaatttctaataaaattcttacatggccacatacgctgtctcccagctttgaacctagggtctcatgctcatttgcatgtctggtttagatcatgtctgggatcccttgaagtctgaaacagagcttgccattctgtgatgtagtgggaatagattcttaccaaaactaaggccattttctcagatactcggatgtaagattccacgtttgacattgcctgctcacctgccagaccagaacaaagtgatgcagtctcccttagtctgacctcacctgcccacttctcctatgatgactccaaagacatgtcccctggaacccactttagcattttagctgtctgtcaaaaggccagtctcgggaactgctggtgttcgaagtttcctcattagaatagtcatcttaagtcatggatgggggaaatcagactgactctgaataacacgaaaccagcaaacaatcaaaagatgttgtagagcttttaaatgtcactgtcctccaatatcaacccactcatactacatgtgaaatgacaaaatggaactagctgtcctgaaagttgtcactgtcaatatgggacaatcccagtacttttcagaggaaaaccatggagttcccaagagctccaatttaatcatgttagacagtccaaatctttgctcaaattctgttttctgaggccctcctacccagccctgcctactccctcttctggcttgctttgctccctcacacccagcagcttcttctaatctactgcattgtttactatttgttctgaattaagttccacagaagaagggagtttgcgttgccagagttgtattctaggcacatacgtgggtctggcaacagagcaggcattcaacacaacttcattgaatgagtgagtatgtggtagggtgtgtccactaagtccaataagctagtactggggtggggcaagagcaaatttgttgagggggcagaagtgactaaggtccggtccctctgctgcagagatgctcacctagccagagaggtaacacacttgacactggatggttgagcagacagggacagtaagcacgaaagcaatggcccgaaggactggaaggaaggtgtgcaaaggtcaaatcgtgaggcagatgcaggatgcaatcgcccatggcaaaggaggacgtcgtataggcagcgtggcctctctgtgtgcagagccagagggcaatcataaacaactctttattgcctaaatgagctgttgttttgcctttttttttcctagctggttttaaacctgacatccatctgaccaaagaagtatgcgattgagtcgtgtctactgtaacccagtgtggaggggaattttgacaaatacccaattcagctagtcaatctaaattcctcttccacgtatggctcaaagccccactttgaggccttatcaaaataaatagtttatttagacatctgtgccatttggacagcgagcccacggggcagacaaaatgaaagaagagcccaggctgggcaggatgccttgcaggaaggtggcaaggctgtgcccagagaatgtgcctcttactttgtcaaactttttgtatttcaaagccgccccgtgcctttccagcattttcctcatgaatcttcttttccctctgcacacagaatatcttaaacactacgtccattgtgctccgcgcagtggtactggtcctgaagctgaggggctgcttgaattccaggacaagatccttgagaagaggaaacttgagccaggatgttttctcttgcttctttgagttccaagctaaagcaaaggattccctttttaacttcctctccctgcagtcttgagggatgccaggatcctctgtagctctgtggaacaaaaatcccactggagggaaggctgggtgagctttagggaatggatcaaatgaggtagaggattcatcctgagcctctggaccagctaaagaggaacctgagcactcctcagtcatggaagaagcaaaagctgaccgctcccagctgcccatcgctgtcttctgagatcatgtttaaaaccagggttcaggatgacccaccactttccttggaatgtattcctggaataactgtttgagggcgccaggttagagttggtctttggggattcttgggcctctcttccttctcaaggccttcctgtacgacctttatgacctcctcttattgtagaggtaaaggcaagatggaacaggcatctatatatcatgtccaaagttcccatctatggaaaacacaattgattcccacagcaggtctgttaagatctgttatcatgctgtgtagggaagcagagttgaagttcaaaagacaaaataacctaaccaggggattcagatgaatagggacagagctgggattagattccagggccatggatggccactgagaccaccattaagccctagaaaaaaggagcactccccagggacagagccctaaactctgtttagactgcccattttcttcgtaagtttcttttgccctggatttaaagtaggatccaggccagtaagtaggtaagattcttagcaaatcagagatgatttcagatgagagactgttccagagttgtgaactgggggttcaggaagcatagttagcttttgtaggaggtgttcagcccaaaggagagtccaaagcagagaattccagtcaggttggtggtcagaaacatccatgcctctactgagatagaacctactaggagaacatgacctcgaatagagactccactgagaggatcatgtaggcacaggccctaggacatctgaccgtccccaaacacagatgacaccttacttattggcatcactgaggttggcaagcagacccaggttttccaagcataaacagcacagacactgccagcctggccagcaaaaaacagaaattcagcgagaagtgaatcttttttccactaagcatagagagcagggggcccagtgtggtgagggactgaaagagaggctgctgtgtgctgctgatggctgtgtgtgggtgatgtcatgacagggtgtgagctgcgtacagcctgatgcacctgcgtcttggacagttaactggaggcatcaggagaaaacaaggtattctcagagatgaaggccatatttccaggaccagtttaaacactggtgcgtctatgccatggtcacagccagcaaaagccttccctttccaacggggctcagagctcatattactctaccctaggaggctgtcttggaatctaagagaccatttagtgtcgcattcagccacactgagtattgcataatggagaaactgttcagggcgccgtagatgggaagcagaattatccacaatggctggcaaagcccagaatccccggcatgaggcccaggtctctttgctttggcgagaactgacctcagggctgcctgaaacaagaaaccttaggcaaagcccactggtggctgctcagcaaaggaatcacaataggatttgtcatcttaggactccttaaagccagggggtgtcagccttccctgaggcagaaagagagtttgtcagaatcagggcataattttctgctgataaagccatctgccaccacagagaaggtctaagagcatcacctcgggtgctggccgggattgccacatttttgacactgagtctttggccacctcagacttttcttctctaaagccagatgtagctgtcaggatgcgggctccatgtgccacatgtggggcgtctgtatgtgtgcacttggctgcttggagccgccacagcccgcgggagaacgctgcactatctggcgctgaccatagccaggcagcatctggctctggagccaggagtgtctgtaggaatttgtacagcaggcttgcccccttctctagcttttccgagttgcttaccgatatgtctgtcagtgtgcctggtactgtagctgacctcactgccaggcttttatttgggggacatttaataggagaaatcacaatccctcattttaacgataacactgccctgtgaatgatggaaccagttctgataaatgccgcctcgcttattttttatccccacgtaaatatcagaatatgctttcacaaactaagatgccgatgaccacccaagatgacacaacattacgggaccaccatcccttgtgctgtcccctgttgatccaggcacataaatgagtggtgcccagctcctgacctccctgaaggaacatactctcagcttccacttcaaaatgggtggcttgctgctcagccggtgttgacatagtctgtagtccttatcaccacaggcctgaactagctagagacctagttcaagaaggtaagcgtcttggattcttttctgctagctgacaacaaaagggattgtgtgcatttaacaaggagagacactgctgattccattcgttggttcgtgtgtatgtattgcatgtttaccatgtatggctgtgaggacctggtgtttgtgtgtggaatacaaacaacaaagatggatgaatgaatggaaaaggagagtgagaaggatggggagacgtagaggggatgcgtatttaacaaatgggccaatgtgtttctgctccaggtgtttttcagatgagtgagaacagcacagatcatctcaacgctaacgatatctttctcctaaaacatggggcacactggtccttgtgctcagtggtaacttgaccctttcacttcagctccaaaggtctccaatgctttgagcatccgaggcagctagatgcccttggccttgggctttctcatcttgccacctccctctcaaaacactggtttttcatttcagtcttgcacgaaggagacataccctgcaccacaactcctctgtggtgcattcaccagcttgtgcagtaaatgggcaggccctcacactgctttgcagattcagaggccagagaaaggacgtctgcatatgtagaggggctgatgggagagaagactgtattttccatgtttgattccactcactgggtcacacagtgactgaagatgcctgctgatggcatggccattcattgctcagtgaacttcatagtgacagtgttgcaaggctggtttatggagtggcttctccatctgtatcacttctgccttcacttatggtaggaccgagtagtactgagttggaatccccaggagataggcttatgggagcatctccctgcgaactcagcatcccccaccttcgaggtctgctgaatcttagactgaaaatagaatcttagaaaagatgggctgctgtggcctacctcaagcttcaacttcaaaacattattcctcacctagaattaccaaagaatatggtgacgtcctaggaaactaattcctacattctgggacagctttcatccaggaggagggctttccgaagcaagtgtaggttgaaatttttaaggcagattttacaagtgctcgagacatcagatggcacacatcatctcctggaacatagtgggtccttctcctttttagttactcacctggctagtttcacgccaacttgacataagctacaggcatctgaaaggagggaacctcagttgagaaggatgtaagtctttatcttaattagtgatcgatggaggatgctgtaacgccaattgtgggtggtgtcatccctacattgatggtcctgggttctataaggaagcaggctgagcaagccatggaaagcaaaccagtaagcagcactcttccatggcgtctgcatcagctcctgcctccagatttcctgttctagttcctgtcctaacttccttcattgatggtcttgttacctgggagtataagtgaagcaaaccctttcctccccaagttgtttcactgtagcaatggtaagcctaactaagacacttatatttatcactttccaggtcatccactttctcttctgtccttacaaaatgacctccacttcttagggcctctgtgctttccacacagcatctggaatgtgtggaaatgtctttgctctatgtctctcagagtcactacatactgggaacccccttggccgtatcgtttgaatgatgaaggccctaaaggtgatagcttagttcctacaaggtcccaaagggccacccaacccttccttccttgtccttttcttctctccctctacattcctgtatgccagccatgcccacagtaccactagccttttcatggctctcccccacccccacccccgaagctaggtcttgctcaagtccctaaggcctctagtgcttcttgccttcccctcctttgtctccaatagttattgacatctcaaccattcttttgcacatggtcgtaatacctcatagtctttcagactgtgtcatgtctaaatgcaaggactttgttttatatgactgacttctctagtgcatgcacacagcaccgttcagaatgttgattctaaatgattgacaggagaccgaactaatcatattccaaaacttagctggctcccccttgcctgaggcttatcctaaagctgaatgcaccctgtgggactccacagatcccctcagaaagtgtccataaagctatcaacctcactccaagcttataacaaggctagttgacttaagctgttttcaggaaacaaagaaaaaaaatagatcaaaaatgaaaaacattcaacttaaaggagctgtgtctccttgtcctgttccctgcctccctctccaaccccacccccatgctctgttttgcttttcgtgccaatggctgaagactataattttaaaaactgagctgacttttccagacccatgaagaatgtgcgtgtgcacatggatttttccacaaggacacttcctgtcttttgggttgtcttagccagtaatagtgaagccaggcaatcagatgcatctgtccattcgtccatccatccatccatccattcatctccccagcccttccttattctaatttgtttgcgaggctcaggacaggccaaaggggatggtttgtgtttcaccctgtcagacagttgtttgatgaggtttgtgttccatttattcagatggtttttatggttcctttgttgttaagggaaagactttgaaagtcataattctgtatccttatcccttctggtaggcctgtgccatgtctcaatggctttctcacaatgagaaaggaaatgagtgtttccaggccgttacttgagcagtttctgaacatggttgtggaagagaaaagctgagtcaaagttcagggtccatatagtgctggcctctcccatctgaaagatctctgtcggttcattctctgatcagcccaagtcctcaccacaattctggcctgacctctctgtgggtggttataagaccctgcccctttctgctacagacatgtctgagagccttggtcagcctacaatgtggacacatgtctgcatgtcattccatagcaccaggactatgaggtgcgaggctggagttggccttacaggaatgtcatgggcctggaccttgagacgttcttcctagagaccttcatctagacatcacctcttagattttcatccttgcccaacatccttgcatcagtgaaaagagtttgtatttttcccttgatttatagtagtttatctttttagaaaatcttgtaaagtggctcacaaatattctcacttgatccttagcataaccccagaaggtagataattcatatacaattttgcgtctacaaagacacgggtcaggggagacctgtgggcttcccacgtctcacaacaaataacagcagggatagcgattgagccaatcctccaacttgaagttcaggattcttcctactgcttcagctcccagattagacaaataagatattagagtaaatattactcagggaagacgatacttcaggaatgtagtggtgcttaacaagttattgctgaagtaaatttaacttcttctggccgccaagagagcatcttcatagaacgaaccttcctgcaaaacatacagagctgatgtgtcctcttttgttctttctcatagacccttcttatgactctgtcaggagaggagcatggaacaataatatgaactctggcctcaacaaaagtaagtaaataggaaaccatttgggggtgagtcaaatgtttctggagagccagaagttggggtgtgggcgtagggtcataagacacacactaaaaacaagtgttggtcttcatgctgcctgattagatgtcagtgtgaatttgcagtgcctgctcagatttttgaggtttattttgtttttttttttttttttttttgctatatttatgtgtacttggttttagaacttataaggtttgaggttttctcgggacaacttgatttataaaagaaaagtaactcgtctggattttgatatttcagtcaggacgttgaatctctgggacatatattctccacatgacaaggctcagtcaggtcaatacccctagccctagttagagagattaacatgaaggataacctaagggatgttgtgcatcacagacattaatttgaccaacagtgatcagccgatgatttgttgaaatccacccagtatcttccattaaggggcagtgaaagagagcgattcactcttcaaccaacgtgtccatnnnnnnnnnnnnnnnnnnnnnnnnnnnnnnnnnntatgagtgtgcagtgtttgttcactctgcatgcaggacatgacgctatgggactcacaaagtataagccaggcaaggaccagttatttaggcaggagagagaaatcatggacacacatatgtcttcatctgggttgtattaaagagttcttgcgcacctgctaccgttagagctactcagacaggccatgtctagggaatgtctagggaacaggagacaggtaaacctggagagctagatgtcagggacgaccatggtggtatgtctgacagtgaggaacctaggtttatggagtttaggatgcagagtagaccaaaagataagaaagggatagtgaatgataatatggaagtagattccagatcttcagtcctaaggagtgctgaagagtatgtgagtcagtttgaagtatgagaggtccagttacaccgagccacccatcacacaaaaagcagcatacattcaaaactggggaagccagaggtcaaacatgaacagccttggagaggctctcacgaaacacagtgtgacaggcaccaggtggtctgtgctcaaatgacactttctcaggagagacctctgtattgccatgtctatttgtgggggacacgtgtgtacatttgggggcacaagtatagccgtgtacccatgcacatacatggaggccaaagagagacactggctgttctgttttatcactctgtgcctggtccctttgagacactctcttactaaaccctggagttcaccatttctcggctagcctgactgtccatcaagcctcggtaatcttctgatctgtgccaatccctctccgttcccaggcacgtgttagaagtgcacacagacatgtcaagtttttatacggggatgcttgggatctgggcccatgtcctcgtgcagcaaacagtcttaccatggagccatctcgaagctcaaggtcctacatttcaaaagaatggtctaaccccatgtcagcagacattgttcagtgttttctcttctgttaaaatataacttcattgctaactcttctgccccgagaccagtgccagcgtagcgggtttgataggtattcaggaataaaatgagtctgtgagtccatgggagagtgtggtcccggcagctcatgtgccctccttctgggagatatgtaaagggagcattttctgccacttttcttgatttctccacaggtcctctccttggaggatcacagaccatgggcaagaacactgagcagcggccccagccaggtatgtgattcaaatatgtagcctctcacttgtgtgttatacagttgtggagtcagtcaatggtggagcaagacagtgtacagttggctgtccatatctgtgggttttaggcctggggatttaaccaaacacaggccaataatattcaggaaagaatctacatctgcactgactgtggacagacttgctttcttgtcattattccatcaacaatacagtacggctctttgcatagcatatgtgtcatgatggtaatctatgatttaaggaatgtggatggatatgactagattgtatgcaaataacccattttatgtaaaggacttgagcagccacagatttcagtatccttgacagaccttagaacaaatcccctgtgtatcccaagaggcaactctagttcacacattgtctcttctttccaagagagtatctgggaattaagcagcaagtcctggaaccagggagcgatctgttaaaaggaacttaaaactgaaatggtccaatgccttatttcgtggaagaaaacaggggttccgaagggtgaaaggatttgctgaaagacaagcagagctgaacttctttaagttccagagcccccactccttgtccaagcattttacattttacgaaaccatacagaactgccttcacctagtagatacgcagtcaagacataagaccttttgaagctatggacctggagacccttaataaagaaatgacttagagactgcagtctataatccctcggtagcatggcctcttatgatgggatgcccttgtttctgaccctgaccccgcccctgctcctccttgcttgcttcaacaaacaggaagttgacaacctaccttgacttaatccttttctgagccagagccctctgttcagctacccctctggccacttgtcttctggggagaggtcccacaggaagaccctacacagatctgaggagagccattgcactcagctctgctgtcttaattaagaatctgaattaagatctgaacaagctatttgctttggggtgtgcaaacatggttcttcatttccagccaaaatatagaaagagaaattgtagtaaaaagtgaaattcaagtgaaaaccaagtcaggtagagcaaatttttaaacaagttccaacaacaacaacaaaattgaatatctactcaaacaatttcagtttcatcaaaatttaataaaaaatgtggactgaaaggcttcaagaactgttaaatcaattctttttaattcattaataattactattataattgaaaaaagcagtgtgtttttaaaaaggagtgacttcatagctaaaatacaaattctgcttagtgttgacattttcaagcttaaaatcacagagttttggtagaagggaagagagcccagcagcccaacccactcttcatagctgagaaaacaaatacccagaggttgtccaaaccatgatttagttcatgacatagctgggactagaacccaggctacctaatggtttttatagtccatcggaaaactcagacatgcgtaatgtcttcagcattagaaagatctattaatggctagtaattgctgaggaacctgctttaagcatgtttaataagcaatccttcagttcattcactgcctggttgaatttagccagatgctttccaaacgtgtgggcgattttgtttggggggtagtgacagcataatctaaaagtttagaaaccaggtatgaagcaagagtgctattactcgtctacgttgactgggccataactttgatcaaggcctctaatcaagctttcctatggccctgagataaaagtaggaaccgttgaagtctccttcatcttgatgctgctctcagattatttgctgaggaatgaagtaagctttttttttctttctagatccttatcagatcctggggccaaccagcagccgcctagcaaaccctggtgagttaacttgaacctgcaagcctttccctccagagcattcgttatatctgtaaggttacacagaaaccttactcctcggtacggtacaggcacctgtctggagactgcatgggcttccttagtcaaatattcaactgtgcacaaacaagaggcagggcctgttcatgagtagcagggtctgctgccacaagacgtttctggagaacaagcacctctggacagaggtttatgtccatggcaaatgactcagatggaagctccccgttagggaagctattctcagttattcctcatccagggctcatggataaatgtccccaagtgttgtggttttgacttgagtgctatagttatccagcctttgaaaaaggaagtgcaagcatcccaagagagttgcacacacaatgaacgtgacaagatgtgaaggattcactattaaaaataactctcggatgtgttcttctaaacccaaaccatggagatggggagctcaaggcaacaaaagccaggcccacgtgcctgctgcacctgcagtgctacaagctcgctgggcctcctccctaacctttagctaaaccattcctgcccagaagataaaaagccatccagcatccagcccctcccgttgcctctgcccatgcggaactgaacactaagagccgtgcacttttctggaaaacagcccagcttagtgaaccccaattctatgaggtgccttctctctgctctaccccacagccaccccccaagaggttcttggatacttgacactctttaaggccaatgttgaatagtttgagggatttcagtactaaatggagattagatagtgactcaggtctaggtagaaaggtctaaggggagggtcaaaaatcttaacaaaaggatgtggaaagttggcttccctgagatcctaagagcttgggacaaagccagcattcaccacaaccatcctttgggacaatctgtcttaagatctaaccttgcttactacgctcattttggctgcggcagtagagtaacagtatatactgtaccctttttttaagatttatttattttatttacgtgagtacactgtatctgtcttcagacacaccagaagagggcatcagatcctattatagatggttgtgagccaccatgtggttgctgggaattaaactgaggacttctggaagagcagtcagtgctcttaaccgctgagccttctctccagctccgtaatgtacctttggaaactagctggataagccggtctttgatgatgagcaagcttttgaagtgatgggtgtgtgaattgcccctctgtgattgtcaaccactatgtatgtctgtcaaaatatcaccacatgccctgtaaacgtgtacaattatcatgtgcctatttctgttttctaaaggaaaacataaagggttgtctccactttccttttttgttttgttatttgtttgtttgttgttgttgtttgtttgtttgtttgtttgtttgtttttccagatagggtttctgtgtagcagagccctggctgtcttgaactcctagaccaggctaacccccaactcacagagatccacttgcctctgcctcccaagtgctaggatcaaaggtatgtgccaccatgcctaaccaataaaggttgtggtggtggtggttgttcttgttgtggggaaaggacatgagttgtcatgtttaggaatcagaactgagactactgttcttctgtttcctcctgcatgcagggagtgggcagatccagctgtggcagtttctcctggaactactgtccgacagcgccaacgccagctgtatcacctgggaggggaccaacggggagttcaaaatgacggaccctgatgaggtggccaggcgctggggagagcggaagagcaagcccaacatgaattatgacaagctgagccgggccctccgatactactatgacaaaaacattatgaccaaagtgcatggcaaaaggtatgcctacaagtttgacttccatggcattgcccaggccctgcagccacatccaacagagacatccatgtacaagtatccctctgatatctcctacatgccttcctaccatgcccatcaacagaaggtgaactttgtcccgtctcacccatcctccatgcctgtcacctcctccagcttctttggagcagcatcacaatactggacctcccccactgctgggatctatccaaaccccagtgtcccccgccatcctaacacccacgtgccttcacacttaggcagctactactagaactaacaccagttggccttctggctgaagttccagctctcactttactggatactctggacttaaaaaggcacagtagccttgaagagataagaaaactggatgttctttcttttggatagaacctttgtatttgttcttctaaaaaaattattatttttatgttaaaaacttttgtttcctctacctgaaaaaaaaagatcattccatgagccagtccaccagtttggattctcaacctcctatcatcgaatgagttaaatatttaggttactggaacggtttataccatgattctgagaaaggagtacgcattttctttactcttttttttttatgaccaaagcagtttcttatcagcacacgggtctcatcattgtaggattccctacgatcatgaatcatggacttgaccagggttggtctggtttgagacttagtaaaagtcaaggcaggatgtttataatcttatcttaggaggactcaattcagtggatggcaactggaacactggctctgaggccagtgaagttttttgcccaactggaatttaaaagatgtgtgtctatgtgtgtatttaagaagccattattattacaaaattcctcacaatgggcagtatgtgtttgggtcactcttctcctcagaaatagtcagaatatgaacaaagaaagtttaacacaaactcagacactcctgacgggcagaggattaaataacatttttttggagggtttaataacatttttggaggggtttttttgtttgtttttgtttttgggggttttttttgtttgttttttgttttttggtttttggtttttttttgttttttttttttttttggttttgatttttaatgacagtgagtcccagaactttgaaaagtcatggggatttctaaactcagattcgcaaacgctgtgcgtttgtcagaccaccagaccaaggtcaaacaatcagaaggcaactaactgtataaattatgcagagttattttcctatatctcacagtattaaaaaaataaataattaaaaattaaagaataagtaaacgagttgacctcggtcacaaatgcagttttactatcaaatcaatcattgttatttttttaaaatataatttgtacatctttgtcaatctgtacatttgggctatttgtacgtttttgtaactgtttttttttaataagcataatgtgactattgaaaacgaggagttaaaagtcactgagtttttaggaagaaaaacctaaaaatacagttatttaacacgcatgcccaaacaagatctgtttagacctacaacgctttagaaatgtttgtaaataacagagttgcaataacctgaaaaggacaaacaaacttttctctgtgcacacgaggcactctcctgctctatatatgcaatatatttttagatgtgcaaatatatatataatttttcaggtaatcgtgactttttaaacgatattgttaaggtgacaactcttagtccactgaagactaagttgtaaaataatttgaccttaataaattgtgccttcttctttttcttcttctctcagaactggtgacattgttttcttatttacttccagatcaaaggctttcccggagggaagttgtttttattgctggtgtgtgtgtgtgtgtgtgtgtgtgtgtgtgtgtgtgtgtgtgtgtgtgtatgtaagaacacacagcacacatttaaaggtcagaaggcagtttttatcaaataaatcagttctctccttccatgttagtttttgaggcagaatctcttggtatgtctcccaccctgtggactccagacacacaagcttccaaaaagctctcccgcttccacctcccctcttaccacagagcagtgggattgtcggtgaatacctccacgtatggcttctttcatgagttccagggatcagagtcagtcatcaggcttacaacgtctcacgtttatccactgagcccatctcattggccccgaggaaaaaaataacttgcctacttattcttgtaccatcgataatctcctaactgcatgtgctgcagtacagtggaagacacagtattctgtgagtttcagatgcttgttaacaatgacgattttaaagcttctctaagccattaagatactgtatgacctttgtaagtgagagacagacctaggtaaannnnnnnnnnnnnnnnnnnntgagagacagacctaggtaaactatatccagggaactacagcagcaaccgtctccaggacctggccaggtagacttgactctgttccccacaagaaggcgacctgatgcttcagcagagaacaggagtctagcctgacttcaaccccacactagggtcttacgtagactctctggctctatttttcagcccaatagagaagcttgcttccaacggcttcagcgttaagcatcatgctcctctcctttacaacaaagatgactaaaactagaaatagctggtgttgttgcagggactctcatagaactagtagctctagaaaccccttaaagaagtttgcagcctctggtcctcacacagagtaatttctagaccaggtaagcctacgtgaagaagatgagaggagttctgaacactggtctccaacttctaaaacatgcaccctacattataaaatacattaagaacatatcctttatgtttatgtatatgctggtttgtatcttgcattgacaaaatatataccattatacatttgtagatccctccaatcatgactgaaaatattcagaaagtgttttaaattattgggtaaagagagctattgaggttaagagcaattgctgcccttacagagaacccaggttgggttcccagaatttacatggggtgactcacaactgcctataattttagcttccaaggatctgttgccctcttctggcctcctcagatatctctacactcacagcatatggttacacaaacacacacccctatacacataaatgaatagttgcatctttcctgaatatatactgactctttattggcattttaatcaaatcatgagtgataacaactaattacagtgtttaccttgcacttgatatgatacattatgtagatgtgatttaaaagataggagaagaatatgtaaacagtgtgccattttaaataagtgattttggcatctatggattttggtgtctttagggtagtcctggaacccatgcttatccagaggaaaataagattaaatatttgttataaacaaaaagatgagattttagaaggtgatatgaaaatgtttaagctgacattctgttttcttcccttatttatattgcttcatccctggttccaacattcaaaacggaaacagtgaacattactgagacgaacacatatatttacattcatacatttgctttctagcaaagaataactacttggcattaatggctcatgcatagaaagacatgaggcaagtcagttatgttcataagtagtcaactttcaagtctcatagtcaacttgaaaggtctcatgtcagtttgcaaatctacaaagtcctattaagggggaaattgagaggcacatatccctgatgcactgctaaaagaacaggatgctcacaccattagttcacctttaaaaacgtgtgtgtgtgtgtgtgtgtgtgtgtgtgtgtgtgtatttgtgcatgtgtgcctgtgtgccacctgggtgctggtaactggagttgccagatgaggatgcctacatcctaaccctgaaactggagttacaggcagttatgagctgactgccatgtgagctgcccaacatggatgctgaaacacatgcctatgtcttctgtgagggcaaacagtttcaactcctgagtcatttctcagccactggttagccctctagacagttttgtttcctacacaaagctgcaatgctttctcacaatcctgtacccagagtgtcatggtggttcattccatgatccaaaagctggtctaccctgacaggagcagagcaatttcgtccatcaagccttcgctcagggaggaatgacatttagtgcccagattgaatggtctcagctgacaaacaggcatttatgtcatcctgactgtgagtcccctctaccactctgcacttgtgccatgaaggccattacatctgataaactgtggcagcaaagcagagagggcacagcaaccctgtgagggactctaatggaaaccgatcctctccatgtccccacctcagctccggacctgtccacagcacttcagagcaggtggctgtcttagtccatttgagaagtcatggcagactgctgtaggctcgctggcttataaacaacagaaactcagtgttcacagttctggaggccagaattccagtgccaaagcaccagcagatttgtcattgatgggggactcactgtttattcctgattcacaggaggtcccttcgcactgtcctctcacagagtcccaggcagcaagcagctttctgacatagtgtgtgtgtgtgtgtgtgtgtgtgtgtgtgtgtgtgtgtatctacgtttattcatgagagctcctctttataggtccacctccaaatagccacacattggggattaagctttaatatatgaattttacaggggaatggaggaatattcaatctacagcagaaattttaacttcctggtgtcaaaatattgttgctacccaaagaaagttgtattttcaatatctgttgctttgaaaattttttagaagtcaaaaaacactagtcatttaagaacaattaaagtgaccaataatacctgcatgcagttggggaatgagaataacacatgagttctgtccatggcaaatgaatgagatgtggtttcataaacagaatatttgcactcgaaaccaagtgggagaaaagtatccagaataccaaggaagaaaacaatatccattaatcccaagcaagacacagccagagcaagatattatttgtggatattttaaaaaccactgcaaatcaaagattatttttaaaaattgcatctatattcaatgtatattaatatttgattacccctaaatattatttcactattatatataataatatttataaatatataaggcattatatatacaatattctcttattccataaataatacagtgcaacaattatttccactgttctactgcattaagcaatagaagtaatttagagtgatttaaatatataatgcataaaatatatagatgcactatgccattgtatataagggacttgaacaaccaggggtttgggtatctctgtgactttctgaaaccaatacccttcaaatttcaaggtacaaataattaaagttttttttaagatttacttctcttactttatcttatgtacatgggtgttttacctgcgtatacacatgtgtgccacgttgagttccctgtacttaaggaggtcagaagagaagggttagatccctgttcctggagctactggttgtgagtcaccgtgtgtgtgtattgagaactgaaccctgaccctgtgcaagaagtgccctcaacaggtgagccaccatctctccagcctgctttctatgagaaagtttggactctgaggacttgctgtcacaccgcactttcccttgtctttctttattaataaccataatgcaaacatgttgctttgaaaaacagctgggaaagcacactttggaagaatgtgcctggggacatggtctgtgagcatggcgtctgctgccagccagcatcctgtaccttgctgtggtctgactcttcacaggggttcctttatgtcatcgggagtgggggcttgcttctagaactcaggaggtagcaaagaggtggagtgtctgcggagaccaggagcgaggctgtagactagacaggggcaggggtggagttctggtgagcacaaaggcttcacttttatccaagaagactttgtgatttctgaaaacatgcaccgagcatttatttcatcactagaaggctactgaaacggatactgcacgcctttagccatagaccctctagaggattagaagaggtcagctgattagaatactacaaatcccaggttccctgggaggatggccacttctgagaggaagtggttcagccaggcaaacccccagggctgcagccaattgagaaagaaaatgaagggaagtttttgaaagaaatgccgggctcatgtctggggtctgtctccctctctcactcctacttggcctcctgtctaattgttacagcctgtctgagctggcaaattccaaagcacatagtcaatttacacgtagcttaaaagctctagaggaaaacacatttgcagtgagaacattcacttgcctacaattgctaggttaaccttctgggctttcacccagttaactcgtgtgttttcttagttgggagagagagagaacttggggagattaaatgagtgtgaatataatcccagggaccctgcgttcaaattttgaccctttcacgtagtaggcaaattatcaatacctactgactagggtatcatctcctgccagtgatcctgtctatacacacacatcaaagaaacgacctggaagtccattgcaaaatgctgcacaggatgtgtgtgtatagacagtgtcacctgctagatttctcaggggacaatattaaaactgtaatagctaggagccgctctgtccaggcacttaatgaagattttttttttatttgtggtcaagaaggtgtttttttttttgttttgttttgtgttttgtttttttgttttttgttgtttttgtttttcaaatgagtgaaaagtaggagtagattgagttttccagagggtatttatatgtctgccatcgccagcctcactttgccgtgtgggtgcttgtccttcactggctctgtatggtcacctcaagtcagtagagcatgcaagaagctttagggctgcaaataaaagagaatggcctaacgtgaggctgaaagggaactttgtcagaagtattggctagattgttaaattggctaagaaatagaagttggcagctgcaattccctgccttgataagcttgtgcccaacattctcacagacctacatttcctccgaggcttcacgggaggtgggcataccgctctcttgtttgccactgtggtgacactggttcgcagcaactggtcacttgtaaatgtggagtgaagcagaagaaagcgtccacagtcagcaagactgagttgtgaatccagctgtccctccctgagttatgaattcttgtctctgaggttcacttcctcatgggtaaagctaggactgttgtagtatcatccagggatatcaaagaagtaacgtaagatcaggtaatgaagtgcttgctatctgttttaaaaaaaaatacggaacttcaaaatattatatggatgtcttagtcgattgatacttcctttttacatggctctggtccccctgatataatacagagttaaattaggagctgagaagatggctcaatggataaagtgcttgttgctcaaacattagaacccgcatcctaaccccaagctcacacttaggaagcctagcttgatatctgcatgagtaactgagctgagtcaggcaggtccctgaagttctctggccaatcagggtgctccaagctcagtgtagagatctggcctcaaaaaaaaaaaaaaaaaaaaaaactatactgtaagagaggaagagaggaaaacatgacatcaacagggagagagagagagaaagagagagagagagagagagagagagagagagagagagagagagagaaatgcgctactttattgtacataactatttttagatttcaatcacttgggacaggagagagatgcttggtaggtaagagacttgtcagggtaagaggacctgagttgaaatcttagttccatacacatctttaatcaacattgtgtggtaggaagtagagggagacaagagtttgtatccctgtgccttgccagttgtgagtctagttccaagttcaataaaagaccttgtctcaatggagtacgatgaagggcaatagaacagaacacctgaaaccattctctagccctgaggatgtgtgcactagcctgcttctgcacatacaaggttgcatacaccacattcactccgatgcatacacagtcacacacacaaagacaaaaattataaagccttgagatcatcacaaacttacaaaacagctggaaaaatataagtgagcgtcttttcttgggctgtttgagaggagactcctgacaaatgctccattaactctggatacctgagtgtatatttctgtcaaacatcggtcttctcctaaggagtccaccacaagtcagagaaccagaaaattaacctgcataggttacttccctgacactctctggcaccaatcacttttctttctgcatggatatttttttccaactctgggaacttaaccaaccctgtcatatactgctctactctttattttaaggcaagacttcactaaattgcccagcctctccttaaactccctttgtagccaaagtaatccttatgatcctcctgcctcagtttccatagtaatgcaaattagcagctttgtgccaccaagccagcccattatcatgtgttgtaggagaagaaagcaccacccagaatcatttggaatgcccagacttcccctgactttcagaatcttgggaattttagaaccccttgggctggccacattgtagaataactcccagggttaggtgctcgggtgtgtgttcatggttagggctgccttccctgtgagcagcaatcatagaagtcctcccaggttcctcccctggcagcctatgtggaggtacatgccctcaatgtatctcgatatgagggggttcacttagatggatggttgtggaagagatgatgtttttcaggttcttctaaaaatttacatttttccttttgtaattagcattttgtgcagtgttcctcatggaattatggaaatatcccccactattaaattctagtgcatgtgtgtgtgtgtgtaagtataataagtgttcctaaaggtacatctctaattagtcctgctttccaattttattgagagacttgaatttgttcttctcattagtttgatgatgattttggcccaataggaaaccatttaagtgggtttcaactttagcttacgcatgctaacttccttacttgttccttcaaaaacacatttagggctccagtccctaattcagggattcctgcatcattttagtgagaaatgatttttcaaagccaatatctgtgtgctaggtgtgcccattgttagtggtcttatctctaagatttcccagaggatagcactaagcattatatgcatacataataatatgcatatactatgtgtttatatacatttccatatgttcatgtatacacattcataagctaatatgtactcactccatattcatctcaatctatattgaaaatcctgagttcattcagatgtgtccatttccaaccagggagcgcaggattcctctacttcttcctttccatattgtaatgaaaaccatgttttttgtttagacatacagagtatccttccttaccaggccctgccaaaaaccagtttttcctctctggactgtccgcacccacacgtgacaggctccttcccttgcttaggccaaccccatggcccttcccttcacacagtgtatgccctcttcagttgttcaaacataacaccacatgccatcttccctctccacaaggacacagtctccagcctgtggctgtactctgactcccatacacaacacactaccacagcttgccttgccctgctgagcactactgctcacatcgggccaacccagtgccactgcacctacagcttcaggaggtgaagagattgtcgaggcgggatagatgtattaacctgtggcttttatctgactctgtctacacgtacacatatgcacccatgcatgtgggtactttctgagctagaaaatattagaaatggggagaacaataattataaattggcacccttctaatgatcttatgttccattatgatattttttttctaaatgac

SEQ ID NO: 1206 - DNA, 1729 bp, Mus musculus
aaagtgaagtcacttcccaaaattagctgaaaaaaagtttcatccggttaactgtctctttttcgatccgctacaacaacaaacgtgcacaggggagcgagggcagggcgctcgcagggggcactcagagagggcccagggcgccaaagaggccgcgccgggctaatctgaaggggctacgaggtcaggctgtaaccgggtcaatgtgtggaatattggggggctcggctgcagacttggccaaatggacgggactattaaggaggctctgtctgtggtgagtgacgatcagtccctttttgattcagcatacggagcggcagcccatctccccaaggcagatatgactgcttcggggagtcctgactacgggcagccccacaaaatcaaccccctgccaccgcagcaggagtggatcaaccagccagtgagagtcaatgtcaagcgggagtatgaccacatgaatggatccagggagtctccggtggactgcagtgtcagcaaatgtaacaagctggtgggcggaggcgaagccaaccccatgaactataatagctacatggatgagaagaacggcccccctcctcccaacatgaccaccaacgaacggagagtcattgtgcctgcagaccccacactgtggacacaggagcacgttcgacagtggctggagtgggctataaaggaatacggattgatggagattgacacttccttcttccagaacatggatggcaaggaattgtgtaaaatgaacaaggaggacttcctccgagccacctccgcctacaacacagaagtgctgttgtcgcacctcagttacctcagggaaagttcactgctggcctataacacaacctcccatacagaccagtcctcacgactgaatgtcaaggaagacccttcttatgactctgtcaggagaggagcatggaacaataatatgaactctggcctcaacaaaagtcctctccttggaggatcacagaccatgggcaagaacactgagcagcggccccagccagatccttatcagatcctggggccaaccagcagccgcctagcaaaccctgggagtgggcagatccagctgtggcagtttctcctggaactactgtccgacagcgccaacgccagctgtatcacctgggaggggaccaacggggagttcaaaatgacggaccctgatgaggtggccaggcgctggggagagcggaagagcaagcccaacatgaattatgacaagctgagccgggccctccgatactactatgacaaaaacattatgaccaaagtgcatggcaaaaggtatgcctacaagtttgacttccatggcattgcccaggccctgcagccacatccaacagagacatccatgtacaagtatccctctgatatctcctacatgccttcctaccatgcccatcaacagaaggtgaactttgtcccgtctcacccatcctccatgcctgtcacctcctccagcttctttggagcagcatcacaatactggacctcccccactgctgggatctatccaaaccccagtgtcccccgccatcctaacacccacgtgccttcacacttaggcagctactactagaactaacaccagttggccttctggctgaagttccagctctcactttactggatactctggactctaaaaggcacagtagccttgaagagataagaaaactggatgttctttcttttggatagaacc

SEQ ID NO: 1207 - DNA, 1359 bp, Mus musculus
atggacgggactattaaggaggctctgtctgtggtgagtgacgatcagtccctttttgattcagcatacggagcggcagcccatctccccaaggcagatatgactgcttcggggagtcctgactacgggcagccccacaaaatcaaccccctgccaccgcagcaggagtggatcaaccagccagtgagagtcaatgtcaagcgggagtatgaccacatgaatggatccagggagtctccggtggactgcagtgtcagcaaatgtaacaagctggtgggcggaggcgaagccaaccccatgaactataatagctacatggatgagaagaacggcccccctcctcccaacatgaccaccaacgaacggagagtcattgtgcctgcagaccccacactgtggacacaggagcacgttcgacagtggctggagtgggctataaaggaatacggattgatggagattgacacttccttcttccagaacatggatggcaaggaattgtgtaaaatgaacaaggaggacttcctccgagccacctccgcctacaacacagaagtgctgttgtcgcacctcagttacctcagggaaagttcactgctggcctataacacaacctcccatacagaccagtcctcacgactgaatgtcaaggaagacccttcttatgactctgtcaggagaggagcatggaacaataatatgaactctggcctcaacaaaagtcctctccttggaggatcacagaccatgggcaagaacactgagcagcggccccagccagatccttatcagatcctggggccaaccagcagccgcctagcaaaccctgggagtgggcagatccagctgtggcagtttctcctggaactactgtccgacagcgccaacgccagctgtatcacctgggaggggaccaacggggagttcaaaatgacggaccctgatgaggtggccaggcgctggggagagcggaagagcaagcccaacatgaattatgacaagctgagccgggccctccgatactactatgacaaaaacattatgaccaaagtgcatggcaaaaggtatgcctacaagtttgacttccatggcattgcccaggccctgcagccacatccaacagagacatccatgtacaagtatccctctgatatctcctacatgccttcctaccatgcccatcaacagaaggtgaactttgtcccgtctcacccatcctccatgcctgtcacctcctccagcttctttggagcagcatcacaatactggacctcccccactgctgggatctatccaaaccccagtgtcccccgccatcctaacacccacgtgccttcacacttaggcagctactactag

SEQ ID NO: 1208 - DNA, 73725 bp, Homo sapiens
tacagggtacagtcctgggaggacgcagagatcctcttctctgtgctcacttaggctatacccttcatttgtaaaacaccattaaataaagtactttcgtctgcaaataattgcaattgcatcttctaggaattctttctctgggtcatccactgctgagccccctccccaggaagtggaattgtaagtgaaaggggaaaggcacttgggagggggaatgatgttcaacaagactccttgaaaagtcagccggggtccaggcacggtggctcacacctgtaatcccagcactttgggaggccgaggcaggtgggtcacctgaggtcaggagtttgagaccagcctgaccaacatggtgaaaccctgtctctactaattagatgggcgtggtggtgggcgcctgtaatcccagctactcaggaggctgaggcaggagaattacttgaccctgggaggcagaggttgcggtaagctgagatcgcgcctctgcactccagcctgggcgacaagagtgaaactctgtctcaaaaaaaaaaagaaagaaagaaaagaaaagtcagccggacactctgaagctctgtggcagatttggctgtgtgctacggcctaaaattggagacggcaaagtggaaacggtttaggggaggagtagaagctttgcagtcaggccagcagcatggagactcatgaggtgaggggccagaggcaagtagcaaacctctttaagcctcaattttcttttcaataatatgaggatcctaactcatattttaaaaggttaaatgaggtgatgatagtaaaagttccttggaaacttcaagtcatcaaataatacatgttctatttgatcgttctcatttaaaaatgtggtccttgtttggtttttgtctgttgtttattttgtttttgtcgtttggagataattccactatgtgtctatcagaggacttagactttaattctgagatcgattcccccctcactgtgtgaacctagaagggttatgctttgtgcctcagtttccccacctggacagtcatggtgctgattcctgccagccagtgtcaataaccacagtgaaaggatactcagacagtcacctctacagcctttgaatatgggttttcggttgctgagtaaaatgctcggagacgttccggttactatggctacataagaaattaccccgaaacctagtggcataaaccaattattaggctcatgagttttgttatccttcactgaaggctcgttcactctcaagtctggaggttgacgctgtggttggctgtggcctcggttcctctcctgcgggcctctccatacggttgctcagcttgggctaatctgagcttcctcacagcatggtggcgatttccacggactagaggcccaagagagaacaagaagcaggtggaagtcataatacctttatcactttgtcccggaagtcacgcaaggccatttcttgaggcaatcataaagttccatctgagttcaagggggaagaaaataagctctgccttttgatgggaagagagaggcaaagataagaaatattctgatggtcattttgagaaaatgcgactgtgcctcatgcaaaggagttttcagttaatgcttgatgactgactaatgtttcccaccttcttccttatccaactttccataaaatttacctcctcttcccttttccctccctgccctttacgcagtggaaatgaggagcaagaaatgcgcacatgtagagaggagagagaagcaaaaggcttagccttgctaacagcggccacctgctcttggcacttcagatgagacttggagtgaccccaacccaggctgatcacccccactgctgcagagcctgctggtttcccaaagcagagaacacagagggctttgcacctaagtatcttgttcgcatttcatattctctccgactggcaagagaagggacttcgtgtcattatgcaaataatgtaataaaaagccaaaactagcgtgctccctgtggtgaccctgggtaatggatatgccagagattagccttccagagccctgtactgggagcggcggagtgggcccactgagcagggcagccacagggaacttggtctggttgcttttgacattcctttcaccagacacctccagccaagctggtcagccccagacaactgtccttaggagattcagggcagaacagagggaaaggaatgggaaggacacaatgggacattggtgcttctcaggccccatgtcttgggtcattctgtgttagaaataaagctcagcctacgtataaggaagaacagagggaaagggtctcccactcatgtccacttctggcatttttcctcctctaactccactggactcataactgtgaaatatttgttccttcccacacacaggataatggcagaaatttctgttatgtcttcccgagtgaaatggggagatactcaaaccaccctcttcttctttccttgcccctctggaggcttttccatctcggccttagctagactgtttgaagatgcaatggtttgctcatcgttcatatcggccaggccactgtgcggccatgctctgatcacatcccatcactcaactcatgtgcacatgaaaagtaacatttgacttaatctaaggaaaacaaatgttggaagacacatttgtaagtataacaagaaaagatgcatataggcacacatatgtgacaaattccaaaataagtgaaatttttaaattcgtgaatgcacagatgtacccacgccattcttctgatattcactgagtatgtggtgtacgaacaacagtataaataggtgctagccacctaccattttcattatctcacaacagatgcctcctctcctcattcacagggctattcaggctatgtaacagagccttatctatggcacctagaggcctggactcagaaaccagagacaggcagaggactgagcctgcaatggaatgacacccatggttttaaaggaagagtggacacgcagattagtgaaatcggctctgtactctaggagcccatgggatttgcatttcaggctctatcatcaccaaatctacttattagtagtttaggcaactaatcttttaaacaatcaacattcggagaagtaggtatcgctctggctttatctgaactccctcttgacccatctccaacccaatggttctcacgccatttctcagcattggccttcattaaaattttttttaacttttttttttttttgagacactgtcttactctgttgcccaggatggatggtatgatcatggctcactgcagcctccacctcctgggctcaggtgatcctctcacctcagttttccaagtagctaggaccacagacacaccaccacaccttttttttattttttatttttatttatttatttttttgagacggagtctcgctctgtcgcccaggctgaagtgcagtggtgtgatctcggctcactgcaagctctgcctcccgggttcacgccattctcccacctcagcctcccaagtagctgggactacaggcacccgccaccacgcctggttaattttttgtatttttttagtagagacagggtttcaccatgttagccaggatggtcttgatctcttgacctcgtgatccacccacctcagcctcccaaagtgctgggattacaggcgtggtttttttattttggttttgtttttttttttttgtagagaaagagttatgccacgttacctaggctggtcttgaatgcctgggctcaagcattccacccggttcagcctccaaaagtgctgggattatgggcatgagccattgtgcccagctttttaaacaatttttttcttttttttctttggagacagaggctcactctattgcccaagccagagtgctgtgccgctacatcggctcacagcaagctccgcctcctgggttcaatcgattctcctgcctcagcctcctgagtagctgggattataggcacccaccaccacacctggctgagttttgtatttttagtagaaacagggtttcattatgttggccaggctgttctcaacctcctggcctcagatgatcttcccgcctcagccttccaaaatgctgggattacaggcatgagccaccatgcctggccacatttttaagtatttactttgtcccaagaacttcaggtgcttgatttaggtactttactcatattatctcattttatctttatccagaattaccagatcaggtactgatattatccccaacctacagatgaggaaatgaagttcttggaaattgtactagatgcgtaatgagcagcagatgaagcttggatagaaactcaaatctctctgactcaagatttatgctctaagttacaataaacaccggagttacacttaaagagcttatggtctaattgagaggacagaaaattcacaagaaagaacctgtgaagagtagtggttatgtgcttaggctgtagacctgaatttggatcccacatcacactaactttctgtgtgcctgagcaagttatttcacttttctgaatttccattttctcatctgaaaaaatagaatacatccctcatagaattgccaggaggattaaattaggttactcatgtaaacagtgttttgtatttaataagtgctgtgattattaccacttttatctgttttctgtaacgacgacagagggtgtattatatcatgtactaaaggcaccttgcccaaactggaggagaaaaagtatcccaccggttcaagtgcattactggtagcaggccccagctggatccaggaccaggagggggtcgtggaaagcaagcatttctatcggcaaatgtgagtgatctgctgtagctcagatgccaccccaagcagcttgccttgccagaggtctctggtaaaggggcatcattgggtacaaatgtgctggggcacttccctgcctggaacaagggaccctatgccaccctctggatctaggactcagtggctctggacccacagacccagcctttccagcattctgcaaaggaaagtgcttctcagaagccaatgactaagccagcccaggggttccttttacagagacaattgttgggtcaagaaggaaccccagagctgagccccacatagggctaggagcccacgcctcctgtctttctcacttggaagtcaattttacatagcatggtctaaagcctcatggaccccacaagtcttttaaataataactaacttctcttcccttgaataaaataatcagcaacaataggagaagcaaagtcatgagaaacggaaggaatgtagtccctctgaggatggctggtgaatttgcatgctggtgttcttcctacacccagcctatcacctcagttaagtacttattgatgatttatccgtggaaagttcttgaacgctagcaacatgctcatttctgtaaagagcttgaagtacaaggaagagttttaagtttaaactttaaaaagttttaagagtttaagtaaagagctttataagacacacatgaagtagcaacagctcctcatgtgtaacaagctgcaaataagtgaaatttctgccagctcagcagctcctcgcctgcagacagcagcagccacatcaagttgcccagactcattcctcttgtttgcctcctccgtccctactctggtcttcccagagcaatttggagagggctccctactaccagtggcatcataaaaatgacagtgtacttgccaagggcatggtcttggggtgctcctaaagctgttgaactgcaaaaaggggtgccgtttatttgcagaagccacaagaatgctctcctccccaactctgctctttcacttgggtctcaaatcagcttgtctggggccttatctccccaaatcttttattccacttaggggccctcacctcccttcccttgcccatattggcttttcaaattcagcccagtgagccagacagggaactcttctccttcgtcttctctctcttcacagcccccatgatctatctcttcttttctctacattgtaatggaaaaaaagctttttgtctagccatgattgcaaatagaagggggatgtgtgtgtgtgtgtgtgtgtgtgtgtgtgtgtgtgtgtgcacatatgcatacccaaagcagtattctcacgagctgttaacagctcaaaggagtcataggtcatcatcagaaaggtttcatggaaacaggaagctctcaggaagatctcacttaccttacacaatggcaaagataattgtgcatcagggtgaaagagtaaagaaaggttacttgcagcaaaaggaaccacaaaattaaggcacagaagcatacctgagtagggcttgtctagtggagcagtgagaatagttagaattggacacaagttgcagcaagaggaagttgtgcaatgtaagtgtggcaggtgggacaaagatgacctttggaagacaagtggctgagaagagatttgctgtggtccacctctagggagctctctgaggtttttgagcagattgtggcaggatgacagcagtattcacaacttgcaagggagctggatccagccagggagcgcacaaggtgtactgaatgagggaagagcatgtcagtgggtcgtcagggagggaagagtctcagagagaaatgcccagactggacagaagtgtgaggcattcccggtgaaccgggacgctctcctcctacaatgttgccacttgattggagtttccttgattgtgaactacattcttaaggaaacttctattccaaaatgagttcaaactggttttgtgccctttctacacctacactctatctcatcacttgtttttttctagctgtgtaccactcacttccttaagaagtctctcctgggtctgcctccagaaccgctggctttgtgttctctgtgtattctctttgctgtgagtcttgattttgccgtctgcatgtccccttggtcaggacaatcctgtgttccctgttgcctggtccaccctccttaggataatgatgggaggaactttttgcccatctatggagcatcactgtgcccagccctgcctcccgggcttctttgcctctgatattctgtcatcttctcccccaacctagaagagggaagggaaagaaattattttactggaaactccaaggttcatgaatgataaactaagaacgtaagccattctctacagcagaagatgctacctgattcctgaaatgtcatctgtttttgtagcaggactgtggtacatgttcttcactcttatcaccaaaagacacttaggggtcataggtggtaatgtgtcctctgcttccagtgcggagctcaaggaatttcatggagtcagggacagctgtctgaaaggttgcaatgtcacccttttcagctcagaaccataattccttgagcccagataacagttcaaaatttaggatatgaagccaaagctgaactctagctgaaatcaagagtggatataataaccaagaaacaaatggttctgacaagcacagctttactctgagcatgactcaagggcatctggtagaaaatgaagaaggatcccagcagatgttagggctagggagatcccctcggttgggggatgtaagtgttttaatattgtgtgggcaactctgctttgaatgtatgtctggaggcacctacaccatccaaagccttctggtgcaaaagcaggactcctagagtatattccagtattttttccctgatcccagctgaaaacagccatagaagagcctccctttttgaattatggctgtctgtccgctggggtggagaatggccctgggagacaagagacagcccatggagcaggttgtaattctacaggcatatgaagagcattcattctgaagaagacattcaattcaggaatgtgaattacacaaggaaggtagacaaatcccagctttaacaagtgctgttcacctatcactacattttcaagtaaaggtggtgtatccatttgctagggtttccataacaacataccagggctgagtggcttaagcaaaagaaatttatttgctcagagttctggagactggaagtccaagatcagggtgccagcagggttggttttcctcagaggcctctctccttggcttgccaatgactgctgtgtcctcacatggcagcccctctgtgcacacactcccctgggggctctctgtgtgtccaaattccctcttcttataagaacaccagtcatattggattagaacccaccctatcagcctcatttcaccttacctccttaaaggtcctatctccaaatacaatcacattctgagtactgcgggtaagggcttcagcatatgaattttgtgaggacacaaggcagcccctaacaggtggcctaagagaatctttgtttgaatgctaataatcatgatacctaacatgttctgagtgtgactcactatgtgccagagacttctaagtactttgcatgtattatcacaactattatcacaattatagattatataattattgattatatagattatagatcaattatagatgactaccatcttctctgaagacttactttggtgtaattatgtgactgtagtgaacactatgccctggtccctgaccttggatgcctgtgattcgatgagacatggaataatgggagactcttaccctcatgttttgattggtagcagatctccggaatgtgcaaagttttttagttgtcgttgttgttgttgtttcgagactgtcgcccaggctgaatgcaatggcacgatcacggctcactgcagcctctacttccggggctcaagtgatcctcccacctcagcctcccaagtagctgggcacatgccaccatatctagctaattttttctttctttctttctttctttctttctttctttctttctttctttctttctttctttctttctctctttctgtttttgtagaaacacagttttgccacattgcccaggctagtttagaactcctggactcaatagattctcccacctcaggctcccaaaatgctgggattacaggcatgagccaccatgcctggccaaggcttcttttcttaatccatgatctcccaaagtcacacccaagtcagtgatgggataatatgagtgggaggacccaacaacctcttttggagggtcttgccctgactggcacttcacgtgtctgaggttcctctttcgtcctttggctggctgagtcatcaacattgagatctacaggatgcaccagcacctcctagagggccctcagcaaaccactgagcatttcttacaagctacacccccacaccagatcttctcatttaatccacctatcgactctgtgctaaaactatttttatccctgttacaaataaggaaactgaaattggcctggccacagccatgggcaccacccttcccttgtgtgaccttgagcagcacacctagcctctctgggtggatctcactggccttgcctggaaaataaatgctggatctcatctccccttcattgctgatgactccactcagctcgtaagaggcatttctgcttatgcctggaaaaatctagcattcacacaccaccacaatactatattccatgccaagtcaccactattcttggcctccctatccccaccctcctttttgggggtcccagactacagaaccaataaacaaacccactttcatgattcctccatccccactccactgcccaaagtccctcctcacccaggtaacctgcaaacacccatctggtttgcataagggcaaacctgccccctggagtgtgagtcaaacaggaacttccagacaagctgtcctggggcagccctgggccaccttgccagctcaaagcaagagtgtcacttgcttgggtgaagagtgacactgggctttctgtctcttctctggccctgcaggaggctctgtcggtggtgagcgacgaccagtccctctttgactcagcgtacggagcggcagcccatctccccaaggccgacatgactgcctcggggagtcctgactacgggcagccccacaagatcaaccccctcccaccacagcaggagtggatcaatcagccagtgagggtcaacgtcaagcgggagtatgaccacatgaatggatccaggtaagctcaccaggcctgtgcaggattgggggaaggcacaaagtcgccagatctgcagcaagtggcttctggcacttaaggtttttgcagcagatggggctctagagctgggccaggaagcctgtgtcagtccctagagagctaaggcagagagggccacagactgatgatggggtggagtagggctaggaagcccccctggctctctggggcccacgaagccctcagaggccaggtaggagtcaggccccaagcgcctatgcagacactcgtggaacacttatttcttgttaatcccaggcccaggtccagtcctgttggggacagcttagcaataagctactcttccctgtcctgttgaagatacttaacccctctgggcaggtctcagcagagcaaaggtgaccaaaccattctttagtaagagtggagaagggatgaggaaggtgtctaccttcctgtgggggctcactgtgtctgggagggggcaggcacctggaaggcgtgcatgaagtgggtacaatactgggtcagttcgggctttgcttgtagaaatggagacaggagggtccagggagagaaaatcacagggtcatggaagaggacagtggacaggcggcctcagttttgcgtcctgcctctgccccttgggcaagtcatcgaaacccctcagagcaccagctttctcccttctcaaacaggactgggatattcacttccttatggtccttactctagcgttactctgatgcctcagggaaaggacctgggatggtgcctgagacgcgttaggaaagtgctctatagtgacagtgattgttatgagcaaagacttgaaagacagagaacatcagtcttattcacaaaatatcagataatctactgggccaaaggcacaaagagatgaaaataaaaagcaacagagggccctgaatggcaggctgaaaacatgtgccatttattccacagccagaggctgactttgagcaccgatgtgacatttaacccagaggctgactttgagcacagacgtgacatttaacctcatcagagcagtgacttaagactagcgagctgacagtccttgcgcacagacggtaggatgggagagtcagaaagacaagtgaagaagttagtaaaatatcccagataggaaataatgaagttctgaactaagtgatgatagtgattttggaaagtgaaaaggacagatacataagggcgatagcaaagagatgattaacagggcttaggtgagtaaagtgtgaatgaagggggtgcatgacaggaaagaatcaaaggcgactaaagcctgcacattttaaaggctggtgctgtgagcagccgcagaaaggtggcacaggaaatgctttaggatgggatgtcagtgttctctttgagattccttgtgagcaatgggtagaacatccagataaaaatgtctactaggctttgggaactgaagctcagataatctttcaggcctggaatttacgtttgggcatcatctctaaggagtctgaactgtgaaagtggatgaggtcaccgaggaaactagtctagattgaagagagagaagggaatgagcatggttgggagggagaactcctccagagcagctcatggcctcagacctgcctgtgggaactcccaggcctaccacatttcaaccctactaaccaaaaccagtgactgggatctcagccacctttccagatcccaggatttcaggaaggctcagaggttctgagcctgcagcccctcagatgaatctctctccagatgtaattctgatggtgccggagctcctaacagtcgaaggacatggtgtgttgaacgttttcccatattatcttaccacttgttcctcaccactatactaagaagtagttactgtaacttcactgttacacaggaaggcaagcagggctttcaggggacagtgctttgtctaaggatttaaaggaggcaaagttggagcccgaacccaggcgtttggttccagccccacgtgccatctgttaggcacctttctgctccctctgcttgtgtgtcatgcttttgcaccaccacctcattcctgccaatgcccacctggtgaggaggcctattctacgatgcctcctaaatggggcccttctccaaggagctcccaatgcttgttgaagatccagatcccactggtggagattccttttttttttttttttttttttgagatggagtctcactctgttgcccaggctggagtgcagtggtacagtcttggctcactacaacctctgcctcccaggttcaagcaattctcttgcctcagcctcctgagtatctgggattacaagcacatggcaccacacctggcaagtttttgtatttttagtagagacggggttttactatgttggcccggctggtcttcaactcctgacctcatgatccgcctgcctcggcctcccaaagtgctgggattacaggcgtgagccaccgcacccagctttgttggagattctctggcctgttgtaacctgaatctgcctactccttacctccactgcccctgcctggtgcaagccagcagcacctctcctaggcttctgcgggggcatcctgctctccccacttcctcctgccttcctgaagtctattctccggacagcaagcagccagagccatgctttcctcgtttgtaatcctcttgctcaaaactcttcaatggcttatgacaaaatgcaaagcccttagtgtggccccaccatccctctgacatcctctctactgccccctccctcccacttcttccctccgcgccagcctcataagactctagctgctgctcctagacccccaggcaccctcgtgcctcagaatctcttcccctgagctccttcattctggaacattcctactccatctagtcatatgactctctccctcacgagttttgggtttctctacctgaacctcaccttttcagaggcctcccctggccacctgatcgaaaccagcgcctcctcactctttaccctgcttagagtgtctgtcctagttcttatcacctccctcactgacacgtgggcagggcctgaaacggtaggtgctcaataaattgtcgtcaaataaataactgagaacacatggctgagcagactcaaaagagaaggtgcttgtttaaagttaggacgcagatccaggtctgctgactcagccccttcaatgctgagcctgagttgatgcatgggcttctgagttccatcttcatgctcaatggagacccatgggtatttgtgtctctggtgggaaggaagtatgctgctcaccactccctcccctgctctcagagaatcctcaagcacttcaggatactgatcctgtgcaaagagggtcccccaaggaaattgatttttcagaacccacttgccagctcatacctggctccagtcacaccaaaagccagctggagagggcctgtgtgaatattccagtgaacagacaggatatttacctggctttggctacacagagcagcaacctctgcttttgagttgcttgtcttgacccataccatcagcgggtaacaaagtaggttcagaaagactgatatcttctcacccaccctgggcaagcagagacaatcctgtggactctcagagccaagcagcttaggcacagctatcgccagcaccccacaaatattccctaagggctcacatgtaagctggactagtggctagcaggaagcaaggagttttagaaaaatgtcattgcttacagtggaaccatgtcagaccctatcatttaattatgccaaaagcaatgacagaatgaaataaatgccaggctctttaaatctctcatcctgaacactgtgcttctcctatcctctgagtattattgataatgacagttcgttacttgcacatgatttgattgtttgcagtggtctaattcgccataacacaaaaagataggagaggatgttataatgattctgaacttcagatgagaaaaccaaggcagggtataaaatttgagactgcttggctcatgggctagacctgtgctgttcaatgcagcagccactagccacaggttgctactgagcacttgaaatacggttagttgaaaattgaaatgtgctctaaatataaaccacatactggatttagaagacttactatggaaaaagtgtaaaatatctcattgattatttattatgctgaaatgatcttcttttggctatattgagttaacatattaatatactttaatatattattaaaattcatttcatcgttttgttttcttttaaaaatctggctactagtaaatttaaaattatgtagctcggccaggtgtggtggctcatgcctgtaatcccagcactttgggaggccaaggcggcggatcacctgaggtcgggagttcgagaccagcctggccaacatggtgaaaccctgtctctgctgaaaatacaaaattagcctggcatggtggcgcatgcctgtaatcccacctactcaggaggctgaggcaggagaattgcttgaatctgggagacggaggttgctgtgagccgagatcatgccactggactccggtctgggcaacaaaagtgaaacaccatctcaaaaaaaaaaaaaattatgtagttcgcacatgtggttcccattctacttctattggacagtgctgggccatggtggtctggactgttctgtgattcacagtgcattttttctgcattccttgacagcatgggcttctgagttatgtcttcatgctcactggagacccattggcatttgtgtctctggtgggaaggaggtgtgcggtgcacctgaagctaccatgcccacttgcttttcaccccagtagcaaaccctctggcccaggggcaaagggtcaagtgcagagactgaggtctgaggatctcagagacagagtggcttgcccatgttgagggagttttgtgctctctttcttcatatcttcctgttgtggttgactctgttaggctgggttgccttgaaacagcatggcccataggttctgtgtcgcatgtagacttcagcaacttgatccaaactgtggtctgcaaataactctcagctgcatcctgtctcaaccacagggataggggaaaacatcccatgaagaaaagaatatcaggttatagagggaaatgcaagacttgccttgtgagcctggtattcaggaccagagttcagagctaaccttccttgaaattccctggcctggcccccagggtctggatgccctggacacctagggactcacattccacacagagaaggatcagctcctgttccctggaacttgtgcctctctggctgcgaggcccctttctaaactcttgtgttctcaaccttgcagtatgagacatgtcacacataacctgggtggggaggatacacaggatcctggaaaagttagcagcatctactgtgtatggggatgaaaacagctagtggattagggcggtggctttatcataagtgatgctttttcttttcttggaatttgcttttaagttattgcatctccttttcaaaaacaaaaaagtcacatctatgtcctacagacttcctaaaggcaatacagattgtttaatttttgcacagggtgcatactacgcaggagttacacgccgcgggtcctaatgcagccatgtgacttaggcagcccgcgaggcctcactttggccacgtgaacatcaggtatcctttgacagtgagcctgggctcagatgtgcgggtctgatgatatacccaagttcagttgctctgagttgactaggaaggtagagaagatctttgtacagcctaaagaggtaatcttcaggagaagtctttgaaatctcccttcatccaaacacccaagatcttacaccttgttttaaatggcctaacacattgcaaagctttttttggaaaccagtagcaatgttcacagaacacacacaaacagaactcgaggagtcaagagctatgtccagtggtggaaatgaaggacaagggctaccctaccctcggcagctctgctgtggcctctgtcgccctgagatggagatgtgctgagttattacacccttggggccaccgccacctccctgctctattgtggcagccccaggctctcttgtcacctgtcccagtgctatcagctgccagtgggccccagccccatgctagctgtaagtgcaggtcttaatacaaattagcagcagtgcaggcaagctgaatggcaaaacctcgtcccgcactccccctccctcttgttttcatcaagccttcttcacaggcgccagctgcctcattaaagagcagccttttatgctgggcttcacctgtacccaccctgagcggcagccgtggagccccatggccgcacgcagggcttgcgctggctggaggaggcacggtgcttgggagctgcaagaatggagggaggactggcaggcgagcgggcgaggtatggctttccttctttctctccctgagcagtgggaggagggccagctgggcaagtgtggggaaccaggatggtgccagcccttctccctaaggacacccgcctgcaggtcctagtgcagaagcctgggaccgaggacagggccattttccagaggagaaacaccctggcgggcgagcggccaaaccgatcacctgtccagctggagagcaggtgtgtgcacagggccgggggagggagagaggaggagggaagcggaactgggagaacttctatgggtcagtgaatgaggaggttctgctcagggaatgagtggcagcggccaccccagcaagagagccccctcctcctctgcgtccactttcccttcgtctaggtgcccatggctcctctccttacaaggtcacgtgttaggcaggtttggggaaatgtttctttcagcttttcacatttattttcctccaaccctggcacctgggaccagccctgccacctgtgcctaccgtacatggccataaccataaaggctcactccatttcagtgagtcctgaggtgctgacttctctgcacagcaagaggtcagtttttaactcagaaatccccaggggcccggctgatgtggaaaagaatttttccaaatatcgtatccccaccgtccacaaacgggaggagcccggggagtgtgccctcctgtcccaccatcctgccccctgctgtagttctcctttccgagagacccctgcccataccctatgccctcttgctctgggggtcctccaagggaagagcgtgcagtgtggagcccacctctcccacagaggccgcctgccaatgaaaaccttgctcacttggttgcaggccaacttaatccttcaaacttctgcagcacttggactgtttcacaactgacaaggatgcagggaaaggctgccagaccatgtgcgtgagtgtgtgtgtatgcgcgcgtgtgtgtaatgtgtatgcgtgtgtgtgcactgtgtttgcatgtgtgtgcatgtgttgaatgtgtgtgcagatgaagtgtacgtgcatgtgtgtgcatgttctctgtgttgaaatgtgtgcttccatgtgggtgaagtatgtgtgttccatgttggaatgtgtacagtgcgtgtctgtgcatgtgtgttgaagtgtgtccatgcatgggagtaagcatatgtgtgcacgtgttctctgttgaagtatgtgcatgcatgtgggtaaagtattgtgcacatgtgttctgtgttggagtgtgtgtgcacatgtgcatgcatgtgtgtgagtgtgtgcctgcagttagccccagggcgggtgaggggacccagtgcactcgggccagagctcagctcagatgcaggcaccagggtctgactgggactgcttcatctcaggccaggtccttccgcagcagaagccaaagggccaaacgctggtgaaaagtcctgatgtgctactgcctcccctcccctcccctgccatggggacgttaaaccttcagcaatctggaactctgacggctggtttttggttctctgcctggaaaaacagtaggcgaatagtaaaaccttaaattctaacatgtgtgagttatacatcttattttcattttcagcccatgtttccctctgtaagacatcaggaaaaaattaccgtctgacttctaatatctcagtggagcatttatctcccagctatgataagtgatcttcaatatttttttcctttcagattaagaaacaaattcatttaattttctttattgaatgtgctcaggcctccccgccctgcctgggtctcaggaagccctgggctgatctcccttctcctgggttagtgactgccgtccctgcttgtgggatgggtgggtccctatctggtacggccctgctcctcaaggcctcgctgtggtccgttcctgcgcctggcaggggatggaggacagtggccaggcctttggaacgtccggagaggttatgcggcctagagttggaaggctgtaatctgaaccttatctgaactccttggtctgaaggcctggtttggagctcttgagagaactggctgtctcccaggctgccagaaccgatgcttcctgctcagtataatggcggctacagcttctccttggccttcccatcgtctcctttggtcctgctgctgctggagtggctgagcagcgggcactgggtgtgacagggtggcacctcccccaagtatgctggaggtgcgtgatgctgggctggagggcatgcagagtgtgtttgccagccagcttcagggcgccaggtggccatgggtgggacttcacccctccagacagctgcccatcaccagtgctgcaaaataccaggtgctgatcaagttctgtagttctaggctaagttggatgatctgctttctctcttgtgaatgtccatactgcttccacagtgagcttggggccagggatgcaaaatgccacagggccaccacctctccatcaggtggaagttcctggactccattccttctccaagtagcaaccagctcttttgcatgtgtgcttgatagtgaagcttaacacagaagacctgagtcctgtttccaccttgactagctgtgtgactgagccaggcagcccctgtctcgatttcattaaccatgaaaaggagatagtaacccttgctgtgcctatcctgggggcttattgggaaattcaaatacaacagtgcataagaaatgcattaaacttatatatgtgcaatagaaataactcactgagaaagcatttgctgctcacctcctgtaagaatactagggttaaacaaagaaagtgatgactatcctctcaagaactcagcagtcagggggcgcaggccaagctgagaatcagacagtgtgacaagtccttataaccaaggcgggcaccaagtgctgggggactgtggggaaggcgtgtctgggagcatggactaggttgcctggcagtgaggctaaaaatgtaagctgcagtcagacagggagggctgcgatgccacacaaagaagctcagaccttggtctgagggcactgaggcgctgccagcagtttttacgtactgtaattataggattgggctgggatttgaagaaaactctggtggcagcatggaggatagaaagagggcatcatcatcatcatgacaccaagtgtggccgggcaatggctccatgctcatcatcggagccctgggctcatgattcagaggctgaggcaagctgccctgtcagtgctgaccgcctctgggctttgtctcttctcactttagggagtctccggtggactgcagcgttagcaaatgcagcaagctggtgggcggaggcgagtccaaccccatgaactacaacagctatatggacgagaagaatggcccccctcctcccaacatgaccaccaacgagaggagagtcatcgtccccgcaggtaattcgagaaccaggctgcctgggcgccattcacttccccactctctggggggcagggagcatctaaacctttatctgatactctattccctgtggaattgcaaaatggagaaagctgcacgccagccgggagtggtggctcgcgcctgtaatcccagcactttgagaggccaagacgggtgaatcacttgtcaggagttcaagaccagcctagccaacgtggtgaaacctcatctctactaaaaaaaaaaaaaatacaaaaattagccaggtgtggtagtggacgcttatattcccagctactcagggggctgaagcaggagactcgctttaaccgggaaggcggaggttgcagggagccaagatcacaccactgcactccagcctgggtgatggaatgagactctgtctcaaaaaaaaaaaaaaaaaaaaagctgcacattttacctgacttcctagctgccctttaaggcagtatcccagatgtcacctgatgtgtgggtgctagaagccccacccttaaacagaccacatcacagactctacatcaatggcctggtcctcaaggacgggctgctcagagagcagaggcaaggccgcctccacccaaaaggaatcccgtgagctctggatgtgggcatccctgcctgtgaggaggaggtcagctgcagaggccagtccttccctccaggctcgtacttcccggcatctaccaggttccacctttccaaaattacagccagctctttcagttttaaaatagaaagaactatatttaactaatggagtgccttaacatgtgtgccacaagttatgtcattaggtaaaaatagcctctttttcctaggtgttggtgctgttggtcccagaaaataaaatcatcgttcagtccttcagtccattggctggacactccaccccagctagcaccagcaagctcagctgcctgcacaagaagggtgtttacaaactgccacgtgtagaactggtgccaggtagaaggggcaaggatgtccaaatcttaagcaaagtgattacagggcagggattaaacctgatcttaccaaaataactttaccagagaggcaaaactccttccatttgtaaaagcataaatgtagttgcctctgaagtcaaaaggttagacatctctttgaggcagtccgaaggcatctgcttgtaggtctaaaggcagaaatgttaagggctgcctcctgccttggcccgtggtgtttgttttccctgggaagctgcatctcaccatatccctggattacagctgcctccctgtgctctgggccaaattcaagaaggtgtgagcaagagtgaggcagcagacgggtggggcttgtagaaatttctctgtaccctttaggacttagaaatgactcctaaagcaattctaagtttgctcttccacaagcatctgacctaacaaaggaagaggaagaatcacttccatttattgagtgctttctaggtgccaggcaccacgtaaattgctttatctccatggcattacttaaaacacctgtcacaggagaccagctagtaatgtttagcccaggtgtatcgtctccctcctcactgaaagcagacaatgaaactgtattagaactgacaggtgggaatctctttgtacagcccaaagcaaagctgagcctcactgggtcttcactcaaatggtttcaaactcccctgcttcagtcaaacagctcccagcctgggagggaaagcttgcgggactgaagggtttggggatctgagattgtctttgaaccaacctttggcaccatctcattttggtcgtcattttggggaaggaatcttggaaatgggcagaagtggccagactgctatgtcgaccctccaaactttctttgatcagtgttgaaatgctttcaaaaggaatagcaaaacatcaggcttggctgagccaagttacctatagcgctggtggtgaaaataaaacaaattcatgtcaaatgattttcaaagcactttcaggctatggatttacttcattattttagctccggctagatcttttaggtcctcacacattttggcttcctccaggccaggctgtggatatgaggggaagtctcatttgggcaagtccacaaatcaaggcaataaaatattagtggaataaccgattgaatttatgatgggatttaaagacaagtataaatgtgggccctagttaatcactagctccatgttcagatgggaagaaactaggactaaatcatccaggaaatgcatttggaagagtttagcatgatccagagttgaagatttataattcattgtgctgtagagggagagtaataatattgttgcagagcccaaagcaagggaggaaataataaaataaataaaatatatggtgtaaaattgaatttgaggccttggatactaaaagtgaggaactgggagaagtgaagaatgaaataatatgctacataatccaactctcccgaggatatgtttctctagaattctgaaaaggtgcaaaattatttccatttgccaatgatccatgcctaattgcttctggagagtaaaagagcaagaaatgtatctgagagagagagaggaagacatacttgtacaatgacactttagaggagctccgctttctggcttcagagcagtgtaactcacaggtgaggtaaagcaggatggtgagaagaggaaaggggctttgggggaacccacctcttcagcttagtgaagtcctataatggtttctattggaaccccagcccagatacttaccagcgatggggctttgggcaaaggacttaaccttttaagactccattttgcatctgtaaaatggggatattaaaagatttccttggtaagtaaaaatagggctcgcggagcaggtggcacatagcacccaccatctgagccgtcactgctcacagggcattaggttgttggaatgacattcagcagcaggctgtgacctgtgaacccaaactctcctaactcctcccctttgccagctcctccaccttcagcacaacacagcagccactctcgtgcatgggcagggcctgggcactttacaaagcagactactcgggccctgccacccagattctcacacataaaaaccaaggtggaatggagagtccaaggacagttggtggatgcttgtgtaaaagtgctgggaaacttgcctctggctgcccagctgtgaagcgtgagccttgcttcttgccccacatccactcctagtcattcaatcctggttccctgctttgccaggagccttcatagacgctgtagaatgagagggtgagttgcttgaggggtagcacagatattcctgcctaataaatatgttaaatcaaacaggctcattagaagccggaggctaatggccgacttacaataaaatgccgagtctctcctcccccaggaagtcttccttgactctccaaattttcactattcccttccacttatgagtcctcgaaccaccgccacacagtccattgcttagtagtggtgtgcttgcctacctgtttcatgggaatgagtatttcttgaaggcaagcgtcatgtaattttcttctatgataaggatatttaaggtgtttattggacccactaaccattggttgccaagtgaagagatgggcttcagactgtgatgagtgataaaagagttctgcctactgtggaacctgctggaactcatcacttgtgctgaaagtgcaacatccccaccacacacacacacacacacacacacacacacacacacacacacatacacacactgagaaggaggaggaggtatgagtgtcctaccatagagatggcctcagtggttaccttacctgtgttcactcaagagctaaaatgttctccccaacgtcatctctcatctttgggtatttaaatatctaaaatatgttttggggatgccctggtagaaatttctacacagctgtgcttaaaaggagaaaaatctagtttgggtttctgttcaagactaacaccgctgggtttttcaactgcacagatggaattgcagtaaaagtctctctgtttcttttctacagccatctgagggatccgtgttctttcatgaaatcattaatattcttaaaatacagatggttcccgtttccagagacattggtcccggggtctgtgaaattgtgtttattttcattttgatgccaccatttctcaggcaaaggttccaactgctctccaaaactttaaagagtgctctgtcaggatacgtagtgaggcagctaagcacctccctggagtgctaagtggttcaggcagcgccagatgccatggagcctgatgagtgttctaggggaaccatgtggaagggagctctcccagagagaaagagaagggaaagaaagagggacaaggggtgagggaggctgcctaggctctcagggagcctctaccttcctgcagtccttgctaacaacgtcttctcctctgcagaccccacactgtggacacaggagcatgtgaggcaatggctggagtgggccataaaggagtacagcttgatggagatcgacacatcctttttccagaacatggatggcaaggaactgtgtaaaatgaacaaggaggacttcctccgcgccaccaccctctacaacacggaagtgctgttgtcacacctcagttacctcagggaaagtaagtgccgcccaagtacccagggctgggaggaagcttggcatggagccaacccagggagaggaagtcagtgctgcccgttcgtgttgggcagatgccgccggagcagcatcgtggggcctgtagtgttgccaaggtcacgtgggctcctacagaccctgtgaggggcagacccaatcctgaagtgtcaaaggaagtaagacgagaaatggagaaaagtagagagctgtgacctggaggggtctggcagaggctggttacactcttcccatgagaccgcctttccagaaactattccaatttgaaaatagatagagatgggtggtgccctggctggtgttttcctaagtgattatttaaaattcctccaggaaactctagattcaaggcttttggatttaaggtgttgaaaataatttacatattagcttcctcttaatcttgggatactctggcacaccctaaccccatttgacagggctgctatctgcacacttccttgataaggaagagcagccaaaggtgcaggtgtgttaggatccattggaggctttcttctggtacagccaagaaaaggaaaagagctttggaaagggcgagcttaagaaagaaagcaggcagttgtccaagagatttatctagtatgaggtactctagcaccaagcgcccatccgtctgatatgaatttcatttgatatgaaatatacacagagcagaagaatggaattattttagtcctgctggtaacctcagcctgagtgccctgctgggaatccaggccaggtggtatatcaatatcagtgctacccctaagtatggaaggattgtcctggggcctgaaaagatggtgctaggatcacaggaacacaggtttgggctcacactacgtaagagcattctagcagccctgtgcaaagacagggcagccttgagatgctatttgttgtgaatggccaaggcagctgcgagtcttgcaggagtttagctttgggcaggggcttgatgattttaagcccccttcgcaagttcagatccttagacagcaactctgggacctgcttttcctggactggctggctctgggttggtgagctctgtttgctcgccatcgttctgtggacctttaactccccatctttggaatccactgtcccttcagcgacagtgttcctcatggggcaggggcaacacgtgctggctggagaaatgaaaaatcaaaaaactggctttggcagtttccactggtgcctctgtgctctctggtcacctttccgaggcgtctggtaactagtgcgagaaagtagatgatgcagtatttgttagctccggagcaattacctcatgtctgagtcttgctgcaacatgaggtcagcccaagaaacaatttcaaaaaaggggacaattttccacccagtttttcagagctttggataattagcactttctaattcatattttcagcttttaactgtttgtggaattttaaaaaataaggatctttgaacagagtcctgcagtgatctaggcaggccagggtgggtgtgtggaggttagcatgagaaggagagaccagcaaagcaacctgattccagcaggagtttgcaggaaccctaagccctttccttcatttgccaggagtagagaggacaacagtagcatagacagcatgctctgaactgttagttaaagggcccagtgcttcgagactcttcggcggatgcccttgttgggagaatgttcaaggcattctctccatgtggggaaagcccattcatgccatatgaccccggggccctaaccagtccataaacagcccaaggtcccctagtacttcctgccaccgaacaatgggaacacagatgctgaagtgagacaaatgcctgagaaggtggtcactggtcgccagtagagagaccttctattggagaagagcagataacaaggttgaagtggaggtgcagaggatggcattttggggggtatagcatggcaagaaaaagcaaattgcttctttctttttaagaatatttatagacagaaagtgcccccaaatcaataaaaatattaggtttcccaaaagggacttattagtggagcatatttccagagtggagaggaggtggaatccagcttgtatactgaagacatttgaaaatgcagggcagatatccagagttgaggatggtggcgaacagtagtacatccacaagatgggaagtagttgttctgccattgaaatgattattgggaaacaccatgagaagtgcttaggatacaatgttgggtggaaaagctcattataaagtggtctgtgcactgatagaaaaaccatgtctgcctgcgaaagcaaaaaattaaaataatcgtgttaaattaaaaaaaaaaaaaccttgccccaacatggtattgaaatatccttttgaggaacctagacttaaaatgatccactgtcagggaaaaggcttttagattcatgctgctttttaattggtgtctaccttggggttccagccttggggaccctctagtgtgaggtggtggctggctgctaagcgcctgcaggaggccatgggctggcgatcgtgtctgctctgtttctgctctggattgctgggaactcccccgtgacaaccagcactttaaacgcttttaaagccttcaaacactttattgtttttccagactgacttccagtggatgttttgtgcttaggtggaaggccagtgcttgcggagagtttgaggcgatgagtcaaggcaaggggagagggtgctgattctttgtgctttatcatcttgtcctttcattggagaggaaggtggggctcagatatttccactttagcaagagatggatggaaaatagctgagatccttcactccggtggaggaagtactgcagggtgaaggaaagttgatagagcagaatcggggacctgagactgtggctggttggaagtcagtagagtccaagttggtggcacttctctgatctaatctttctgggctttatagaaagtctagaaaaaggaaaacttcataggataagaagctttggcatcaaatttacatttcacaaaaggtgcttgactatttattctggtggtttgggaggggagctagacttttacattttaaatgcaaatgtattttccagggtagagaagaaatagcagttccctgtgcccctacagaccctgtctgatggccaggcatgctagggaggtgcttgttcttcacacctgggcgtgtcagctgtgccagaggagctgtgtcacacgccacacaggcgcccacccctcccccccaccaccacaggaaatgcaaggaggactgtgatggctggggtggccacggttcttgggggtaattcccatgagtcctgggaaactccagggtttacacctgtcaatcccagcactttgggaggccaaggcgggtggatcacctgaggccagaagttggagaccagcctggccaacgtggtgaaaccccgtctctactaaacatacaaaaatgagccaggtgtggtggtgggcgcctgtaatcctagctacttgggaggctgaggcaggagagtcgcttgaatgcgggagggggaggctgcagtgagctgagatcgcaccaccgcactctggcctgggcgatagaccgaggctctgtcttcagaggaaaaaaggttgcccccttgtggacaactatctacagtacccattttgaagctgaacccactgaggcccagacagcttcagaaattggttcaaaggcatccagccgattgagagcacctggcatctcagactagggcctctggagtcccagtccctggcctcgcgttgccgacgttcccccggccctggagacagcaagccagcctgcgccacacaggcaaggcagcctcactcccggccttccacgtgggcagcccggccacttcccccacagcattttctgttgtcatttgtaccaagagataaatgctttccaaaaactttcctgtggcctcctggaaggaggccgattaagccaaacctatcaccacgctaactttgtccttctctgggcctgactgtcggccccaccagtatctctcccggacacaccccgtgtggcagaggagccttcgcagcagctgctgcgggaacgagatttgtcccttctcaggccaaggcggggaaggacctcgaagaaacggagggcgccgggctggcagttcaggctcagggccgctggggggagtttgcgcaaggctgggagccccgaggccccgggggaggtggggaggcagaaagaaaaagagccttttttaagttttacaaacaagttcgttttgtatgtcaatctgggtctgacctggaaaaaaaaacactaagaaactgcgtcttcaaacagtggctgctcaaaagaatgaaactgcgcgaccgggagaccacggaaagggtgtctatcttcattcccatttttaatttaaactttaatggaaaacacattttgcattttctggtctttccacctgcagcctcagatggtcgggcagaggttttgggtctgggcaattaagctggtgcaatcttatcacttccaggcctgggtttgactggtgaaggagaacagaatgccagctgaacaaaaggccaggtttccctggacccagtagtcagccaggattgttgtttaaagatcccagagccttgcaccctcccgctcctgcacactcagccagagctgttgatatagcagtgcagcccagagaaaagagagacctggattcaataggctggctgtgagggggcactggtgaattctatggtcacagcgaggcaggagacaaaggctttggcactgggacgcttgcgccccctggcccaggtgtccccgatgaaaagcaggttaggttgagggaatgtgaagcagcagaaaccgtgattgttggggttctaccccacacctgcaaagcctcacactgctcactcccctctcctttcagatccaggtactgtctctagcagcacatggattcaaacatggaatggaaaatgatcttttccccatgcttgcactttgggaaggccattctattctcagcaggagctactttatgctttttagagcaaaaatgccctcaataaatagatatatgtatatgcatacacacccatatacaaatatatacatacaaacacatatacagaaacttacaaataaccaagtaggcaaatcttatacttcagtttgaactgaagtacaacacagagagaagtgcaaaaatcatgaagtgcgctacgtgagacattatcgtgacgtgaatccacccactcccataagcacctcccgggccaaggagtagaatttcagccccctgtaccctctctccaccccacaaccgcttcctccacaaaactaaccaccaccctgcttcccagccccataggtgagttttgcctatttctacgatttagcctggaggcagtgggatctgccagattgaggacaggttttgtgaatagaccacgatggggctcctgccttctgcactctctggctgtgtgatcctgggaaaatgatatgacttcgctgagtgttgctcctttcatctgtaaaaaggaataagggaatgctggctctgtatggcttatgcaaggattaagtgagaaaatagatggaaagcgtctggcacaccgtgcatgttcagggagcactgcgtccccaccaccaccttcatcatggcctgtttaccctgatgtgctggcatcgggaaggtgggggagctcagcagcacaggcctgtggcagggtcaggccagaaagagcctcaaggcaggagaaagcagtccaaagccacagagagggaggccagactccaggaggacctgcctgcatcagaacaagttccttaagaaaacagagcctggggaactaatgaagtagaaatcggagaagaggagggaatctaggtcccttgggagagaggccagatgcccccaaccagcccctccttggggaaggcagcctctccttctaggagtgaaacttgaaccaagaacagtctttagggcaaaatccttttcctaggttgccatgaaatatgcatttcatgcaagctttggagaggtcaaatgaccctttctctcagctttctgggagtttcctgtggaattcatgtgtgcccaaagaagaactttcaccaatggggaaatttaataaatgtggtttatctaaggttcgtgctttcggctacatctgcactaatgactcaggcagtttgctcctcggagaccatcatttttctttatttgctccagcagtgaggtttcagcctgagggagagaacgtcagggacggagaggcaagcattcttggtcctacttctgggatttttttgtattccctccgaacatttggttccatttcttcacttccttccagtcgtgccggattatttcttattgcagcagaacccattcataactttaatcagaggacaggacgaatgttcagtaaacgcatgtataaagagaactattgtatgtaattgtgacatctgtgggagaaaggatgtaaaaatagtaacgatcatagctagcatttatggaacacttatgagccaaggtccattctgagcacattgcatgcattatttgatttaatcttcataatgccattgagtggtgttagcccattttacagatgagaaactgctggctcaaagagatgagggaaatcagtggagggcacaaagctagtcagtgataagaggcaggtctaattttaaagtctcctttgcttaataaacatacagtcgtgctttgcttcatgatggggatagttcatcttcatgtgaataccacaaaatgtacttacacaaacccacatggcatagcctactacacactgaggctgtatgctacagcctgtggctcctagcttactaagctgtatagcatgttattgtactgaatatagtagacaaccgtagcacaatggcaagtatttgtgcatctaacttttaaaagatacagtaaaaatacactattaccgttgtcgtatatgtggtccatctttgcccaaaacatcattttttggtgtgtgactattaacaggaacttgtcccagccttactttgtcattggtattcttgaacatggaataaccaaatgtagctggctcttggatgttatattcatgtgactgtctcatttctaaaatggcatccacatagccacactttggcatacagcgggctcaataccacccccgtcatccccctccttgttttcatctggagctgctgcagagctagaactaacagtcatattctaggcaattggacaattcttataaaattctcttcctctgccgggtgcggtggtaatcccagcactttgggaggccgaggcaggcagatcacctgagaccagcctgaccaacatggagaaaccccgtctctactaaaaatacaaaattagccgagcatggtggcgcatgcctgtaatcccagctactggggaagctgaggcaggagaatcacttgaatctgcgaggcggaggttgcagtgaactgagatcgcgccattgcactccagcctgggcaacaagagcgaaactccgtttcaaaaaaaataaataaataaattctcttcctcatcgtctggcttggatagtgcacacattttctctgaggcacacaaccaaacgcccacagctgggtgaggcggcaactccatttcggcatcccttccatgactggagactaaaaataggggtgtgtctgacagcccattcccacccctggcacccaagccagtccactcggccacagggagcggggaaaagggttgtttagaagaattttcttagcctcgaatacatgtgttgagcttatggtatgttttataaaagcagatcccagccctcgtttcaagggctctttaagatttccttaggagaatctcaaagagaatggcaaaaatgcctaagtttcacaaaatacaaccttgaattcactttaaacaaaggaaaaagtctagttttaggaaagaagggagaatgtgttttacatgtaacaacaaattgctttttcaaagtgctgggtacagaagaggtatgaattgaagtttaatttgaaaagattggatatcagcattctgagattacagaaaattcaacgcgtgactcctcaggttcagtgcgtgctcttagacataggtgaagggaagcaaaagttcctattggaatactaccactcacctccttcccaactcccattgccccctccaccagtaacatacctgtgtaccttaccctcacctgtgaaaggacccatatgtacataaacccagaagataccacagcaggaaggagtgatactggcttctcctccaggccatggcaaagtacaagctgcaggccaaatctggccaaaagtggcccatggacaaagcaaaacaaaaactaagaagactgtgcaacagagattgtagttagcctatgaagccaaaatatttactatctccttttgatagaagaaatctgccaacctctgctctagttcaagaaaaaaaatcaaaatctagacatgtcaagtcactcaccaactgtcacatggtgagttaataacaactggaatagacccgggtttactgattctcaatgctgtgttcctatcatgattatggcacagaccacagcgcttcagaactatgaatatggcagcttagggggcgtggtgtttgtttccccagagagcatttcattccaaagtattctgtctcttcactccataaagctattacaggcctgtatgattgtctccaaccaaatggattccattcgcttttcctttcttcctaggagtcctctgtccctcttcccctctccccatctctttccctttctactccctcctcatgtcatctcctactcttgatctcagaagaacattttggttataacctgtttatgttttgcctctcaggttcactgctggcctataatacaacctcccacaccgaccaatcctcacgattgagtgtcaaagaaggtaagtttgttcttttgtgcacttaaaattttcttctgtaccagacatgacacaggcccatgctgttaaggttgttgcagaaaaccagcttgcttgttccactcaacttttcctagcatacaaagacaagccaaagattttcgccacttgtgctaccagttgcaaaaatacagtaaagaaagttttacagtatcttgtaataatatcacaaagatacaacttgaagttgtcactccatgcaggaaaacatgttacttttagaaaaaaatgaatgctgcttactttcaaagttgaaagttgggagttttctctgatgaaaataatgaaatgaagagttcaaggattccagcatgtctacctttaaaggtttttttcctaagaaattttagcagccggtcatgctggctcacacctgtaatcccagcgctttggggggccgaagtgggtggatcacttggggtcaggagttcgaagcccagcctggccagcatggcaaaaccaccatctcagctaaaaaatacaaaaattagccaggtgtggtggcaggtacctgtaattccagctactcaggaggctgagacatgagaatcgcttggacccaggaggcagaggctgcaatgagccgagttcgcgccactgcactccagcctgggcgacagagcaagactctgtctcaaaaaaaattttagcgatgtcaattcatttttaaagtggtggcttaagggtttggtctggtttggtttggttttgctgagaaagaaaacttcctcggcaaatgatttttgccagtgaagattttagtacacgtcacaatagaattcctcagcgtctttatgaaacatcgtgaggagtggttcagatactgttagatttcaggcattgaaacaagtgaataattcatagtacctggtttaaaggaggaaaagatgtgaacaaataattattaggaaccagagagagactggaaaaaatatttgcgcggcatagcaaaaattccacagaggaggggacttttgaataggagcttgaagaataataagagtgtggcaggcactctgtcctccttggctcgctgtctgtccccagtttttctttaactcaccctccccaaaatatataagaaaggcagaagttctcaggatcagttacatatagcacagcactgcaaaacctttcagagaaacaaaggctcttctaagggaaggaccatttggcttaaaatccgcatggggtgtgaaggaaacagagagccaaaggcactagctggctgtcttgcccaaggttacaactttgatcacacagcactttgtgtttcctgttaacaatttataatttaataatgaccagaacatttagtggaagaattatacaacataatgaatccgcttttaaacatttgtgtttttcatttgtttccttctctcctatcccaccctgagccagtcctgtttctgccactgtttttcctttccaaatcagatttcttgagttttgtcatgaacgctgaatttctatggattcattctacattgtgagtcagatttcactttttgacctattttaatatgctgttgcaaatgtctgtaagagagaaaatacattttagtggcaaacgcattagattgaaggtcagggcacctttggcttcctgtgagaaaaccacttcaggccctgaacctcagtttcctgcagaacgaaagagaagaactctgtcagcaagaggccagccctgactctggagatcttggcctctaaggagatgacaggagcactcacattgcgagggctcaagagccactgtcctttgatatgttctacatactgagttttatttcatttgtggatagggatccactttttggaaggaaggaaaaaagaaggggaaaaatgactagagggagagagagagagggaaggaagggaagggaaggaagatagggagggagaaaagcaaggctataaggaaggaagggagggaaggaggaagggagggatgggaggaaccctaacctctgaactgctgagttcggatttttgtaagtttctccaacacttcaggctacaacctgctaccaacatcagaattagccagtgaggctctgaagcagagctaatgaaatattttctgatattgggcttcagatatagggtttagtttagaaactggtttagccaagttgaaatgtgttgctaaccatctcctcctcctcctcctcctcctcctgctgtcttattgttcagccgtgtcctctacctgccatacacatttccttcccttggcccttttgtgtttagggaggacgtttgtaacactgctggctcattcaggcttattgcaggagcagctccctcttgctgggtagcaacccctcttctgaaatgaattaactgtagtatccaggcaaacacacgctgccaggacctcattcaggtggtgccggcatttatctcccaacatcgggcctggcctctagagacgattaagcctgtgctttgcaggtgcatcttttgtccccagtaaagctctccacttgagctgtcttgctcctctatgccttccccttgtgaggtggtctgaatctgtctgaacgacccatcaagccacaaaacaaagtacattagcaagacaaagctaagcaagccctccctctatcctccctgcctcctccccacctctcactggctctcctgctctgctctaatcactatctattagctattagaagacatcaggcaaccttggctccatcttctttgaataagacacacacagccccaaacaaacccagagttcatcaagagcaccagagctgtgtgtgtgtgtgtgtgtgtctgtgtgtgagtgcacactggtgcagtccacaaagggcaggtgctggcatcaagcacaaagcaaggaagttgaggagatgctgtctattaatgtcttcaaagcacttatcaaattagaatggctttttgctttaaaattgtataatcacccttccagcttgtctcttgaaaatggctgcaatctctaggggttatttgtgcccaggaagtaagagtagattttaaaaattaatttagaacaatctttaagcccctttaaattaaatattctatggacatggattggatccagctagagcagttatgctctacctttagtttatcaaggctaaggcacttaaaaaaataaactaggataaaagctattgttatccatttacaatagcagccacaactgtcatctgtaaagggttttggaatatatcagacacctccacatgctttgctttggagcctagcactgggtctttgaagtagatattattatctctattttgcagacaaagaaagtggggttcagcactattaagtgactcactgaagggtacacagctactagatggcagagcaaggactcaaaccaggttagaggattagactagaaccccctcactttctgacaaatacagcctttctcttccagctgccattctgcaaaagcaatacctagcctaaatgtaacttgggcaaagatgtgaatgttttgcattacttgatttctgtccatgcagttttcccactgtcagctccatctccatccctaaacttttctctctttccaaagatgaaccaataaacaacttatgcttggcaccagcccttagttctgacagcacagagaatcaccaggagatctttcaaaatactgactctaggacaaacattgcatgattgcactcataggaggtaactgtcaactttgtagagccagaaggtacatggtggttaccaggagcggcaaggagtggaaatagggtgttagtgtttaatgggtaagagtttccatttgggaagatgaaaaggttctggagctggatggtggtaatcgttgcatagcattgtgaatgtacttaatgccactaaattgtacacttaaaatggttaaaatggtaagttttatgttacatattttactaaaattttgtaaatgcaaaaattaaaataaaaaaatactgatgcccaagtgccaaaaaatgatgcattaattcagaacctccaagggtgactcctgggcattggaaatgttttagagctctccgggttattcatataagccaagctgcagccaagctagagaagcctgctttatagaacagagacaaactagagagaaatgaggcccatgttagagctactccagattttcttggagacacactgggcggttgtctggacccagattgtcctagaaaaggaatagcaggccctactggtatattgataaaggtataggtaagtgaagagactgtacgatcttgattagttttttgtcattgtcattgatgactgattttattgatgcatgatgttactgatttagacaactgtacgttcgtacatctcagaaatttctttctgacgtgtcctcattcagtcctctaaaaagtagatatggtgttggtaacgtgattttataggaaggatactggggttgcagaagttaagtggccttttcaagtgtgtaagagtcctggagccagggctactgactttccacaccttgttctctcccgtcctccaggctgcagatgtgcgtgtgtctgccctggtcccaggtcagagcttccctttgtttttctgggcaaaccctgccggaggccttcccagcacactcagctggcccagcagtgtgcaacaatcagcacatctcttcctcagagcttctttgcatgcctaagccctcatttccttagttcctcatgctgaatctgtttaaatacctctgactttccaaaagacagaggatattgagttccttgtttattaactcctggaactcatcaaccggccaagggcctgtggagcactgagcttctagccccagcctggagcctttcaggactgccattgaacacggaaactgaaaaccacagccccactgcaagcggaatggccatctccagccattgccttggctgatggataaaaagtctgtcggcttgcatgctaagtatggaaaagagaggggagaaactacctttctgtgtcccttagagtgaaatgcctggctggtgctgaagcccatgttaacgagaggctggcttctctccaggagagtcctaggtggcaggagccatgcacatggtaacaacagcattttggcagcctggtagggtttgccaagcacgttcctatccattatcccgtttgtgccctctggtgccatcaccatgagatgagaaggctggtagtattattatcccccttctatagataatgaaaacaaggcacagagagatttcagggttccttagaaggcacccaggtcatgaagcagaacaagactcaagtccgggcctttggtgtgttctgtccttcctctaggctgcttctggaatcattatctcagcatacttgattcaagcatctgacaacatcttaaggattctttaatactctcaatttaccgaaggtgggcactggtctcctatttcagcattatagcatactgattaaaaacttgggctctggactcagactgtgacctggacaaggtgcttacatttttctgcctcagttttctcatgtataaatgaggataattgtagtgccccttcagggataatgtaaaactcataaatcagcacagtttctgacacaccaataagtgctcaataaaagttataataaggatagtaaattgttattctaatttattatagtacaaattctaatagtaattaacattattattgaaagctaattacaattttttttttttttttttgagatggagtctcgctctgtcgctcaggctggagtgcggtggcgtgatctcggctcactgcaagctccacctcccgggttcacgccattctcctgcctcagcctcctgagtagctgggactacaggtgcccgccaccacgcccagctaatttttttttgtattttttagtagagacggggtttcaccatgttagccaggatggtctcgacctcctgacctcatgatctgcccgccttggcctcctaattacagtatcccgctaattacagtatttttgagggtttaccagatgttaacaccgtaccaagggtcgtgaaggatactatacatagatagccaagctgctttaaaacttattcgggggccgggcatggtggttcatgcctgtaatccctgcactttgggaggccaaggtgggcagaccacctgaggtcagaagttcgagaccagcttggccaacatggtgaaaccccgtctctactaaaaataaaaaattagtcaggtgtggtggcatgtgcctgtagtcccagctacccgggaggctgaagcaggagaattgcttgaacccgggaggcggaggttgcagtgagcgaagatcacaccactgcactccagcctgggtgacagagtgagactctgtctcaaaaaacaaagcaaaaaaacaactatttagggagacacacctaggaaatatgaaggaaatataaaactgcatgtaatcgaaaaacaacaatgcatgctacacacaagaaattttctgagtgtaatgaagagatggaaaatcattaatgctcaagctgaacatctcctccaaatcccttatagaacaggagagatctgaggccagagaaggtgtggacccagccatggtcacacagggagtgaagacaaatatatacaattattcctatgtaggcagatgttatagatacatgataccttagtcaggaattgacctaaattctgtgattcatgctctcctccattcattcatttctttcttatggagaatcttctctgcatagaataccaggctgagccctaaaaccatggtgaacacagcacactacctaccctcaagcaggttctagtcaaacagagagacagacagctaagtaagtaaggaactactgtgctttagagtgagggcaatgcacgtatattaccacgtctttcaattttcccctgcatttagctcctgtgtggatgtcctttatgattttagaggtcatagtaaaagatggaggcctctagcaagctgcagcatggcagggctggaaatagatgttgaagcaaagggaaggaggaaggcaccaaggaaaccagcgtgtttgttggggtgggtgtgtgagctttcaagttgggttttggagacaggagcccaggtgagcccttgcaggaataactgaggcctgggtgtttgatgtgggtttcaggaagacaccctggggtagaacctgtgcaccatggcttcctggtacctggaaaaccgggtgcagttggatgtttcattgtgagacaggaagctcagcgaaggagcggagagccagggacttgtgtcaaaatcatttggccggggagggcggagtaggtgggcatggagctgaaataagactgaccatgaattcatgattgttaaagcagggtgatggggcctcagggttcattagactttcctctctacttgtatatatcttagaaattctccgtaactcaaaaaatgcctcaagatatctttgccttatttctccgggcgaagagtttcctgaggagggcatctttgtccctcgcgatatgcactgcctgtgtcaggctgatgcgctcccgggtgcagtacttgggaaggcgggcatttggcagccttgtgtgtgtgtctgtgcaggagggcgtgagctggtgctcagtgtggaggtgggctgtgtgtgttgccttgtagagtgcagcgtatgggggctaggtctggaacatgtgtacccaaaggaaaaggcctgtaatactgtgaggtaatctcctgttatttttagggagtaaataacatctctcatgcagcaggttgtgtgaccccacaggccccatctacgtcagctcacacacacttcaaattggagggtatcgcggcctcacaggagagcctgtgaagaacattgtcattatatgttcttcctttatgatgaaatgtgcctaagccattcttagcaaaagcagggatgattgctggatgtgtgtgtgtgtgcatgcattcgtgtgtgtgtgtgtgtgtgtgtgtgtgtgtgtgcacgcgcgctgtttctgtggtccaaaggcaagatttatgattatgggatagacagtagcttgctctctctattttattttttaaaaactgttttcctttgaaattcctgagttaatgttctgtctgctttctatctgaccctcttcggagagttgcattttttttttttttttcacgagagagagattaagagagagagagacagagagagagagagagagaacgagggtgacagagagaaacagagatcgggggaggagggagagcgagagaactggaaacaaagactcgttgtctctaagctggagcaggcaggaaaccccaatccctcgggaacttagccagcccgccctgtcctggagtcagactccagctctctgaattcaatttgacagcttgtctgggacactttctaagtaaccattatccttcctttctctaagtaaaaggactgttatttcttttcgtgggtgtgctgtgcgaactgctattgcacacgtgtggctcacacagtgactaggacacactttcctcaaattattggaaacagcccgtttcctaagacaagtgtaaatttgttccaggataataaggcaaaagactgagtatcagtccactgccttattagaggtgggcctattccattagaggaggaattttgtgtatgtaggttttacttctttgaggattcttttgaaatagacacaaacaacaatatctcccaatgatcattctccccagtttctgtgttaattggtggattaatttaatgaaacgcatcaccatacatcccactgtggagggaactcagatgtcctcaaagctaccagaggttgtgcaggccacgggcacaactaggggtgaccacctagagttcaaaggaggctgtcttctgcctgggaacagggccatcctggggtttcttttaattactcagacccagttgagtcaccaccataacctgagggactgtgaggtgatcacctgcccttcaatgtgttcctattggaagaccatcccgattcagctctgtgggaccgctagagacaagttccagaactgtctggatccccctggagcgtagaggtgtgatagttttgctcagtaatacagctttgcccatttaggttctgacccaaagacctgtccttcaaacatgacttggttcctgtctactctatcttcaaccacactttggaataatgtttccccattcttcctttgccgggtatacctttcatccgtctcagtccccacccccagtccatattctaggaaaccacactcaccctttagggccgtggtcagatcagacagcatcacctcattacggtcttgtgcacccttccccaggatgctttgcttatacccactgttttaccaatacagcattcaatagattctagcccagcagtcttctgtcttgtgagacgggaagcgtcttgaaggtagggactattggatggatggatgaaaataataggcaaagtaccttaaactgttccccagcagtctggtgtagaactaaccctttgagatgtttctacaaggtggatgttttggctctatccactgcagctgctggtgtggcattgcctttcctccctaccctgccctaaatttccattgcatgggaccccagggtggttccttggaagctgtgatcagtcccatccctgagcagggaagcaaaactgataaagagcagatttcaatcacaagatgatggcaccagagccccttcttggcccaaccaccgcaggatcctgctgccaactggactccacaggcccttcaggtctctgcccatcaggaggaggctgaggacacgccaagccgaggaaaggtgacgctgcagggagaatgtaccttctgctcaattccaccttcctttcttcacttatgccccagacagccacaataagagctaacatttgttaagcacctactatgtgccaagaaatttcctattcatttcacatttatccttcataaaaccttgttaagttggcactatgattattcccattttacctgaatcacaggtatgatgttaagcctgaatcacaaagctagtatgaaacagaaacagaagagagcctgttcctgtagtcccctccccacctaggcaatggcaagggctccaaaatgaccctttcctacttcatctaccacccccatcatgcatttcccccaagtagctgatgttgtctagttgctaagatatattcatctattgactcctgctaccatctaaaaaatcaggagcctgacccagtgcaatcaatcttatttgcatttcaagaagcaatctagcaatttagaattttagaaattccactataaagaggttgtttgccaggtgggatggggcggtggtaatggagctgcaaagtatataaaagaaacatgctttgtccacgcttatcagtcaaattctttctttctatccatccctggagagagagagggagaggaagcttcttccatgccacatggagacaaacgggcttcagacatcttctagtgaaagaccaacgtataggaagcatcatttgtggtggtttcacagattttttttattgttacgctttataatttatataattatacacatatccttttgtgtttaatactacatttaagaggataaaggaaaacaagagatttagaaaacaaagtattatattgagtaacactctattgatgagaatttcaataaactgaatttaagaaaccatccaggcacagtggctcacacctgtaatcccagcactttggaaacccaaggtgagaggatcacttgagcccaggagttcaagatcagccctggcaacacaactagaccccatatgtacaaaaaataaacaaaagtagccaggtgtagtggtgtgttcctatagtcccagctactccagaggctcaggtgggagtattgctcgagcccgggagatcgaggctgccatgagccgggattgcaccactgcactccagcctgggcaacagaacaagaccttgttctcaaaaacaaagcaaaataagagtgggggtggataaattcaataaatttaataaatttattatttgagggaaataaagtttccctcaaataatttcatgggtctatcagtttcatgggtaatcctctgcctctgtaagcttcataaacccatggttcccaaggagaagaaggaagagatgtcaaaatcaacttaaagcatcttaaagacacgtccaggatgctccagctgccccaccctgccccgtgtccctccataaattcacctgtgcccttggtagatgaaggaatgaggagaaggttggagatgaacacttgtgttcttagaataatctccttccattgctctggaatgccccacccctgccctgccccagtattgagagccagggcttcatcccaatgcttaactggagaagaaaggcaccttcctgccactacagagttcgcctcttctcacccctgtgccagaaggctccaggccaggcactgctcctgaccactcagaagttcccactttgccctttctgccttccctgggctgtctttggtctttctgcttatcagagctgcccttaaatgcaccctgaataaatcaagaccctcataggtgcccatgtgctctgctacattaatgatggtgacaatgaatgcatgagccctgctacattttagtaaaggacggtgacattaggtaaacctccaagtggggcagggaactggtgccaggctgtgggactgttgctgggggtctccagagcaccctccccattcgttcccattggactcagcccaacaatgactcctcccgcactgccaagaaggggctttcatgaccctgagtgcttggcagggtagagctccactacagttctcagtggcagttcacatccactggttgggccgtttgggttttgcatgtcttctaatttatctgcagactctgggatgttactattttaggcctgccatctctaccaagtttccccttgacactacacgctcatcccactccagacgacagagcgaggactgcagatgcagttggccttgcttgatgcagcttcattgctattgcttggttcacaatagaagttaaaagtgatccccgttggccatttagaggagaagggtcccaaaatactttgggaaaaaaaaggacaggcctataatgctctgccaggggccacctcagcacagagtgttccaaatgtgttggttctgcctaatatactgatttagaaattccaccacatggaggttatttgaggcgattggtagctggaaggtatttaaaagaaacttgtttcaccaaattctcatcaaccaaattctttctttcatctatctggagagagagagagacggagaagcttcttttgtgccagacagagatctatgagcttagggcatcttctagtgaaaggccaatgtataggaaacatcatttgttattttaatataaaaacctttctaatccctttttatagattgaataactctctctcttcagaagcccttatctaagataataaagagcatatttctcatgaaatatccttgttggagaaaagaaagtccttgaggaggaaatatggaggctagaaacactacccaggttgtgagtgggctttttctttcttgtctcagggatctgtaagatcgagaagtttaacatgggtcaggtgtggtggctcacgcctgtaatctcaacattttgggaggtcgaggtggaaagatcacttaaactcaggagttcaagatcagcctaggcaacatggggagagtcaatctctacatcaaataaaaaaattagccaggcatggtggcacgggcctgtggtcccaactatttgggaggcttaggcacaagaattgcttgagcctgggaggtcaaagctgcagtgagccaacattgcgccacttcactccagcctgagcgacagagtgaggccctgtttcaaaataaaaatattaaacagaggcttaacatgcctctttgataaagtttaaattcttgtatttggcatattctaaagaaaagatggtaaaattaagtgggacaattactttatctgtcaaaatccaacacactcttcaaaacccgattcaagtcctatctgcctcaagatatgtttttcttcctccttaagactatagtctcctctcggagcctcacctcattcacaggctatttatggacctaattacagattaccttgtggtctttaattgtgagttttctcctggctcttttcttccagccctgtatatattcagtaaataccattgaatatttactcaatcctgctccaataaaggaagaaccagaagaaattagctttggttgacacaagaaaaattaacttcttatgtcccatgaactaaactctgaaaaagagtatcagctagagttctgtaggatgcgttagaatatagaaagcaattttttttttttttttttttgagacagagtcttgccctctcgcccaggctggagttcagtgacgctcactgcaagctccgcctcccgggttcacaccattctcctgcctcagcctcccgagtagctgggactacaggcacccaccaccacgcccaactaattttttgtatttttagtagagacatggtttcaccatgttagtcaggatggtcttgatctcctcacctcgtgatctgcctgcctctgcctcccaaagtgctgggattacaggcgtgagccactgcgcccagccctagaaagcattttcatatgcatggtgtcatttattctcaaaagatccctgtgaggatccagtgtgctatttgcttttccaaactcttaaatttaggaataatcacaccactctctcccgcccctgccaagtatctaccttttacagagaggttcaataagaggttcagagaggttaagtcatttgcctcagaccacacagctcataactgacagagatgagaggcaaagcaaggagttctgaccccccagcccagagttctttcctttgcaatgagccatttccctgtttggaatggattcacgagaaattatggaatttcttcccatgaagatctttaagagcccttagtaacaccaccaacagtcctatgcttgataaattttaggtatcactcttccaaagagatgaaaatcattcttggtatcattttgaaaaatctttgagcttaagaagtcttcggccttttgggcctgtctgcaaaataattatcagccctgcccaatacactagaggaggttagagagaggcagttttttgctatgagtcataatttcaatttctattaaaattcttacatggccacatatgctacctctcaggctttgggcctctgggcctgtgctaatttgcatgtctggtttagataatgtctgaggtccttccagtctaaaaaggagcctctgatgctgtgatataataagtgagatcacattccacctaccaagacttgatggttctttttcttttaactactgtgctctgtctgatgtgtggatgcacagctcagggacggaagtgtttcctgctcacctgccaggccacaaaagaaggagtgctcttggccgggcgtggtggctcacgcctgtaatcccagcactttgggaggctgaggtgagtggatcacctgaggtcaggagttcaagacaagcctggccaacatggtgaaaccccgtctctactaaaaatataaaaatcagccaggcatggtggcaggcgcctataataccagctactcaggaggctgaggcagaagaattgcttgaatccgggagacggaagttgcagtgagccgagattgcgccattgcactccagcctgggggacaagagcaagacttcgtctcaaaacaaaacaaacaaacaaacaaaaagaagtagtgctccttcagcatgaactcacctgtccacttctgctacactgaacccagagacttgtcctttcctgcaaagcatttcagacataggtcaaaaggcaaatcatgggaattgttgggattttacgtttcttgatttgaatggccgttctaattcaacgtgaatccaagaccacagacttgacaatcacctgattcaaaatatgtgaaaagtacttgagtctttaaaatatggggttcatctcaccttttactattcctctcccaaacatcaaagagatgctgtcaagtttcttagctaactttgctatcctacaacataaagcaactctcatgcataaaaaactaattaaaaggaattggctttccagagggactttgagaccaatgtcagccaatctgtcacttttcaaaataaaattatggaactatgtagagctctattttcataatgttagatcaagtctttgctcaaattctatattttcagagaagacctcccatccctgcactgcctacttccctcctctggttttctcttcttcatagcattcatcgccttctaatatacaatgtaatttactacttgtcttgaatgtcagctccacagaggaaggacgtttgtctagcgattgttgtgttctcagcatgtaaagtgtctggcaaggtagtagacattcagtaaaacattgttgaatgaataaatgtgtggtgggacataaggcatcaattaaatccaataagttggtgatggcgaggggcaagaatgaatttttgagagaaacaaaggtgcttaagatacaacccctcttcctaaagatgatcacctagcgagggacacaagcgtacaaagaattacactcaaaggctaagcaggacacgggcagtagacacaagacaattcaccagtgagccttgacctgcagaactttgaaagcaaaggacacagaagctgaatgttacgcagacccaagagtgtatcccctatggccaaggagaagaagggcaacctcgctgtgaacattgcaacctatgagggtcggagcagggcagagggcgttgcgtataaactgcctctcatttatcctcaagcctgattacctaagtgaactgttatgttttcttctttctacctggaatcctcttaaaccagaggcagatttgacctaagaagtatgcaatttagttgcgtctacatgacccaatatggaaggaagttttggcaaacacccagttaatctagtcagtatgaattgctattccacatgaggctggctcaaaaatcccactttgaggccttatcaaaataaataggtcatttagacatctgtgtcacttagacacagagcctgtgggagaaatgaaatagaagaaggtcccaggttcagcagggagcctcacgtggccatggcaaggctgtgcccagagaatgtgccacttcactctccacgcttttcatatttaaaagtcagctatttcttccaagccttttcctcgtaggtctttttttccctttgcccatctaatatcttcaacagtacctccattatgctccacacagcagggtcagctccgaggcagaggggctgttggattccaggacaagatccttgagcaaaggaaacctgatccaggatgttttttccctgtgagttccaagtttggggaaagcgttccctggatattttcctccttccaaggtctcagtggatgccaagctcctctgttgctctttgggatgtaagacgccgctgaagtgaaggtttaatagcccctctagaatggtgggatgtagtgaggacttggtcctgagcttcaaggccaggtggccagtgactctggcacctgacagtgggggaggaaggaggatgctgggtaatgcctgggcctaacagccaggcagaccacctgtagccatcagccctctctgtcttctgggatggggtttctcaaaccagggtccaggataataatccacctcttcttttaaaagaaagccacgatttattttattatattattattattattattattttttttttttttttgctttggagacaggatctcactttgtcacccaggctggagtacaatagtgtaatcatagctcactgcagccttaaactcctggcctcaagtgttcctcccaccttggcctcccaaagtgctgggattacagccctgagccaccacacccagcctgagagccaagctttatttaaatttgggaatcactgttccaggagcacaggaataaaactgtccttcatcctttatagccctcaggcttctcttccttttcaaggccttcctcaatgggcttggtaatctcatctcaccaagataagcatggtagaggggcaagcaggatggaatagactccatgtatatggtgtgtatttttaaaatcaccatttatcacatgcttatttaatcctcatagcaaccgtagaaagcacctgttattaatgcttttcagagaagcagaactggaggttcaaagcagctgagcaacatgaccaaggtcactccacaaggccaatggcggagctgggatttgaatcccgggttaactgattcgaagtcctatctcctaactgccaaaataatccccaggcccaccagagagaaaggataccttcgtgatgacatcctaagccctgcatctactttgcctcagggtggggctgagagcgcggactcgagcaaagactgcagcagatgagaagctggtcctgagctgtgggttgggaaggttcgggcagtgcagcagttctcacaggtggagagcaggatgaaggaacgcttagaggagagcagcttctgcaggttggtggctgggagaggctgctcctccccaaagactggacctattagaagcacaggacctctgatggagatggggttttagaggatttcctagtccagccctctaccagtacacgtcataacctgtcggacagcccaacaacaaagaccgccgctcacctgcagtttcttccctgtcggagtctgggagtgaatcttcctcctcgtgggcttggctctcttgggaagttgagggctttgggtctcaggtctgccattgatttgagcatttctcctgtgcatcctcactctttcaagaaaggaggtctggatctggctaccaaatccccctgctctgctgggagcatgagcagccttgcccattgctcggctgaaaggtctgcattcagaagccaggctttccaaggataaacagggttaggtgctgccagccttcttagcagcaaccagaaattcaatgagaagtttcagggaaaattcatctttttccacccagtcattgagagcaaggttttatgacacagaggatgaagagagaggcttttgtgggctgatgtcgctgtgttgctggcctccggtcaggtcacaaggtggagcgctgcatgccggcagggacgtttgggctttcagacagcagaggcatcagagcagaagcaaatatcttcccaaagatgtttggccatatttctaggaccaggttaaaagcttcacacagaagctaagttaacattggtatgtctatgagagggtcatgtccagaaacagctttcgccttccaacagagactttgcggaaaaaaatctccatgctcatatttctctacctcaggaggctctcctggaatctaagaggccatttagtgtcaaattcagccccactaagcatcacataatggtgatactgttaaggacatcatatatgtgaggctgaattatccacaatggctggcaatgtcttcattctccagactgaggctccggcctctttgctttggcaagagttgatctcaggactgcctgaaaccagaaactccaggcaaagctctttgggtcactcttctgaaaaggaatcacaataataagatctgttatcttggtactctgtaaagccaaggtgtcagccttcacgacagtgaaaagttagtttgtcagaaccagggtgtgattgtctgctgattaagccatctgccaccacagaaacagaccaagatcatcaactggtacactggtgccgacggccacatttttacacactgggcctttggctgccacctcaagtttgtcagttctcaggaggcagactccaggcaccacattcgagagggcctccatgcacgctcaggcttcttctcatagcaggcacaccctgcctgagccccactccatgcgctgacggagagtcggggcaggagctctcatgcagccaggtgttgggctctgcaagggggtttgtgtggggatgtgagccactgggtcagctccctggttcaggcttctgcattcaggttatagacatatctctgtgtgtatgttggggactagagatgaccacactgctaaattcttcttgagtgacttttagtaggaaaaaaatatgaaccctcacttcaacaatgacattgttaaaaacacataaaatgcacaccacttcaccgagcagcattcaggccttgacttccctgtgggaacaagcttttagcctatgcctcatacataaataggtggattgtggtccactcagaggggacacaggagtgatgtagtctgtacccctcaacaccccagatggaaatcttttgcctggaggcttaatttcgtgaagaagtcagggtaggagcactgggttctcttcagctagtgatatcatgaacaataagaagaattgtgtgtatgtagcaagtaggagaaaatattggccaagtttattcattcaacaaatacttagagtctactaactctgtgtggggccctgttctaagtgcttggatgtatcagagaacacaacagagatccctactcttatggacctgatgttcaggagggagggggatatgaaccataaacgacaaatacaaattaattactgattaaattatgtgataagtgaaaatggaagagcagaggaaggaggatgagggagttgcggggaggagggaattaatgtggatttggaaggctgcccaacatgtttctgggtctgaatatttttggtctgtgacacaaatcgtattcttgattgctaacatccactgaggccacctctgtgctgggcactatgctgggtgtttacttgggtatctcatttactctgcaaggctggcctggttcttcatacccctagggcagaatgcaagactttagttcttggccttctgcatcttcatgctttttctttggagcagaaattgctctgaaaatgctgggtttaacttaaatcttacattgaccagacgtctcctcgagccccagagcctacggagtgcttttgttaaaccccagagccaatgtgctcaggctgtcctttgtgcagccaggtaccagtgggaagattttccatgcaaatacttgggaataaaaaagaaatgagagggaggcctgtggtctttgctactctgactccacaggctgctgggatggacgttggatgaagacaccagcttagggcatggcctgttgctatttatgactctattacttcacagtgagagcacagttcaggctgactgctgggtggcctctgtgtttctgtcacttcctttttcacctatgtgaggactgtagcattgattgggacttccaaagtcctgttagccaagcttctgccatcagatgggcctgtgggcacattgccccataaaactctgcctccttcctaaggccctggggcaccacagaaagatgggcctgccaagccactgctctgataaggcatgcctttaaccaggctccatcactcagagctacaggaaaatcccatggtcatccgccctctgttggtgacagggaattccatcatgcattcagatttttgcatgcctgctctgtccctggaactagaataagagaatagggagaaaagccgataagaagtcaacgataactatagccatggccataatttgggctccaaaagaaataattctgagtggttaccagatagctttcagagagggttgaagccttcagtagactaatgattgagcagaaaaaaatgtttagaaaacttgagacagattttatccatgcagtaagtcagaagtcaagtcagaagttcagatgacatgtacgattcctggaatttagtgattttttgtttgaatgtgttacttctcttctactttctgttctgctcccactagaattatctccttcccccaggccctcagatccaccccacataccacaagctcattcttcaccacaccctgttttctagcatggctgcaagcgcaaaacctcccttagttcccacctgcaacgccaaggtcccagagtttgctgagctaccatcagcaagaccttgaacatgcctcggccctctctcctctccctccacattgctctacttcagtggtacagctcctcccatggctgtctctagacctcaccttgacatctcaccacccacctctgccttgttcctacctgatgcactctcccctctccaaagagtcacctggccctagttccactcacctctctgtcaacctccaggaaccctttatgtgtcctccatgccttaggcacatgacccgtgtttcctcacaatcacagttaccctctcatactcacatgcaaggacgaggaacttgtttcctattacttcacacccactccctggccatgcacacaatacagtgcagaagttggtcccaaatctattaccagaggcctaagcagcagcctcctcctgctcaaagaaaaatgttctgccgctgccaacattgcacttcctctgcaagacatctcagaaaatgcccatcagagccttccacctcattccaagcttgcaagcaagctggtctttcatttgtcttgtttgtttttaagcaagaagaatccctttagaggaggaattaggaaagaaaaaaaagtcaaacagaaacagaaggagtggaggtttgtctctctcttttgtcccctgccttgcccttcctccctatcccatccccctcactttctgtgttgcttttcatgccagttgctaaagactgtaattttaaaactgaacgggcttttccagagccttgaggaatgtgcatctgcacgtggatttttccacaaaaaaagtgtccctgtcttttggatcttcttagccagaaacaatgaggccaggcaatcagagtccatccgtcttcccaactcttattctaatttgtttgagaggctcagaaggggctgaagggcatggttgtgtttcaccccgtcagactctgttgtttgatgaggtttgtgctccatttgttcggatggtttttatggtttctttgttgttcatggaataactttgaaggtcataattctgtatcctcaagctcctctgctattcctgctcaatgtctcaatgggactcataccaagagaaagggaaggaagaagtttccagctagttagttaagcaatttctcaacacatttatggaagcatgtggaatctttcaagaaaggggttacgatcacaaaagttcgatttgaggagtattctccaagacaactgagaagcaagcccttagtcatgcccaggtggggagcaggtctccaacctctcatttcctgatccagcccctttcccagccacatttctggcctcttccctttctctgtggtcatcagcccagccctctccactatcaatagaaaagcccgagagccctcagagagcctggaatgtgctcccaccgctgtgatgtcatcccacatcatccatgtgctgaaatcagggactggagtcggcccccaggaatgtcatggccatgggctttgagacactcttcttatgggcctttcacccaatccagaccttgcctgctcttcagagctgcttgaaggattttgctacagaactatggacatttaagaaatgtctaaccttgtgtcagtttatatttgtagaacgcttcataaggtgcttttccatatgttatctcatctgatcatttccacaaccccataaggtagataaaacataaatttttatttccgtattaaaattgaagcccagaggagacttttgattcatcccaggtttcacaacaaagagtgtcaggaagagaacttgaaccaatcctctgacttcacattcagggttcttcccattactttggctcccagataagactacaatcttctgaaagtcagagtgttaatattccaaccccagggggtgagtacacttccagaatttagggatgctttaaaagccattgctgaattgaattttatttctcctgatcactacagataatgctcatgcaacttttctgagaagcaggcgatgctaatgtacccctatttgttattgttcattagacccttcttatgactcagtcagaagaggagcttggggcaataacatgaattctggcctcaacaaaagtaagtaaatgttttatagttctttggaggaaagcatgtttctgaggacaggattggagaacaggatcatgagacacaggagagcagcaagcatttgtttccctgctttttgagtagacatcaaaattatttgccaatttagggcctttccatgataccagtccttgaaagatgatatgggattttcgtttagatttttgagttttgttttattgcgctcggttttagaacatgggaaatttgaaggttttcttgagacaaggttctgtaccaatgaatggtcactgtcactgggttttgcttttgttatttaaatcaagataatgactcgctataattttgctcccgtaactgttgaggctaagtcgtaccaatttccccattccccttgatactgggtagatttcctcatatcatcatctcaccacttggtggagaaattgatgtctcagaaccctgccatctcctcaacaggttatcttctgtccctgatgaggagatgccggggggtctgggacatcaggttctccaccaagtggtgagatgatgacatgtcgaagtctacccaatatcccccagtaagagaataaggggcaagaatgactcatgaactcctgtaccagaaatcaaacttgccatgcctaggaagcaaaatatgaagcacatgaacaggtggtaaagggaattctttcaagaaagaggttggggttacaaattaatgcccaaacaataaccaagaccccttccaattatgtgtattaattatttacttactctgcacatgacatttggcaatataagattcacaaagatgaatcagacatgcactggtctcataagcgggagagagaaatcaagcacacacagaactcctttcttctggttggtatcaaggaaggctttgtggacctggtagcacttgagttagctctggaaggagaggcaggatttggacctgtggcgatatgggctggggaagacatgagcttggcatgtctgacagtcagtgaggacctcaggttcctggagcttaggatgtgtgatgcagaagaagtctggaaaggtaagaaacagaattgtaaatgatgctatgaagatatgccttagttctttaggcaatgaagagtcactaaggttttgaacactggcgtgtatggtgggttgtggggagacagaagagtaatgaggacaccagtcagactaagccagaaaccatgcaagaagcaatacagatctgtgatgcagaagtgatcatgggaatggaaggggtgtgtgagagataccaaggaggaaactcacaagacagggacaccaggaagcagctgatctttgctcagatgtcactttctcagtaaggacttctctaactttccgatttgaaaatgaaatccacagcctcagtaccatcagtgatgctatactgttagtttactttttaaaaatttgaaaatgaaaaggtgacatttaagcaaagacaaaattttaagaatttaaaaatgtgtttattattgtctctcccattggaatgcgagttctaccaggaactgcttgttcattcctgaatctccagcctggagaacagggccagcacatagtagattctaggtaaatgtttctaaaataagatgaataaatgagtcagtggagagtgggcgaaggaatgagtgagaaagcacatctgtcaagacgtcttgctcccctcggggagctgggtcctactcactgcatttctttccctcttgccacaggtcctccccttggaggggcacaaacgatcagtaagaatacagagcaacggccccagccaggtacctgcccaggatatgtaatctctcctttgcttcctgcacagttgttgatttcacatggtcaactgatggagggtttaaacaatataccacatatgttttctcttatttctctcaaagagggtctatctttgaccctaatagtcctgtgaatgaagtaacaggtactgacatcaagtagagacttgttaaatatcaaaggtgaaagaacttgaagatgaactattccaatgctttattttgttcaataaagaaactgaggcccggggaggtgaagtgacttgctaaaaaccatacagctggttaatgaaagaaatagggctacaatcccagatcccccaaattcctgtccaagccttttatgcttcaccaaaccttactttcagaaatatccccatcctgtgatgagttggcttaacaattaaggcagaggaactttgaaagccatggacctggagactccgtattggagaggaacttggagatttctgggtctatcctaccctcacctctaccttacttgtgcttgtagtaaaacagggcgttgactttctagctgggctcagttccactatctgacccaaagtctgcctcctggaatttccactcaagcttttccttctggagaagccttcctcctgcttcctccgaaatcctttgcatatctgaagacagctgctgtgcccaagccccagctcctctctctatcttcttatgtgatgcagctgagatgaagttctgaacaagtcatttgctttggggtaggcaaacattgttccccatctccacagaaggcagagcaagagaaaatcaactgacatttcacctggaaggttaagaaaaaatttgctgactgtggatcataagtcagatgtagagagttttaaagactgtccaataacaacaaaattatgcattagtcatcacctgccaaaaataattatcatattaatgatgtggatgagaaaagatggtctcaatgggcttaaggacttttgaaggtaatttatggttctaagtagaaacccaaaaatcatagtgatatttttaaaactgcaattatagttgaaaaatagcaaaattttacaaaatacatgacaattttgccaagtcgagacccagctctctaccatgatttcctcaactaacaaaaaaggagataaacctctcacctaaaccagtattgcaaagactttttcatggctaaataaacacatacgttttgaggaaagtgagattttaagaatagtcattttatagctaaaatgtacactctggtttgtgctgacatttctggcttgtgtgacatttcaaatcacagagtgttatactagaagaaaactgaggaatccagtagcccaacccactcatttgtcagatgagaaaactgattcccagaaattgtccaacaagttatttgtttatcacatagctgctgctaaaacccaggctgcttggtttctaggcatgtgtttttcatgctacattcaaaaaaaaaacagattaataatgttgttagtattaggtagagttattaaagaccagtaaccatgagacctgctttaagcccatggagtcagctgtccgttgtatcattgaatattatccagttcctttccaaatgttttctttgttttgctttgggtaatgacaacataatctgcacattttagatgccaaaataagaaaaagtaatcctgttcctattctttgttctttctgtaattattgagatgaagaccacaaatgtcatcaagatctttgagatctgcaaataaaagcagtaaagttttctgaaatcagtctttcctgtgatcttgaaataaaagtataaacccttatggttttcttatggttggtacggttgtcatattttttaaaaacactgaagcaaatttccttttttatttccttagatccgtatcagatcctgggcccgaccagcagtcgcctagccaaccctggtgagtttaccttggcctgcaagccttttttgccagaatgtttcgtagctttgtgaaatcacagagacttctgtcctaagtccagacacctgagtggggagtaacatgcacctctttccttgaaatgttcaatgtctgtttctggagcatgtgaacaacaggtcagggcttgttatgaggtgtcaaggttggttagctgaggatacttctaggaataaacacatcagcactgcacatgtgcacttaggtgtagatgagtaataagtggcacaggtaggtaggcgtttcaatcagagaaaatgggcaagaaagagaagaagacaactccactcagctctcagttgtctcccacatgccaggcacaagttcataaatattccaaagggttttatttgtgattttagaaagtgttgccaagttatctggccttataaaagagatgtgtcctggaaaagttgcagatatagtcaatttgaccttgtactttaaagatttagtatcaaaaataactctcaagagggtccttctaaaccaagtccatcgagattgggagctagcaggcccttgtcgcagtgtggcccactcaccttcccatcccagggactctgcctacccattccttagtgcctggtcattactgccagaggagaaagcagccacccagcatattctgggtatttttctctctgcacaagttctctgtagaacttagagctgcaagccaagctctgggcctgccaagggccaatccaggtcctgtccatccaaaagctaaagctcatggcgcagcttctcccaatgactcccacagtcatgccttgcccctgactttttattgctgacagggaattccctgggggacatgaccactaattagagatcagtcagtgattcaggcctttctagatgaagagattcaaaagccttgccaaagggattgaggggggatatggctcacccaagatcacacagctagttctgggcagagtttgcacctcacttcccacattccatttaccaggccttggggcaaagcatcttaggatctaacctcgcttattatacccatctccaaggcaagcagaaaggcaaatcaacaatgacataagaagggcttgtcaagtcgatcccaatgtcgaaggaaacaaaaggtttctttaaaaggatgagaagctccctgcatttagggaactgggttctgccttctctgggctgaggtgttctgttctctcccgtttgcctcacggcgtgcaggaagcgggcagatccagctgtggcaattcctcctggagctgctctccgacagcgccaacgccagctgtatcacctgggaggggaccaacggggagttcaaaatgacggaccccgatgaggtggccaggcgctggggcgagcggaaaagcaagcccaacatgaattacgacaagctgagccgggccctccgttattactatgataaaaacattatgaccaaagtgcacggcaaaagatatgcttacaaatttgacttccacggcattgcccaggctctgcagccacatccgaccgagtcgtccatgtacaagtacccttctgacatctcctacatgccttcctaccatgcccaccagcagaaggtgaactttgtccctccccatccatcctccatgcctgtcacttcctccagcttctttggagccgcatcacaatactggacctcccccacggggggaatctaccccaaccccaacgtcccccgccatcctaacacccacgtgccttcacacttaggcagctactactagaagcttactcatcagtggccttctagctgaagcccatcctgcacacttactggatgctttggactcaacaggacatatgtggccttgaagggaagacaaaactggatgttctttcttgttggatagaacctttgtatttgttctttaaaaacattttttttaatgttggtaacttttgcttcctctacctgaacaaagagatgaataattccatgggccagtatgccagtttgaattctcagtctcctagcatcttgtgagttgcatattaagattactggaatggttaagtcatggttctgagaaagaagctgtacgttttctttatgtttttatgaccaaagcagtttcttgtcaatacacggggttcagtatgacacagaatcatggacttaacccgtcatgttctggtttgagatttagtgacaaatagaggtgggaagcttataatctaattttaggaggaccaaattcagtggatggcaactggaacattgattgtaaggccagtgaagttttcacccaactggaatttgatggaaagaaggtttgtgtgtttaagacgccaagggcattgcagaatccctctcagtggacagtatgcactcagctgaccactctctctagaaatagtcaagatatgaactaagaaattttaatgcaaatacatacattcctgaaagacggggaattaaattactaatttttttttttttttaaatgatgacagtggtcccagaacttggaaaagttgtagggatttctaaactcaagcagattcgcaagtgctgtgcgcttgtcagaccatcagaccagggccaaccaatcagaaggcaacttactgtataaattatgcagagttattttcctatatctcacagtattaaaaataaataattaaaaattaagaataaataaacgagttgacctcggtcacaaaagcagttttactatcgaatcaatcgctgttattttttttaatgtaatttgtacatcttttttcaatctgtacatttgggctgtctgtatgtttttatagctggtttttaaaaagcataatatgcctatagctgaaaaggaaacagggctgtttaagtcactgacttatgagaaagcaaagcactggtacagttatttaacaggcatacacaagcagggaaaagataatccatttagatctttaatgctttggaaatgcgtgtaacagtactgcaataatcacagctctgggaaaaacaacgaaactttcccttgtggagaggagggattttcctgctctatataagcaacatatttttagacattaaaatatatataattttgcaggtaattgttgacttttttaactatattaagtgttaagctgacaactgtcaaagaagaccatgttgtaaaataatttgactaaataaatggttccttctctcagtgctgaggacagttttcttatttaccgcccccgttaggtcaaagggttttccctggggaactttcctatttacttcttgcactatcaagaatttttcgaatgtacctactgcagtacagcagaaggtaaaaaatcagtgtggtttttcattgttgttgatgatgtttgtagtgtttttgtgtgtgttatttaaatcttcctccagcctaaaagggttttataaaacagcagctaaggccatggataaacctgtatgtaaggactggagcaaagcgagctggtctatccagacttgtctgtgagatttaactctgcagcctcccctgggcacttcagacccagacggccaccttctgccactccagcaaagaataagcgccctgcttccttcaggtctcagaccaggactttatggctcatgcagatttttaaggtcatttttcttcccaaggaagaaacttgcctccagttccttcactgttaggtagcttattttcattttctctattttacaatgaaaagagtgagacctgggaagtccttgatttgcaaggaattagactcacagcattggtaaccctagaaccttcttagggtaacactaagtaccttctagacaacatgtctacctaaatgaaatgggatgtgtttcggaacatttgtctccagtttttttttaatcttgcaccctgccatttaaaaagatgtgtaaagcacatattctcaacatatgcacattgatttataaatcatatatacaaactgttacattattcttcatattagaaaacaaatacaaaatagaacattttaaatggtgatataaaaataaattgaaactgaaattctactcttttcctcctattttctctatattgaatatcctctgctattaactctcaaaacaaagatgttggtctttagtgaaaaaagtgtatgcatgtactggatttctagtgacttccaagaaaggagaaaattaaaacttggtattagtggcccaagcatagaaagaggaatgatgaaggccaggtatgtttaagaacaaactagctgaattctttggcagatctccatcttagccacgcaatttccccatcaattttgaaatctgcaaagtattcattagggaaaatggaggcatatatttctgagtgctgtaagaagatgctcagcccattagttcattcttttaaaggttttctttatgtgtcctactcaaacactggctcaggctcatcttctctacacagtcatagagctttagccaaatctcgccccctgaatatgttccacagtgatttgtcctatgcctcagaagctggcccactggctgacaggactggggcaccattttctcctcataagcatttgtacagagggggcactggcatttattcccctgcaatgcccagattgaacgtttgctagctggctccagggcatgaagcggactagtcccagaggacaaacagaatctttgccctcctgtctgctagtccagtcttttccctgctggatcattgtgtgcctgtgccatgaggtttctgccatctaacaaacagtgccagccaagcaaagcgggcatgcaggcctgcaagtggttctcatggaagctgttcctccccacagtttgggacactgaccaacagtcctttagcaggaggtcgtcttagtccatttggtctgctataacaaactaccatagactgggtggctcataaaaacaggactttatttctcacagttctggaggctgggaagtccaagatcaaggtgccagcagattcagtgtctggtgagggcccttgccttggtttatagagggaaccttctcactgtgtgctgatatggtgtaaggagcaagggaatgctctggggtctctttcataagggaattaatcccactcttgagtgctccaccctcatgccctaatcacctccaaataccttcacattggggattaggtttcagcatatgaatttgggagaagggacagacacagtcagtctatagcagaggtcatcttttttcagtgtcgaaaaatgttgttgagtcccacacaaaggaagttctattttattttattttattttattttattttattttattttattttattttatttctggagatagggtatctctatgttgcccaggcaggtctcaaactcctggcttcaagcaatccttccacctcaacctcccaaagtgttgggattactggcgtgagccaccacactgggcctattttcaatatctgttattttaaaacatttttaatagtcaacagccactagaaaacgtaatgacacttaaaaagattgttattttacttaaccaataacatctgcatgcaagtgagcgatgaacatacacaatgggaaatggattaagaggttctcagataaggtttgctagtttagaccaaatgagatcaggaggttctagaacacaagggaggaaagcagcatctgtccaccccaagccaagttactgccaacccaaggcaatgcttagtggataaataaaaaactgaacaaaatgcagtacttcatgtgagaggtggtttctgtggacttggattcttaccgtatttcctctaatatctgttcattacaagcaccatgtaaacctgttgccttaaaaactcttgaaaaggtgtcctttgggggaatgtgcttgggggaagcaacccttaagcatggctgtctgctgcccagccccactcccacaccttgctcagaagttcctccaccatcaacagcaccactgagcttgtgtccagaaggccctcaggaggtcgaggtaagaggatgctttgtatcagtgggggcagggatgggagaggtaataagagccgggatgggggccaggggagtgactgggttctggtgagcatacagaagctttgctgttattcaggaaggaatgcaggttttgcagaaagcacattgggcatttcatcacgtagaaagctactgaaactgacactacacgccttcagccagggagtcccgctaagggattatgaaaggccggctgattccaaaactacaaatcccaggctcccccgggggatggacacttgtgagaggaagtgggttagccagtcaaacctccagggtttcagccagttgagaaaggatagggagggaagttttaaaaggaatgtgggcccacaagcctgggatctgtctctctctctcagtctgatgcggcctcctgtctaattgtttcagtctgtccgagctggtaaatccctaagcacatagtcaatttacactcagcttaaaagctctagagggagacaggaaaaatttccagtgagaccactcactcacctacaactgctagattaaccttctgcattttaactgagttaactcatatgttttcttagtgggaggaaagaggcaatttgagtagacaaatgaaaatgaatataatgccagaaaccctgggttcaaatgctggcccttccacctactgggtaacttgtcttcatcgattaactaggacctgagttatacctcctgcatgagtttctgtgaggcatcggacgacagtgtggaaaacccattgtagactgctgtacaggaggtttatggataatcatcgttgtctgctagtattggctagtatttttcaagaacattcattaagtccttggtagctggtgggcaccctgtttggggagttcagtgcagggtcatttttgttttgtggtcagaaagacattttccaaatgggtgcaaagtagaaataagttgggttttccagagagcctttgcattttccccatccacggccctcccattgccccacttgggcttttgcccttccttggctctatgtgtgcacctaaagccaggggagcgtgtggccaagctgcaggatgttgcaaataaaatgagattttataaaggaatgctaaaaatgtgctttgacagcaatgttggatgggatttttcaatcggctaagaaatagaggttgggagctgggattttatgcccggcaagctcggagcttgatttttccatctataaaatgaggatgatttaataactatacaagagtatcactggagttaagtaagatagtgtacataaaaatgctctgtatgttgaaaagaactaggaaactgcaagatttcctaggtattattgccaaggtcttactgtcttcatcgagaggcaactcctctttaccttcaaaactctgtacaggtctctgttcctctctgatctaagatagagtgaagccacactattctattctattctattctgtattgtgaatatacattgtgattttttaaaaaactgtaaaatcttgaaatagtcacaaacttccagaaaagttagaacagtacgacgaacaatttttagtgaatcatttaagagaaatttgccaaccatgcttcatcaaccccaaatgcttaagggtatatttcatttaaacaacaaccttttcctacatagtccagtataatcaagagaatcgaataactaatgcaagcggattactcctatgtaatcccgaggcaccatgcactgttggctgattgtcaccactgcagtcttttggagcaaaaggttcccattctaaaacactgattgtgtatagttgtcatctaccattagtctccctcggtctttcaggtctgtgacaattttgaatatgacaggtcaggtattctgtagaatgttccccaatttgggattgctggtatctcttcgcgattggattgagccaaggcttttctgagaggaccatcgcagaagtcatgctgccttcctctcctgtattccattgcgtggtacatcatttcaacgtatcccgttattgatgaagttcactctttgtttaaggtggtgcctcccagccttctcctttgaaaagttattcctttaccctttgtaattaataagtattttgcggaggtttactttcaaaatatgtaaatatcccattcaacatcaaatttcaaagtattcattcatttatttatatctctaagactcatggctctctattttattgagtggatatgatctgttctttaaagattacattgtcccaatggaaggatattcacgctggcttctgtctcctttgacatgttcccatcagtctttaagtgcttccttactttctcgcacaacaacttattttggagtttctgccctagccctggaattagtcatctcctcatggattcctagttctttttagtggaaaatgctatttagaacccaatacctgggggatagatgtgccaattgctaatggggtgtccctgctcccaggctccctcagtgtacagagccaagcaatagacgtagatacatacatacacatatattatgtatgtatgtatgtgactatatgcactcacgtacatacatacatatacagtcatgccttgcttaataacggggatacattctggaaaatgtgtccttaggtgattttacggttgtgaatatcatagagtgtacttcacacacctagatggaacagcctatgacacacctaggctacatggtacagcctattgctccgaggctacaaacatgcacggcatgttactctactgaatactgtaggtgactgtaatacaatgggaagtatttgtgtatctaaacatggaaaaggtacagtaaaaataggataaaagttaaaaaatggtacacctgtatagggcacttaccatgaatggagcttgcaggactgcaaattaatctaggtgagtcagtgagtgagtggtgagtgaatgtgaaggcctaggacataactgcacaccactgcagactctgtcaacattgtacactcaggctacgctaaatctacaaaaccttttcctttcttcaataataaattaaccttagcttaccgtaattctttataaagttctaaattttttaactcttttactctttggtaataacatttaacttaaaacacaaacacattgtacagtataaaaatatcttcatatccttattctatacactgtttttatttaaaaaaatatttcgttttactccttgaaatttttgttagaaatgaagacatgaattcatatttagcctataacctgcctgaggctgttttacagttaactttctaaacatgtaagtaggcattatctacgtatatctaaaatctatcattctaaaataatgataaaaatctatcattttaaagtaatgatacataaacagtaacatagttgtttactatcattatcaagaattacgtactctacacctgctagactttcatagaccgtcagggaagtaggtttgttcacatcagcgtcaccacagacatgaagattgcattgcacttccacagggcatgagcaccgatgtcactgggtgatgggaattcttcacctcctttatagccttgtggcaccaccattgcatatggggtctttcacggacctaaacatctttatgcagtgcatgactgtatatgcttatacatttatatctatatttatttctgctatctatatgactatgcatatacatctatttctgtatttatttctactacctatctatattgaaaccctgagttcactcagaagcattcatttctaatccaacactggatgttgattccccttttgtgtctgtaattcctttatttgacagtgaaaagaatggtttccattagacatcctataagcccttccttgtcaatccttctgcatgcacccggtcttccatctctgctgcacccctcacctccatgcaacgtgttcatctccctgcattggccctaaactcccatccaggccaccccactgcatgggcaccctcctcaccccaccccaggcagtgcctctgtgtggatgttgttctcaccctgttcaagctctgatgccccaacccaggcaacgcctccacaggcaaaccctcctcaaccagctgtagccctgacagccaggacaggctgcacgccctgcgtcccatgctctctttactccacttgggcactaacacttcccatcaggacgcgccacacggaagcccttctcaccccgttcaggctctgatatcactaccccctgacacctgccttgctgtgctgcacccatggctcctggagtcaagacttcagtgggagggggaggaagagggaaggaaggggaaggaagaagggaagatgcgtgcttacacatttacaacagcacatatctcattgggtgtgtgtatgtgttgcccatgcatggcaaaaagggaccacaagatccattaaactgtagttttgcctgcttccatattctctctctcacacacacacacacacacacacacacacacacacacgcacacacccttgtgccttttgagatgcagaatctggcaagcagttagagaaaggagagaaagagatgaaggagtagttaaccagagaggctaacaagataataataaggaacgaggcacagacaagtggagaaaatgaaatgttaaaatcttgttttaggtgtgcaggggagaaattggaagtgtggctggtaaggatgaaaaagcaatgttctgggttataacgttaatgtttttgatagaggctggggtgaagaatgcatggctttttaattatttttggttgttgtgttctgtcaagagagagtaatacaagaccccaggatctatttgtatctgaagtctgtgtcctccattagacaataagggaatgaagggcagaaactttgtctaactctttctttataagccagtgcctggcttctagaaagatccagaacatgtctatttgtcaaactacacctactggacaaaacgtgtccaaacccaatacagctgcccagaaattctgagggaagcatgagctgtccgttctgctcagttactgttaattccggaaatacacagagaaaataaaaatcacggaagatgcagttaaagtatggagctagaccactgttaaaacttgccagcaatttttaccaatccaatctttggtgttaattggtttccccagaagatgcaatatctctttccccactgatgattatattgcccagagccgctggctttcagaaatgtttaatcaagcattgcatatattcaagcaatactttccagacacctcagcttttcttgacagcgttaccttccttcgctctttctttgtctcttttaggaacatcaaatcatccagtgattttctgcataactcaaagttttgtcatttagaaaaaaaatcataacagaacagataaccattaggaaaccaatttgcatcagacatccatttgagaagtttaaaatgtggggaatgcaaactctacccatagggacttagtctgtagggaagaaatatgaacttgccactaatttctgaaaagcaaaattaattcagttatagctagatctgccttcataaggatatttctgatgcttctcagcctgttccttttatactgaatatttacaaacttcagtgatcacctgatcagaatccaagacacaaaactcaaatgaatccaatttttcaagtggcttcaacccagcaaccaaatcatagggctgccatttgtgctcaaagccaacactccaaggttttgtgtagatgagaatgaagagggagaaggcgagaaaagaagccatttcctgccgggggcggtggctcatgcctggaattgcagcactttggtaggctgaggcgggtggatcacctaaggtcaggagttcaagaccagcctggccaacatggtgaaaccctgtctctactaaaaatacaaaaattagctaagcgtggtggtgcatgcctgtaatcccagctattcaggagattcaggaggcaaaggcaggaggatcgcttgaatccgggaggtggaggttgcagtgagccgagatggcaccattgtatgccagcctgggcgacagagtggacttggtctcaaaaaaaaataaaataaaataaaaaataaaggtgtttccatccccacaaagagctatgtcaccaaagacacaggcaccccctatgacgtcctgctcatttaggaaacccatattcctagaagatcaaagcccattacctctggggaagtttgtttaattccgggagggatattatgggcatttgtggagtttccagaaaactcaaaagagccataaaaatcgtatttacatacaacattcatctaggttaaatttctttgcaagaagtgtctaattctcaagagatcagctattcagcttgctgggagctaattacaaatggtcccttagctttgctcagtcaactggccaaaaggcaacggagaggaaattggagttaagacaactgcagttggtccctggagggagcctattctactgccagcattctggctaatcagaatggatacagatggacaagtatcctttatgcatgagggcctgctggttttcctgggcgag

SEQ ID NO: 1209 - DNA, 2957 bp, Homo sapiens
gaattcccaaacgtgcacaggggagtgagggcagggcgctcgcagggggcacgcagggagggcccagggcgccagggaggccgcgccgggctaatccgaaggggctgcgaggtcaggctgtaaccgggtcaatgtgtggaatattggggggctcggctgcagacttggccaaatggacgggactattaaggaggctctgtcggtggtgagcgacgaccagtccctctttgactcagcgtacggagcggcagcccatctccccaaggccgacatgactgcctcggggagtcctgactacgggcagccccacaagatcaaccccctcccaccacagcaggagtggatcaatcagccagtgagggtcaacgtcaagcgggagtatgaccacatgaatggatccagggagtctccggtggactgcagcgttagcaaatgcagcaagctggtgggcggaggcgagtccaaccccatgaactacaacagctatatggacgagaagaatggcccccctcctcccaacatgaccaccaacgagaggagagtcatcgtccccgcagaccccacactgtggacacaggagcatgtgaggcaatggctggagtgggccataaaggagtacagcttgatggagatcgacacatcctttttccagaacatggatggcaaggaactgtgtaaaatgaacaaggaggacttcctccgcgccaccaccctctacaacacggaagtgctgttgtcacacctcagttacctcagggaaagttcactgctggcctataatacaacctcccacaccgaccaatcctcacgattgagtgtcaaagaagacccttcttatgactcagtcagaagaggagcttggggcaataacatgaattctggcctcaacaaaagtcctccccttggaggggcacaaacgatcagtaagaatacagagcaacggccccagccagatccgtatcagatcctgggcccgaccagcagtcgcctagccaaccctggaagcgggcagatccagctgtggcaattcctcctggagctgctctccgacagcgccaacgccagctgtatcacctgggaggggaccaacggggagttcaaaatgacggaccccgatgaggtggccaggcgctggggcgagcggaaaagcaagcccaacatgaattacgacaagctgagccgggccctccgttattactatgataaaaacattatgaccaaagtgcacggcaaaagatatgcttacaaatttgacttccacggcattgcccaggctctgcagccacatccgaccgagtcgtccatgtacaagtacccttctgacatctcctacatgccttcctaccatgcccaccagcagaaggtgaactttgtccctccccatccatcctccatgcctgtcacttcctccagcttctttggagccgcatcacaatactggacctcccccacggggggaatctaccccaaccccaacgtcccccgccatcctaacacccacgtgccttcacacttaggcagctactactagaagcttcttctagctgaagcccatcctgcacacttactggatgctttggactcaacaggacatatgtggccttgaagggaagacaaaactggatgttctttcttgttggatagaacctttgtatttgttctttaaaaacattttttttaatgttggtaacttttgcttcctctacctgaacaaagagatgaataattccatgggccagtatgccagtttgaattctcagtctcctagcatcttgtgagttgcatattaagattactggaatggttaagtcatggttctgagaaagaagctgtacgttttctttatgtttttatgaccaaagcagtttcttgtcaatacacggggttcagtatgacacagaatcatggacttaacccgtcatgttctggtttgagatttagtgacaaatagaggtgggaagcttataatctaattttaggaggaccaaattcagcggatggcaactggaacattgattgtaaggccagtgaagttttcacccaactggaatttgatggaaagaaggtttgtgtgtttaagacgccaagggcattgcagaatccctctcagtggacagtatgcactcagctgaccactctctctagaaatagtcaagatatgaactaagaaattttaatgcaaatacatacattcctgaaagacggggaattaaattactaattttttttttttaaatgatgacagtggtcccagaacttggaaaagttgtagggatttctaaactcaagcagattcgcaagtgctgtgcgcttgtcagaccatcagaccagggccaaccaatcagaaggcaacttactgtataaattatgcagagttattttcctatatctcacagtattaaaaaataaataattaaaaattaagaataaataaacgagttgacctcggtcacaaaagcagttttactatcgaatcaatcgctgttatttttttttaatgtaatttgtacatcttttttcaatctgtacatttgggctgtcttgtatgtttttatgctcctttttaaaaagcataatatgcctatagctgaaaaggaaacagggctgtttaagtcactgacttatgagaaagcaaagcactggtacagttatttaacaggcatacacaagcagggaaaagataatccatttagatctttaatgctttggaaatgcgtgtaacagtactgcaataatcacagctctgggaaaaacaacgaaactttcccttgtggagaggagggattttcctgctctatataagcaacatatttttagacattaaaatatatataattttgcaggtaattgttgacttttttaactatattaagtgttaagctgacaactgtcaaagaagaccatgttgtaaaataatttgactaaataaatggttccttctctcaaaaaaaaaaaaa

SEQ ID NO: 1210 - DNA, 1359 bp, Homo sapiens
atggacgggactattaaggaggctctgtcggtggtgagcgacgaccagtccctctttgactcagcgtacggagcggcagcccatctccccaaggccgacatgactgcctcggggagtcctgactacgggcagccccacaagatcaaccccctcccaccacagcaggagtggatcaatcagccagtgagggtcaacgtcaagcgggagtatgaccacatgaatggatccagggagtctccggtggactgcagcgttagcaaatgcagcaagctggtgggcggaggcgagtccaaccccatgaactacaacagctatatggacgagaagaatggcccccctcctcccaacatgaccaccaacgagaggagagtcatcgtccccgcagaccccacactgtggacacaggagcatgtgaggcaatggctggagtgggccataaaggagtacagcttgatggagatcgacacatcctttttccagaacatggatggcaaggaactgtgtaaaatgaacaaggaggacttcctccgcgccaccaccctctacaacacggaagtgctgttgtcacacctcagttacctcagggaaagttcactgctggcctataatacaacctcccacaccgaccaatcctcacgattgagtgtcaaagaagacccttcttatgactcagtcagaagaggagcttggggcaataacatgaattctggcctcaacaaaagtcctccccttggaggggcacaaacgatcagtaagaatacagagcaacggccccagccagatccgtatcagatcctgggcccgaccagcagtcgcctagccaaccctggaagcgggcagatccagctgtggcaattcctcctggagctgctctccgacagcgccaacgccagctgtatcacctgggaggggaccaacggggagttcaaaatgacggaccccgatgaggtggccaggcgctggggcgagcggaaaagcaagcccaacatgaattacgacaagctgagccgggccctccgttattactatgataaaaacattatgaccaaagtgcacggcaaaagatatgcttacaaatttgacttccacggcattgcccaggctctgcagccacatccgaccgagtcgtccatgtacaagtacccttctgacatctcctacatgccttcctaccatgcccaccagcagaaggtgaactttgtccctccccatccatcctccatgcctgtcacttcctccagcttctttggagccgcatcacaatactggacctcccccacggggggaatctaccccaaccccaacgtcccccgccatcctaacacccacgtgccttcacacttaggcagctactactag

SEQ ID NO: 1211 - DNA, 41936 bp, Mus musculus
  misc_feature (18413)..(18496): "n" at positions 18413 thru 18496 can be any base
  misc_feature (24424)..(24817): "n" at positions 24424 thru 24817 can be any base
  misc_feature (34689)..(34721): "n" at positions 34689 thru 34721 can be any base
agaatccaagaggacatgacaagtgcagtggaggaagagggggcagcttcctgtttagccaaagaagggatggagagtcggggggcgcacaaggcagaccaggagagacgaggttctgggatgtgacttgggagagaagaggtaaaaattaagctgtgttttactttgctttgttttttgtttttgtttttttctagaactaactttgcaatctcttgctgaagggccacctagacctcacccgatgatttccatttgtctgttttgacagctgtggtagccactggaacagttgatggtgcaagcgtcctcgatggtgtgagtgggtctcttgactcgtgtgcctgctcttgggactcttttcctcccgttgagttgtcatgtccaatttcaatatgatagcttttgcttccacttattatatttattttgtcatgcttggttgttatctcttagaagtgtattcttttctaatgagagacagaaacagagtgaatccagaaggaggggagttagggaagaactcggagcagcagaggaagaagaaactataatcagaatatattgtatgagaaaaggatctttcttttgtttttttctttttttgttttttgagacagggtttctctgtgtagccctggctgtcctggaactcactctgtagaccaggctggcctcgaactcagaaatctgcctgcctctgcctcccgagtgctggaattaaagacgtgcaccaccacgcccggcttatttttaataaaagaaaaaaagcagaaagaagtgggggggggccaaaagttaaaaacatgctctaatttattaacatggttcatggctctaaatctaaatttctttaggacattcatacttaagagaattcttcaaatggaaaggtcagccatacctactggtacaaacaataaagagaatttatgttctgtgggtatcctgaatccctgagagcatcccccaagcttggattgattagcagtgagcagagatcaccttaaatatttaggagatccaagtagttgactaaggtgtcttcctaaggcaggaaaggtagttaaggtttaaggttgaagttcatcacttacaagcaaaggccaaaagaaagatctcattatcttgtcaagtccacacgtgtataagactaggaaacagaaaataacggtgacttcaaacccagtgatgacgatatatggttcaggggcttgtcccacgatgaaaaagatcatagatgtcacagttaccacctagcagaagaaaacaaagacttagtcattgatcatacaatgggtttagttcctatggggaggttgggtgcatgtgtggtactgggggttggatccagggtctcaggtagtgagtgctgtaccatgaagttacacatatccctagcccccaaatgaggtctaaaaccaataagatttctgtcacacattgtagaaaggagaggcatggctaacgtgggtactgagtcctgcttgtggtttagaggactaagtgacctgttcaagtgcagctaatcactgcactgtgctctcaggtctgtcccctccaattgtctcctctccctctcggtctgccctcctcggccagctcatctcttcgtcttcctctaagacatctaggttgtcttctgtaaaacactcctcccaaagccctttcctttcacctcttccccagacaaatcctattctgttctgcttgtttgttggttttctgcttcttgctgcttctcaaaaacatctgcatcctggctgcctgaattcttcaccatccactccctcataactccttaacgctcagtaatctgcaatctcctattggacttcagttgaatgttgccgtgaggggcaagatgaaggggagggtgggagtggcagaggaggaggagatggatagaaacattgtcagaagcaaaaataaacctgtgtgcattttcatgtaagtcctcttactaaatacattgccattagaattaagggacagctgaagtctggaaacaacctaaatgacacccagaagtgaatggataaagagcatgtgatcagagctgggatgcagctcaatgattggtgtgagaggtcactaacttagcacatgtgatggcctttgttaattcccagaaacacatggacgtgcacatgcatacacataccacatacatacatgtatacacccacacacaaaaacatacatatacgcatgtacatacacacacacacatactcaagtgcatacatgcatgaaaggcaggggaataggtctatccataatggaatgttaggaacaaaaaatttgaagtattaatatggatatactattgacatatgacatcgatgactctcataattagatggatgaaagatgacaagatgagtatacatcatgctatttatagaaaattctaggaagtaaaaggtcatctgcagttacagaaaaagcttatttatacaaaacagaactaaattttatagaaaatatagttacagagagcacatgagtggacccctggggctagagtaggcaggaagaagggattatcgtggccatgaggaacattttaggggtttgggagccaatcatgtgccacttaacaaatagatccactctgggaaatacggtgagtgattttgtcgtgcaagttatcataaaaatacagatactaagatggcgctgatatcaccaggtgacatcgtctcatgggactgctgatatataagcaatcagcccatacctaagaaagtttgccaggcatgactgtattgattaccctgattatggtgataatttcattggttatatctgtgtccaattgatccaatgacacacacactggaaatgcaagtgtctttcccatcaactatggcaacacgaccttctaaaacataaatttgttcacatcctttgtctatttaaaattcaagtctacattttctctattatatagtccccctttcaccatgtgtcttgtatctcaaagtcagctaccatttactgtagcaaaaattcgcctctcaatttgtccatgaaaattccagtggtcacttcccaggcctcatttacttctgttccccctggtgtttaatgcagctgatcacagcctcaagtttcttcacttagcacccaggacaccctgacttatcttcttctacctccctaacaactccctcccactctttgcatgttctccctgccctgcctttactgctcacagactgctagagttcacacatccccttgtatcttctattaaatttctttcttcatgactccacccaccacttgactttcaatacgaccatctctcacccaaatccagctctatccagttcagtttcgctactcatggctctcacaggtatctctaatctactactgcattcaaagctgcctgctcctcctcccacacttgcttctcctgcagggcttctgataccagtgtgtcgcacctacactttttcatatgtgtaggcccctaaattcccaaataccaggactaaaggcaagtatcactgtgcctggtcaaaatgcaaaaatgttgactgctgtgtgtgacagctgacctttgatggtttaatgtgcacaaacttttgcttcatgtatgaaatcactaaaaacactgtctactaccccgcaggctatgtgtacgaggtatccataaaacgtaaatcaattctgtatttaaagtcgggttctatcttcgagatatctcattacacacttgtagatactccaaatatcctagacagtgctggtcttaagcatttgggataggaaatctgtagatccctgatctgactatttgctatttgctgcgcactcagtcacccgacccttgcttgcttggcgtgtcttgcagcgatgagctgtaaccctggtacattcccgcctcatttacttcacatcactggctttttctattcacaacgtattctcatcactagcactccgtctcacttaactctgaccgataccatcccagcaaagtctaaccccaagactacaatctgaaacctttgtcaaactcctcctcctcctcctcacgttccgttctctgccttttatttctcttatcccctagcacttaggcttaagatgccaggtaatgcactgggcttgactctgctgccctatctcccatcccaatatgtaaatgtcttgttcactgcggacagcaggcattcagtaagtgcttgttggatgagtacacgaagcaccaaacttcttattgttcagagcagagattcttaaggttttcttactagccttcattcacgtgggttcttttgggaaattttcttctggtatatgtctcgcttctgtatcctacctttatcctatcacatatagtacccctttgctttcatgtttgtgtcctggactaaatggaagcattctatgaggcaagaacttctgttctgtgcctggcatagaggtgcatgcatttaatcccagcccttgggaggcggaggcagatctctgagtttgaagccagcttgatctacagagtgagttccaggacagtcagggttacacagagaaaccctgtctcaaacaaacaaacaaacaaaccacaaaaacaaggggctggagagatggctcagtggttaagagcattgactgctcttccagaggtcctgagttcaattcccatcagccacacagtggctcacaaccatctgtaatgggatctgatgccctcttctggtgtgtctgaagacagctacagtatactcacattaaataaataaataaataaatctttaaacaacaacaataacaacaaaaccactaccacaccccccaaaaaaagaaagaaaaaagagaaattttgtggttggtgacatggctcagtcagtaaagcacttgttgaatagtataacactaatattaaaaacaacaacaaacaaacaaacaaagaaacaaaaacaaacaaaaagccaaagccggacatgatagaacaccctaactctgcctgttatccttgtaatcctaccattgtggagttggagactgtttgctggccagcctaacctaattggtaagcccaggccaatgagaaaccctgtctcaaaagccaatgtgggtggctcctgaagagtcacatattttggtgactaaatataaaagttttatgattcagggatttctgtcttggtaactaaatggaagaattctgtgagttaggaatccacttttgtcttggttgctctttcttccagctaccagcccagaagctggaacacattaaatagtcacatcgtgtacagctttgtgtctcaggtgtgcagcacccatggtggccagaagagggcatcctatctcctggagctggagttaaacagttggccaggagcaactcaacatgggtaccagaagttgaacactcgttctctgtcagggcagtagctgtggcactgagccattacccagtctctcacactgagtagagcggtaatatcagggctggagatttgactcagtggttaagggcatatattgctctggcagagggcttggatttgttttccagcatcccatggtggttcacaaccatccataactctgctgccaggagatctgatgccctcttttgaccttcaaaggcaccaaacactcgtgtggtgcatataaatacaggcaggcaaaacactctcacataaacggaatagatctaaaataaataaataaagcaagcaagcatctgggtggttgggtggtagagacagatgaaatgcttgtgagtttttcaagaccagccaaagacatgctatgcgaacctgttaaaacccaaatggggctggagagacagctcagcggttaagagcactgactgctcttccagaggtcccgagttcaatttttagcaaccagttggtgtggctcacaaccatctgtaatgggatctgctgccagcttgtggtgtgtctgaagacagctacagtgtactcacataaaataaataaatctttaaaaaaaacaacaacaacccaaaaccaaaaaaaaacaaaacagaacaaaaaacaagttatattaaacttaaactcctcccccctccccaactatctatctgtttcaatgttctggagctaatgtaaaactccaggtggccagtcaccttcttgattaaataaggcaaaggtaacctctccctctgctccagagtctttttctgaatgtctcatatgaatcataatttggagctacctctccgaatcacggatttctgacacggggaaggtttcctatgcaattaattttcctcattcacttgaagtttgaatctcctttacaacatcctctttagtgcccacccgtgccttctgtagtcagggaaatactgtcttctctggcggtcatttaagtttgtcgccccttcaatataataaactcttcgtgttatgtggaaacgttacccttggaacttttaaccatctcatttcagctctccaaattttttgaacggcttaacttttctttgagttttcttacattccttttaatatggtagttcagtgaaaaccagggcttttaggtatggttgaggagaaagttgtattgtaggtatgacggaggatacagtcagaggtatctggaagtggtcagattgaattgagccatgagaggagagggcaggggagagaggaagaggaagagagggggacggggagagggagagaatcaagaggaccaggagaggagagtgtgtgttgggggaagggggtggggtaccaagagagtctgcagagatggccagtttatatggaaatgagaagctgggagaagggaaatgaatcccagcctctgggctggagaggtttaaggtaggggcggggtgagaagttctgggaggagctacaggtacagagtgaacccagtccctggccgtttgtacttctctaacgagctgagaacattaccctttaataatgatctcctttctccaaagtgctgtccagaacagactgcaatgcccctgttagggcttggagccctaatacgggcagtttcctctttgctctcgctctgggttgtatccgctctaagttcggtaacatccaatgtccgacttacagtaaaagaccaccaacttaaaaaaaaaatcttaaaaaaatatttatgacttttgagtggtgagactatacagcgcctggtctggtagaggttatcaccaagttcgtaaaacaagtgaagggttttcggatagacccatgggcgtgtccctacatcatctgaaggaggaagccactctaccctatagttcttctccggtcgaactgagccacagagcaatcaatgccttgcgtctggaaaggcgtggctggaaaccaggtggccgagcaaacgctgctccaggcttccgaacccagtcttctctaccccggagcactcctgactaccgaccgccctgcattcccgccctggtcctcaccaaccgcaggaacttcacaaagcatttcagagtacagcagaagggccgacggcttacgaccggccgtggagtctccatcttgcccacagacccaacagtcacgcctctctttcaagccttctcgattaatggctctttccaggactcgcgccaccagctcaactgccggggctgggcctgcggcaccgcgctcaggccaagtccgggcgcgcctgcgcactagcgcgggccgcccactggctccgcctcctggtctcttaagttcctaactcttgctgacacctgtctagcctaacccaagccaggtccccaccactgctcctctgccctggagctttcctgtggagaagcactgttggagtaggcgagaaaaacccaagaatgccagcccagcctcttcgccatttgagcatctcaaatgccacctccttaggatttcccttggttaccttgtctagtcattcctcagcattttttttttttttttttttttttttagatcccatccagattacaagtataatatcccccaggaaaacgttgattcactggtagtaagttagacttaggcaagagaagttccgatgttctgttagtctggttgaccacggataatgaaaatgtatagttttatttaaaaactaaaaggctacaagaaaggaatttggccgttttcagcacagaaattattccgaagagacagacttatcctgatatgaatatcacacaatgtgcacatgtaataaaacatccaatggtatcttgtaaataaatacaattatgtatcagttaaaataaaaaatataaattctataaagcaaggatctgtctgcttctctgctcgaagggtccccatggtctgggccactcatcaatagctatagaatatatagcctgaacttatggcctggccctgttagtctgtccttgctctcagaacgtgcaagcctgtctctagagtacttttcgcctcccactgctgttagttgtcccacagtttataaagtgctccggtgtagccaggacaaaccatcttggagcatttcatgatgatagacacaggaagaatatgtcacttccattatgtgaattaagtctcatgatttcttttggagaactgaataaccacccgtcctagtttgcttctctgtgataaaacaaacactgaccaaaagcaatttgggggaagaaagggttatttggcttacaggagggaagacaaagtaggaactcaaggctggaaccggaggcagaagaagcagaagcagaagaactaagagtgtttatcagcttcagtagttctctggtttgctcattcataaagacccgcagctcacctgcccagggacagcattgcccatagcaaggaggcaaaaaacaaaaacaaaacaaaacaacaacaacaacaaaacccctccttcatcaattagcaacaggaatatgctccacagacatgcgcacaggccaatctgccgcagccagtttctcaattgaggctccctttcccgaggtgtttctagtttgtgttgccttggtaagaattaactagcccacaaccccagtccatttagatctctttggatcctgcccatctaagatctgttcatttggctgaatctgatcaacagttaccaacaatctcaccccaagacgctcacacacacacacacacacacacacacacacacacacacaactgtcgactttgaatttgaagattttatttgcctttactaggtgcctagcaaataaacaggaagccctgttagggtgatggcttttttgttacagatctaaaagagtaaaacaaaacccagaaaatgtctttcttcattttgcccaagacgactgccagcatcttgccacctggaagaagtggaaatcttctttacacgcattgtaactgcccatatacagtcaaggcggcaacatctgggcttattggtcttgaatgggtgaattatagtacccaagcttatttttgcttacaagttggccttacatgctttttttcttatcccttttttgttcattcaggggagatattcgttatgctttcccgaggaacattaaaatccaaacgttgaaaatgtcaaagactgtaacatttgggaacaatggctttcacggccctctcacctgtgtccctcacactgttttttgtgatggtggggattaaacctaggagggccctttgaagcccaaggacaagcttggaaaatgttcccaagtttgacaaggtctacttgcagagtattttcgaaggaaaatacaggacatcctgagtaggcggtgcgaggtgtggatggagccggcaaccaaggaagtaatcggatatactaagcagtccccggcattattatgccatccattctctaaatctacttgggtcagggccattctgcggtctgtaagtggggaaatcctcactttgaatctcttcggtgtagcctagagggagaaatactagcggatcccttaaggggcggggccggacaaggggtggggcggggctccaggacgcaccggaaggaagtaggacttgcacatcagccagggactatgctgctgcggtcgctgcgtagttgggctgcccggtccctgcgtagcgtgggcccggggagctccgggagccccgggagcctcgattcgggcgccgggccgctgtgggcacctcgccgcgcctggcctccgggtaactagtgcttttgtgccacctcgtaggggccacactgaaccccgccccctcacctgctagtccccaggaagggtctggggactgtgggaccctaatgaactgtcaggatcggcacttagtggggctcaaacgcggcttctcggcccatttttttaatttttattttttattgtcagattctttaggcttgggaggtggctagttggggcacgagctgtatttaatcagctcttagtggatgcaggtgtctgcggacctagggggcgggttcaggcttgcgactttctcctcttgctggcagtgcggatctttctcttcggaaatggaagccaggtgacatagctttcattggcctcgggctgctgctgccaggtgggttggcagtgttgccagtcttggcctagacagcctgggtcccaacccttggaatctctcagagtgtaggttatccctgggtgcgctgtgaagatcctaagcacacaatccaggtgaaacggaaagtagaatgtaccgagcaaaggaaactaagcaagcacacatgggcctgggcccagtacagcgacacatacggacccaactgtagagagtcccaagaatggcaaacattttttgtaagccagggaacacgcatacgcaatgactgtgtggtcatttatcaggtcagcacagagcagagtgaataattgaaacatcgatttcctttccttttttagataaagatagagaaaatgataaggagaaaaaagcagtggtaagtttctctttgcatgctttctccagcgtaatttcggtttggttttgttttttttttttttttttttttgaggcggagaacaaaaacaatggtgcgcacagtgaaaaaccaaacccaagacgatatccagggtcacaaatctctcttccttcttgtggcccggttcctctccttagattccatcaccgttagccatttcttgtgtgtacgggcgggagtggggcctcgagctgcattcaggtagtaagcactcatgttcaggtgtttgtgaactgccaaagatgctgaccgagccatctaaacggcttaaattgcatctatttgcttcactgccgattgccccgcccagatgtgggggggaagtgttcttctcacttccttctgctgtctagtggagaccagagaatccacgagggacctcagggtggcctcagtcaggaggtgcttgacaggcaggctctgggggttggggctgtgaggtcaaaggaagtgcaagttagacaggtttaaatgttgcagcagtattttggttaccaccagcccaaggggttcagtttcttcctttgagatcatctcaccccaggctggcctcaaacttgtgatccttcggcttcgacccctcctgaacactgggatttcagttgtgtgtcactcccaagtggtcagggcccgtttctgtaagggagctgaaagccttgagctcagatggctggggagaaggcagctggagcaccttagtgcctctggagggtggaaggtgtgccctcctgtaccccttggtggggcagtggaggtagtcaggaggaaggcgtgtccctgggaagcaggagtgacatcacaggaagaggaggcttggttttcaaggctggagaaatggctcagcagttaagagctcttgttgatgttacagaagattcaggtttttgttcctagcactcacgtgacagcccacaaactgtttacttccaattccaaaggatctgaccccgcctctgctgctcttcatggacaccaggcatacactggagcacagacgtacaagcaggcaaaccatttatccatataaaatacatctaaaaagttagaggaggaaggtggtggtggcggcacaggcctttgatcccaacactcgggaggcagttctctcagttgaaggccagcctggtctacagagggatttccaggacagccagagttacacaaagaaaccctgtcttaaacaaccaaaataaataaataaaatgaatgaaggagagaaagaaaatatggatagctagtgacatagaatttgtatttgtaattgttgagctaaccttgccaagtgttggacctgttctggatatggtctgatgcacccctgggtgtacagtagcagtttgtagaaagtggtagtgtggagcctggtctcaggctcagggtagccatttaagtacatttttgtgtgggaggcgctgggctggaaccatgagacttgaaaacaaagccattggcattgcgcacggtaacctgacagacgggacagtaaaaaggacatcagtgaatctagaaagcagtgagtgagcttggggctttgaggaggggactcaggactctgtgcagccttgggaagccttgatgccccctgagaggtagaggagaggggactgtagttgtaagaatgtagagagagccgtaggctggctttatagtctgtccttagatagtggaggcttggaagtgttcagagaaattgggctagatgccaacgtcagagtcaccaaaggacttcaccataaactgtgtaatttttactaatttatttatttattttttaagttttcgagacagggtctcactgtcttaccacgtagccctgtctgaattggaaatcacagatcctcctgcctccgcctccctagtgctggcattaaagggtgtatcatgtaacctttgaggagtagaaatttatttgtttcgtgtttctgggggctggaaagttcaaggttgaaggactaatatctgctggaggctgcatatgtgtttcatcccatggaagagaagagaagacaagaccagacccactccacagatcatgcctttttttatcaggaacccatccactgataactgccctacctccacaatactactcccgaattcgcctccacaagtcactctttgtgcatgactgctctatttgcaggtacacctgcatgccagaagagagcatcagatcctattacagatggttgtgagccaccatgtggttgcttggaattgaactcaggacctctagaagagcagccagtgctcttaaccactgagctatctctctaacccccaccagtcactcttgatggcggagttcacacaatctctctgcaaggtctaatctctcaacactgttgtaccggggactaagtttccagcttgtgaactttaggggatgcattcagatcgtagcactgccacgcactgtggtccgacttgcctttcagggtgagatggtagggatcacagcaggagagctgtggggtaagctgagaggtacagaggagtagcgaggtctccctctaggagtaggagaaatgctacttgtttgtccttggttttcattaaacatccaaattgattggcagttctgtagggttacggtgatcattactattgtattgctcctcccctgacagggtctcaactgtgtcctggctggccttgaactcacagagaccacctatacaatgagaatgtttaacttcctttttttgatatattaaatgttacttaaaaagaaaggtgtagagttgggtatggtggtacaggcctgtaataccagcattgaggagactgaggtgagaggttggagaatttgaagttatcctgggcaacagcaagacactcacatacatccccccccccaaataaaagacttatttactttatttatatgagtatactgtaactatcttcagacagaagaggacatcggatacaattacagatggcagatggttgtgagccatcatgtggttgctgggaattgaactcatgacctctggaagagcagccagtgctcttaaccactgagctatctctccagcccccctctgtctctaaataactaaaaagtaaaaatgagagtgggtggatttccgtcgtaacgcgtgcttagcaagcatcaggtaagttccattcccagcaccagagaaagatgctcacccgtgccagttacagtggctggagagtggactctgcttctgggggagagtgggctgagccgcggcacagacacagaactttgagccaagctgcctgcatcctacagcagcacagcctcctatctctgtaatctgttactttctttgctaccctcacatttactgtgaacactgttgaggctgggaccagattttccatatgatgtgctgggctcatagtaggccttcaagcagttgaaagactcaaacctgcctggtttactgccttgtcaaatcaccacgtattggtggtaacttctagcgagggtgtggagcaacaggctacttgctatatggtagggtaggcacttctctgtgtgacccagaggatgtgcaagaaggttctgaaggagcaatctgtcttagattgaactgtgcacctgtcgtgatctgctggagccaaaaccaaaatatcgattgagggcttctctgtacaagtcagcaagttggatcctagacggcatgcacgcgatttttagtctcaaagccattgataaaagtcaggttaaggaaatgggacacttttatactaacacagaacagtgtgaagggtggatctagggaagggctcagaacttgactgggcagacaagttgtgtgcagtttaggtgacgtaggtggcagggagaagggtgtgttgtttgggctgaggatgtagtccaggggcagatagcttgattggtatgtatgaggctctgggtttgacccctagcttatttaaaacaagaacaagcgggaccgggtcaggtgtggatggatcacatgggtttgtcagagggtgcggcatgagggatgctgatactgtgtggtgggaccttgggggattcccaaggtagggttttagcttacctctcaaagtcctggcccgaaccaagaacctggctattcacctgagcctagttctgtcgtgctttatctctatgcctaatgtacatttgtcttctgccaggtttgtattgagggcaatattgcaagtgggaagacgacatgcctggagttcttctccaatacaacagacgtcgaggtaaggctcttacagtgggtttgtaggaacccgaaacacctcagtggagtaagttataccgggcacagagagccctgtccagcagaaggctgatgcgagctgccagtgagctgcacgtctgatccggtgcctttaaagcctcgtggagtgaagcagggggagctgtaagacagccctgatgtcaattaacatgtcaacatgaagtcagtgttaaagcaatgaatggactgttcacattctgtgtttgatactcaatccctgggcctggagttcagttagtgtttacagctttctcagtttggactcccagataatgcccaaggcatgatttctcaactccggattttgtttgactataccgtgctgccaaggcagtatacattcagtccagtagattagtaatgcacttcagctcggcctgttttcaagtgaggacacagcccccttaaagaagaggcgcatctgtggtcaagcttcaaggtcatcgtggttgcatgtggcttgtggcccctgtatgcagtggtacatgagctcccaccattcctgtctgagaagggaactttctgtgtgggggctgctgatgcaaacagtatggatcatcctggacaactgcttgcttcttggggagctgggcttttggaatgtgccaggcagtgatagtctgtgtagttatgtgacccctgagcttccaggcctaggtcacctttcctggtagacagtacttgacatgtgttgtcacaacttgttgctgggaaaattgagtgtgtcttgtgtgactccattgggcaaggatacttgggagttctggcccatctccctccaggtacatcccctgtgcagatttggtgctgtgacctctcatggcagttaatattggctgtcagtgttggatgatgtctcatcgatcatcagcgacccagcgaccggccttgagtggtgaccctctgaacagaacttgaaaagtgcttatatcctcactgtagaccttggggccagttagcaacagtagccgcagcagtagctaaaatgatccaaggcaccgtgttaagtgtttatggcatatctaattgattccatgcttatctgcttaacaaccctctgaggtaagcactgttatctctgctgaggcgaggaagcaaaggataactggcttatagaatttatatggtgtgatagttaattttaggtggcagcttgccagaattaacgactgcagcagcctcccccactcagcgtggtttcagttacccgaggtcaaccaggatctaaagtattaagtagaaactttgggatgtatttaagttctgcattgttgtacgatgtacccaaagagatctcatcccgcccatgtaagccatcctgctgtctagcataggaaagaaaagcatggcaagtgttaggcttgttgtacctgaagcttcaggcatccgctggggatcttgcaaccccaggaacaaggaggcagcactgtgcctgggggctgatgaagtgttacctctatacacgtttagagggtgcttctggagaagaccgatatgtaaattggcagccttactaatatataatataacaggtcatataattggccacagtcctggatagaacaaaaaggaaagaaaaggattttccccccctcttcctgctgtgggacaccaaactgctggctttccagccttaggacttagggacttagccagaggccccaggctccagggtttcagccccatacttaacattacgccagtgatctctctgttatcagactttagacctagactgagctctgccgcttgcatccctgggacccaagctggagacgacctgtcatgacacagaggtcttggcctccataatggtagagccaatcttgctcacgaatttcatcttgtatgtcagtttctatgttcatgcaattggatctacctctgaggagagtcctcacctatcaagtagtgtgtgtcggggccagtcccagcaaaggctgtggagcttcagggatgctgtccatgtttgtctccaagctgtgaagagcttggttgacttcaccgagcctattcccctctagactgagccagtttgcagtcagtcacaggaaggacttccccacctagaaggagctgtggccgttcaagggttcatcccacccttggtctgtagtgcttgcctgcctgtattctagatttggcatgctgtcacacgtttgctctccttccaggtgttaatggagcctgtgctcaagtggagaaatgtccatggccataaccctctggtgagtagtttgtctcttgcacaaatgccagcttccctgtgagtgcctaggagtgctggttctgaggcctgtgcccagcacagccagtctgtccccattgttctagctcattcagaggaaaggggaatggcgagccagggatttctgaggcctgggtgggtttgcacgaagcccaggaacctcccgtgaggtgtctccaaggttccaagtggcttagctttccttggcacttgttccaggtcaccaggtttctcgatgagcctctgacttgggtttgggctttacattaccgaggaatggatccctgtggtttaccctggagctacccatgttccttgccaaggtggggctagagagccagggactgtaatgtgcatgagccttctccctcctacactctgaaagctttgtgctgcctgcttgaacaaagactgatagaaagcagatgctaccagaggggatgaagaaggactgtggtcctgggctcccgtgctatggtatggggtgcttagtatttctcagctaagaaaactggtcatgtaggtttagcagtgcctcgcagtacctcggcaataccacgtgtagagtccattagactcaggcccacagcagacagcactgtgtctgctggaacccggctttaggacccacttgctcactcactcaggatttattacataccttttatgtggccaacactgcttcgcactctaggacactgagcaatttaataaagcctctggtctcctggccctaacatccactgtggagatgaaggagacaggtattagaatgtggtggcgagtgacaggagctgtgaggagagctacagcaggtgaaaggatgctagttagataagacagaagctcacagttttaaaataggaatcgcacagagctgtgacaggaatctcacttgtgtgcatgtgggaagaagatgggattgtcagccatcttttagtataacagagataatccattgcccttcatannnnnnnnnnnnnnnnnnnnnnnnnnnnnnnnnnnnnnnnnnnnnnnnnnnnnnnnnnnnnnnnnnnnnnnnnnnnnnnnnnnntaagacaagggtagttttagatgtctgagactaaaggagacacttcacagaccagaagtacagtctcagaaggtcgcataacaagtgttatccttaccatctcttcatcatcatcgtcatcaccaccatcatcagatatatttccactcctttctgctggttggaaacacaagactgctgcttgtgtgacagttactggctcaccacgctggctccgtgatgcagaaagtcgcctgtttccgcagtcatccagcttctgactttgctgagattttctttgacccataactaggaaagcctttagttctcagtgctgagcaccgagtgcggaagtgcagaaaggaagctggcgtcctgtcacatgcctgtgatctctccacccgtgaaagctgaggcaggaaaaccccaagttcctgaccatcctggttgtttaataagactcggtcttccctcttctctccagacagaaccccatccttatccgtccaacacacaccagcacacacacacacacacactcgtgcatatgcacacgtacaccctagagagagaagcaaaagattactagaattactagagagtagactgcagcaggaagtgcttttatctgtaggtgacagaagattgagggctggcctctattttatcagggtaggtaggacaatgcatctctatgaaggcgacatttgtcagagacctacatgtgagggagggggcactgcaggcacctggaggaagagtaaaagaggcaggtgccagagccctgaggtgggggcctgcttggcatgcttgcagagcactaaggaagtttgtgtgcctggaagctgattggccagagaaagaagggtaagagacaagtggatgaaggtgggtttctagggcctgtggttcagatgggggtttagatttgatttgcacccaatgcaaagtccctagacgggagatgttagcaagctcattttggctgctggatagagaacagaccacagggaaactcaaaggccaactatgagtgtctaagtgccttttcctcaggcagcacatcctggtctggctgttagggggctctcttatagttgtgttcacatttgtctctgtccacctactctgagattcctacagctgtcctgagtacatctctggcctcagccctgcccctgtgggtttcctgaaatggctttcacggacttcaagacctgggccctgcctgtacttgccacttggacacaaagtgctttgctttcctccctgcagagcctcatgtaccatgatgccagccgatggggcctcacactgcagacgtacgtgcagctcaccatgctggaccagcacacgcgccctcaggtatgtcacaggtctcactttcaaccttataaacatccttcagattcaggtgttgtcagatagggacatcatagtaaatgtccctttggacctttatgctgtccagtcttctgacttcagtaaggtctcctgtcctcacaggtggctgtgctggtgccatcctgagctcacatctgtaatctgatgaaaagttgctaaggataacacacacaatgcaaccttctgagactgtacttatggtctgtgaagtgtctccttgagtctcaggcatctaaactactacccttgtcttacttgatatcaagccttgagttctctctgacttctagaaagtatgaaggccggtggtttttctctattataccaacgcatgcacacaagtgagattcctgtcatagagctgagtgattccagcttttgaccatcctttaacacagaatccctggcttggggcatcattgtcacctgggggcttgttagaattgtacatttctcatctcctccccagatctactgagtcaggaaatctggggctaaggtctaggagcctgctttatccagctgtgcaggactcctggatatgtgttctgcgtgtctacctgtttgagagcagacctttgtgaggtctggctttcagattctcgaaagaatctgattcaccttgggtcacaaccaggtgttggggcaggacaggacacacagcgatacttaggtccttccattagcaggagcaggttgtcttaggaggtcaggtggcaagggtgaccatggttgctacctatgggaaaagctttatacacaggtagaccctttccctgtaggagacaggatacccctatagccagttacgttagcaccatcattaggctgagcagttggctccaagtgtggctccctgcagctgtaggtgtcattcttctgtcgacatcagtctgtatctttacaaattgacagatgggaatagaatctttagaagaatatgaatttgtcctttccaatggtttcctaagtgacagagagcagaacacctgcagttagcaccttccccttggtttgctctgctttgcctaagtgggcattttaaattatatccgatgatctgtgaatattatgggatgtgggctgaaatctgctaaggaggcaaaggcagagctggctggactcagcaggagagagatggctgaagagggagccggaaacagatgggaaagaaagataggagcagcacgtgcagaagggacagaaggaaaacagatgggtgcgcagagccaggaggccgggaggtaagcagcgagtgggctgtaggcttgaacgtgctctgggtcacactgtctactaggtgtcggatgggcaggtccctcctgctctccaaaaggacgtagtagacgaagggaaagatgatccatggagggtgtgagcaacttgcagaaaggtgatgtgcagcctcttctctgttggtcagagtacttttcagttccagcaggcagtgcctccctaaccctagtcttttggggctctgcttcagacacccaggtccctggctcagggctccactcaccagactgtgtcagcggggcagctttgccaacgtgttccatatcctagtgagtctcccttctcctgtgagagcaactgtggggctgctggcagccctgggcccccacatggctgcctttactgtcctctgtcctctaaacttcaggatggctcaggtcagggtggagggagacacacagtgagtctcatggcagatttggcttctgttgactgttgtcctccctcacagtctctgtccagcagagatggaagggacccgtaagaggactggggcaagttcttcagggcttcctgtaccttcctcctcgcctgagagtaaatccctttttccattcctttagatgtcacctgtacggttgatggaaaggtcaatttacagcgcaagatacatttttgtagaaaacctgtatagaaggtactgtagcttgtatagcccatcatttattaactgattttgtgtatgtgtgtttgtgtatatatattaatatgtatatgtgtgtttaggtgtaggtgggtgtgagcatgtaggtgtgagtgcataggtgtgggtatgtaggtgtgggtgtgtaggtgtaggtatgtaggtgtgggtgtgtgggtgtgtaggtgtgagtgcataggtgtgggtgcgtagatgtgggtgtgtaggtgtgagtgcataggtgtggatatgtaggcatgtggaggccaaaggacagccttgggtgctggttctcaggaagtatctatattactttaattattttttctttaggtttgtttagttttatgggtatgagtgtgcttacatatatgtatgtgttccaggtgtgatcatggaggacagaagaagctattagattacctggaactggagttacagatggttgtgagccatgtgggtgctaggacctgaatccaggtcctttgagatagtagcaaatccctgagccatctctccagccctccactgtgctttttgagacagggttgctcacttcttagttatcgcttctaggctaggctgactggccagcatacctcagggatctgcctgtttctaatttccagtgctaaaattgcaagcagatagcctcatgcccgtgcttttacatgggatctggcagctgaactcggctccccatggtagcacaaatactttaccatcagagctgtctccctggccctaaactattgctggtggagttagttgcctagttacctgacagattcggagtaccaacagtattgatgagcttcggttgctttataatgttgtgtaacaaccaccaacccactagtgacagccaccttcctttattgccaggtcagtttgggaggtcagccaagtggctccttttaccttggctgggcttagcaaaatgcctgggagtgggctggactagaatggacttgacccaggtggtccaggcaactcatttctcttcctctcacctgtcatcccctctgggaccagaagcaagcataggccctgtcatctcatgtgtgtggcatagggcaaaagtcccagtggacacacagcggcatgcttacatttgttgttccgcccttgcccacatcccattggtcccatgcctagggatggcaggcgagagggccaagggggtccatggcacaatgcaagcttctgggaagatggagatttgggatgcttagagcagttagtctgccccgtgcttatgctgtgtatagcttctgtcctcagttatctagacagttggaaggcttcaggtgcccacccgggcttagggctccagtgtgggcagggcctaatgtctgctcaggttattgataatttgggagggtcttagaggaaacaggttgcagactgaggtctgaagtttcagccttttctgagctgtttccatcttcatagccatgtatcttgtcctcatgtccttgtcagtgcccgattcttaccacctcttcctgctctgagcctgcagtgccactgccacttcttaggcagtcctgacacttgtacagaatgttcctagcttcccagacccctccctcccatcacagctgtccttatggttctgtctcagcccttcatgtgtctgtgtgtctgtgtgtctgtgtgtctgtgtgtctgtgcctggtgcccatggaggtcagaataaggcattggatcctctcagactaaatctatgtacacagctaactccatttcctaggtggaagcagcaaacagttcaagacaaaggataattatctacatcttgctagtggggcaagcaaggtgtgcggaatagtgagaggctccgatttctcttattcaggtcatccctcaggcaccactgaagcccctcctctctccacactggctttactcatgccctctattaccatactgagcaagtccccttgtactgaggccgcccagggctctctgtgtttatcaggcaccttctggttgaggactgtgatgtaaacgaggtccaccagagggcagccactgcgtaactacaggggttcctgcatccctatgctttagcccttttcctgccggggaggcctggccttctgtcctgggaacaagactgagctctgagagttgtccttgggattgagggtttatggtgcagggtttcctctgtgttgtactcagcctgtgggttccatttcacacgtgggacctgaggttttgctggttgggtttttacacttctatggtaaagagtcccaggtttttgtccaggtctagagtggagcagctgtcagccaaaggctttctgttttgacagtgaaaagggttttgatcagagcttcagaggaccaataggaggagaagggagtttggggttcttatacggtcactctcctcgtaactccagcatgcccagtgcaccggtgtctcacagggggtgctatagagaaaggaaattgtctagagctttctacctcctgttcccatctcatcgagaattagtcaccttaggtagaaggtgctgaaaaaacaaagaggctgatagatccaggactgtgcaaactgcagtttattagggactgggggcagaagcggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntagctatctgaatatctatttgctccttagggcttgaaatacacgccaggttctcatggtggataaaatagagttacgacaaacatgtatacgagccgtcaacttgtttccagcctgaaagctggttctgtaatgcagaattagctttagtggtatccttagcctgtatttggactaaaatgtcttggttcttacctgtggaagctcagctgggcactggtatgcttccccacttcctgtgctgcccatggcttgctaatgtgcagtggtggaaagccctttcatagacgggtctagtcatggctgacctggcagtgccaggttcatcttttccccagggatccctagaccctttgctgaggatctggaggtgggggcctggctctgcaatctgtaattgaaaggttgggtttctggagaagcccacagatatgaattggtgttctacatttcctcaaagcaaaatttctccgtgttcttgcctttgggatcttgaacaagtaactgcgaaggagagacatacctcttctggtgaggtaggaaggcagagtgagctcagttacatcactagcagtccgagagctttgtgtggattactgaagaggaaggtcagctttcatgctgtcctcagaaacaggaactgagctgtgtgcactgggctgcaatgcagagctaaaggtggcacagaagcgttatggccaaagaagccacgcaggcagttgtgtagtaagctctgtggctgagggattgagcaaatgttttacaagactgcttggtcttcctttcctaaggtcagggtagaggaatggagtgggtgcagctgggaacatggcgttgactcacctggcacatgggaacaatgggcaggtcctccctacctccctgcccagccccagaaccaggaggccaggccacagaaacacgggggatccaggttagcccctcagggaggacaacaaatgcagtggagagcaggtgggactgagggcaaggctctgctggaacacagggctagaagaggaaacagtgtatttaagtatcaggtttctgtcttaatttgtttgaaatagtgtgttattgtgtagcctaggctaatctggaactaagaatttttatgtagcccaggttggtgtcaatcatgagatcatcctgcctcagcctcctaagtgctaggattacaagcaggtgccacttcaaccagcctttgatttggttttttgagcatcaggtactttcaactgaactaaatagaaacatggtacaaagtatggtgaacagtgggactgtccatggctcagctaaggagttgaattggactctctgtgttttggtcagggttactattgcttaatgaacaccatgacccatagcagcttggggaagaaagtatttcactcacagttccatggatcagctcagcatcaaaagcagttagaacaggcagaaacttaagcaggacaggaacctggaggcaggagctgatgcagaggccgtggaggggtgctgcttactggcttgctcccagtggcttgctcagcctgctcgcttatagaacccagcgtgtatgtgtgctcattatacacaagtgtggagcccagataaggacacagtccctgctctatcacatttataccttcttctctgagacagagtccttgactgaaccaaagcttgctttcggttagacttgctggtctaggagctctatctgtcccagcaccacagggctgggtttagaggctcagggccatgcctggcttttttttttccctatggggacttgaactcaggcactaatgcttgcagagtaggcactcttatttactgagccttcttcccagcattgcttttttagtcttaatatttaaactgtgtaatagtgccgcctcactcttgttctgagcactgatactttgctcaagtttaaaaagtaaagagccaaggaggaagagtctacagtctgcagctcagagagaagccctgcaagcatttctgtgtatcttttcaaatgaggacatatgttttttgtgtggttgaggcatatgcatacaatttagcctcctgtatccattgagcagcatcaagttcagagtctttcccctgtctgcgtatgactttcctacatcatccttcagctactgtgtgcttttgctgcagagatagatcaagacttcatttctcacaatgctgaacagtggtgcatggcgagcatccatgagcattttcacagagaatgagttctagaagtgaaaatgattggctgatccactcccaacttgaatgatgtctccacgtgtagagggcagactaagatgctttgtctccttggagttcattccagagtaggctccatcagtcactgctggggccagctcccatctcccagtggtggaaggtcagacagacagatgctcagggtcctggcagtaccatgtgggcatcatctgtggaccacactatgcaacatgctcttggtgctgcccttccaaacaaaagccaccccttagtcctttgggggaatgacacagcacatgggtgaataaaaatctttgacctctgattgcagtgggaagatgcccgaggttgactacgcgattctgtctgagtggtttgactggatcgtcaggaacattgatgtctctgttgatctgataggtaagacagtctctctctgtcccctacctggaggcttccctgggcacagctggggtatacttgggaggttctaccttggatcgacagaaggcagggacacctatcacctgtgatgcctcctctatcacagctcaccaaggcaggcagcatttagggggttcttctgtccatgaaggaactctggccttggttccttaaacttccttcttctgggtcaactacttctggtggcccccatttgttctgttttgatggcttttcagtattgtgtgggagggacagaaattgagtagtggctaaagccaatggcttgccagaccctgtctaagaatggaattcctttaagcttcatgatgatactgtagggctgaggacaagaaaggggactggggcctgagggtcgggaatcctgttggtcccacagactgagcaggcttggtgaggctcctgcacgctccaccccaggcctgtgttgcccttgtctgctcccacaccaggagcacagcactcagtcgcttgtggttttacttctcagtttatctgcgaaccactcccgaaatctgctaccagagattaaagatgaggtgccgggaagaggagaaagtcattccgatggtaagagaccagagccacctccacctcatcctgccagccctctcctttcctccaccatgacactatcacgcttatctggagcaaaacccaggaagtacgactgaggcagctcaggcttcctctatggctttggagcccttgtgggtcccagggccactttacttcctatgtttcctgactcaggcctctgcacctccatgtacacacacacacacacacacacacacacacacacacacacacacacacacacacgtacaggcacaccccccccccccacacacccactgtgtatatactcatttgttctgtacagtagcttgtcttcacacacgcacatgcatgcactcacaccccatggacttagacaaatgtgcctttgcatagtagcttctcttcagctgtgatgtcactttcctggccttccttacattgcccctaggcctcctatggtgatagccctcagaacagcatattggcagagtttgttcccatttatctttacaccataaacacttttagattttggttttatttcttctgtcttcaacatgtgtcctggggcctagcacctagcagttgcttagttaatactggactgagtgtgagtactttatgtgcacagttgtccttgaaggatagataggggcaggctcttttgggacatcatggtgctctgaacctaggatgagacctaaaagccaggtgtggtggcacacacctttaatcccagtactctggaggcagaggcaggcagatttctgagttcgaggccagcctggtctacaaagtgagttccagggctatacagagaaaccctatctcgaaaaaccaaaaaaaaaaaaaaaaaaaaaaaaagatgagacctgaaagaccagtctgatcccttaagctcagccaggttttgttttggactaacaagagacatcccagccatgaaggcctaggccttgctctgggcacttcgtttgaaatctcaaagacaggagtgatagaggatggagcattgtgggctgtgctgtaatgaggcttggcatttagaaatgccatgtctggagttcttccaatccattatccaaggggttgccaaggtctttaggacaagcttggctctagtaccagggggagtccaggctgttcatgtcacttcctaatagtccttgagaattctgccccgccctgtccctgtgagacccttggtgggtgggattcccccctcccctctccctacagcccttgtgtttccatggcaggaatacctccatgctattcaccgcctctacgaggagtggctggtcaacgggagcctcttcccagctgcagcccctgttctggtaagtcactgtccctcccagagaatgtcacctggacagagactcagagggactcggacttgaggaggctagttattttagtaacatgtcgtactcatcatcaccacaaagaagtcctcagttactctggacctgggtttgcatttggacctttggggatgatggtgtccattcttcagtgggtgacacggagcccatcgtcacccatcgtcatagttaggtgactgggcatcttctgaaggcatctcagtggttgtcctcagttgtcacacagtggcacctcaggagctgctgaggtgtaaaagtgccacgctcctgctgcctccaagctgcaggccaatgtagcagtgctggtgtgtcctacctatccatatgtcctactgtgtgtcctgtgccccagtgtgctcctcctgaatttcctcaggcaggcaggtgtacttgaggccgtctcacatccagccggtgatcatgggcttttgtttatgcccttgggctgtaggccacagagacatcctggtgctaagagacaggtgataagggacatgtcactgtgggaactttcagagtttattgtttccttcactgtgaaaagcaaacctgagagggctgggaaagtggcagagtggcagagaacttgtctagacattggagtccccgggtttagcccccagcagagccccaactcctgtctcagtgaaaagaaaaggcattgttggtgggatgtggaaatctggttgagagtgtcagttgccctggagccagagtgtgtggttctgaccctcttggcctctcagcctcttgcctccccagtggggatggagatggccagtgcagcctgtgacctgtttgttttatttccaggtgattgaggctgaccacaacttggagaaaatgttagaactctttgaacaaaaccgggcccggatattaactccagagaactggaagcatggaccctaggactgagtgatctacaagacagcgccaggaacagcccagccagggccaggttagctgctaggagcatttggaagaatctactcttaggagggtctgttatctaatcagatctattttctcaatggtcttttcactgcagtacaaatggcttttgtctgtcagatgcttgcagcatacatccctcctggtgcccctcctggtggcttcctaacgatgaagccctgtgttaaaatcactgactgtatccctggggttgttctggatcctctgcatcaggtcacctcatgggtgagggagcagtcttccaccccaggcaaggatttgaagcccagagaggtgtggggactcgtcaagccagagcattgtggagggagctgggaccattcagatacctggtttgggctgcctcctcctaagctgttccccaccgccctgctgctctgagcaccagcccccgcctctgtgagaagagtggacagtttgtgaattccatcatctttcagtaccgggccagttcaaggagaccagacatcactaggtgttggcacacctctcttatttggcatgagcccagggtgtcctggtatgagggtactgtgacctctatccattcctttgtcacctggacctcggtgtccactggggactcctggatcggcctctgcttggtgccagagtccttgaggatgagtcctccccagactctaccagttccctgtcgttttgtgtcagaaaaaagggggttatgggacctggacactttaccctttgctgagcgaggccaagggcagccagctgagcttccaagaccccatcactctctcctgtccttgtgtgaggagcagtgtccccttgctccagggagagtgacagtggccttaactcctttgaagtgtttttccatctgagcagatgtcatggaccacgagcatgaagaagtcatctctattggatcagaaaataccttagctttgctgagccgtaactgtgcactgaaggtgcagctgttacttgaatcagtcatgaccaagagaggccggccattcctcaggaccgtgagactggaaagtcatggtttgccaacaaagacaatttaagccttgctgctcttgacattctagaatggatggagtgcatctggaaaagactggacacagatgatacaggggaatgatgaccgtataccctggagaagcacagcacaggctggggagggggctgcaggggagccctgctcccctgtttagctgcctgggagctagaaagagggccaagagtccagctcttggtcctttctgtttggaccaattcttggcccttttggtagtatgaagagtagcatccagggagattgtccatcagcacctgcagtccagcaatggataaacctgagaaaggcaggaactttgaaccagcagtactcatgggggcatctttagaatttgcaaacgaacagtctagtacttgccctttgctctaccagaacacttgttttggggagaaatgtgctgtttctctttctctctagtagccaataaaattctacagctaaaccatgatgtaaattcattttcattcattcattcattcattcattcattcattcatccatattctctctctctccctccctccttctctccccctctctctttctctccctcttccctccctctccttttcactctccctctcttctttgagtcaggttatattttatagactggcctggccttgaactctcagaagtatttttgcctcaaacttttgagttacaggcatgtgacactatgtctggcttgtgtgttcacttttgagttgactttattttattttttattgttatgtgtttgtgtgttttgcctgtatataaaagtatgcctggtgaccatagaggccagaagagggcattggatcttttgggactggagttgcagttgtggcttgccatgggcatgctaggacttgaacctagggtccctagaagaacacccagcgtgcttaactcctgagccatctctagccccatgtgttcatttttcaaacaccacattttatagtatagtgcgcatggctcaaaaaagagcctgctgtccttgcacttcaacactgcagacaggagatcatctccagtaatggctaaggtttgcagaaccttccagctcaaaagatcacactcaaaacagccagaagcatctttcccaaggactgctatcaggcagacctggtaggggcaggggtcatggagcaagtaccagcactaacatctcatggccagaaaagggcaggtaacacatggtgggccacaaggcctagttcttagacacagggcatcactgccttcagctgtctccgagtggctggtggagcgtggcagggactggcatccctgaagagctagagtgttgtcacttgatcctaaccaagaccacttattcctttcatctgggtcagatttcacaaactgcattttggagggtcccttctcagtgtttggaaaacgacctgtggctaaataaatgtggtaaacactctgccaagcaaggtgcccttgcttctggcctccacgattcctcaggctaagtagtaggctactgaggtgtggtattcctggagggagagagaggtacttcccgacctcgtggactcgcttcctaaacgaaaacattctttttattttgaatcatgtatatgcccatgtatctgtggcgccccatatatgtacatatatacacacatatgtacctgtgcacagtgtgcacggagtccaggagagggccctgaatgccctggagctgtagtttcatgttgtgagatgctggacgacggttccggggatcagatatgggctcactgtgtattttccatagctcctttgccaggtaatgtgaggccggcaatctagggatagttcagtaacttggggctcttctggtaggctaggtacatctccctcttctaataataacgggcaacctagctcctttatatgtacatactgtgcacacacccctccgtaaccaggttacctagcaatatgggctcactacctctgtcaggttgcgcacacacaccttgaaacaatggggtgagtttctcttcctctaacaacaatcagatggtttctattcaaatatattcctagtgtgtctgtgtataaagaatagaaaggctggtgtggcctcagctggttttgggtgtacatgcaggataggcaaaaacacttgtaggcagaatcttctatttttaccatcttatatgcctatgcctagcagggtgtgtgtatgatgaatgtcagatgcattatgagaatcggtatgcccagcagaaagatggttagatgtccaaagctatcaatcaaaacagaaccacctcttagtaacaaatgattctcttgggaaccgtaatcggagccttgggcatcctcacccactcgtcttgacagtgtgtccctctccagtctgttccatcactttgctctgattagaggtacttgctatggcaagggagcacattcagagaccttttagatctgtagggtcaggctggaatgctgacaaggcgcacactttcaacccctctgcctgtaatacacacataaaatgcctttagtacacaccttcaatcccaaacaatgcagctaaggttaggttgtagaaggaagcagccatatttgaaagtgatgtctaattgagtggtagagtgacaaatgagagaaagatttgacagaataggatatgcccaactctcatgaggagagggaaggagaagggggaggcgggggacaggtctaccaggacaatattactgagacagattgcgggtgaagacagaacgagccggagaacgagaaggaaccagaagattagaaacagactgccaaagttccgaggtcaagccgagcaattcagtcagaagctgagagaagccagtttgaatcagtcagcttggagagaagttttgagcaactgagttgaaccagccagccggagctcagaaagaactagaaagagtgagcttattcagcagtaagcctcgaagatgccaattatatctggtaagttacatttacacaaattggtgtgagctcgtcttcttttttcttttttttttttttagccattaagttaatttattgaaacagttgacttaggcatctacagtggtgacttcagcctccactcctggctccatattaatggaagcagtccgctcgacaatctcagaaggacagtgtagatcactgagtagcttgtggatcctcctttggaaatgatcacgtttggaaccttcaccacaaggggtttnnnnnnnnnnnnnnnnnnnnnnnnnnnnnnnnncatggctgaggcatggcttcctgaccgacttgttcttcagcaggagggaacagcggtgagtggggacggagcagactgtacagcgctccacagcccgcaccaccacgtctcagaaagctgagcccttattttcaattctttgggtaaaaggccaagaacctagaaatacttgctgcaaccctgacagttctgaccaccagtaagaaaggcagcaggttcacaggttctgagattacgatacaagcatctttgcatgggaggggagtcctgtggtccaccatcccaagtctagctgatactcaaagtcatacctgtccaatattgtgaaacttggtcgttgagaacaggggtggggggcttctagatggggagatgcaggactttaggtccttggcgattcgggctggttttgtgtgtcaacttgacagaagctagagtcatcagagaggaaggagcctcagataaggaaatgcctccatgagatccaactgtaaggcagtttctcaattagtgatcaatgaaggagggcccattgtgggtggtgccatccttggcctggtaatcctgggctctatgagaaagcaagctgagcaagccaggggaaacaagccagtaagcagcacacctcccatggcctctgcatcagctcctgcctccaggatcctgccctgtgtcctgacttccttgagctgtgaagagcgaggtggaagagcaagcgaaataaaccctctgctgtctacgttgctttctggccatggtgcttcagcacagcaatggaaaccctgactaagacacttgaccacgaagtgtgtccgtgggagccagagtctccactctccctgatttttggaggcagaggctcatgccactcaggctggctcaaacccagtatggagctgagcctggttttgctctgattctctggcctccatctcctgagtgctaacacgcacttgggcatcttaaagacactaatcaccgtgtttgtcttcctatctctttctttaatcccttggctgtgggcagattagttccttgaagagaaggcgggagtggcctccttttccactctcccagacctcgaaaactggcagactcagtttcccccttctcatgggattcttctgtttgctttggatttcttagtaagtgaaccatttccccagatctagacaccttagtccccagcacccattgggcctaagagccacccacttctagttctcaaagggaagccatgattgggaaggagagtgaaaacgctgcgtatggttgctgaagtcccctctccggcctcacatgtttgaacctgtcctgcttctccacggcagcttcctggcctgatgcctgcctctacatttggccggctgaagcctggttatactctctgggccctcaagagagtgatgcgctcagagagaacctgctctcactgatgcccaagcacttagctgcagggaagcaacggggattagtgcggaggttggacaacggctattcaagaacttcttttgtctcagcaggccggaggaccttcactttcaatagccctaaggtcccttgtataacctatgaacttgggctcataaaggagagagatccagttaaggatgcggcctgggcacagggtcccaggcctgagactcagcacttaactgtcatcaagctcatgtgtaacaccagggaaagggctgttttctgtcagaatagaaccgtatgttgttacatgttctctcccttgctctgccgccaaccacagccacttagaggctccagcagagtcctgtccagtccagtcagagtcctgtgagatctgatacttgctttctggaagagagagcatctcttcattctgggtcaggaaccaaccaagtcagacatgggacatttatcgtcattttaccaatgggagaatggagacagtgtggtggtcagagtccagagggacagtatatcaatccatgcccttggacttcctggatctagccacaaatgaagcctgacttatcacttggacaatttagtcacatgacccagtaagtattctttcttgcctcttgcaattgaataaagaagggggtgatggttggggctcagagcctgtcagagggtcaaactctccattttaatagaaaacagccctgcagcccctccccgggccccaaggactcagcctgatgagggtgacagtttggtggctgagactataacagggctgccgccttggaatttcttggaaatgtgctgagcagacacagctctgctacagcccagtggtcaaaggtatacctagctcccaagctcagacccattaggctttggctagataagggctcttgggctccagagagttagcatgggcttgggaagtaccgcgaagctaggcagaacagaacccaggacaatagatcgctctctgatgataaagcggtggcctttatatccagtccttggacaaccatgttagtgtcagaggatgcagacgggagctgggagcaggtgtgagctgcacctggctgtgcaaacgagagccttgcatggagagggtacttgtgtgggcaccaaggttgtctgagtaaacgtgtaggaaggaggagggagttatgtaatggtgccgtgtgcatgcacacggtttgtatatatgaacacaggcttaacccagtgatggtggagggtgcgcatggtagccatggactgctgttagcctcgctagtgacttgttctttccgtctgtgcttcagtgaggcctggtgcttagcagtggcagaggcctctggttgctagccaaagcctgggactttctgtgcccatccataatgattcagctacggtatggctttgtctgccacccgctgtggcttccctgtgtgaaggcctcttctgatctaaagagcctgcatggcaggaatcaacactctgtaaaaggctgcctcaaaacagcgctgctgagagccaggtatgagcgacacggagctgtcacctccgaatgcctgacatcgaggccttcaaggcatggtgtaccctgtctcttgggttgccactgggagagtttggtggcctgcatcctttcaagctttcatctcccgccacctccaccttctacttccccgatgccatttccctgaccggcgcttttgatagtatggccatgtaccaggagttggtcctgcttcttcctggcttaccatccgaatgatggaccatcacatgccatctcccagggattccaggcacccagctgttctccttaggccttgtccctggcaaacagagggctcaggctctttgtaggaatgggcagagccctgagcaggatgcctacagcccaaggagtacgtggatagaagagacaggcagaaccaagaggctgagagtcccaggagtttaaatcgttagaatgagcgtcagtgtaggtggtccgggtgggagtcagcatgtggctggacaccagcaccataaaggaggtagagccccacagtgcaacatagtagcaaacagaacagagggccaagtgttttgcatagagaggagaatgcagccaacaggaattatcagaaaatgagacccagagacaaaatctcctcttgaaaatcagcggtataatacaaacccgggatccaaacatcaggctcatatagctgtgagtgtcccacagcagcagtgggcttaaaaataaaagggatttcctcctcctcctagggtagagtctgtgacaaatgaacagtggcagcagagagccagcagggggcagtgtgtgcttgagttaggccagttgcaggacagcaggcctagggatttttcagaaggaacctgtgggtccctgtctcataatacccccgacacccccatctgcctcactttgttcagggtcacaccccaattttagggtgtgatttttgggattctctgtgctagcggaaggaaaacatgtccgagaaagacagtctctgtgcgtaaaaagaggtcaccaggcaaagcctctgtctgaagggcaatgagaaagatgagtgtttctgcagagggaagcatggagcatatttctattttcctcagaaggataagcctatggagtactgaaggccaaaagatggtaccttgtgtatgtggagtcaagttctgaaattggtggctcatcatatcctcacatcagacaggtctcagaggagtggcagcaggctccatatgaagggggctgggagatggctcagtaagtgaagtgcctgtcgtgcaagcaggtccaagtaggaggatctgagttcagattcccagtaccacataaagtccaggtgcacaagcacagcggggcacaggaggtctgggggacttgggtggccagccagccggtctaaactaataaggaagcagagacaggaggatcgccccctgggctacatagcaacatttgtttctaaaacccaaacacaagcagagaaacaaaagaggaaatcccatgagactgtgcagacaccccctccctacaagagcgccacctggcgcaaacttgagaaacagccagctgggcgtctcagcgttcagaggggcatacttaagactgcctgtttacagggttcccttcaccctctgaatttgcagccaccaggaacccgccggggcccctatacacccctcgaaagtatcacttccttctacgtatttgttgataatgagcatttattttgagtacagaaaagatacattgctgcttattcagcctaacctaggaaggagaaaagctgttccgcagatccctccgacgtggtgaataggcggggatgtttttctgcccccaccactttccagagctctagaaacagactgcctttcttaaaaagagtctcatccccggggtgtgttttaaaggctggacagtaccacagacagacatctttgcctagaaagcagaacgccacaaaggtgggcaaaagggcttgtaaacaaggctccctcccccaggcctgggactctagggtgctgcccgcagcctgcagccgctgccgcctagatgctacagaactggtggttgggccctttcggctctgcatcagaataaatgctttctctatagaaaataaaaatccttgctacccctctgcttaggaaagggattgatgaattttcttagcccttcattggaggagttgaatgtgggaaggggttcagtggggatgggtctgctcttctgggatgaccgtcagaaggtaggagtccgggaggcaggaggtctcactccctgccagcggcagtgctgacaggatcctcctcaaaggtgcttagctttggcaagccgggtcttcaaagatggcctcgtcaccttatatagtcttcgatggagatcacatcgctggagctcaaaggctaatatctgagcctatctccaactggctgcctccacacacctgcttccgtgatgggatgttggcagcagacactggtctcatagtgacatgaagttttttttgttttttttttgcttttttttttttttttttttttttgtggggtacatgtgtgtgtgttgtctctgtgtatatcccagagaggcaaggccagacttcatcagcccagtccccagctgggagttaccaccctggatgacagcgctggctctttggttggtctgagacctcttacacccaggtcaccagagctggctgggcacttactgagcagtggactcttctgtgcctcctctgagtgatgtctaggaagcattatgtgtgtatggggctgcccacaccttgtttctcttgagctctcaatcctggcacagacattagaagaactgtgttgttcctccacgatacaggcccaagggcctgtctccccctgaaacttagggtgggtgtctgagctaaccccactagcaccgccacactaaggacatcgagacaggctaaatgggctgtgaggacctccaggtcatgcctaagccaccagacctgtttctctcccacctcggaagtggcaggacggtgacattgtggctcttcagccctggagttgagagataggcacagtgcacagtgggaccttattgggacctgtctcagctcccaataggataagccctggggtaggagttatggcaggaagctgaccaagcagtctctgcaggagaatcagattgtggccatagcctagaggaggctggggagaggatagaaaattgggtttcctatctcacctctgcccagcactgttcagagaggcacggccaccaggcaccaggctggggaggaagagataccatgtagggaacacctcatccaaagaaaaccttcccaggtgagtttgtgtagtagtgggacatgtgcatatgcaggtgtctacatatgtgtgggttgtgtcagtgtaagcacttggggatatgtcagtatatattgatagtcatatatatgcatgtgcatgggttgtgtgtgcacctgtatgcctggaggagagagggtagcctggaaagaccagcggaatttatgagcttggccactcacacaatcctttcagggctgggcatcggagcctgggttgggatgggtgagccctgggagttacttggccatggttctggtcctggcaatggcagcaggtcagatggagagcctgtcccacacacagcttcataaggtggcagtgtgtccatggagacagtgtggagtctgctctgaccctgggtcctctgctcttgctgacggtggctgcggctctggccgctgtctgagtcaagggcgccattcagcctgggacaggagtcagtcatggagtagggcggtggtgcatccgtggggacatacagctgagtggcccctggtcccatgcattcctcatagctgtgagagaagagttttcactcaggggttgtagattctgagaccttcgggcagatggaagagtctgtattctgtatggcaaggagctgccctcattgtagaatacagccaacttcatatatgctggctcccatgagaccctctagtcctcagggaggacagtctgacacccttagctgggtcagacttgaccctcacatcccatgtgaaccaaagcaagtccttacacccctgcccctctctgtggggttttagattccctggagcaagaacagccctgtctagggaggagtcccagcctgggcactgtgaatgggctcggtaggacccactgagacatctccactgctgttttctagatttaggaatgagtctctagccctgaaaccat

SEQ ID NO: 1212 - DNA, 2385 bp, Mus musculus
actatgctgctgcggtcgctgcgtagttgggctgcccggtccccgcgtagcgtgggcccggggagctccgggagccccgggagcctcgattcgggcgccgggccgctgtgggcacctcgccgcgcctggcctccggataaagatagagaaaatgataaggagaaaaaagcagtggtttgtattgagggcaatattgcaagtgggaagacgacatgcctggagttcttctccaatacaacagacgtcgaggtgttaatggagcctgtgctcaagtggagaaatgtccatggccataaccctctgagcctcatgtaccatgatgccagccgatggggcctcacactgcagacgtacgtgcagctcaccatgctggaccagcacacgcgccctcagatgtcacctgtacggttgatggaaaggtcaatttacagcgcaagatacatttttgtagaaaacctgtatagaggtgggaagatgcccgaggttgactacgcgattctgtctgagtggtttgactggatcgtcaggaacattgatgtctctgttgatctgatagtttatctgcgaaccactcccgaaatctgctaccagagattaaagatgaggtgccgggaagaggagaaagtcattccgatggaatacctccatgctattcaccgcctctacgaggagtggctggtcaacgggagcctcttcccagctgcagcccctgttctggtgattgaggctgaccacaacttggagaaaatgttagaactctttgaacaaaaccgggcccggatattaactccagagaactggaagcatggaccctaggactgagtgatctacaagacagcgccaggaacagcccagccagggccaggttagctgctaggagcatttggaagaatctactcttaggagggtctgttatctaatcagatctattttctcaatggtctttttcactgcagtacaaatggcttttgtctgtcagatgcttgcagcatacatccctcctggtgcccctcctggtggcttcctaacgatgaagccctgtgttaaaatcactgactgtatccctggggttgttctggatcctctgcatcaggtcacctcatgggtgaggggagcagtcttcaccccaggcaaggatttgaagcccagagaggtgtggggactcgtcaagccagacattgtggagggagctgggaccattcaggtacctggtttgggctgcctcctcctaagctgttccccaccgccctgctgctctgagcaccagcccccgcctctgtgagaagagtggacagtttgtgaattccatcatctttcagtaccgggccagttcaaggagaccagacatcactaggtgttggcacacctctcttatttggcatgagcccagggtgtcctggtatgagggtactgtgacctctatccattcctttgtcacctggacctcggtgtccactggggactcctggatcggcctctgcttggtgccagagtccttgaggatgagtcctccccagactctacccgttccctgtcgttttgtgtcagaaaaaagggggttatgggacctggacactttaccctttgctgagcgaggccaagggcagccagctgagcttccaagaccccatcactctctcctgtccttgtgtgagagagcagtgtccccttgctccagggagagtgacagtggccttaactcctttgaagtgtttttccatctgagcagatgtcatgacccacgagcatgaagaagtcatctctattggatcagaaaataccttagctttgctgagccgtaactgtgcactgaaggtgcagcttgttacttgaatcagtcatgaccaagagaggccggccattcctcaggaccgtgagactggaaagtcatggtttgccaacaaagacaatttaagccttgctgctcttgacattctagaatggatggagtgcatctggaaaagactggacacagatgatacaggggaatgatgaccgtataccctggagaagcacagcacaggctggggagggggctgcaggggagccctgctcccctgtttagctgcctgggagctagaaagagggccaagagtccagctcttggtcctttctgtttggaccaattcttggcccttttggtagtatgaagagtagcatccagggagattgtccatcagcacctgcagtccagcaatggataaacctgagaaaggcaggaactttgaaccagcagtactcatgggggcatctttagaatttgcaaacgaacagtctagtacttgccctttgctctaccagaacacttgttttggggagaaatgtgctgtttctctttctctctagtagccaataaaattctacagctaaaaaaaaaaaaaaaaa

SEQ ID NO: 1213 - DNA, 813 bp, Mus musculus
atgctgctgcggtcgctgcgtagttgggctgcccggtccccgcgtagcgtgggcccggggagctccgggagccccgggagcctcgattcgggcgccgggccgctgtgggcacctcgccgcgcctggcctccggataaagatagagaaaatgataaggagaaaaaagcagtggtttgtattgagggcaatattgcaagtgggaagacgacatgcctggagttcttctccaatacaacagacgtcgaggtgttaatggagcctgtgctcaagtggagaaatgtccatggccataaccctctgagcctcatgtaccatgatgccagccgatggggcctcacactgcagacgtacgtgcagctcaccatgctggaccagcacacgcgccctcagatgtcacctgtacggttgatggaaaggtcaatttacagcgcaagatacatttttgtagaaaacctgtatagaggtgggaagatgcccgaggttgactacgcgattctgtctgagtggtttgactggatcgtcaggaacattgatgtctctgttgatctgatagtttatctgcgaaccactcccgaaatctgctaccagagattaaagatgaggtgccgggaagaggagaaagtcattccgatggaatacctccatgctattcaccgcctctacgaggagtggctggtcaacgggagcctcttcccagctgcagcccctgttctggtgattgaggctgaccacaacttggagaaaatgttagaactctttgaacaaaaccgggcccggatattaactccagagaactggaagcatggaccctag

SEQ ID NO: 1214 - DNA, 59554 bp, Homo sapiens
caaacctcactcttgccccagctcttgttcacaactcaatacccaaccattcagatacacctgcaggtcctggagggtcatgctctttctccacctagaccctcacatatgctgctgcttttctagcagaaaagcactttcccttccctgtatcagtcatctgctaactacgtttcatccttcagccctcagtttgggcactttttcttcacagcctactgtgacttggtccctttcccttgctgggttgcatccacgccatcctaggtgtatatctctcatagcacctatattctctgtgttgcttcctgggtgcatttaaagtttctgaggtacaaggtttttgttttgtcttaaccaaagaaccaattacagaatctaggattagcaaatacttaacatttgctgaataaataatttcattagatcaagatcagaaaggattctgggtttcgtaatggagcaaaaacttagttacccatataacaccccatttctaagagatacaatatcagtaaagtttgatccttagagatttggggactattcctttcagtgtgctacatataagctactctctctcagtgtattctgttacactcctggctcccagtttattactgggacatgtaagaaactccaaggaattatgtttggaaaaaaagaaaggctaaaatgtgttagttttattaaactctagagaagcagagtgtgaaaagcaactatacaagacctagaggatgtggaccagtgttcattatcctcttgaagaaatctttagaaaaatttagtttaaccctttctgccactaaatgagggccaactgaggaagactttgtaatctcttctcctagacctccctccaacgaagtccagctctgaagtgtacatcaagtagttttgagaggagaggttctatgaagatcctatttcccagcttttcccttttaggacttttaaaaagcttatgatttgcctgaaatgcttgccactggccttgaaggtggttccagaaggtaccatttaaaggcatgcttatggtttaagaatagctctaaagtcttttcttgttaataggaattatcagcttggatattagcactgtggcatccaagaggatgagaccactgcagccaaggaagacatggcagcaatcagtccagccaaagaggagaagggcagcagggggattcaggagggagacctacagagacaggatgctgggaatgagacttgcaagaggacagaggagaagtcactcagtttttcttagaatcagcttctagtccaggctgaggggctgcatacatcttaacgaataacttcaatctgcccaatttgacagttttcagaaccatctgggcattccactgggcagttattcctaattatatgagtatggcaggttacagtctatatactatgaaatataagaggtgccaacattatttagtaataactacagatattttcaagtgagataacattgtactttagcctccccaattagtttgattttccatttagtgaccaaagatgtgcaaggatagatacttgtgtatctgtctccatctctatcccaattttgaggccatattaacatgcatccaaataggtaataaagattaagaatgcactacaattttgttaacatggtcctaaatttaaatttctttagaagatctatccaagtgaattctaacagaagcgtcagccacatctactgatagatggtgcagagaacttatgctctgtggctgccctgcatccttgagaccctctcccaaagcaatacagggcacattagcaatgggtagagctcctccttcctaagcctaacagagattaccttaaaggtttaagagaagcaaaaaacagagttcattagaatatctcactatggtaggaaaaagtaaaatttaaggatgaaactgaacacttacaagcaaaggccaaaataaccacttcattaatcgatcaagtctgagtacatataaaagtatgaaaaataagataacggtgacttcaaatccagtgataacaatatatggttcaggggcttgtgcgatgataaaaaaggtcatagatgtcacagttagtgcctagaagaaaaaaacccacgatttattcagtgacaactgaatacaaatttaaactgtaaaaatgacaatttctaaaataataggctgggcacagtgggtcatgcctataatcccagcattttgggaggctgaggtaggaggatcgcttgaagctaggagttcaagaccagcctgggcaacataaggagacctcatctccaaataaacaaaaataaccagatactggggtttctgccatatacacacacatataaaacagccatgcctaaagtgtatgatattgacttctctttgtcttttagaggactgggtattcctctctgttttaagtccaattaattattcctcttgtgcttctgacactatcacttcccacatcagttctcttgatgtttttccaccaagtacctccgttcccccttgtactttcaatctgtcctctgctagctccttttctcatcatcctagaaacatctcagttgtgttcttttaaaatacacacacacatactccttccttttatcctgctccccacagaaacccttgttctgttttctactgttgttatgcttcttcaaaaagtctgtatactggctgtctataatttcttaccatccatttatcactccttaattcttaacaatctggagtctactgtcagatttaaacttagaatgctgccatgaaaaatactgaggagcaaagttcaaaacaaattgtcagggtgggcgcggtggctcatgcctgtaatcccagcactttgggaggccaaggcaggcagatcgcctgaggtcaagagtttgagaccagcctggccaacatggtgaaaccttgtctctactaaaaatacaaaaattatccaggtgtggtagcaggtgcctgtaatcccagctactcgggtggctgaggcaggagaatcgcttgaacccaggatgcgggggttgcagtgagctgagatgccactgcactccagcctgggtgatagagctagaccctgtctcaaaaacaaaaacaaaaaaaattgtcagagaaaaacaattctgatgtttaatagctttattaccaaagtaccattttttacacaccccacctaaacaatgcaatcagaatctatgctattttaagtggaaaaaaaaacataaaaaactctgaaatttcttcatttccaaatgaagatacagaacatggcaatgttaagtgaaaaaaatagctggtgggtcccaggggagttctgtcaatgttcttaggaaataaagctctttccaaagctctgtgtttttggtaaatggtttggtcaagagtcttccctggctagacttttaaaatatcctgtcagctggtaacatatacatactcattttaagtccatataggttacttattcataattcttccaattactttattagcataaatatgcctttcttttaaacttctaaactgatcagtttgattacaaataactagttactaagtaacttcattctttataattaatataattactattagcaacacataatctcaaactactccaattactctattggaccaaggtcttcagcccacagattatgaaatgaagggccactttttcagtccctatcctctgtaacctttttcatcatggtgatttgcactggtgattactccatttccttaaacctttctatggtttctgtcaaactgtgttctcctgtgatttatatttacagttcttacatctttcctaagctcctggcctttgtttccagttatcttttacatatctcactaataatatttcagacattaccactctatggatattgcttttgctaacatcagtgatttcagaaatactaaatttaatgaatgcttttttctttttttccagtactttgagctgctgttttacaatgaacatttttcattccttatcctagtggacccctatgacgttattgccattggctgtccttcccctactagtgttttcttttggctcccgtgtcagttctccgagattttaaacctccgcgactgttctctcttggtgggttcttctccttttattctcccctgtaaaatgctgtcattctcattccactcaatgagtctgggtctctaacccaggtccattctccacatttcacaccaagtagccatttagaatccctatctggataacctacaggaatctcaattcaccatgtctaaaactgaaatcccgccccttcctcctggattcacaacctcaactggtggtaccacaatctaccttatcacccatgccaggaacctaagatcactgttcctacccattccccaactgatcaataatcgggtcctgctaacttaatgcctaaacattttgggcactccctcctcttcatccttacaactactgcctttcatcgtcttttccatgaactatcatgatgaaatttctaacatgcaaatttgtttacgcatttcttcatctatttaaaattcttcagtggctctccagggtctttagagcctgcttctcaccatgttttcaagatcttccacaatttggctcctgtctacttcttgagaaaagacttgcttcacaatttatccacatgaatcaaactcctgatccttttttcacatttgctttatcaataggctgtctcatctcagtggatggtgactccatccttccagttgcttagaccaaaaacttcagaagctgtcttggactcctctttttccccacatctggctcatcagcaaatcttgttggtgctactttcaaaatattacatcccaaatgtggccacttcttattacctgctttgctaccaccagccaccatcatcatttcttgcccagattactgcaattggtctccttggttttacctttgcccctgcagcaatccccttctgtccttccctaccaatctactgttaacatagcagctagtatatttttgtttgtttttgagacggaggctcactttgtcacccaggctggagtgcagtggggtgattttggcttacctcaacctctgtctctccggttccagtgattctcctgcctcagcctcccgagtagctgagattacaggcatacgccaccatgcctggctaattttttttgtatttttagtagagatggggtttcaccatgttggtcaggctgctggaactcctgacttcaaatgatctgcctgccttggcctcctaaagtgctgggattacagggtgagccaccgggcctggcctagtatacttttaaaatgtaagttagatcatatactttacttaaaaccttcctcatcttcactcactcaccccagtccagttacgctggtttccttgctctttcttgatgccttcccacacattcctgccataaggccactgcactggattttctctgcttcaaacactcttcttccaggtattctcatagctaactccctcatttcactcaaatctttgatcagatgtcatctcaacaaagcctagaattctattcattacgcaacttttctctgcaactccttccccgccttacactcccttacctggcttttacttttctcgttccactgcacgtaccaccttctagaatactaaaatttattgtgtttgcttcccctgccctcccatcccaataatgtgtactccacgagggcagggatctttgttttttttcactagtatttttcaagagcctggaatagtgcctggcacatgacaggcattacacagattatttgttgaataaatgaggtaacactcaacttcttatatttctctgcatcaattgtgctattttttgcctccatgcctttactcaggtggctcttagatccaaccctagattgctctaggaagagcttttttctgacacctctccttggttagacgcctcgcttctgtgttctatctccatcttatcacatatcttaactatctgctcatgtgtctgtctcataattaaactgaagaactccatgagtcagggatttttgtcctggttcgtctttgctgttccagctcctagcccagagtttggaccatattaagtattcaaatggtttgttgagagaattaatatatcaaaaactaaccattctcacaggaccattctcacatggttcccccttcagtgttcaagatctttcctttttcagtgttcaagatcccagaccttctggtcacttttgccctgagtatttactcccaatcaaaagttatttctccttccctcaactccagagtggtttctaaacctcttatgtatctcaacttacatgatatgaaagctacttctcacaatcacagacttttggtgtgagaaggatcttatatgcactttgttcaacccactcaccttaagtttgagtctcctttataacatcctcaccaagtgctcacatatgcctggtacttttgtctgggaatgtactgccttcccaagtggccatttagttttgggagctctcccaatataagattcctcctcacattaattggaaatgttttccttgtaactttgaactatctccattttgcctctcccatgtcaactctttaaaacttaaaatgatttattttttccttccctgtaaggtttctctgtgaattcctccaatgatgagtttctagaatagattccttcaactaggatagtttccacttctctaactagctaggtcacttctctccaaatgatcaacttcctccaaacctgttcagaagtgactgcagtgctcccggtaggaagtctgctcccggaaacgagcagttctctccttgtcctggttctgggctgtatcagccttgaactcagtcacatcaaacgtctgtctcacggaagtccacacaacattcaccgaaacccctgaggcttttttttttttctttcaaatcttgtgggcttctgagaggtataactgcagttgtctcgcctggtaacctgggtacccggtttgtgggtccaaatgtagaccatttgggtagatctgatttttaatttaaaaaaagggtttttttttgtttttgtttttaaagaggcaggacctctctgtcgcctaggcttgtgtgcagtggtgcgatcaacgttcactgcagcctcgaactcctgggatcaagcgatcctcccgtcccggcctcccaaagtgctgggaccacaggtgtgcgccacggcgccccgccctctctggttttcatgaatgagtgtgtccctaaaccctcctaaggggaggacagtgccgtatctctctccttcttccccaaggaggccatgccttgcctttcaatcttgatcaaagcgaggttgaaaagcaaacaggcgttcagctttgcacttcacacccacatctcccgccccccagcagcttcatcagcctcccgccctccgcggcccggcctcaccagccgcagcatcttcacgtggcctttcacactgaagcagaaggggcgatgttttattttcggctgcacgttatccatcgcgtctgcagacccagcagcagcactttccctcaactcttctcagctggctgcctgagtaggttctgcgaagcgatagcaaccgccaccgcggcggagcaccgccctcccctacttctcgcccagctcggcttcccgctctcttgcgcgcatgcgcacggcgccgcgttcgctctcgcgcatgcgccccaacgggatcccgcggccgtccgctctggcttgtgctgtctttcagttatcgcgtagcacattagcggacctagagctgggcacatattagcggacctagaggtgggcacgcaggccagcgccctgttagcccgccgtgttctggcctggcgttaatgacggcagcactccagctctcctgaggagtcttcctgtcgggaaatcctcccagggttgggagcagaggagagggagggggctgtagaaatggcggccccatctcccaacaacttgggcattgtgaatatcacctccttaaaggggatctcctttggtcatcccgtctagagcagccaccataacttctgagcgtttattgctagctgatatatatcagaaaaatacaaattccacaaaagcagggactggtctgcttctctccctgcagggcccaggttctggcacatagttggtgcagaaagtgtgcagcctcaggtcctatccaagcccccagggcatcacactcgggacttgttctgcatatttttacttttgcctcccactggtactagttcttccgtggaacagcctgagtcccttcagatacttaatgttttttctcaagtgctgccatgaagccagatctccaccgtcttggggcattcctttttagggatgggaagtatatgtcgctccttttatgtgatttacattctatcttggataatttggccatcaccgtagttcattcagatctgtttggatcctgcccatctcagcttcagtccatttcattcttttaaatctgatcgacagttacctccaacagcttcatcacaaatcactcacaaaaatggccttaatcctgaagtttatttacggagagcacacttgctaggtgtgtggcagatatacaggaagcacaagatgaggcagcagatctagaggcaaatgacttccttctccctgcctagtggtgactgccagcatcacgccctcccgggagaggtgagaaacccctccacgcaagcactggaaccttcacagtcaagagtggcaacagctccggttactggacttgggcctgttgaattctaatactctgtgactccacatctgggctgaatttttgctgagtatgatggaatttacatgcttcctccctagcccctacttgtctgtatagttggaatatttggttgcctcctctggagggatctagtacgtttagagtctagacgctggaactgtcaaagttcagaggaaagagctccagctgcaaagcaagagaaatgggctggaattctagcttcaccccttaatgaatgcttctgatttttttttttttttttttttttgagacgtagtctcactctatcgcccaggctggattgcagtggccacgatctcagctcactgcaacctccgcctcccagactcaagcgattctcgtgcctgagcctcctgagtagctgggattacaggcgtgcgctaccacgcccggctaatttttgtatttttagtagagacagtttttggccatgttggtcaggctggtcttgaactcatgacctcaagtgatctaccttcctcggcctccgaaagtgctgggattacaggcccgagccaccgcgcccagccgcttctgatcattaaaaaaaaattttttttttggcggggggaacgaagtgtccctctgttgctcaggctggagtgcagtgcagtgatctcggctcactgcaatctctgcctcccaggttcaagcgattttcctgcctcagcctcctgagtagctgggaatacgggtgccccccaccacacccagctaatttttgcatttttagtagcgatggggtttcgccatgttggccaaggctggtctcgaacttctggcctcaggtgatctgccttccttggcctcccaaagtgctgggattacaggcgtgagccaccgtgcctggccaaaaaatttatgttttaaaaagactagtcaagtgcagtagtgagaaggggggaaagagtagagcaaggagttatatctgttgcttctgaccattttgaacaagttacctaattctctgaggacaagctcggagaatgggagagacagttatctatttgcagggttgttgggaggaataagtgacatcatgagtgtgtgccaggtgtctgattacagaaggtgttcaattaatctgcaatcattaattaacccttcagtcgctggtattatttgccatccatcctccgagtgttgccaagttatgggtgcgttctgccagcgtcctagcagtggtaaggcttctggctgccagcggcgaacctctcccttcgagtatttctcctcttgctgagatgaaatgcgaccgggtctctttaagggccaggcgccgggatccaggcggcgcccaacggctggactagcagtcgtccgcgccgactcgcacaagaaggaaccccgggcctctggatccgctcgcccggctatgctgctgtggccgctgcggggctgggccgcccgggcgctgcgctgctttgggccgggaagtcgcgggagcccggcctcaggccccgggccgcggagggtgcagcgccgggcctggcctcccggtaacgcgcgtcttggtcccgcctcccaggagcccctatgcgcccacctactcccggcccctcggcttccggaacccgcccgagcccgaagcgcctcttccgaggcgcgggatttcctccccggctgcggctgggacgggggcggccatcggccgttacccgggcgcgagaccgcagcgagcgctgggggcgctcggctttggttctgggatggagagagggcctttaaagagcaggacggacacgctctgaacattccggcccaaactcggtcccccgacccatttcctgtcccgattctttcgaccttgggggcgatggggactgggagctgccttaagccgattctgctcacactctggtgccagcgtgggggaggggggttacgcccccggcgctctcctgccctccctgggagtggggacccacacagaaacgggtcactgttacacccgggttctggtgtccgccatatggctgttgagagacgcctcagaaccacctgtgggacggatgggcagcgatgcccgccctgggcctagaggaacacctgggtcccaggcccaaaaccacgtccgccgcccactcttccccgtgcaccgcgagtggaggctgttctgcctttccacttgcttaacatccagtctgtgaagatctaaataaataacgtggaaaatgcaaagtataatgtactaagtgaaagaactcgagcacactgggggtccacgaagctgcagctgcagcccagggtggcacatcggcgagacggtggtgcgcgcctccaatctcggagggcgcccaaaatggaaaatgtttttaggccagggagtgagcataaacattagtgtttttgtggtcatgtagcaaattagggcagaggagagttatttaaaagtgagtttaaaaactgatttcctttcttttgtagataaagaacaggaaaaagagaaaaaatcagtggtaagtccctcttttatgtgtactctctaggataatttggttttttgaagaggagagagaaaaaagcagagtaaaaagcaaaaatacattccatagtaaaaagcaaaaatacaagaggatctccagggagaaggaagtctgtcaccctcctagaaggccacctctgttaccaatttcttgtatctttccccagagtctgcacagataggagcacacaagtatttgtatccttcaggtagatttgggctgttaaagcttaagggatgattgtgaaaggatttgaaaaacgctcattgtgttgtggggaaggtcagtttcatcttgggttgggcagctcagatgtgagggaagctctgtccaccaccaccctctccccccagtgttgagactggtgggtgggcaggggatcagagagaaaccattagggtccacagatgtgggttcagttatcagggtggctttgagatgctggctctgggctggggctgtgactagtgtgaggctgaaggtcaaagaagggtcaggttggtgtccatggggatattgggtgctttagctggctggggtagggagtgatattttggtcacaaaccaaggctcaattccttaaaagaactgaaagtccctagctccagtggctgggaagggggtggcttggcaagtggtggcaggagtaccgtggctgggatctgcagagggtagacagtgcgggcaggcccccagcgtactcagggtggtggagagctcttgggaagtagtgaaaccacatagagaggattgaaatgcttgagatttgtggaagtttgttgaaattaggagaaggatatgccagcgggtgccatagaaggggagggaaatgcaaagttgagctggatggtaattaatgtatttttgtttgtttatacatttaagagacggcgtcttgctgtgttgcccaggctggcctccaactcctgggctcaagtgatcctctggcatcagcctcctgagtagctgtgatgacaagtgtgagccactgtgcctggctatttattagttattgagctagcattgatgtgagctgggcctgttctttgtgctttttgggtgtggtttgatgtgcccccagacacacaatagctagttcatagaaagtggtatggagcctgcattcaggctcaggactgtttgtaaacattcaagtcctgtgagctcctgtgtgggatgcactgggctaggacctgggcacctggcaaacagccctgacatttgggagtctgcggtctgtctgatgggggaggtttgtctgatgggggaggtctgtctgatgggggagacagcagtaactaggagaatggtggaactagaacagcagtgagtatggtggctgtgagtaggggggctgatgactgagaggagctttgggaagccttattgcctgctgggagatggagcagagtttgaggcaggagtgttggaacaggtacaagtcacagaagaatgagaacctgcaggcctgggcttgtggccagtccctagagaggtggctggggagggctgggggataggtgcagagggactgagaataggtcctaaaacccagagtcactgaagggcctcacccccacccagcacgatccgggttgcctctcagggagcgatgtggggaaccatgagtggagggcctaactgggtgagactggaaggggagagaccttaactaaactagagatggcacagagcccgcagctgagtgggaaagcagggcccaggggagttgctggttggttgactggtgttggtgggtgaggagagatgtccagagtgttaaaggtgtctgggtggatggtgcagccattacatggcacagtttacaatattagataattgagtatcacaacaaagttttttaataaaataactggacagaacttaacatccaacagggccatacctaatggctcatgcctataatcccagcacttcgggaggcaaaggtgggaggattgcttgagctcaggagtctgagaccagcctgggcaacatggcaaaatgctgtttctacaaaaaatacaaaaaattagctgggcatggtggcatgcaccagtagtcctagctactcgggaggctgaggtgggagggttgcttgagcctgggaggtcaaggctgcagtgagctgttattgcattgctgcactccatcgtgggcaacagaacgagaccctgtctcaaaaaaaaaaaaaaaatcaaatagtagggagttcaataaattgtgacaggtcttatataatggattatgtaaagccattaaaaaccatgtttttgaaaaatatttagtgacctgggaaggcactcactatgtaaaagatgaaaaaaaaaaataacaaaaccaacaaaagtatatgaagtatgatcccaaatgaaaaaaaaaactgtccttaggaaacaaacaggaaagaaatattataaacattaatgccgaaattctcagtctagttaagagatagatgtggggttaacaaggagcatgtaagagagagtttgtggtgtgatggggtaaaagtgtcttcccttagttatttgaatgttaaatgaaattcagctgggttcctttttaaaacagctttattgtaatttgcataccacaaaattcacccatttaaatgtgcaattcaatgatttttagtaaatttacagagtaaacagcactacagagtaaacaccactacaatctaattttattttattttatttttattttttattttttgagacaaggtctggctctgttgtccaggctggaggacagtggcacaatcacaacttactgcagccttgacttcctggtctcaggtgatcctcccacatcagcctcccaagtagctgggactacaggcacataccaccattcctggctaatttttgtatttgttgtagagatgggatttctacatgttgcccaggctgtgcaatctaattttataacatttccattactccaaaaagaaaccttgtgcccatttgcaatctcttctggccccaggtgaccactaatctacttcctgtctctttagggatttgtgttttctggacgttccatataaaatggaacatatagcgtgggatcttttgtatctggcttctttcacttagcacattttttttttttcttttttgagatggagtttctctctgttgcccaggctggagtgcaatggcatgatcttggctcactgcaacctccgccgccagggttcaagccattttcctgcctcagcctcccaagtagctgggattacagtcatgtgccaccacgtgcagctaatttttgtatttttagtagagtcggggtttcaccacgttagccaggctggtctcgaactcctaacctcaggtgatccgcctgtctaggcctcccaaagtgctgggattacaggcgtgagccaccgctcctggttgcttagcataatattttgacatgcatctgccttgtagcacgtattagtatgtcattttttcctatagctgaatagtattcatggcgtggctgtagtgcactttgtttatccacttgccagttgttagacgtttgggcaagtttcttttgactgcagatttctcagggtctttgataagacaggatatttggattctccctgtggaggctttggcacccaagccagtttgcctctggaaccctgggttctaattaaacatccaaatgacaatgattgctgagatttacgagtgatttttattttcttcttttagggattgtgtaataaggtttgatcagagaaatccaactgataaatacatatatgcatattcataaacatatacatatattcatgcatacatacattcttgtgtgtgagaatgtatttctttttttttttttttttgaagacagggtctcactctgtcacccagactggagtgcagtggtgtgatctcggctcaccacaacctccacctctcagctcccaagctcaagcgattctcttgcatcagcctccccagtagctgggattacaggcatccgccaccacgcctggctaatttttgtatttttagtagagacggggtttcaccatgttggccaggctggtcttgatctcctgacctcaaatgatcccctgcctcggcctcccaaaatgctgggattacaggcgtgagccactgcgcctggccactgagaatgtatttcttagcacaagaatgcttaatttccatttttaggaaagattaaatattgttacttataatagggatagatggctcatcacagtttcagttataatcatggaaaattggactcaagggctcatagcagaggaaaatggagataaattgtagcgtaatcacagagtgttgggccaggccggccatgtgctcccacagcatggggaccatctccttttcacagtttcctgttgctttcctccacacactcatgagctctttggccgttgcaacgaggccctgagtacacagtgcctggcacagcataggccttcaataaacagttgaaacgtgctcaaagatgaggactgtatagaaaataatatttggcatgaaatatgctcatatgtcatggggtttatctcttagtattgggattatgggtgatagtttctcctttttgattttctgtattttcttcaatgggcatgcacttctcttataatatttttagacatcactttaaaaagaaatgtaaagactccctttgcttgcttcctgttcccccttccatttcaggggaactttgtgagattcttcctgcgttgcctgctgtaaaccggagggcagattggctgagctcattcagggcctgacattcaccagctcttcaggatttcatgctggggataggaacaagtttctgggagaagggcttatctgaacaacctgttaaaatgcttcaatgaacaggaaagaaaaaagactgtagagtgatgtctaggttgagctctttttatatatctaggaagaggaaaagttttctttaaagagcaataaaaaaattaaatccattagtgccctaatggggtcttttcatgcccttttgttcattcccttgggttcattttgtagtttggggctctaaaggagtgggctgggagggacccaggatgggagagtggccttgtgtctcctggatacccgttaggatcaaggcaggaggaaccttctccgccagctgacagagttctagttgctggggagactttagtggggtcgggtgagacggcccactgtgacctggtgtttatgtgaggtgtgactgaggctccatcaggagtcgtgagaaggggcctggatgtgaattctaattctgattcttccctagccaagtctggcacttgggtaagttacctgtgttgcccaggtttctctgggtgcttccagcctgagtgcaaaggaacaggcctctgtgcagcaggtcgggcccctctctgtgtgtgcccctggaggatgtctaatgtgttctcaggggacagtttgtcttatgtattggagctgcccgttccctgtggccatctgctggagccagagccactgggcctatgtcatcagcagtgcctggctgagcagagcttggtcagaatcactgggctacaggttcaagggctccagcctagagtctgatttagggtctggatgctacctggtgccacctcatgtttaaccagctcctctggtgcatctgaagcaggcatctgtggactagacagggagaagctctgctccagcctcgtggttcccatccttgcctgcacattgaaatcgcctggagagctttaaaagttactgaggcttggccgggtgcagtggctcacgcctgtaatcccagcactttgggaggctgaggcgggtggatcacctgaggtcgggagtttgagaccagcctggcctacatggtgaaaccatgtctctactaaaaatacaaaaaattagccgggtgtggtggtgggcacctgtaatcccagctactcgggaggctgaggcaggagaatggcttgaacccaggaggtggaggttgcagtgagctgagatcacgccactgtgctccagcctgggcaacaagagtgaaactctgtctcaaagaaaaaaaaagttactgagtcttgagtctcactcccagagattgtggtgtaattggtctgggctgtggcatccctgtagagatttttaaaaggtcccaggtggtcctagcgtatagccagagctgagaaccgctgcctggaataccttctctccctaagatgagttacttctaggatgctccttggtctttggtataggtagacccagaaggctgtttctggcccctcccactagtgccatgaccccctttccctcccacgtgcagtcattgtgagcagagtctaggttcaagctgtccttgctttattgtcttctacaagcctcatttttgttttctgtgaaaaatgttaggacttacccttctcaggtttcagtgaggttacatgtgataatggtgtgttacctgtctcagggcttggcctgtgacaaggtgcttaacaaagtccttgctctttttttcttctcccctttcctaatggtttccagtcagtgaccaagtgctttttttttctgtaaagcagtgaattcgattctagataacatatatgtgtttcctagcctcaaagccattgattaagctctcgttaaggaggcaggacacttaggcctaaaatctaatagtctgtggggttgaactaaggaagggcagagctgggctgggcagacaagctgtgtatggtttaggagttgacgtaaaggaggatctggtctggggggaccacatgagcctgccactcagggaggatcggcttatctgttattactaacaatgggaccttgccagtttcccgaggagggattttggtttacatgtgaaagtcttggactgaaccaattatgctggttacatgagccctttccgtagccattattccctgacattcccctgggtgcttgagttctggctctaatatgcattcgtcttttgccagatctgtgtcgagggcaatattgcaagtgggaagacgacatgcctggaattcttctccaacgcgacagacgtcgaggtacagcctctatgctaggtttgaaggaagcggagaaagcttgatgggataatttatagagggtgtggactaaccttgtccaataggactataatttgagccacaagtgcaagccacaggtgtaatttaacatttctaatatcctcattaaaaaaacaaaaggggccggtgcagtggctcaagcctgtaatcctagcactttgggaggcggaagcaggtggattgcttgagcccaggagttccagaccagcctgggccacatggcgagaccccatctctacaaaaatatgccaggcatggtggtacgtgcctgtagctccagctacttgggaggctgaggtgggaggattgcttaagcccaggaggtggaggttgcagtgagctgagatcacgccattgcattgcatcctgagcagcaggagtgaaaccctgtctcaaaaaaagaaaaaaacccacaaaaaataaaaaggacattttatttcacataacatatgccaaatgtgatcatgtcaacatttaatcaatataaaaatcatcaatgagctattttgcattctatcttgttatactaagtctttggaatatgatactggttgagcatcccttatctgaaatgcttgagaccagaagtgttttagatttcagaatttttcagattttggaatatttgcataaatgtaatgagatatcttgaggatgggacccaagccaaaacacgaaattcatttatgtttcatatatacatagcctgaaggtaattttatacaatattttaaataattttgtgaatgaaacaagtttgtgttaagtatttatgtgtggaatttttcatttgaagtgtcatatcggtttccagaaagttttggagtttggagcatttaggattttggatttttcaattagggatgctcaaactgtttgtatttgtaaaataagtgtaacttatagcatatcttaatttggactactcatatttcaaggtcttaatagttgcctgtggctcatggccactgtattggacagtgcaagtgttgactgcctcaaagtctggttaggaaaagagtctacatgggtaagaagaaaggacaggctattgagcagggctagaagtgtgacatctgagatagcaatgtctgagcagtgggtattactatgcataggcaattaatttaatttctagttcatttaaagcctagtcactaaaactaacctcagagatgtttaagaatcatctctacactaagacattgacctgtcttccttgttctagattttagtggtataatcttctctattgatggctctcttttgttactacagaagctacaatttctatacttttatagtcattttctttccttcttcccttcctttcctgtttttacttctgctagaaatatatgcatggccaggtgtggtggctgatgcctgtaatcccagcactttaggaggctgaagggggaggatcacctgagcccagtagtttaagagtagcctggccaacatgacaaaaccacatgtctacaaaaaatacaaaacttagctggatgtggtggcacatgcctgtagtcccagctgctcaagaggctgaggtgggaggattatttaagcccaggaggttgaggctgtggtgagccaggactgtgccgttgaactccaacctgggtgacagagtgaggccctgtctcaaaaaaaaaaaaaaaaagaaaaaagaaagaaagaaaagaaatatatatagtttgataaaaataataataaacattatatagcccttgtcctgctgtgttcatgtgctgctgtgcaggaaagagttaacatagcagacctaagactgctgccctttagaaatgcctgcttgcaagggtggtctttggctggcatctgggaacttagatcttgggagggcccccaccattcctaactgataacagtggctctctgcttaaattgtttctgcaaacagtatggtttatgctgacacctgctttcttcctgggagtccggaattttggtacatgtcaggaagtggttgtctgcatggctgagcgctgatgaaaaccctgaactcccaggttcaggccagcttgcctgctagacaacatttcacatgtattgtcacatcttgttgcctggggaattcagtgtgtactgtgcagctcctctatgagaggacccttggaagcttgtgcctggtttcctccagactttgcacctgccctttttccctttgctgatccttttttctttttcttccttttttttttttttttttttttctgagatggagtcttgctctgtcacccaggctggagtgcagtggcatgatctcggctcactgcaacctccgcctcctgggttcaagcaattctcctgcttcagcctcccaagtagctgggattacaagcacccaccaccatgcccagctaatttttttgtatttttagtagagatggggtttcaccatgttggccaggctggtttcaaactcctgacctcaagtgatccacccacctcagcctcccaaagtgctgggattacaggcgtgagccaccgtgcccggtcccctttgctgatcttgttttgtgtcctttcggtgtaatccatcttagctgtgagtatgactgcgtgttgtgtcctgtgagttctcatgaatcatcaaacctggggaggagggggggcttggggactcttgacccctgtcctgagtgatatgactcttaatggcactttagaagtgcttatagtctcactgaagaccttggacccgattaacaacgatagttaacatccagtgagtatactgctatttgcccaacactgtgttgagggttcatcataaatactaaatgatctcaccctcacaagaatagtccctctgaagtaggtaccatttttaccacagttttagatgaggaaaccatggcctaatgaggttaagtggcttgtccagggtcgctaggccagtgtatgatacagccagatcccagcccggatacagccagatcccagcccaggctgtctggttccaggggccacacccttgtttgattctgtggtacgaagagctttgttggctttaggaagaccactctcccttcagatctgagctccgtgtcccctgaccttcccagcgaggttatgcttcctgacagaggatcccctggccgctctgtacctctcttttataccacttcttggggtttgaaaacatgttggcttctgtgattacctgagtaatgtctgcttcccctggtaggcttaaggttctgtgaaggcagaggctgggctggttttgctattgttgtgtcctcagtgcctagcatggatatctggcacacagtgggcactcaataaatgtttgttgggtgacagtgctatggatggagcacccctgagctgggtcggggagcaaggctgcctgtgacccagactctggtgggcctgtgtggtgctgtgtatgctacttaggggctaggaagaagacctagaagaaggagagggggtttgagaggggcaggggaagggcatatttgaactggattttgaagggtatacaggagttttccatgtgatgaaagttgatgtgaagtggaatggggtgggaatgctggtcagaagaaacaacgtaagcaaagacacagagtatcttgcttgagggtggatcacttgaggtcaggagtgaagggtggggggtgattacttttcttttctttttagagacggagtcttgctctgtcacccaggctggagtgcagtagcgcgatcttggctcactgcaacctttgcctcctgggttcaagtgattctcctgcctcagcctcccgagtatctgggattacaggcatgcaccactacatccggctaatttttgtatttttagtagagatggggtttcaccatgttggccaggctggacttgaactcctgacctcaagtgatctgcctgccttggcctcccaaagtgctgggattacaggtgtgagccactgcacccagccagggtggctacttttcaagagttccatgcattgcctgccattggtcttttgtcacctatggccccttctcacatgtactctgaaagttcccagatggatcctggcactctgaagatcttggccccaagaacaccatttaaatcttttctagcacacacctgcatacccagaaaggctctagcagagtctggggttgtcccagatttgtgtgtctagaccacagatggaggctctagaaatgcccagcagagatcctgatatgtgtctgaaaacacacaggatgttggagagattggcagtcatcctaaaaggtacaaacaggaccagagggaaagaatgcctccaaaccagtgagacagggagcgtactaaagaaacagggactatcagcagccagtgcacccagtgcagtgatcagaggcaggaaacggaggcaggtggcctgccaaggcctagccctgtccagtgtccctcctggcttctcccacccacctgccagcttgatgtggtaggcaggcaggggtgggatagaatacacagaagagggatggacagagccagctctgaccttggggaggctaccagggcaatagagaggtaggatgtacctatgcttggcacattgggtaacatggatagagttattctcaggacatttctggaagtaatgtgaggaagccgtgtctagatagagttgtgacctcacgggggttgtcagctattttggcctaccttgggcacccaaatttggatagtctttttctctctttttcccttctctcctcactttcccctcaacacttacacacttttacagggttcagcacagagaaacagtagctctgatgttttctttccttccaggtgttaacggagcctgtgtccaagtggagaaatgtccgtggccacaatcctctggtgagtgggttgttggttgcatgaacccccggcttccccttaagcacctgagaatgatggtgcctctgcctgagccctgcctgcccaggcattctctgcgctcttaactgagttggagaagaccagggagggacaagcagaaaatggtggcatgttggtgttctgaggtcaaggatctctgaggcctgagtggctgtgcacagagcctagggacttcccgtcagctatcccatactattcccagtggccgaccttagccactaggggtgtccatttcttgttgctcattccagccttcccctcccctagaagaaacctatcagaacccgggacttctcaggcctaacccccccaggacctatctctaagtaaccaggatccttggtggacccctgacttgggtttgcaaacttggccctgtctggtaacaggggccacctctggcttacctggaagccaccagcctgctttcccaagggtgaacctagcaacaggggctgtagtgtgctgtgtcccttccttcaccttccccaattcgaggttctgctctggttgcttgaaagagatggatagaatctgggtcctgcaagagagagctttagaagaggatgttggttctgagctcccatcccatgaggtagggatgattagtctcatttttcagcttaggaaattgcacttatataagttgcctgaggtcacacagctagtaaatggacttggaagcctgtgctgccctgtgattttttttttttttttttgagatggagtctcagtctgtccctaggctggagtgcagtggcgcgatctcggctcactgcaacctctgtctcccaggttcaagcgattctcctgcctcactctcctgactagctgggactacaggtgcgcacgaccatgcccagctaatttttgtgtttttagtagagacagggttttaccatgttggccaggatggtctccatctcctgaccctcatgagccacccacctcagcctcccaaagtgctgggattacgggcgtgagccactgtgcccggccatgccctctgatttttagcaacacaattggcatctcctgtgtggttcattagactctgagttctactaggagcagggactgtatctactttgttcattgttatttgctaaaaccaaggcacactgcctagcacttagtaggggcttgtgcattcatccattcattcaaccaatattcagtgcatgtcagccatgtggcagacactgttctggatgatatggcagtgataaattcaaagcccttgctctcctgcccctaatattccagtgtggggaggcagaagtcaaacatataatctggcgggtggtgatagggcctaggaagaaaactaaagcaggtgaaaggatgtttcttaaataaggcaaaacctctcagtctttcaataaagaatcctaaagagacatgagaagaatttcttctctgtgcattcgggagaagatggaataccagtcatcttctttggatataacaaagaaacctctgtaacattcatattctctagaagccaaggaggaacccaggcttagttattaagtaagacagctagagttgcaggtgttagggatcataagtgacgtttcacgggacagaatcacagcctcagaagtcttagtgtccttggtacagatagccttttcaatgagagtttcctaataaaaaatacaatagaagtagccatttttatataagtttccactctagaccaaaagaaagatcgatacttttgtgaaaaatctcaattcatcactttatctgaattggttttctgatgcagaaaggtgactgtttctgcggccatcaggcaagagggagtgtttctcctagcctttatgagattttctctcaactgcagtcagaggagtctgcagttctcaatgaagaacactggagtttcattagtttgcaccaagagaaaaatgaaaagcaaaaatgaggaaaaggccgggtgtggtggctcatgcctgtaatcccagcactttgggaggccaagatcagaggatcacttaaagccaggagtttgagacaaccctggtcaacataatgagacctccatctctaaaagaaataaaagtaaataaaattaatttaaaaatgaggaaaggagcagaacaggtttcttagcaagtatgctggagcatgaagtgttttgcttctagaagggatggagagtgattgagtaggtgggttggcttctgttttacatgagataaccagggaatgtgtctatgataaggtgcttaaacatgagggtgtgagcactgcagatatctggatgaagagtgtttaggcagaaggcgctgcagaggcaaaggccctgagatgggaccatgcttggcatgtttgaggaatgctaagtaagctcatgtggttggaagccaaccaggccagagggagatgggtaggagatgagagaaagccttgtgggccatgataagggtttggatttcattctgcatgcaatgggaagccactggaaggttctgagcaggggagtggcaagaactgatttaggtttcacagactcactcttgtggctggatagagaacagactacagagggctcaaagaccattcactgaacgacttgaacgcatgttccttggtgattttattttattttttgaatttccaaagaaaagtaatttattttttgcagttagggcagctgagaagtccagggttgaaggggtgcatctgctgagggctttcttgctagtggggactcttcagagtccccaggtggtacagggtgtcacatggtgagggagttgagcatgctaggtcaggtctctctcccttttctcataaagccaccagtgtaagataacccattaatctattaatccgtgaatagattaatccattcaagagggctctgtactcatgatccaatctttttttttttttttttttttgagacagagtctcactctgtcgcccaggctggagtgcagtggcgcgatctcggctcactgcaagctccgcctcctgggttcgcgccattctcctgcctcagcctcccgagtagctgggactacaggcgcccaccaccacacctggctaattttttgtattttttagtagagacaggatttcaccgtgttagccaggatggtctccatctcctgacctcgtgatccgcgcacctcggcctcccagagtgctgggattacagacgtgagccaccatgcccggccgatccagtcatttcttaaaggcaccacctgctacatactgccacatgggggattaagtttccaacacatgaaatttaggggattcattcaaaccaaagtattatttgttaaagatgatcttaaagagcttaacttctttaaaaattttaaacttatttatttatttatttattttggagatagggtcttgctatatcacccaagctggagtgcagtggcacaattatagctcactgtaacctttaactcctgggctcaagtgatcctcctgccttgggctcccaaagtgctgggattataggcatgagccactgcacctggctctcttttctttatgctagaaacattcaaattattctcttatagctttttttttttttttttttttttgagatggagtctcgctctgtcacccaggctggagtacagtggcatgatctgcctggccagcatggtgaaaccccgtctctactaaaaatacaaaaaaatttagctgggtgtggtggtgcatgcctgtgatcctagctacttgggaggctgaggcaggagaatcgcttgaacccagaaggtagaggttgcggtgagctgagatcatgccactgcacttcagtctgggtgacagagcaagactctgtttaaaaaaaaaaaaaagatttttatcaaaaagacaggtgataggtgtggagaaaggggaaccctcatacatagttggtgggaatgtaaattagtacagctactatagagaacagttatgaagtcaggcagtgtgatgcctccaactttgttttttttgctcaggattgctttggctatttggggtcttttgtggtttcatatcaattttaggattttttttttccctatttttgcaaagactgtcataggtattttgatagagattacattgaatctgtaaattgctttgggtagtattgtcattttaatagtattagttcttctgatccatgagtgttgaatatctctttttttgtgtgtgttctgttcaatttctttcatcagtgttttatagttttccttgtatagatctttcacttctttggttaaatagattcctaggtattttacttttattaattaattaattaatttattttttttttcgagacagggtctcactctgtcatccaggctggagtacagtggtacgatctcggcccactgcagcctctgcctcctgggttcaagcgattctcatgtctcagcctctagagtagctaggaccacaggtgcgtgccaccacacccagctaattttttgtatttttaatagagacaggatttcgtcatgttggccaggctggtcttgaactcctggccttgagtgatctgcctgcctcaacctcccaaagtgctgggattacaggcatgagccactgtgcctggctggtattttatattctttgtagcatcgcaaatgggattcctttcttgatttctttctcaggttgttcactgttggtgtatatacatgctactgatttttatatgttgatttgtatcctgtggtattactgagttcgttcatcagttctaacagttgtttggtggagtctttaaggttttttttttttttttttggtcatttcaacttttattttacttttagcggggtacatgtgcaggtttgttacctgggtatatttcatgatgctgaggtttagggtatgatggatcccatcacctaggtactgagcatagtacccaataggtactttttcaacctttgccccctcccttcctccccactctaggagtccccagtgtctattgttgccatctttatgtccatgagtacccattgtacccacttataaatatccacttaaagtgagaacatgcagtatttggttttctgttcctgcattaattagcttaggataatggcctgagtctttaagcttttctaagtgtaagatcatgttgtccgtgaacaaggttaagatgacttcttcctttccaatttggatgcccttcatttctttgtctggcctaattcctccggtccctcggagactttccataggctcctattatagctgttaccatactgtcctataattgtttcagtgtctgcctttgtccaccctgctgtcagagccctgtgatcatgctgggtttatctccagccccaaccctgcctgtgtaggtttcttgagctgtccttcagtgccttgtgagaccagggtcctcctgcagatgccactttgatggaaagtgctgtgttttcccttctgcagggcctgatgtaccacgatgcctctcgctggggtcttacgctacagacttatgtgcagctcaccatgctggacaggcatactcgtcctcaggtaggtttcagatgctcagtttcagccttcttaaacgttttcttcagacttggggtatgtgattgccaggaagggaaactttacaaggaagccaggctaggccttcagtgctgtgcaggcctctctgtgtggggccaaggtctctggcttctgtggttctcttctgacctgcctctagtgcccccacctgcaaacctcagccagccaggtggtgcccctgccaccattctgagctcacatctttatgacctgaccactgctgggcttaatgccgtttaactcagttcttctcaaagtgtggtccctggaccagcagcggaagcatcacctggaaacttgttagaaatgcacattttcagctgggtgtggtggatcccacctgtaatcccagcactttgggaggctgaggcatgcggatcacctgaggtcaggagttcaagaccagcctggccaacatggtgaaaccccatctctactaaaaaatacaaaaattagtctggcgtggtggtatgtgtgtgcctataatcccagccacttgggaggctgaggcaggagaatggcttgaacccaggaggcggaggttgcagtgagctgagatcataccactgcactccagcctgggtgacagagtgagactctgtctcaaaaaaaaaaaaaaagaaagaaatgcaaattttctagtcacatcccagacctgctgaattagaaattctagggatgaggcccagcaatctgtgttttatcaagccctccaggtgactcgaatgcatgctttgtttgttttcatatttgagaaccacttatttaaccttcatggggtctggctcttagttcaaattcttgagacaaagaatctgattggttcagctttggtcaggtgtccagccctggttcaatcaggtgttggggacaggaccccaaggcacaaacatggctgcttaggcctattccatcagtgaggatgcatctagagacagagtctcttagaagaaagggggctgtggaggtcctgatcagcacctatgtttcaaagctgtaagcacaacctatgatgccagctttaaggctctgcatgaaggagacagactgtccctacagccagttaacactggcacagctgctgggctggacagttcggtcccagtctgggtacctgcagcaatagctaccattcttctgtaagtctgtcttttaaaattgaaagatgtgagtgggccgtttttggtgaataagaatttccatctccccaaatatctgtctaaattgcacaaatccacaaatcgaaagatctgaggttagtgcattttgcctttgctaatttgcttttcctgagcaggcactcaattgcaaacctaagttgtatctaatgatatttgaataggaagggatataaatgcactcctctatttaaggaaatctacctcaggaggcagagagagatggacagaccaggaaagatgagcagaaggagaccagagggatgaatggggagctaggaagtaaggaaagagaggatggaagaatggaaaggaagatggatgggcagaggatggatggacagagggacagcagggagagggaggaagtgcctgggttatggctttgaatctgccttggatttgttggcccaggtcccatgggtgctgtgggccatggccaagtgagagtagtgttagtgtgcctggcatcaagggtcagggcgcctcttgcttcccagaggaacgctggacaaagggcaaggtcgtctgcagagggtttgagcatcctggcagaaaggggcactgtcaggctgtcttcctccctcttgggcatcgttcttaccagtttccttgggcagagcccccagaacgtcacccccaacccgaccctcttggggctgtacctcatgcatgtggtccctctgcttaagcaaactcaccctatttaggtccgtggtagtcaccacatgttgcctcaagtggacagctttggatggtttctccagggcttgaccgtgttctagttgagactcacctgccatcaaagaggcagctgctgatgagccctcagcctcggcattgctgggccatgcatgcagctttggggtgtggggcaggtcagggtggaagggggacacagcctgagcctggtggcagatgtggcttctcctcccggcaggggagtgaggaggtcctcctgcttcactctctctgccgccttgattctcatattcagcaaagtccccaggcagggggagtaacagacatttctcaaggcctcctggctgtctccttttcccctgagttagtgattctctttttgttttcctttaggtgtcatctgtacggttgatggagaggtcgattcacagcgcaagatacatttttgtagaaaacctgtatagaaggtactgtagtttgaatagttgataatttattaaaccactaatttttcaaaatgaaatagaaacttgtttattcgattgacagatatggagtacccgctgttgtatcagttatccattgccatagcaatgcggtgtaacaaacagccacgaatcctcatggcagacagctatctgcattcattgcccagtcagccagggtggtcaccaggcagctctgcttaccttggctaggctcaatgagatgtctggggatcagccgatgtaggatagcctaagcaagggtgactggaggtggctcatctcttttcctcttgcctgtcactctccttctgggaccagcaaaccagcccaggtgtccacttctcacggtgacaaagggtagaagcaacagcagagatgcaaggacatatttttcaggcctctgctccaagtttgctagcattccattggccaaagcagatcacatggtcacatgagcccagggtggaaaggtgggagggtccagtgagttacacagcatggtacaaggctaaagggaagggtggagagttgggcgagtcagacgcacagtgtgcgtcgcatttgttgtgtttttcactaaaagcttccctcatgagagcagactctgtgatgtatacctagttaggggcttctggtggcctgtcagtgccaagggctcaggcatggggccctccatccctgtgctcagagactgccgatttctaggggtcttggaaatgggttgcagaccccacctgtccctgccgcgagcttgggatactgctgtccttccctcgcagagctgttcggatgtcaacgctggaggcccttcctcccactctcatctgcagctgtcttcctaaatgccaccctgtctcccagccctccccgaccacgctgtctagatagggcaagctccttgttagtctttgtttcgtttttggttttggtttttgttttttgaggcagggtctggctctatcacccaagctggagtacgggggcacgatctcagctcactgcaacctccgtctctcaggctcaagccatcgtcctgcctcagcctcccgagtagctgggactacaggcacacaccaccacacctggctattttttttgtatttttagtagaggcaggatttcgtcatattgcccaggttggtcttgaactcctgggctcaagtgatcctcctgccttggcctcccaaagtgctgggattataggtgtgagccactgtgcctggtccccttgttattcttaaggactactttctgttagttttctttgtagtatttaaggcaatcatatgaaattgtttaaccaattatgacctacaaaaatggcagttttgtgtggttcaacttagtatgtgtctaattgtttattgccacccacccccccggaccataagctcctaagggcaggcaccaagtttgttgtccttgcctagggtggacccagcacagagcaggctcctcgttgatacctgttagctattgttggatgaggggacctgtggctgtgctttggtctccagcccaacttgttccccaggctctggtcccccactgttttgcacctttcatttgaggggccactaaaaaggcttctcctaggagccctgagctgccatggatcatgcctttgagcctgtgtcaccccccaaaatgagagcctctgccccaaatccacccagagcatcagagcaatgctgtgggctcaggggctggcagccaaggtgagtcctggccgtggctttgccccctggcctcagacttttcttgtgggctgcagcttgccctctgagcaggtggcattcctgaccttacggccccattttcacctgacaacctgggtttccaggtgtccactgctaggtttatccagccctctgcggtcctcagctcctgctccttagcacctcagccagagggaggacaggcaggacagaggagagcgagagcagaagggagcctctgttatgtttgtgtactgctctgattagaactgtaacccgaggcggaggttgcaatgagccgagattgcgccactgcactccagcctgggcaacagagcgagactccgtctcaaaaaaagaactgtagcctgaggaacagatcttggcagtggggtgggattacctatgaacctcgcagagtggggctgtgtctgtcttttaatcacattcagcttggcctgttctgtgtggggtcagtggctcttgttgctttttttatttttgagatgggcttgtgctctgtcacccagactgtagtgcagtgccatgatcatggctcactgcggcctcgatgtcctgggctcaagagatcctcctacctcagcctcctgaatagctggacctacagcacatgtcaccacttctggctaatttatttcttattttttgtagagacagggtctccctgtgttgcccaggctggtctcaaactcctgggctcaagcgatcctcctgcctcagcttcccaaagtactgggattacaggcatgagcctgattacagctctgctcggcctcgtggctctttttgaagcaagtaatctggaatggaatgaccagaggttaaggggagaggatagagtgtggcatttggtgggcctgggttctatcctggctctgaagtttgctctgtttgtgagcaagaccaagtttctaaatttctctgagcccatctctcatctctgattcctcttgtccatctctgaagagcctttggacctgccacctccttcgtgtcttaggacccttttgtgggtccttgcccaccttggtctttattaaatttgtgagttccccaatcctacccccaaacctgtaggccacccagcgctaggtagatttccccaggagccatttgtctttgtttggccggtcacagttcctgctgatggccatgggctttggtaactcacgcccatggtcctgcatcaccacatttctgatgcgtcagttctgtatctcccaatctctgtggttacggcattggtctagatgacatgggccttgcctggagctgttctgtgggtagtttaggaagagaatgtagcttttaatttttttagctcttttcctgtcctgatgactttatatttatgtctctccctggccctcccagaatgcatggcctctgtggttaggatttctgtgggacaatgaaccacagaagaaacttacagtgtcctttctgttcttgggatctaattgttttaagttcatatggctttcggggggctcagattcccctgaagaccttgttggggccttgagatccatcactgggatctcttgaagccaaaggctctcagtgggcatgtggcctcgggcactccagaggctactgggagcactgtggctgcctggagggccaggctatctaccatggtctccagagagatgagaaaaggcggtgttcctcagaccctttcatcggattcctctgaaggcagaggaaagctccccacagcactgcttcctcatcctcccagaccctgtggtccaaagcagccacctgccaacaacccagaagtttcttggagtctcctattttaacctagaattcattgggattttgcattttcctccataatatgttcttaagtttgtatctaaaaataataatttacataacttatcattgaggacaatggatgttcctgtattaaacaccatgctttgcatgtggcttggagttcccactccctcagccacataccccagagtccctaagtccaggaggcagagaaccaaggggtagcggcattcaaaacaccttcccagggcaagtgattcacttgtgaactgcacctgcttatgtgttccctggaaacgggggcatctgctctcatggttaaggaacagggcagggacccatggacaggagctgcatttactgtctggttgttgaccctattgggcagataaggaactgagaaaggattacaaagccagtgctccttcctgatcgggcaggaactaaccacaggaggggaaggtgttccgaaccctgctgtgtgggggcaagcagcaaatgaggaagtggcaggaggcatctagatttctctcatcaaggccaaaggcttcagggcccactgggttccccaaagctgagaatcctgaggtactagcccaagggggagactctgcctctttccagacaggctttaccctaagcttctcccacaaccacctgtgcatcttgtttacaggcagattccacttcagtagcactgaggtggggcctgagaggccacatttctagcaggtgcccaggtgggaccatactcctactggtcggggatcacactttgaggaatacgggcctcagaagaaggtggcagggccgggtgtagtggcttatacttgtaatcccagcactttgggaggcagaaggggaaggatcacttgaagccaggagttcgagaccagcctgggcaacaaagtaagactcccatctctacaaaaaatttaaaaaattagctgggcctggtggtgcacatctgtagtcccagctacttaggaggctgaggcaggaggattacttgagcccaggaggtcagggctgcagtgagctatgagcataccactgcactccagcccaagtgacacagtgggactttgtctcaaaaaataaaaataaaaaaagctggtagccaggtggtccacagggcgccctccatcccaatgccacgacccttttcccctggagttctgacggtaaggtgggcttccttggggcttcactggacctttgggggtcataagaacaagagcctcggcctgagggttgtctttgggaccatggtgaaaagttctgcgcagtgcaggatttcctgtttcctgcacctggcctgtggtttcttaatttcacatttgttgcttcatatttgggttgctgggggctgtgttgtgttatctttgtttttaaggtttctggacttattcctaggccaagaatcaggcagccatagggcaaagtaaaaagtatttttagccagagccacagaagggataaagggaaggaagactagagcttggccactctccggacaactccagctgccctcgatggagcggtcatccacaacgaagtattactgagaaagtagatgtggggtttttttgttttttgttttttgtttttttgattttgagacagaatcttgctctgttgctcaggctggatcactcaggcgatctcagctcactgcaacctctgcttcccagattcaagcaattctcctgcctcagcctcccgagtagctgggattacaggcgcccaccaccacgcctggctcatttttgtatttttagtagagacagggttttaccatgttggccaggccggtctcgaactcctgacctcaagtgatctgcctgcctcagcctcccaaagtgttgggattataggcgtgagccaccatgcctggccaaagtagatgtttttagaggtttcggctccttcaaaatgcagattactgtcattgtcactacctatgcaaaatgtagcatagaactgactttggctgggtcctttgcccatacctagaataaggtgtcttggttcccacctgcagggagttcagccaggtactgggaaccacacggtggcatgtggggcgtcagctcctgcctgggagctcgtgtttcctcatttcctgggatgctctaggaaaaggcttcccaaaatgccatgatggggagcccttcacaaggtgggagggcacattaccattgccccttcagtgcttgggttgatctttttctccctctcagaagctcttgcaaccttggttcaggatctgtgggggcctagacagaaggctatatggcaggctcaggtccccagaaaagcccacatattggaatcctgcatctcctcgaagtaaaatttcttgaagggtgttcttgctctttgggctgtgaacaaatgaagagctcgccagggaaaagacccacctcttctggcactgtctaccctggcgaggttggggtgtgcagaatgtaactgcagttatgccaccagggattcgagagggctgtgttaattgctggagaggaagattccagttacacagtatccttaaagacgggaacttctttttcttttttttgagacggagttttgctgttattgcccaggctggagtgcagtggtgcaatctcggctcactgcagcctccacctcccgggttcaagcgattctcctgcctcagcctcccgagtagctgggattagtcatgtgccacaacgcccggctaattttgtatttttagtatagatggggtttctccatggtggtcaggctagtctcgaactcccgacctcaggtgatctgcctgcctcagcctgccaaagtgctgggattacaggcgttagccattgcgtctggccaaagacaggaacgtgtaaggggcaggcagctggctggcatgaaaagctgaaggtggtgagcaagattcatgtagctaaagaggccacacaggtgactgtgtgggccgagtaatgggaagcaaaggttttacaagattgcctggtcgtccttttctaagaacagaagtgagggcgtggagtgggacccagctcgggaagtggcatgctgactcacctgtggcttgtggttggggacactgagtaagacctggtgtttggaaccacaggctgggcctcctcccctgctgattggcccaggggcttaagttcttcccagctcctgtctagactgaaacctcctggtgtgggtcatgcgcctaagagctgtggccttcctggagctcaggctagagagacactggacttgatccgagtcagctgacagactggggtgggcgggtggtgcaatggagagcatttgggtttgggggtagggagagccaggcttggacccctgctcagacagagttggccttcacttctctgatcctcaggtttcttctataaactgggactgaagccagcctcacaaggtcttgtgaaaacaaaaggaaataacgtatacaagggagctcttccattccattccgcacagactggggggctctcttggcctcagggaaggatgcaagaaattgtactgatgtaacagcaggattcatgtggatcaagaccttggttttgcccccttggggtcagggcaagggtgagacccccatgcccactgttgagttgtgtgcttggatttgccaagcttggatttgcttggtattgctctccgtgcattctgtagaaataaaggcagtggcttgtcttgtcggtggtgtggggagccccatgcttgagacagacacaggaggagctgggcagagttcctaggaggaaatacagttagagcagcgcccactgtgccccatgtccctcggagtcatggagatcaggcttctgtttcctcactcagctcagacactggtcattcagtcctcctggatcccccagcctcttctggcacatggttctagtcatggaagggttttcaataggtctggcctactgaccctgcccatgggaggccacccgaccaaggaccccttccaagagcattgggaagggagaggctgcccctcagtctgcaccaaccctgtgggggaagccttttgtttggctgtgatgggggtgggagtgggaggcccctgtgactacctggagccgattcccaggggagctgtggcaggggcagagccaccggagtctgtcagtcccagagtcccccacaggtgtgaccccctccccatgtctccatgtgcagacccccgtgtactgtgactgttttgcagtggtggttggtttggttttagttaacactgcttcatttgttctgagctgtggttcagttccatgatcatatctgtgggcaccctcccagctctgggattggacagagtctccctcgagctgtgcagacgcatgaggtactccggtggctagtccagccttggacacttgggagactgtcccatgggcagctcagcttctccccagttgctgctaactggccccacccctttggtgccacctcttctgtgccctcaagccatgagtttgctggagtaggcgagaagctaatcagcagcttcctcattgcacatcctcattttcttagagtcaattttgttctcagtcttctttttccagaaaaggaaaataagagatagtggtttggtttcttgaacatcaaatattcggagctgaactaactgaaacccaactcagggtagcctgaacaatgaggtgtcatcaactcccaacagatggcttatttggtgcctctggcctggtttctctacattttgctactgtgcatcctgttcgtgtcctcatgcagttctctcagggtgacaatgtagtcgtggcagcattgggcttctcactcgctggttggagtaagggcaggtgtcttgctagtggctcttccctaagcgtgcggaagtatcttttctgtaagtccctgcaaacctccctcacgcctgcctaatccaaattgggcccctggctgggggaggccctgcactgattgacttagcttggcttcctgaacgcattgctggaactaggggagacgacttcctttagaccgattgtgcctaccctaaagcttggaagcttggggtggggtgaggtttccctgaagcccttgggtctgtggatggaccctgaataaagaatgggctacttttaaggaggtaagcggagaggaggcagggaggcagcctgtggacacaaagttgtcacctgaacttgtagtgcctgagttttgttgcctgggagtcccctctgcaatgctgtaggatttccttcccactcctccagcctcccacgcagcttctccaggttttctgggagtcctggccgtcccacaggttggtctgccctggcctctgtgctgcagtctgctcaggccccgctgctgttctccgtccactctcccgctcctctgtcaaatactcttctcttctgaggacatgggggtggtctcagagactaggggagaatgtccctctccagttggtgccatgccttgctgttagggccccaagacagggctacttgtgcccttggcctcccagagtgcctgcctcactcttccagcctcttacttccttccatgctcatcccctcgtgggactggagtcagcccctccctgccccctccccactgagagcctcccattgcacatggctcaggtacggccactcccccatggccagtcttgccgaacccagctctgagcgggacccacatggagccactagtggaatggaggatgttaaagggagaattcctctgctaggcctgtgagggttgtctgcctgctgatgggcttgtgccctccagctgtgtccattcctgctctctctttcctgttcatttcctcccagggcacaggaaacccacaggaataccaggaatagatgccagatttctccttcaccctggctcgttcttccttcccactttcttgcctttttttctttcttttaaagttaacatttaaaatgtgtagtaggccgggcgcagtggctcatgcctgtaatcccagcactttgggaggccgaggcgggtggatcatttgaggtcaggagttcgagaccagcctggccaacatagtgaaaccccgtgtctactaaaaatacaaaaattagccaggcatggtggcgcacacctgtagtcccagctactcaggaggctgaggcaggagaatcgcttgaacctaggaggcggagattgctgtgagctgagatcacgccactgcactccagcctgggcgacagagtgaaactctgtcttaaaaaaataaaaaatagaccatcctggctaacacggtgaaaccctgtctctactaaaaatacaaaaaattagcccggcgtggtggcgggtgcctgtagtcccagctactcgggaggctgaggcaggagaatggcgtgaacctggggggcggagcttgcagtgagccaagatcacactactgcactccagcctgggcgacagagcgacactacgtctcaaaaaataaaaaaaaaaaataaataaaaactaaaatatgtagtaatgctccccaactcccactgctgatttgagaagtaatgtgttgttaaaatttggaaaatacaaaaaggtataaagaaaaaaagaaaagtctcatgtagtcctgcagcttgagaaaagcactttttacattttgatatttttctttcccacctttccaagatgcattggtgaatacttttggaaatgtggttgggatatacacagttttagatcctgttgctttcactgaacattagatttgaaatttttccatgccattaaatattattttacaatatcatccttcagttactgcgtgaattttctgttatatagatttaccaagatttagttttttattggtttaaacagtgccgcggtgagcatcatgattattttcacaaaataaatttttttgttttgtttgagtcaggggtctcactctgttgcccaggctggagtgcagtggcatgatcatgacccactacagccttaaacccctgggctcaagtgatccacctgcctcagtttcccgagtagctaggaccataggcatgcgccaccacccctagttaatttttttgtagtttttgtagagatgggggtctttccatgttgcccaggcagatcttgaacttctggcctcaagtgatcctcccacctcaccctcccaaagtgctgggattacaggcataagccaccaccctggtccacaaaataaatttctagaagtgaaattggtttgctgattcattgcctaacctgagcactgtctctgttctcagggtacaagctttaaagtccctttctctgcttagagttccaatcccaagtgaattctcccatcactccgtgccatggcccttgcagcattgtgccataagccgctcccaggcagcaggaggtcgggaatgcttagggtccttgtcactgcatgtccagtattgcacggatcacactgtgccctggtacccttggtgactcctttcattgagagccgtctcaagatccttttgggggaattgcatagcccagaagttttctcttaggtgaataagcccttacaactctcattgcagtgggaagatgccagaagtggactatgtagttctgtcggaatggtttgactggatcttgaggaacatggacgtgtctgttgatttgataggtgagatgcacccctcccacctccctctcttgtctctctcctgggtcccttgaggatgtgcttggctgggccccaacccttgggggcagtgggtgaggcacttgcccttggcagttccttccccatgggagttcagctttctccctgagggcagacagaattcgggacttctggtctctcatggagaagaaccctggcctttgttctttaaacttccctccctggctcagctactttcagacccaaatccactgtgatctgatgggtttttctagtttgcaaaggaacaggaaggacagagcctgaacattcactgagacctgctgggtgtgaggcctgttttgagctctgtctatgaacagaatcccattcagcctcaaaacgaccccacggggccgctgacactgaaagagaatgaaagtcgaggcggagggtcagtggtcaagccaagagctggccctccctgcttcctgctcgagctgtgcagaccttcctcccgcctttgcctgtgtgcctgctttgcttccaagccatgagcagagtcctgagagccacgtattcttttaacctcagtttaccttcggaccaatcctgagacttgttaccagaggttaaagaagagatgcagggaagaggagaaggtcattccgctggtaagaggcctctttgacttggttaaagacaaactgggaaaccacctctgtccaacccggcttcctctcccggccccacccccatgagatcattgtgcccttgtttgcagagagagaacaggaaccaagtgtatcagagggtgaactctgacttcctgtttggccagagacccacgtggatgtccagatctgcttggcttcctgtggtcgctgactcacagtttggcaaccctcctgcttggaggcgttcccctcccctccccacctgcccctccccatcttggcagcaccagggcttgtctgttctgcctcctgaagattgcctggccttgtgctctctgtgtcctccctagaatgcgagttccaggagggcaggacccagccctcttgttcactgctgcatccctagtgcttagcacagtgcccggcacggaggcggtgctcatgcttagtggtgtttgcccactggagagatgccatgcccttctgagttctgctcaggccacactgactctcatggggactctgccagtataggcccgggctgtgcatctcgccctggcccttccctccttgcatctcccttcaaaatctggcctccaggctgccgcccggctgatatttccaatactcatcaccactcgtgcaatttcccagcccagaacctttcagtgccttgctgctggctagaatgcagtccccactttgtaatacggcttatgacccggccccaactgcctctctggcgttatcatcctccattccctactttctatgctctggctataaggaactagttgtggccacacacaaacaaccacatacacagtggagttatgcaaatgtgcctttgcacagtcgtttcctttgtctttaaagtgttactcagatgtcacctcctccaggaagccacccctgaccttccttccattgtaaccccccccaaacccaccccctggctttctgtgatcatgggccttaggacagcatactgacactatttgtttatacctttgttccccatccctcactaatgtgagctttttaagattgggtcttattccctccgtgtcctctgcatgtgccttggggcctggtgcctagtagttgctcagttagtattgaactgaatgtcccatgtgagaagctgccactggagggagacagaggctgggcaagcattcagtggggtgtcaggggctctgagctcaggataggctggactgggggccctgggaagcctatccaactcctgaaatcctgctcagccttgtttttccttggtgccagcacgatgcattcctgccacgagggcccaggcgtcactctgggcagctcctttgaaatcttggagacaagaatgctaggaagatggaatgtggtggaatggggccaggctggaccatgctgtgatgcgcacagcagctctgtgcagtgacccagatgctccccaagcctgggggccgtccaagccgtgatccaagccattgtcttaagggtttgaccaggtccatgggacacatctggctcctattgccaagggagagctgggcaggagatgtaaaggctgctgcagagttgacacgcgagcctctgggatggcgagtggaatctgtgtgaggagccatcccactctgtgcctgggagagcacgagtatctgctctgcctggcatgcaggccccatggctcaggagggcctgtgccccttttcccttgggctccgctgcatcaggctttctgcagttggtggtctttatagtctggagggtctataggttacgagttgttgagggggtagaagggcaatgggtgagggtcacagtcctcttggtggcaagacagagcggagggtttagaggctgcccagggctgggcccctgcctgaaggaactgaggccctgctgctgcaaaagtggcagtaaatgggagaagccaggtgtgggtcctgcctttttttttttttttagtatttattgatcattcttgggtgtttctcggagagggggatttggcagggtcataggacaatagtggagggaaggtcagcagataaacatgtgaacaaaggtctctggttttcctaggcagagggccctgccgccttccgcagtgtttgtgtccctgggtacttgagattagggaatggtgatgactcttaatgagtatgctaccttcaagcatctgtttaacaaagcacatcttgcatcgcccttaatccatttaacccttagtggacacagcacacgtttcagagagcacggggttgggggtaaggttatagactaacagcatcccaaggcagaagaatttttcttagtacagaacaaaatggagtctcctatgtctacttctttctacacagacacagtaacaatctgatctttcttttccccacatttcccccttttctattagacaaaaccgccatcgtcatcatggcccgttctcaatgagctattgggtacacctcccagacggggtggtggccgggcagaggggctcctcacttcccagactgagcggccgggcagaggggtcctcacatcctagacgatgggcggccaggcagagacactcctcacttcctagacggggtggcagccgggcagaggctgcaatctcggcactttgggaggccaaggcaggcggctgggaggtggaggttgtagcgagccgagatcacgccactgcactccagcctgggcaacattgagcactgagtgaaccagactccgtctgcaatcccggcacctcgggaggccgaggctggcggatcactcgcggttaggagctggagaccagcccggccaacacagcgaaaccccgtctccaccaaaaaatacgaaaaccagtcaggcatggcggtgcgcgcctgcaatcccaggcacttggcaggctgaggcaggagaatcaggcagggaggttgcagtgagtcgagttggcggcagtacagtccagcctcggctgggcatcagagggaaaccgtgcaaaggggagagggagagggggagggggagggggtcctgccttttgccttggctttgattcaggcgccaggggaagggccagtgtttgtgcccacgaacccccagtggagcagagcagggtggctggtgacacttgtgctgttttgctcagcctggccaccgagtgtgtggctgcgtctgccgctgtccacttgagccaggtttgctcttgcagggttcctttgtctgagtcactgcccatggtcattgactactttgaccccctctgcttgacacccttggtaggtggggtctgctctgtccactcccgacagactgcttgtgtttccctggcaggaatacctggaagcaattcaccatctccatgaggagtggctcatcaaaggcagccttttccccatggcagcccctgttctggtaagtaagactcccttacagggtacgagactgttctagaaagaggagtgacccggggaatgtcagccaccttgcagacaggggagggcacagtcctttagagtttgacaacttagaagaaggaaggtgggaaggctggtgctctctctcccagtgcctgtttctgggctgagtctcagagtgagttggccagacccgagggaaggcagtctgtgccagtgccatcacacctggcagttgtcactgatccagcatcttcagcgaagactctagacccgggtctcagttttcaccatttgggatagtagttcctctgatgtgaccttcctccttccgtggatgacacagagcctcatttcacctttgtttggtgactcaggtcatcagaaggaatgtcattgtctggtctgggctgtcacacagtgatgcccttaggaatgctgaggtgtgtggaactgtctgccctgcccactaatgtctctgcgttcctgtgtttactttttacagtaatcctcctttctcttgctgccatgtgtcatttctgactgatattgatgtgtctgtcccgtcagcatttccttacttccccatctccttgttttccagtttgctgtttccagatttctttactcagacaaataagcagtggcccagatgctcccaagaaatgcggagtctggggtccctccgagtcttgattggagggaacctaagatggttacatatacaacatgggattggctgtgaggcagggttgtgcgcaagctttggtgcatggctataggagcattgtttgatgggatgtgaggcagggctgtgcatgagcttttgtgcgtggccataggaatatctgtttgggctcaaacacttctgcttatggctcttgcaggcagtgaggttgccggaaagtgagatattactgtagtaattttttgtttgtttgtttttgagacagagcctcactctgttgcccagactggaatgcagtgacgcaatctcggctcgctgcaacctctgcctcctgggttcaaatgattctcttgcctcagcctcctgaatagctgggactacaggcgcatgccaccatgcctggataattttttatatttttcgtagagatgggattttgccacgttggccaagctggtctcaaactcctggcctcaagtgatctgcctgcctcggcctcccaaaattctgggatcacaggcgtgagccactgcacccggcctactgtagtagatttttaaataagtacagcttatttttctccctcattatggaaaaaaaggagggtagaaagtgatgagggaaaaaaacaaatcattcatgagcttacagggtctcactgtgttgcccaggctggtctcaaactcctgggctcgtgtaatcttcaggtctcagcctcccaaagtgcttggataatagacatgagccaccatacctagctcttgtagtacattcttaagtgaaaacctcattggaaatgtagattgccctagagctgaaagcgatttggctctaaccttcctttttatctgcctgcaaccttctgtgcccttccctgccccctgctgcctgcttccatctgtctgtctccagctgtgaaaggaggatgctgctgaggtcagtgcagccttgtgacccatgtgtctaatttccaggtgattgaggctgaccaccacatggagaggatgttagaactctttgaacaaaatcgggatcgaatattaactccagagaatcggaagcattgcccataggaggcaaaaggtctatggctcatgtctgaaaaatgcctgctgctgccaagttagctattgggagcaatctggaaaaacttgctcccaggagggctttgtgtctggccagcttgattttcctaatggtctcatctcctttgctagtgtctttgtcatgcgtctctggccctcgtgggtaaatgacaaacgggaccaatgggtttgccaagccctttgctgttcgcagcctcacattcccccggtgcctctcccatggctttgtgctgctgagtcgctctcatgaagcccttagggagagcacctgttgtgtgcctgacaccacgctggagctgtgtaccaatcgtctcagccttcattaggaggccgaggtaggagtcttatatcccaggtgaggaatttgaagctcagaaaggttgaggggctccccagaggtcacacagcctgtgtgcagtggagctggcaccattcagactttcagccgactcagcaactttcccttgccctgggctgcctcctcctgagagctgttccccaccgccctgcctcttccggttggaggctctcatgtctctttggggagagctggcagtgtgcggagctgataacattttcccaatattgagcagttcccaaggacagtcagcatttctagacttccacaaaattatgctgcatttggctggagcccggtgttcagtggtttccctgcccgaggtcgctgcagccccatctaccacatcttcatgtggacattgagattcacatgctggctcctgaagggtgctcagtctccttggtgattaaggtcctgcttgaactgctgccaactccatgtcagggaagtcgcttttggtgcctggctggtttgcccagagccaagctggggcaaggggcagccagccctggcttccaaggctcccgtactgtctgtgtccttgtataaggagctttgctcttggaattactgaaagtctgtggcccaagagagagacacaagtggccttaagtctttttgaagtgttatttcatccagggaaatgcctcgagccatagagcctgaaatcatctttgttggctcagaaaataccttagcttcactcagctggactgcattgaaggcgaggctgccccttggatcaagcagaaaacaagagaaagaaagaacgttccctttggggatagtctggaaagttgggatttgcaaataaaggctctggaagcattgctggtcctgaagctttggaggtgggcagagagagcttcaagaagactagatgcaaaccctggaaaggattaaggctcaactctggagaaacaggccacagcctctcagagcagctgttggctgtaaatagaggtagcaaggccgctcccaggcccctgtgagtgtgggcacctgtgcatgcaatgctccgactctgcagaggtgccaagtgcccctgctgggccagtcccagagagttaggaagtcaaggcctgcaactcctggttcttcctgtttggaccagttcttgtgccattggcaggatgagaggcagcagccaggcgggagctgtgtctagcagcacctgtagcccacgtgctgctaattagctggaaaactggcgaaggcagaacctttgctaccaggaatcttgacatgtggggtctgtctttgagaatttgtaaatgaacagtccaatatttcctctcggctcattttgcacatccatttttggggaaatgtgatttctctctctttttttttttttttttttgcctaaggcacaatctcaagaggtcctgagaccacgtacccatgatttttttcttgctctgtgatacccaataactccttcacctaagccctgttgttgattttgaagtgcttcctaggccagtgattttagcttctgccagctgcttttgccagtagattaacgtgtttttatttttcaaactccgtgtttcctaacgtggagtgtatgggtctaagagagcctgctgtcctccctgccttccaccttggagaggaggctggacgcatcagcagtggccagggcaggtcgcaaaatctcccagcctagagaccacacctgaaacggctgaagccagcttgcacaagggctgctgtccctctgcggcaggcagagctggtgggggcaggggtcacagagcagtcatagacaccatggaccagggcaggagaagggcagatggcacatgggcacaacagggccttgtccttagagcactggggggtcatggctgggaggggcatggcaggggctggcatccctgtagagccagaggggccacccagggcagtgacattccagatatgttgggctcacctcatccttgctgtgagactggagttccatggggacatgaagtcagtacaccgcagagctgctcagctgctctacctctcgctgacttttttgttgcacatatacattttctttcaattagcatttatttcagcttttatttaagctttttgacagtacatgtaaaatatatgattataaccatttaaaaataccttatgtacctggttttttttggaaactagatagaaatatatttatcttttacataaaagaagtgtgtagtggggtggtccagggctttgtggtggcttagtggccatcggggtcccaggctcttcccacctttctcttttgggtccacctcttggctcctggcttccttcctctggggcctgactgtccaggatggcagctggagctcctgctctgggcacggttggcatcagagcccactgctccccatccactctttaatccagatgctggtaatgtccctttccaaggcataactaagataagctggaaggttcttacgaggctttgctagaggccctgggaggtggggggaaaggcaagagggcagtgcccacccatagaccgggtcacatgacctggcatcagcgccgtggggtcctttgggcttcacctccctctcccctctgcccccacgtcatcccaccctcatcctcaccctcaccattcccatcccgtaccgtaatgtcccttgcaaggcctaactctgtgaggaatgaaaccacctcatccttgttccaataacatgagtgaccgaatttacaaacgagtgaatgtggacctctggaaacattacccagcttgtttttacttttcactttctctttctgcccctttcatttccgtaggagccctttacctagatgagaagtgtccccccgcctggggaatatatcagtcagaacaatcttcctgcagacatgcaccattagacccgagtgacggtggtgccatttaaacctcagagcaggtaaaaggtggtcctgaaacctgtctacccacagggtgctatggaatctgaatcacttcttttttcctagagccctggggtggggagctccctcaagtgttcacatgtgtgtggaatgaggaacacccatctccttggccctctccaccctgaagagttagttattaaaataattggcaagctcttgcaaatgtcagtcatccattgttcagaatggaatagcaataatacatccctggctgccctgggcttggccaggattactcactgaaggcctcagggttactggcacacactttcttttcctaataatcccatcccctcagctttcctaaggctagagtgaatttcgtgttcctttagtttacataagatggtgaacttggcaaaagctatcattaaacagaagctaagagaaagcctatgtcgtggaatccagaatgggtattgccattcactgctgtccacagaagctgtcttgaatttctttctgtgtcttttctttttttttctttaagactgttgtttaccagactgggctctgtggaacacaggtgtcctgggagatggttaatcattacaaaatattggtaacaatctaaagatgcatacataagagagtggtcaaataaaccattttccattcacatggtggagtactgtgcagctatacagaagaatgaggaagatctctctgaatggttatgaagtaatgtctaggacataaagttatgtgaaaaatgcaatgcccaaacgagtgtctatagtatgctaccctttatattagaaagaagagaggccaggcgtggtagctcacgcctgtaatcccagcactttgggaggtgggtggatcacctgaggtcaggagttcaagaccagcctgcaacatgggggaaccccatctctaccaaaaatacaaaaaagttagccaggcgtggtggtgggcacctgtaatcccaactatttgagaggctgaggcaagagaatcacttgaacccaggagttggaggctgcagtgagccgagactgcgccattgcactccagtctgggcagcaagaatgaaactccatctcgaaaaataaaaagaaaaccgatagaagaaaatacacagatgcaaaggaaatataggaaggacgcccagagacaaaataggttggtgggtaaaggctagaaagaagggaaggatgagactgggctacagggatgagaagggaatgacacttctttgaaatatctttttattttatttatttatttttttgagacagggtctcgccctgtcacccaggctggagtgcagtggtgtgatcttggctcactgcaagctccacctcccaggctcaagtgattctcgtgcctcagcctcctgagtagctgggattacaggtgtgtgccactacgcctggctaatagtagagacagggtttccccagtttggcctggctgctctcaagtgatatgcccaccttggtctcccaaagtactgggattagtgaaccgctgcacccagcctgaaatgtctttttctataactgactgttacatactgtgatgtagcaatgtttcacatacccttcacatactgccaaaataaataagagcaaccaggatgtagggaaaacagaaaacaaaattacagatgaactccaccataccgcaggtgagtaacataaccatactgaagggggcaggaaagaacagaactaacaaataactgtggaaaacagtatctttactggatatggtaagagtaaaggcaaaaatttctgtacataaaagttgtagtatagttattaaaaatgtttctcgaccatgcgtggtggctcacacctgtaatcccagcactttgggaggccaggatgggcggatcacctgaggtcaggagttagagaccagcctggccaacatggtgaaaccctgtctctactaaaaatacaaaaattagccgggcgtggtggtgcacgcctgtaatcccagctatgtcggaaggctgagaattgcttgaacccaggaggcagaggttgcaatgggcaaaaaaaaatgtttctcacaggagtataggttagtgattctgaaactatgtatactaaagttgaacaaacaagtaaatagattgtagactatgagggctggatttcttactgttagtgaaagaggttacaaatgataggggtctagaataaaccccgtggtgctgggttagaataggaggtgtcagtctaaactcatgattttaaaattttaggctctggtggctcactcttgtaatcccagcactttgggaggccaaggcaggtgaatagcttgagcccaggagttagagatcagcctgggcaatgtggcaaaaccccatctctacaaaaaatacaaaaattagccaggtgtgatggtgtgcgcctgtagtcccagctacttgggacgctgagatgtgagaatagatcgagtccaggggttcaaggctgaagagagctgtgattgtaccactgcactccagcctgggtaacaaaggaagaccctgtctctaaataaataataaataaaattatatatagatggatacagaaatatagatgtgtgtgtgtgtgtgtgtgtgtgtttatgtgtgcttagtatacatacttatgtttcctagctctgtcctgagtgtgtctagaggcaatggcacccagtaacagtgagcacacccggtacccagttcttggtctccaaacatcattctcctgcaaaaggaaccaggtctcctaggagatgtggttgattccagggatgccacaggggaatgacaggatgaccctggaatatcttgtggtgctagaaagaaagtgcagggatgtggggggatgatggagccatgtcaagggaattgaggagcttgcctgaagttcctaacggccaaagctggaacagtttgaggaacaaaataaattatgttagtattggattctaacacatagactaaaataaatatccacgaatccatgctgatataaacagttgaagaaataagtaaacagggaagaaagggagtgcttccttatggtagatttccagttaatacacacaaaaggcaagagggaaacagagacttgccattacataaacaccacagttaaaaaatcacaggccaggtgcggtggctcacgcctgtaatcccagcactttgggaggccgaggcaggcggatcacaaggtcaggagatcgaaaccatcctggctaacacggtgaaaccctgtctctactaaaaatacaaaaaattagctgggcatggtggcgggcgcctgtagtcccagctactctggaggctgaggcaggaaaatggcgtgaacacaggaggcggagcttgcagtcagccgagatcgtgccactgcactccagcctaggtgacagagggagactccgtctagggaaaaaaaaaaaaaaaaaaaaaataaatatatatatatatatatatatataaaatcacagacaagatttacctgttgatactaaaattagtggacagaagtttgaggaaaaacaagatttgcatagtttctatttcccctaatatacttatcaagtaaaaagggaaagaaattaactaatttgacagtggagatggaaaccccatagaaaccagcttaataagtgattaaggtaataagacgtagtgacatcatgaagcctttacaaagatgcactgaggacagcatcttttttttttttttttttttttttgagacagggtctcactctgtcacccaggctggaatgcagtggcgcaatcacagctcactgcagcctcgacctcctgggctcaggtgatcctcctcagcttcccggggagctgggactacaggtgtgtgccaccaggctggctaatttttttttttttttttttttttttttgagacggagtctcgctctgtcacccaggctggagtgcagtggcgggatctcggctcactgcaagctccgcctcccgggttcacgccattctcctgcctcagcctcccaagtagctgggactacaggcgcccgccactacgcccggctaatttttttgtatttttagtagagacggggtttcaccgttttagccgggatggtctcgatctcctgacctcgtgatccgcccgcctcggcctcccaaagtgctgggattacaggcgtgagccaccgcgcccggccattttttgtattttttgtagaatagggcttttgtcatgttgcccaggctggacttgaactcctgagctcaagtgatctgcctgccttggcctctgaaagtgctgggattacagtgtgagccatcatgcctggcagcatcatttgtttttttggtgtggtatccttgccagaaatgcatacttgactccagtattaagaaagcaccagacaaacccaaatggagggacattcaacaaaataactgattggaaaaaactctttaaaagcatcaagatcgtgttagacaaggaaaaaacaagaactattacagactggaggagacaaaggaaaatatacaaatgcaatgtgggatcctggatgggctcctggaatagagaaaggattttaatagaacactaggaaacttaaataatatgtgtagtatcgttaataacattgtatcaatattaatttcctgttcttgatcattatattatggttacataagatgtcaacttcagtgcaatgtgggatcctgtatatgctcctggaatagagaaaggatattaatggaacactggggaaacttaaataaggtttgtagtatagttaagaacattgtatcaatattaatttcctgttcttgatcattatactatggttacgtaagatgtcaactttaggagaagcagggccaggagtggaaaggagttctttgtactattttgcaacttttctctccatctaaaattagttagaataacgcccttcatgggaaataaaggcagagcacaacactgtaaatattacaatcccaaatgtttaatatatgcgtatatagaaaaaagactgggaggaattgcaggaatgtggtgacattgggtatcgctgaatggtggaaattatggtaaggtttgctttcgttttcatattcatctgtactttctaagttttctactcatttgatggtttaatatggtggatccttggaaataacggtgaatgagacaagatgaagtttatctctcatggagcttatcttctaatggggggaaatggaaaatgaatacatgaattaaaatctttgtgcagaaaattaagctgatgtgatagatggtcagagggggcctctctgagaaggtgacatttaaggggagatgtgaataacaaggaagagaacatggcagggtagggtagggagacagagcagagggaacagtctgtgcagaggctgggaatagggccaggctcagcatgttccagaaccttgcagaagccagggtggctctggctacagcggacaatggggaagggacctgagatgagttcagagggaaagtgaggggctgagcctgggacttgatatggcctcgggcacccctggagggaactgaacacatgagaatcatgatcaaatgtaggtggtttttttttgttttgttttgttttttttaacattttctattttattttattttttaaatatatagagacggggtctttctgtgttgcccaggctggtcccaaactcctggactcaagcagtcctcccacctcagctttccaaagtgctggaattacaggcatgagccaccacgcacagccctaatgtaggtttaacggaatcctccagcattcgggtggagcacaggctgcagaaggctggcagcctccagggacgtgagtgagagaggatggtgaatttggttactgtggaaggaggggggaaggggttggattcagactctgttgtgaaagagaggagctaggaattggatgaaggatgtgatagagagagagagcggggggaggaggaaagagagaggagagagagatatatgttggtcaagggtgatgtctgcattggattggagtgagtgagtggatggtggactcatttacccagatggggaatgcgggagcggcaggcttagtggagagagcaaaagttctgttttggtttggaataagcatgcttattatgttaatggtcagaaaagaatgaataaaaaaaaaataattagctcgcctttcctgcccctggaatccttggcctaagttgctctcccaggttcctttgctgcaggtcaggtgccctgggggatatgccttggagtggctgtcatggttccaagctgacgcaacctcttgcctcatcctcctgagattgctgacctgctctgcctccagatcagcctgttcttttttttttccatttatttattttaagagacagggtctcactctgtcacccaggctggagtgcagtggtgtaatcacggctcactgcagccttgagctcctgggctcaatcagtcctcccatctcagcctcctgagtagctgggactacatggctggctaattttaattttttttttaaattatactttaagttttagggtacatgtgcacaacgtgcaggttagttacatatgtatacatatgccatcttggtgtcctgcacccattaactcgtcatttaacattaggtatatctcccaatgctatccttcccccgtccccccaccccacaacaggccccagtgtgtgatgttcccgttcctgtgtccatgtgttctcattgttcagttcccacctatgagtgagaacatgtggtgtttggttttttgtccttgcgatagtttgctgagaatgatggtttccggcttcatccatgtccctacaaaggacatgaactcgtcattttttatggctgcatagtgttccatggtgtgtatgtgccacattttcttaatccagtctatcattgttggacatttggcttggttccaagtctttgctattgtgaataatgctgcaataaacatacatgtgcatgtgtctttatagcagcatgatttataatcctttgggtatatatccagtaatgggattgctgggtcaaatggtatttctagttctagatccctgaggaatcgccacactgactaccacagcggttgaacttgtttacagtcccaccaacagtgtaaaagtgttcctatttctccacatcctctccagcacctgttgtttcctgactttttaatgatcaccattctaactggtgtgagatggtatctcattgtggttttgatttgcatctctctgatggccagtgatgatgagcatttttttcatgtgtcttttggctgcataaatgtcttctttcgagaagtgtctattatatcctttgcccactttttgatggggttgtttgttttttttcttgtaaatttgtttgagttcattgtagattctggatattagccctttgtcagataagtagattgcaaaaattttctcccattctgtaggttgtctgttcactctgatggtagtttcttttgctgtgcagaagctctttagtttaatgagatcccgtttgtcaattttggctttggttgccattgcttttggtgttttagacatgaagtccttgcccatgcctatgtcctgaatggtattgcctaggttttcttctagtgtttttatggttttaggtctaacatttaagtctttaatccatcttgaattaatttttgtataaggtgtaaggaagggatccagtttcagctttctacatatggctagccagttttcccagcaccatttattaaatagggaatcctttccccatttcctgtttttatcaggtttgtcaaagatcagatggttatagatatgcggcaatatttctgagggctctgctctgttccgttggtctatatctctgttttggtaccagtaccatgctg

SEQ ID NO: 1215 - DNA, 1960 bp, Homo sapiens
gccaagttatgggtgcgttctgccagcgtcctagcagtgataaagaacaggaaaaagagaaaaaatcagtgatctgtgtcgagggcaatattgcaggtgggaagacgacatgcctggaattcttctccaacgcgacagacgtcgaggtgttaacggagcctgtgtccaagtggagaaatgtccgtggccacaatcctctgggcctgatgtaccacgatgcctctcgctggggtcttacgctacagacttatgtgcagctcaccatgctggacaggcatactcgtcctcaggtgtcatctgtacggttgatggagaggtcgattcacagcgcaagatacatttttgtagaaaacctgtatagaagtgggaagatgccagaagtggactatgtagttctgtcggaatggtttgactggatcttgaggaacatggacgtgtctgttgatttgatagtttaccttcggaccaatcctgagacttgttaccagaggttaaagaagagatgcagggaagaggagaaggtcattccgctggaatacctggaagcaattcaccatctccatgaggagtggctcatcaaaggcagccttttccccatggcagcccctgttctggtgattgaggctgaccaccacatggagaggatgttagaactctttgaacaaaatcgggatcgaatattaactccagagaatcggaagcattgcccataggaggcaaaaggtctatggctcatgtctgaaaaatgcctgctgctgccaagttagctattgggagcaatctggaaaaacttgctcccaggagggctttgtgtctggccagcttgattttcctaatggtctcatctcctttgctagtgtctttgtcatgcgtctctggccctcgtgggtaaatgacaaacgggaccaatgggtttgccaagccctttgctgttcgcagccctcacattcccccggtgcctctcccatggctttgtgctgctgagtcgctctcatgaagcccttaggggagagcacctgttgtgtgcctgacaccacgctggagctgtgtaccaatcgtctcagccttcattaggaggccgaggtaggagtcttatatcccaggtgaggaatttgaagctcagaaaggttgaggggctccccagaggtcacacagcctgtgtgcagtggagctggcaccattcagactttcagccgactcagcaactttcccttgccctgggctgcctcctcctgagagctgttccccaccgccctgcctcttccggttggaggctctcatgtctctttggggagagctggcagtgtgcggagctgataacattttcccaatattgagcagttcccaaggacagtcagcatttctagacttccacaaaattatgctgcatttggctggagcccggtgttcagtggtttccctgcccgaggtcgctgcagccccatctaccacatcttcatgtggacattgagattcacatgctggctcctgaagggtgctcagtctccttggtgattaaggtcctgcttgaactgctgccaactccatgtcagggaagtcgcttttggtgcctggctggtttgcccagagccaagctggggcaaggggcagccagccctggcttccaaggctcccgtactgtctgtgtccttgtataaggagctttgctcttggaattactgaaagtctgtggccctaagagagagacacaagtggccttaagtctttttgaagtgttatttcatccagggaaatgcctcgagccatagagcctgaaatcatctttgttggctcagaaaataccttagcttcactcagctggactgcattgaaggcgaggctgccccttggatcaagcagaaaacaagagaaagaaagaacgttccctttggggatagtctggaaagttgggatttgcaaataaaggctctggaagcattaaaaaaaaaaaaaaaaaaaa

SEQ ID NO: 1216 - DNA, 705 bp, Homo sapiens
atgggtgcgttctgccagcgtcctagcagtgataaagaacaggaaaaagagaaaaaatcagtgatctgtgtcgagggcaatattgcaggtgggaagacgacatgcctggaattcttctccaacgcgacagacgtcgaggtgttaacggagcctgtgtccaagtggagaaatgtccgtggccacaatcctctgggcctgatgtaccacgatgcctctcgctggggtcttacgctacagacttatgtgcagctcaccatgctggacaggcatactcgtcctcaggtgtcatctgtacggttgatggagaggtcgattcacagcgcaagatacatttttgtagaaaacctgtatagaagtgggaagatgccagaagtggactatgtagttctgtcggaatggtttgactggatcttgaggaacatggacgtgtctgttgatttgatagtttaccttcggaccaatcctgagacttgttaccagaggttaaagaagagatgcagggaagaggagaaggtcattccgctggaatacctggaagcaattcaccatctccatgaggagtggctcatcaaaggcagccttttccccatggcagcccctgttctggtgattgaggctgaccaccacatggagaggatgttagaactctttgaacaaaatcgggatcgaatattaactccagagaatcggaagcattgcccatag

SEQ ID NO: 1217 - DNA, 22153 bp, Mus musculus
  misc_feature (6130)..(6149): "n" at positions 6130 thru 6149 can be any base
ttgcagatctagacattgacatctggtcttctcaaagctaagggcaggcatgctctggccttgaactccatgctcagccctagtccttcctttcttcttcttcttctgttaaatggggtttgatttctttgtctgataaatgaggctgggagggagggagagatgatgactcagcagttcagagctcttactctttcagaggacccaggtttgattccagcacccacctggtggttcacaattgcccacaattccagggtgcacatgatacagacaaaattcaagcaaaatagtcacacacacacataaaatacactaaataaatcttttctgaaaagactaaaagggaattgtgattgctggtctcttgggctacagccaggagctgcatgtttattctgtattcttctagtttgttgctctatttgcccactatttttttagttaccaggaaaaatgtatgatagctatattttgctgaaatatgtataacgcataggcacttgttcttaaatttcatgcaaatagtattacctggttggttggttgatttgagaaagccttgataatcatgtagcccactctggcctggaacttgctatgtagctgttgtgtctgtcattgtcccagccaagcaactgcagtcttgaggagttcaactgtacccccttgcaagaaaaaaaaaagtatcctaagctgggctttcttgactctgtacacctcctcatgaaggagtgaggaggcttgtgagaccctcacctgttcctccaggtaataaaaccccagtccctgttgtttgcaagtctgccttaattgcacatgacctgggaggaggctagagtatataggccaggggagcacagaggaaggggagcccatccttgtgggatgggtaggagaaggagcatctatgcccaggtaggtaacaccccttacctctctgctctggaaggaagcccaagaaatgcattgtttccctagggtgagctttggcagaaccacgccttcctttgatgggggaccttaaaagaagaagtagactttgtgtttatgtctccagggaaggaattttaaccaaagtagctgggataagcttgaactcaggtgtgaactaccacacccagtttatgaagttctggagatagaaccaagagcttcaggtatgcggggcaggagctcagccaagtaaactgcatccacagccctcgcctctttacttgctgtgagaaactctgcacgtagaacagagtatcagggaggtttgtacaattcgggatctcaccaggatcccctaagcacgtgttaacagcagcatccagtctcagaaccaagagaaattaattcccagtgcagccctgggtttaagggttttatggaccaggcacaagctgtaattactgggctgtgctaggtattcctggcaaccacctggaaagttataaaggtgtaatgagtgataaatagcaatctccctccccccaaacaaaacaaaatcccagaatggactacctggaggccacaggatgtggaaacttaactcttcatttcccaatgagtcacttttgaattcctactgatctgagtggagtttaaaatttttccacaaatccttttctcaggtttctattctttcacccagcacctactcctctctcccttcccctagtgtttacatttcctttcttttattcctgcaagttcccagccagaaacccttacccttactccatcatcacagagtctcctaggatcttggaggtcctctgtgaggtctgcctcttcagagcagaacatctaaaagttggacacacaatcctgaggcaccttgtcagagtttgtgtgttttgggttgtcatttgctgagctgggtgttcaagacatggagattaagcaaattgcctgccctagtgaataacaatactatcttcaaggcgctgtgctaataagctcccctcaccccccagttttttcttcttaagacggagtcttagctgggtgtaacggcctgtaatcctagcacagaggcggtagcagaatcaggagtcctagatcggcctacgatacatagtaacccgagtcttaaaagaaaagaaagcatgctgagtatggtggtgtatacctttagtcccagcaccccagcactatggaagtagaaacagtcagatctctgtgagtttgaggccagcctgatctatatagtgggtttcaagatagtaagggatatgtagagagaacttgtttcatatacatacccacaagcaaagccaggctaggtggtgactgccttaaatgccccagcactcagtgttagctcaggcttaatgagatgatgtgaaaataaaaagggagagaaggatgaggaatgggagcttcccttgccaaggagacgcagatctgttccctgcagtctcatggtaaataaaactgaggtttggtttggcttttcgagacagggtttctctgtgtagccctggctgtcctggaactcactttgtagaccaggctgtcctcaaactcagaaatctgcctgcctctgcctcccgagtgctgggattaaaggcgtgcgccaccacgcccggcacaactaagcttaagagaggtggacttccttgtcaggcagctgtactcatcagaagctcaggccagagttgctcagatcacctgaggctctttgtttcatggactcctcactccaggaagcagaggatctctgtgactttaaagcaggtgtgagacaaaccaggagctatattgttatacattgttattaagtctccattccttacaagaataagtttctctttcctaaacctaaagtatcctgcaaactgttttcaatctaccctgaaccgggcccactcttttgtcttgataaacccctgagcctgtgataagtgatcacccttttgctttatgaaagtgtgtcttcccaggtacctgatggctcccctttgacataatgtgttcttgctcttatttttattgcctcctttctagcagccagtaaccacagctgtttcctattacacttatctaccccaaggcagccttgagccctgagtgcccccattctctgtccagtgctaacagccattatctttaccgctgtcttttcttttccttttcttttgttgccccccccccattttgttttgctggccttaaattcagagacctgcctgtctctgcctctcattataggcatgagccaccactgcccagcatggacagctgtgtctatcaaccctaacccattcctcataaaagggttcccaaaagccagtgaggggctgttctctgaaaccccaacttagggtaaggcagccatctggccagtcccttgtgcacttctcaataaagctctcttaatcagacagttgtggaaatggtttttttctcagatctaacaccagttggttctacacagtgaattccgtgccagccagggctacaaagtgagactttgtctcaaagcaaaagaaagagaaagaaaaaataatgtggagaggaggagacaagatcttgctgtgtgttctaggccagcctcaaacttgtgatccccttcttcagccttccaaacagctgagatcacaggcatgcaccacagcaccaaactaagagttctgccccttggaagttagagggagggagtatatatgcatgtgcatatgcatgtgtatgttcaagagcgccttgggggcagagggttggggaagaggcacacaagtatttcacagagctcgtatataggttagaagacaatctatgggaattggttttctccttctgccacgtgggtcttggtaactgacctcagatcctcagggctgacagcaagtgttttgatgtgatgagccatctcatgagccccaagaattatccttttaaagctcccagagaccccactgaaatctacgaatggggaaacaaagacacagagaggttaaataacttgtttgatgacacacagccaacaaaggatggaactaaaaccttggctccaggcagccagattccagaaccttctcctttaaccactgtctaatcaataatagtttgattctaataaagacaaatttctaaaaagtgaaaaagatactttattttgtttgttttcctctgtgtagccctggctgtcctggaactggttttgtagagcaggctgggcttgaactttgagatctacctgcctctgcctccagaatgctggggttactggcgtatatcatgcctggtaagataccttgttaatgctaagtggatgctgtgcagatagtaaactagagcaaggtggcgcaggactacagctgctggtgtgtgtggaggttttgtgtttggcctgggtttgtctgttatttgtttttgataagggttcattatgtggcccaggctggtcttaaacttgagatcctcccgcttcaacctcctgagtgcttgggctacaggcatgtgttaccatggttggcatatatgtggtactttgaacaggggtgtgtactgctacattgagcatctatctccctacgtcatagagctttcaaaaggtatatgatgttctctgcaggctctgtacaaggcctggtccagggaagactcaaatgcctgggaaggaagggagtgcagagggagaggcctggcaggtgactcagtgcaaacccttgtcagtgtttgcccagctggggtctgtgtgtagatcatgggtcctgtgactttgaaacagatacccctggagcctctttgaggaataaggaaataacatgatgtcacatgttggctctgggctaagccctgtcacacacatagaggtgttctcattgtcctggaattacacaggaacaaactgaaacttggaagttgacagcatggtgtgccatgatgaagcagggagttctgtgtgcctttaggaaggaaaataaaggtaggacagttgtgtgtccatgtgtcccacatcctgactgtcctgctgtcttcctggacattcaggacactagtaagcttttttacagtctgttttcctataacctgatgtcaatctatttcaaatgagaggaaatattttctgtcatgatgataaaggacaggtaacaaggacatcattttcggtacctttgtcttgatacgttagccctgggttttgtttctttgcttattttaactttttttttttaaatattgatttgaggtcagggtctccctgggtaacccaggctggccttgttaatcttagtatcacattaaagaacttcacaaatcagacataatccagcaaagcaatttctttttatagagtcgtgacccaaaccaggctagcaagcacaccggagcaggaagttcacttaattgttattctaacgcaagtattgactgagtcacctctcattggtgcagcttggcctcataatctgaaaagactggctaatttataatcacacacaaaggaattgaaagaacagagggctgtgtgtcatcacattctgggacttagtgaggttttgtataataagagtttcagttgggcattttacattgtggggagatttatggcacactggctcttggtgggctaaccacattaggtggaaaaaaaaagattctcggagccttggctttgagatcttgtggtggtgggatttcaagccggcaccaccacacccagagctttgtttcaaggtttcttcccttgtgtttatttccaccttgggattagacccagagcctcaaacctgctactctctactctctgtccctagccttcttctaactttctgccttgggacagagtctcaccaggtttcccaggctagacttcaactcattttgtagcccagtcaggctttaagtttgccttgtttcctcagtaactgagatctctcattctcaacaccagagtcaggctccataatgttatcctctctggagtctcctcataaggtttccaattagcccagtactgctctgattcaagcaacttgctggttttactctcatatcctaggtttacattttgatttaccctatctgtctgtctgtctgtctgcctacttaccatatgtttgtgtgggactgtgatgtaagcactgcctctgtgggcatctgtgtgtttgtacacatgtgtgtgtgtgtgtgtgtnnnnnnnnnnnnnnnnnnnnacacgtgtgcacctgtgtgtatgctcgtgtgtatacctgtatgtgtgtgtgcctgagtgtgtacacctgtgtgtgtgcatgcctctgtgtgtgtgcctctgtatgtgtgtgtatgtcattagtattctgtctaagctccaccccacagttacctggcaacagccaggtaggcctgactcactataaaaggggctgcttgccccctcctccttctcttgctcttcccttcttgctcctgctgtctttcctccctacccctccagtcccttctcccctctctttccatgtgctcatggccagcctctactcctgttctcctctacttctctctctctacctttctctgcctctactaccctcttaaccccacccccaccccatgccctgaataaactctattctatactataccatcctgtggctggttcctcagggggaagtgccttagcatgagcccacggaggcaccacttcccccatacctcaccacacctccatagaacatatctcccttttctttattttttgtttttgtttttataaacatatcacacgtggtagcaggaggatgctttattccctgaaacagggtctgtcactgaacttggagctaggcagcagctaataagcagtccttctgtctgcttcactagtgtcacagtgctgggggcagaggtgtgcacatggccgtgcctggcttttaacctgagtgctgggatcttagcgcgggccttcttgtgcagcagtgctctcacccacaggccatctctccaggccctgggccggagctttaaagcagcgctgacacaagaatctggaaaacagatgcttggttttgtttatgttcaggggagaaagccgcaaacagaaacacagcctcttcttaaccagggcaaccagggcctgcagcaggcctggggtcacatccgagccttgtgctgacacggagggaggttcacagcctgtggacgtgggcagaggacttgatgtctggccagggttgagagggtttggtttttctggaatccagttttgttttgtttttagatgtggaatgttttgtctaactccctgcctggagacagcaatgcagatagaattggtgtgggcaccctttctgggctaacatgactcacagggttcatatccttccatcaagagtaggaaattcccctttcctccgagctcagcagctctgtggaagaggaggtggaaagattgtaagagccggggagtgtggataccacgaaggaaacagtgtcttccagacacaacaggactgattgatacacatatgaactcaacacgctggcagcctgcctgcgcctgcccaggttcaagccacatggggtcacagcactgagaggggaaagtggacatggactcccacccctaaccaaattgacacctgcttacaaaggaaaacttagtttcctccaatagagtctcactggctgcattaaccccaggtaagggtcagccccatggccagcaggagatgccaacacaacagtacttttatcggctttcttttctcacggtgttttcatcagacatgttttggtcttattggtcctttgtttacatattatagtttctgattttgtgtttttatggatttgtgtgtgtgtgtgttttgttaggactcaacccctggacaaatggctaactgaagtgcctattaacatatcagggcagatgctgtcagcctgcctctctcagcattgccagcacctattacggagctgtcctggctggtataccccacatgctaccctaaactctcccttcccacagtttctctgattcctaaataagatgactatgctagtatctttgcctttttattacctcttggtctctgggttctcaggtttttttgtttttttgtttgtttgttttttgcctcttggccacttggtccaaggttcctctgtcgaccctcctctcttctcttccccctgtctctttctctctctgtctcccacaggccctgttaagtctgctggccatgttcactctggactcttgcagatagctctgcttgtgctctccctcatgtctacactaaaccttctccaccatacccaggagccgcatggcctctgctttttaattttttcattcatatttctgacgacgacgacggtgacaatgatgattcacctgttcgtttcctatagagtaaaatttgggggcatggggagggtctgggaggagttggagaaaagaaaccttgatcagaatacattgtatgaaaactttttttaaaataaaaaaaaagtagaaaatttcatttcacatgctttttatttgaacttaaaattcatactaattcttatcaaacaacccaagggaagctagtatggactgaaaaagcttactattagttcacacttgattcatactggctgggtgtggtgatgcacacctttaaacctggcactcaggagtcaaaggcaggttgatctctgagttcaacactagactcaaatctggcctacagagcaagttcttagccagccacagctaaaacagtgagactgcctaaaaaacaaggcagggggtatcaaagcacaaatacctgtttatttcattctgccctcaatatattatttaaattttagaagtcacacgtatttattgtgtgtgtacatggataggaatgtgagggtcagaggacaatttatgggacatttttctctcccatactgtatgggtcctggaaaccgataaactcaggttgtcaggcttggtggcaagtactttacccattgagtcatcttgccaacccacaatattttattttaaattccttttctccactcttttttttttttgaggggggagggtcaaggcaagggcactgtatgggaacccatgggaagttgtgactaatccttacactgttcccgcttgtgaaggttttccaggcctcatgagtctgcaacctctcaccaacagagccagatagagttatcctctgttaaagggggaacctgaagcaatcagagagggaaagtgacgtgtccaaggtcacacagcaggaaacactggatctgagctgacttgtgatcccagcatttaggatgaggaggccagagaattgcaagttcaagggctaacctgggctccatagaaggattctgtcagaaagaagggtagagggaggtggatcaggaatcagagtgtggaatccagggtatttgctgtctctatcagctagctatcctccatcttgcatgaggaagaagtccctggggactctgttgaaggggacttttcacaaaaatagaagccttgggtgtgacaggaactgctgaccaagcaagaagtgggtcagtgtccctcctccctcccttttcagtatgtatgctgccactacctcctgaatctgaaccagactacagtgtgtgtgtgtgtgtgtgtgtgtgtgtgtgtgtgtgtgtctgtctgtctgtctgtctgtctgtctaactatgacccaggcccaggaggggcttgtggcagaggctgaaatgataggaaggactggcctatctgaggccctctgctctccctggccaatatcccaaagactgtgcccagatcctgtctgcttcctccgcccctgaggcgagagctttccacgtggaaaaacacagctgtgcttgggtgagtcctgtgagggaggagggaggggagggtgctcctctctgctcaggactgctgtctatgggcccagttctgggaaagggccagattgcatcagacagggcttggagggcgggggccaaccccgtggtttagggaggagacagcgttataagtagggtgagaaactgggagagggcagacattcagacaaggagacacaggcaagactttggagagagcagactaggcataatggccaccttgccaccaacagccaacccttcccagcaacctctaaacctagaggatgaagatggaatcctggatgaatatgatcagtacagcctggcccatccctgtgtcggtaaggttttcgtggtagctccttggtcagcccatctgcttctcactgggtaccccggtttacctttcctagctaatctattcccaactcccaagtaaccccttctagtctcatctactgagttctgtctcccttagccccaagaactcacaagtgagcatctctcattctatacttgagtaaacagcaaggatagagtgcttcagacgtgaagacgtgaccgccccactctggccatttatatgcctgtcctaacctcacacacctcctctacctcctgctccaccagtcgggggaggtcggaaaggtcggaccaagagagaagctgctgccaataccaaccgccctagccctggcgggcatgagaggaagctgctgaccaagttccagaactctgaaaggaaaaaagcctggcgctgagacggagctggaggtgagtcgggagagccgggcctaagtgtgcagagcgggaagcggggaaccaagagctggtcctggtgagatggcgctgcaggtagaggcacttgcaggcaagcaggacaacctgtgcttgatctctgggacacgtgggatgaaaccacgtgatgaaaggggagagaaccaattgcaagctgtgttcccgagggagccctgcagatagatgtccaggcagggaagtgataagaatgaaaaccccattcagactgacttccatcagcttggatcagatttcagggcatctaacgccaggcggttcactgtcagcatatttaaaacacagtacaatttgggaagaggtttctaggcaacagtcagtccatcagttcagttccaggagcacaataaagcttgaggtcatcaggcagatgtgacatctttcctaagagtgggtaatggtctagggaggggagagtctgggattatcattctggagaacttgagtgaggtcggcttctatagcaaaagctgggggaggtctgactccacacagagccaaaagctcaccgggttgttaacaaaatccactctcagatttctgagtggaatgcaggtatttgactttatctcctgcattgtggagacacacggcatgattaaaacttctggttcttagtgcttctcttgagtacaaggacttctgtacctccaatgtccaccgacttccatatgctcaaagtagcacatgagaatacgcatgtgcacacatgcatgcaaacacattggcatatcaataaatgaaaaaaataatgttggccggacagtggtggcgcacgcctttaatcccagcacttggtaggcagaggcaggtggatttctgagttcaaggacagcctggtctaaggagtgagttccaggacagccagggctatacagagaaacctgtctcgaaaaaacaaaatacaaaaaacaaaaaccaaaaccaaaacaaaacaaaacaatagtgttgtgacactatttttattctacatctaaaataatatgagacccgtatttgactgagctccctggtaaccagaggtggggggagttcccatggagcctttccaatggagaggaagtttggtttatggaaagggaaactgaggcagatagagtcaagtacttctctaaggtaatagcaaatatgagtaggaaaggtggaagtcaaactctgatctctgtccctttcgttgcctgctttccctctgcacagataaggccagaccacagacaccacacccagcaatggatacaggacatcacacccagcaatggatacaggacatcacacccagcaatggatacaggaccttggagaaattaggagttgtaagcaggacctaggcctgcttgattctttcccacctaagtgaggttctggagagggagcccttccacccttccagacccagcaaaagggcaagatgggagcaagaagcagagggtagacgggcagagctaggaaggcagcccccaaaagaactgtgggggaaataaatcggatgcccttgggtggcagcaacaataaatcgtacagcagtgacagctttggcatgtgttgtgtgtctttgttgtgtttgggtgtgttgtgtctggctgtgtccattgtgtgtctctctaggaggctgatctggaatgggagcgtccttattgcgtagcatatgggcttgaacggttctccgtgattgttgccttcttctaatgtatgcagatgctttgaggagcctgtttctatggtttcttccagggaagttgctttgtttctttgcagtgctgtcccagagacaacctgtggccagtcccctacatattcttgagcaccacaaggtcctattatatagagctgcttttggaagagaatgtttctattaataccatttgcaaaatggaaaaaaaaaacagcatccatgatttaaaacatgcagaggatttgttttaagcaaccgagggctcaaattcagtcatgaaataccaggctggcttccaggatggggtgcttggtgagctggtgagaaagctctccctaagcatggtgggccgatgggtctcaggaccagaattccaggcaaatgtgaagcaaatgagaagatggttgaaccaagtgtagagtggcctgaggtctgagtttggaatgttgcaattttactcagacgaaacaatgttctttctcacacacaagttctatgagtaaatactcctaagtaacacaggtggcaagtccattttcttgaggctggtctcaaactcctgaactcaagtggccctctaagcctcaaattctaggcacccgtatcaccactcccacttagcctattcgttcttaaaaagaattatttattcattttctgtatatgagtacctggtagctgtcttcagacacaccagaagagggcatcagatcccattacagatgattgtgagccaccatgtagttgctgggagttgaactcaggacctctgaaaagcagtcaatgctcttaactgctgagccatctctccagctcaaccctatttatttttaaggataccatttgatagtagaacgcatagcacctgctcacagtttagtcacatgcttgaagagagaggccggggaatgccattcttagctgccagccatttgctaacccaagctgaggtgagggcagagttttattagaggaagaagatggagcatactggaagaaataagcagaaacattactcaacactcagactcagccaaagtgggaggaaagagcccttgctcttgctctgggctgagcctttgtcccttctcactaacccagcttgtagagcctggagcccattgcacttagatggaaccggaagctagggtacttacggaatcagtggcctcacagcaggctgtgggtcagctgcaactctcagggacatatccagccacctcctgtgcagctgggaacattaggacaatttctggtctggctgggcatggtagctcacatccgtagtcccagcattcggaagacagaggcaggcagagtttatgagtttgaagccagcctagtttatgtagttccaggccagccaggactcatagcgacaccctatactagagaagggggttgggggcggagggagggagtgaaagctgcttctggtcctatctcagtactccaggccaaccaggactcaaagtgacacccaataaatcaagcaaccaagcaagcttttggtcctatctcagtgctctcaggaatgtccggtttccttagtgccaagaagaacaagaagaataggactggcttccttgaaggctgtccaattctacctcagggcaactgctttctgtggactaccagccaaccacctgctctggaaggttctgcttctctgttcaggatgcccgtgacgccacccaacctgcaaggctgagtcaaaggccttgtcttcagcattcctctgctgggccctctcccctccttctgttgatctctcctctggaatgccacaccagctaacaggctcacggatatttcttttggcaggtggttttgtggaaattgtcctggtggcaatggagtgggccttttatttttaaataggatctcactctgtagccttgtctgtgcaggaattctgtagacaagtcaggccttgaactcatagagatctgcctgcctctgcctctcttgaatgctgatattaaaagtgtgagccaccctacctagcccaaatcattcattgctttgacatctgttagttgcttgttattttaccagggcagggccgaagcacagactttgtagagagggacacatggtacagcttttagctttagaacctaaaatagcaccacctctgggcagcatgcttgcagcagtatgcatctgggtgtccagcttcagaaatgacagcgcccatattttgggtgcctgccctaggacagacaggtttgttcatttgtttgtagcgtttgttttctgcggggcatcaaacacagggttacatgctaagatgacagtctgaccgtggcatctgtacctgccctgcaataggattttacagttatgtctccatttaatctttatagtaacccaataggacacactactagtgttcctgtttttccaaacagaaatctaaggcccagagatttgcaagttcatactagaccacatatagtaagttacattgtatttcatggctcatttagagacacgcagactcaatcaataccacatgagactctgagctcaggttttccaacctctgaccttttcccctttgatggtgtgcccaagaaacacggggttctgggcaatgagcaaccctagattgtagatcttctaagggtgggttcgaaaacaaccttccttccgtcagagagaaaattaaggtcaagaacacccgtcctcagtgtcaatggccagtcctagctgctggacccttgagcacctgcttcttaggagatgaacacgccaccacttactcttgacctctgattgacagccctctgcctcacctgtctctggcacagcctctgtgccaggaactgttacagcaattcttagaaccttggagatctcagatcaggaaggaccctgagcagaatgtccctcttttccaccccgttttcatctcgtgcatataatgtctgattctctcagtttcggggattccttagtagaactagagaaatcactgacagaatctttcccttcagggccttccagaaacttctcagatttccgtagctgaaaggattcccagcctcttgcagagaattgagaaactcactatttttttttaactcttgtggttcctttctcaaaaattcaaggcttgactggccatatatatgtgtgcctgtgtgtatgtgtgtacatatatatgtatatgcatgcattcatataaatttcaggatgactcaaagttaattttcaactaataccccttaaagataatgctagtgacagtcatagccgtagcaactgctatgctgggtgccatggggattccccaacgtcatctctcacacagcgttccttccaggtctgtcccctgaggctcacgtgctatattgtatctacttgtcattgaaaaaccacccctttacctgttttactcaagcgcatttaaaaaggaaactatgtaaccaccctaactaggaagccatgtgctgctcataagcacaagttcactctggccaagtccagtgcttgccactgtaagcctgactttagggggatggaggcagggggattgcaatctcaaaacacaagacaaacaaaacttatatacaaatttaacttcttttaaaagttcatcgaagccagccaggatggctcatgactttaatcccaagcactcaggaggcagaggcaggctgatttttgtgagttcaagggcaccctggtctacatagagagttccaggccagtcaggactatatagtgagatcctgtctaaaaacaaacaaacaaacaaatacaaaaaccaagaacaaaaagtttatgtgcctttctacaatgaccaagagtcacaattgtgcacactaggaagacacagtgcaatgtggtaccagaacaagaaaaagtatacttggtgtgaccatggatggatgtcctccaacttacaatagttcaacttgttcattttgaggcaaggtctcactcactacatagccctagctggcatcctcctgcccctggctccagaatgctggaattaatgacacgtcaggcctctgttacgttacagtggtgtaaaagtcattcacactcaacagaaagtatactcttgtttctgtttttgttcttgtttctgtttttgagacagggtttctttgtgtatccctggctgtcctggaactcactttgtagaccaggctggcctcgaacttggaaatccacttgcctctgcctcccaagtgctggattaaaggcatgcaacaccactgcccggcgtgaagacagtctcttggtacccaggctgtgaacttgatattttgttgagcatgaccttgaacttctttaagtatcattgttgaggggaggcctagatgtgtgtgtgtgacatcagaggacaactttgtgggatcagttctttcattatacttttacaagtgttctagaattaactagggttaaaactgcctggcacgtgccttttatccactgagttgtcttgctgctccaaactttgggcttctgaactttttgcctccatcatctgagtgctggcattataagtgaacaggactggcccagaatgagaacacactcttaatcctagcacgtgggaggcagaggcaggtgggtctccgtgagttcaaggccagcctgaactacagagtgagtttgaggacaactggggctatatagaaagattctgtctctcccacccaccccaaaaaggcacacaccactgctcctcattttattaggcgatgagatcaaacccagggcttcatgcacacgaagcaagcactctatcaactgagccatagcctccaagtcagcatttaaactttttttttttttttttggtttttcgagacagggtttctctgtgtagccctggctgtcctggaactcactctgtagaccaggctggccttgaactcagaaatctgcctgcctctgcctcccgagtgctgggattaaaggcgtgtgccaccacgcctggcagcattttaactttttaaaaattacacttataatatattgtgtgtatggtacatgtgtgacaatcaggacaacattcagaagtcacttcttgccttccacaatgtaggtcctgggggattgaacttgggcttggcggcaagcacctttacttgctgagccattttgctacctctccctagtttttttttttttttagatttatttatttattattataaataggtatactgtagctgtcttcagatgcaccagaagagggcatcagatcttattacgggtggttgtgattgctgggatttgaactcaggacctccggaagagcagtcagtgctcttacccagccagatttctttctttcttctcggtttaaactttgcctgtgtggcagtgcacacgagtgcaggtgccgagttgctccccactggagctggagtttaaaagtggccacgaactgcctgatgtgggtgctggagtcttctgcaacccaagctggagtcttctgcaacccaagctggagtcttctgcaacagtaatatgtgctctcaaccactgagcacagttccctcagtccctcagccagcttgtgcagcctggactcacctactgagggatgcactcacagagagctgcccccccccacatcaatcagcaatcaagaaaacaatccacagacacatccacaggccagtctgatccagacacttcctcggctgatgttcgctcttcccaggtttgtgtcaagttgaaaatagaactaaccagagcacaggttttacagtgtagcccaggttggccaggaattcatggttcccctgcttcaagcttcccatgctaaggttgcaggtgtgtgatgacacccccaacttttgcatttcctatttatattttcatcttacaatggactcattgaggcatgaacccatcataaattggggagcacctgaacccagtaaatgaagtgttgggtgctcccattgcctcccactgttctctatattgacagacagcttctaccccaaatccatgccaacagtgtacacttctctgtggacacctacagcaggtcgtgtgatttaacctgatactgttaggatatgaatttagtgcagactctacagtataggtcaaattctacaagaacatagaagccaagtcaaagcctaggccttccttacttctgacccactgagataggtcagggactgccacaagagggcacaaaggcaaactggctctgagccctgtgcaaggaaagcatgatgtgtggttgccttcaccctggcactctccaaaagctttgccataagacatttgattatgccgggtggtgttggtgcatgcctttaatcccagcacttgggaggcagaggcaggcagatttctgagttcgaggccagtctggtccacagagtgagttccaggatggccagggctacacagaaaaaccctgttttcatcaggacagaatgcttacagtagagaagccgcttgtgatgtacccaagctaaaattagacgtagcgatacaaatgacaaaggcggaagagaattgttattgaggaaaaactttgtcccataaaatattcttggtaaaccccccaaatcaactcagatttccagcaatctgtcagagcaaaacccacaaagcctctgtgtgtgtgtgtgtgtgtgtgtgtgtgtgtgcgcatgcatgtgtgtgcttctgtgcatgtgtgcatgcatgtgtgtattggtgctggggattgaaccgagggtcttgacacatgctatagttattccactgagctaagctctcaattcttgtttcctcttttttaattctttttttttttaatttatttattatatgtaagtacactgtagctgtcttcagatgcaccagaagagggcatcagatctcattatgggtggttgtgagccaccatgtggttgctgggatttgaacttcggaccttcggaagagcagtcgggtgctcttacccactgagccatctcaccagcccctcttgtttcctcttaattgacctaaaaatcactgtttggaggtaacacagcaaggcaatgaattgctgactctgaatcccgttagccttgacatcgctaacttgtggccttgaggacagttgcttaggttcctttgcaaaaacttaaaggctgcttttgcattgggatcgcgtgagcctgtagatggaccatagacatgagataagaagctcggctggtctcctctcctgttgttcctgccccttttgctctcttacacttggaactaaattctactctgctttgcagatagacaagctgcttatgggagaaatgtttagtccaagactataagagaacttgggaccgggcagtggtggtgcatacctttaatcccagcacttggcctatttcccattgaatcatttcttttttttcacccttgggctttctctgcagtgcagcagctaaagactgtacagtctttcggccttatccttaggctgaaaccaatcctgaggacaaagcatttatggaagaggatgacatcaagccaggtatggtggcctgtgagctctgccttggtaaggtagagatgggaagacccagaactcaaagccagtcttggatatatagtaaagtccaaggccaggctgagttgtctgagatgggagtgggtagaggagtgaatggtggccatggtggtacatgcctgcaatctcaacttttaggaggcagtggcagaaaggttgcaatatgtataaggcaagccaggaggagacaaggcaactatatcaagaaatcaaagacagaaactgagctgtagctctagtggcagagtgtttacctggtatgctcaaggccttgtactctcttccctgtatcccaaaaaacagagatgtagacgagagagttgggagtgcagggtcctctagctgtatagtgagttcaaggtcagcctagaaaccatgaaaccctgtctcaataataataataatgacatcaacaacagaagcagctcagcttctggggttaagctacggattccaggttaggatggttgaggttgtgcagagcaaggaaaaactccttgactttcaaaattctgccctgaccactgctttagttcagtctagaaaaccaaatctgttgtcttcactaagcgagcagctttttcacgtatttggcttataccagctcccttctactccagagctgaagtcccttcaggaagccttgtcacacagcatgtcctcattttgaaggccccatgtcagcagagcctgcctcctggtagcgacaagtctggctgtattcccagacttcccagaagcctcttcttgagctccatcctttgctgaaagggtccacaaaactcagggacacatctgcttctgaggagtggtttaggcaaaggtgagcactcagaatcagccagagcacagggaagatgaggaggtgaaggccctcctgtgtgaccccttcccaggctctccatagggtctctacatctctttttctgcttctatgatcagttctacctcagagattagctcatttgcctttgaagattaactcaccttctggtcccttccactctctggaggttggtggggaggtgagaactaagagttcaaccttctagtgtaagggtccatgatttgccgaagaatgacaccccagactcaaatagtatgtaaacacaaagagtgttttattctgcagaagtccagcatgctgggacctcccattaccaagatagagaaacaaccaagcgagctcgaaggcccaatttaaaacaccttaggggaatcgggaggccgatgggctttgtcttactccgtctctaaggtcattctgtccctggggcatgagggctggctggaagctgctgacctattgtcctcgtttcaggccaggtgatggggcagtttctgactagctgcctgaagtttgggtttttaggtctagtctctttaactgccaatttgaggcctgtcttggaatcagcctagcattctcaccaagtcaggatgggttccactggtggccagtcccattttccagaagccaccccagtaggataaatgcagctatgactgaaaaggctaagaaaagaacactagcctctgttcttattgctggggagaaaactcaagggtttcaggggctctgtgcccggaccttgggaaagaaggcatgattgcttagattgaaaagatctggccgggcgtggtagcacacgcctttaatcccagcattgggaggcagaggcaggcgaatttctgagtttgaggtcagcctggtctacaaagtgagttctaagaaagccagggctacacagagaaaccctgtcttgaaaaaccaaaaaaaaaaaaaaaatctgaaggagcttcaggcaaataagacagactttattcagtctggctgaaggttgctgggaaggcagtcactagttggcattctttcagcaagcacccaggcacatgtacgaactgcacacaggcagatacaactacagacagatactcacaggcagacagttgatgttggaggagagggactataggtgtacttgtgggctacttcattggattattttactaccacctttctcctcccctgttccaccctaatcccttccaatccccccaacactaggtagatctctctagactatttcctgctgattaaaggcatcaagtcccttggggcaaatccaatcttcatcctcaggatatctccaaccagcaatcgcaaaagcagcaaatgcaactgcaggaatcggcagaggcagagctgaagcagtgggagtagcagcagccacctccacaagccctctcagggctctcacatttataccctctcaagggttaccagaattccaaatgtaaactatctgctgctg

SEQ ID NO: 1218 - DNA, 639 bp, Mus musculus
cacaggcaagactttggagagagcagactaggcataatggccaccttgccaccaacagccaacccttcccagcaacctctaaacctagaggatgaagatggaatcctggatgaatatgatcagtacagcctggcccatccctgtgtcgtcgggggaggtcggaaaggtcggaccaagagagaagctgctgccaataccaaccgccctagccctggcgggcatgagaggaagctgctgaccaagttccagaactctgaaaggaaaaaagcctggcgctgagacggagctggagataaggccagaccacagacaccacacccagcaatggatacaggacatcacacccagcaatggatacaggacatcacacccagcaatggatacaggaccttggagaaattaggagttgtaagcaggacctaggcctgcttgattctttcccacctaagtgaggttctggagagggagcccttccacccttccagacccagcaaaagggcaagatgggagcaagaagcagagggtagacgggcagagctaggaagacagcccccaaaagaactgtgggggaaataaatcggatgcccttgggtggcagcaacaataaatcgtacagcagtgacagcaaaaaaaaaaaaa

SEQ ID NO: 1219 - DNA, 243 bp, Mus musculus
atggccaccttgccaccaacagccaacccttcccagcaacctctaaacctagaggatgaagatggaatcctggatgaatatgatcagtacagcctggcccatccctgtgtcgtcgggggaggtcggaaaggtcggaccaagagagaagctgctgccaataccaaccgccctagccctggcgggcatgagaggaagctgctgaccaagttccagaactctgaaaggaaaaaagcctggcgctga

SEQ ID NO: 1220 - DNA, 21666 bp, Homo sapiens
atgccgctgcactccagcctgggggacagagtgagactccgtctcaaaaaaaaaagaaaaagaaaaagaaaataatttttcttgcaaaaatgggagcacagatgcaccgttgcggagggcgacaatgatgtctgggctcgcttcattctacatgggttggggcatggggtaggggggcacggccccttggcccgaggtgggagggtaggggacggtgtctgtggcccaggggtgggtggggtgggacaacgcattgttttcagggcactccgtctacacccgttacactccgcagcaaagccgtcccaggtctccacccaccaccccacccatcaggacaccaggaagacgcacttgacctgcaagagactgtttgaatacatcttccctaagaggatggactgatgctgcaggctggacaaaccgccaagctgagctccaaggtccccctgactgagccctgggatcctcttgaccttcagcagaactccacctttgaagtccggtacccaccaggcggctggatgagcgtgcctccatgcaggggcgctcaggcagaaagtcagccagagcagatgaaacctgaattgttatcccaaccaaaaattacagcacgatgttgccctcccttgtttttttgacatacacctgggtgttaaagacccctccatgttgaccccgtggggcatgggccagacagcccagtggaggagacgaccaggaccagccctggtgaacgtgaaaacccagaagtgacggcattggacatcagatatcagtgaccccagctggaaacagatttgatatttgagaattttcactggagcttaaatatgataagtttaggacggtagacatttttatgggtttttttgtaagtatgatcttgactaatcaaactgtctataaaagaaattgaatgggctgaatcaatggctaatatggatacctcaggggtttttgtgtggtttttttgttttgttttgttttgttttgacagggtcttgctttgtcacccaggctggagtgcagtagcacaatcttggctcgctgcaacctctgcctccccggctcaagcgatcctccctcctcagcctcccaagtaactgggactatgggtacacaccaccacacacagctaatttttgctttttgtgtgtggtgggttttttttttcttctttttttttttttcagacagctccttgctctgtcgcccaggctgcagtgcaatggcacgatctcggctcactgcaacctccacctcctggggttcaagtgattctccttcctcagcctcttgagtagctgggattacaggtgccaccatgctgggctagtttttgtatttttagtagagacaggggtttcaccatgttgcccaggctggtctggaactcctgacctcaagtgatctgcctgcctaagcctcccaaagtgtggggattacaggcatgagccaccgctcccggtcttaatttttgtatttttttgtatagacgaggtctcgccatgtggcccaggctggtctcaaactcctgggctcaaccaatgtgccctcctcagcctcccaaattgctgggattacagcgtgagccaccacgcctggcctcgtttttttttaacagtgctaagaggtaaggaggactccctaggagcagttcgcagtggcagggaggcatattttattactgacattgttgagaattgatagtgataataaaaggcagaatgatttggatcagtttaattattaagttctttatagacagcctggatcagggtaggggactgctcccactgccctgtcccaaaatgctcccttaaaattatttccagatatttaagagctttatggcatgacccaattgctataaaaattttaacttgaaggaaaatctatactataaagtaatcgtttctttaaagatacattttaagcaagagggtttggaaaaatctttatgtctacacctggtaagcacaagccatgtatattccgtttttctttctttctttctttctttgtttttgtaaaaaaaatttgttttgagccagggtctcactctgttgctcaggctggagtgcaggggcgcaatcaccgctcactgcagccatgacctccccaggctcaggtgatcctctggcgtcagccacctgagtagctgggaccacaggcacgagccaccacacctggctaacttttgtattttctgtagagatgggaatttcgccatgttgctcaggctggtctcaaactcctggggtcaagccatccgcctgccttggcctcccaaagtgctgggattacagcaccaggtccagccatttcctttttttctatgcaagagtattgatatatgtactgaatcatcccatacttgccaatgtatgtgatcacatacttatcttgctgggatcacaggcaagagccactgcgcctggcccaagtttactttttttttttggaaatggagttttgcttttgttgcccaggctggagtgtgatggcgccatctcggctcaccgcaacctccgcctcccgggttcaagcgattcttctgcctcagcctccagagtaactgggactacaggtgcccactaccacgctggctaattttttgtatttttagtagagactgggtttcaccatgttggccagactggtctcgaactcctgacttcaggtgatccacccgcctcggcctctcaaagtgctgggattacaggcatgagccaccacgcccggccccatgtttacttttatagtcccagcaccaagcaagtgcctggcacatggttagtaccctaaacatttgcagactggagaatgcatgcctctctggtctttactttcctcttctgttaaatggggtcgggtttgctgatctcccagaagacatcagtaataaaatttattattttagattttttgcttctttcttttcttctttctttctttccttccttttttttttttttttttttttttttttgtgtgtgtgtgtgtgtgacacagagtttcgctcttgttgcccaggctggagtgcaatggcgcaatttcagctcactgcaacctccacctcctgggctcaagcaattttcctgcctcagcctcccaagtagctgggattacagccatgtgccaccaagcccggctaattttgtatttttagtagagacggggtttcaccatgttggtcaagctgatctcaaacccctgacctcaggtgatccacatgccttggcctcccaaagtgctggcattacaggcataagccaccgcgtccagccttattctaggtttttctactactgtgttttatgtggctgtctattttagttgtcaggagaaaatgtcacacctctattatggtgaaaactgtgtattactcatagttatctatacatttaatgcaaaaatataatttgtagtgtacatgatgttctgcaacctgtgtttttcattaggaatgtattatggacatctttctcatcagagatagagatacattctctctctaaagagtattgaatggctacagtgtttcacagaaggaaactgatcagtcacctactgatggacatttaggttgtttccgatttttggtttttgctttttttagagacagggtgttgctctgtcgcccaggctggagtgcagaggcaccatcatggctcaagccatcctcctgcctcatcctcctgagtagctgggactacaagtacacaccaccatgccagtctttttttttttttttttttaagatatggggtctcgctatgttgcccaggctgggtttcctgtttttcactactacaaacaaatgaacttccttgtacctgcctctttactcacctctgggaagatttctgtaggagagactcctgaaagtgggactgcaatatcagggggatataagcatttcaaaatcttatcaatgttgccaaaccacccattaaagacagcatctggctgggcgcagtggctcatgcctgtaatcccaacactttggaaggctgaggcaggcggatcacctgaggttaggagttcgaaaccagcctgaccaacatggtgaaaccccgtctctactaaaaatacaaaaattagctgggcatcatggcatctgcctgtaatcccagctactagggagactgaggcaggagaatcgcttgaacccgggaagcggaggttgcagctagccgagattgcgccactgcactccagcctgggcaacaagagcaaaactccatctcaaagaaaaaaaaaaaaagacagcatccactgatatttaaaacgatgatatcacacagccaagaaaacttgcaaatgcagctgccagatttgacatttttatctgggatggggttgtgagatcatatggatatattttgtttaacctcatttagatttcttgtgtcctcttggaacacagcgatgtccaatccaccttaattacgtattctgccttcagcctgggaagcttctgttcctttgagctagtgacttcgtacatccctcaggctatccaacagagaggaagtcttgctgtgttgcctaggctggagtgcagtggtgcgatcatggctcactgtagcctcaacctcctgggctcaagtcatccacctgcctcagcctcctgagtacttggagctacaggcatgcaccaccacgcctggctaacttttggattttttttgtaaagatgagatctcgctatgttgcccaggctggtcttgagttcctgggctcaagcagtcctcctgcctcggcctcccaaagtgctgggattacaggtgtcagcctttgcatctggcccacaaacagccattcttgttcaaactttgcctccaggcctggcgtggtgactcacgcctgtaattccagctatttgggaggccgaggtaagaggaccactttagccaaggagttcaagaccagtctcggcaacatagggagacctcatctctacaaaaaataaaattagctgggcatgatggtgcgtgcctaaagtcccaactacttgggaggctgaggtgggaggatcccctgagccctagaggtcgaggctacagtgagcaaggttgctccactgtattcagcctggacgacagagtgagaacctgtctcaaaaataaataaataggccgggtgcgatggctcatgcctgtaatcctagcactttggaagccgaggcgggtggatgacttgaggtcaggagtttgaaatcagtctggccaacatgatgaaaccctgtctctactaaaaatacaaaaattagctgggtgtagtggtgcatgcctgtgattccagctactcaggagactgagacaggagaatcgcttgaacccgggacacggaggttgcagtgagccgagatcgtgccactgcactccagcctgggtgacagagcaagactctgtctcaaaaaaaagagaaaaaaagaaaaaagaaaagaaaattaaaattaaattaattaattaattaaaaataaaagaattagaaaacaagcttcacctcctccaggaagtgtgccttcatctccctatctccagagaggttaggtgccctcctgggagctcccagccctctgcgtttactccaagctgatggcgctgggttgtcataggtgtgcctagcaacgtcacgaaggtgtaactctaagcaggaagaaaataaacttcctcgtggcagattttacatgcacctggaggcttgaggatgggaaaatgaaaccatccctgtaaacctcatgcaattaatcagagaacagagaggagaaatggaaacaagccaggcttgcagcacacccagcgctgatcatgaggtcagctgccccctgatctgcttcctcttagttgtctggtgcctgctgttctagaatcacgtagacctggttacaagatcatagttccccttaactgcactagagatagcaacttgaacgttatgaaacattaaatgttacttttgagaaattccttcaggtcctgcgtgccggtgaagcgactgactccgccagcctgaaggaccccaccaggagctaactccccaaaaatgtctttttcacatcatgatgatttcatttcccttgctctgaccaatgaccccaattttctagcctctcaccctccataatccccttaaaagccccatcccagaattccctggggagatgcattcgcaggtctcctcctatccccttgcacagtgccctgtgatcatgaaactctctctactgcatccctgctgtccagtgtaatagggctgtgacagggcagcaggcatacaaatctgctgttcctgtaacaaaaagcacacctctacgtctagatggagccacgtctagagccctgcagatccatgctagaggggttccagcaggctggagtacaatggcgtgatctcggctcactgcaacctctgcctcctgggttcaagagattcttccgcctcagcctcccgagtatcttgaattacaggtgcatgcctccacgcccagctaatttttgtatttttagtaaagacggagtttcaccatgttggccaagctggtcttgaactcctgacctggtgatccacccgcctcggcctcccaaagtgctgggattacaggcgtgaactaccgcgcctggcccttttttttgttttgttttgttttttgagatggagtctcgctctgtcgcccaggctggagtgcagtggcgcgatctgggctcactgcaagctccgccttccgggttcatgccattctccagcctcagcctccccagcagctgggactacaggtgcccgccaccacacccggctaatttttgtatttttagtagagacggggtttcaccatgttggccaggctggtctccaactcctgacctcaggtgacccacccaacctcgtcggcctcccaaagtgctgggattacaggcgtgagccaccatgcccttcctccttctctcataggcttctttcttccagcacctgtaagatcaaggccagggagacctccttccctggctccatctgggacaatcacagtgtttctgtggtcccctgtgaggctacaattcgcctctcagttcctgcattgcagagcaggtggaagctgagcaagcaacactgatcttagcagagcctcatgtattcaactagacatttactgagctcagactgagtgccaggcattgaggatacaatatggcaggcaagattcctgccccgagaataatgataattaaaatagcaagcatttattgcacactgattatcttctaggcactgcgctaagcatttttttttttttttgagaccgggtctcactctgtcgtccaggctggagtgcagtggcgcgatcttagctcaccgcaacctctgcctcctgggttcaagcgattctactgcctcagcctgctgagtagctgggattacaggcacacaccaccacgcctaggtaatttttgtatttttagtagagacggggtttcaccattttagctaggctggtctcgaactcctgatctcgtgatccacccacctcggcctcccaaagtgctgggattacaggtgtgagctaccgtgcccggccccaaccttcttttctttttctttttcgagtgcagtggcacgatcatagctcaccgcagcctcaaactcctgacctcaagtgatccttccacctcagcctttcaaaacagtgggattgcaggtgtgcctcaccttatccagcctaggtgccattaatcccactgtatagacgagtaaacaaacatgcagactaagcttgtctaagagcacacagctaactagggggcagaaccaagctttagacctgagaagccctgttccagagcctactcctttaaccattaactaaactaaaccaacggttgcatgccagtggggacaaataatggtaaagcaaacaaataaaaaagatactggccaggtggctcacgcctgtaatcccagcactttgggaggccgaggcgggcagatcacctgaggtcaggagttcgagaccagcctggccaacgtggtgaaaccccgtctctactaaaaatataaaaattagccgggcgtggtggcacaagcctgtaatcccagctactcaggaggctgaggcaggagaatcacttgaacccaggaggcggaggttgcagtgagccgagatcataccactgcactccagcctggtgacagagtgagactctgtctcaaaacaaaaacaaacaaaccaacaaaaaaaggatggagtcttgctctattgcccaagctggccttgaactcccagcttcaagcaatcctcccagcttaccctcccagagccctggaattacaggcatgagctaccgcactaggccaatctttgcttaatttaagattattttcctctttctctgatcacctggtctgttattattggcccaatcctgttttcattcaagtatcctgtcttcactttcatttcctgggtgttaaggaactcatacatcatccaaatctgggaaaacaaaggctaaattcaattccggctcaggcaagggagaaacacaagcagaagttcagctttttgtgtttttgtttttgttttcagacacagtctcattctgttgctgaggctggagtgcagtggctcgatctcagctcaccacaacctctccctcccaggttcaagcgattctcctgcctcagcctcctgagtagctgggattacaggcacttgccaccacaccaggctaatttttgtatttttagtagagatgggatttcgccatgttggccaggctggtcttgaactcctgacctcaggtgatccacccactttgtggatctcccaaagtgctgggactacaggcataagccaccacgctcggcctcattgtgtcttctgcctcagtacatccatattttgaaatacatattattttattataatttgtttttgagacagggtctccctctgtcaccgggcactgtagcatgtgtctttcaaacattatctcatttgatcctctccccaactctaggaagaagatacaattattatcatccttattttacagaattggaaaccaaggcacagagaggtgaagggactcgcccaaggtcacacggaaagtggtgggtcaggggattgaactgagggcaactggctccagaccctgaactctccaaccctctgccaccctcctcctaggtgagggagattacattactggggaccctgtttcaggatattaaggggttttccaagatgtttctcatagaaaaaagaaaaaaaagggtgtggctcatgcctgtaatcccagcactttgggaggccgaggcaggcagatgacttgaggtcaggagttcaagatcagcctgtccaacatggtgaaaccccatctctactaaaaatacaaaaattagccaggcatggtggcagatgtctataatcccagctattcgggaggctgagccaggagaattgcttgaacctgggaggaggaggttgcaggttgcagtgagccaagatcacaccactgcactccagccgggcgacagagactccatttcaaaaaaaaaaaagaagacaagcaagatgttgagtgtgactgggtggaagccactgacttgtccctggcacaagtgtgctgatatcccttccccctccttcctcacgtcctgcatctcagcgagaattggggtgccggggttagctgtgtggccgtcatcccaggcccaggtgaagccctcgatcaggtgaggccatgatcccaacgagtgttttagcccagatcctgcctcttccctgctttctgccgagaagcgggacctcctctatggaaaatatccagctgggtgagcctgggagggaggaggtgagttgggctggactcagggaccgactcttcccgtctcatgactgtgtttactgggctggattttgggaaggggccagattgcatcagacagggcctgatgggctggagccagactgtggtctgaggaggagacacagccttataagctgagggagtggagaggcccggggccaggaaagcagagacagacaaagcgttaggagaagaagagaggcagggaagacaagccaggcacgatggccaccttcccaccagcaaccagcgccccccagcagcccccaggcccggaggacgaggactccagcctggatgaatctgacctctatagcctggcccattcctacctcggtaaggcccactcagccatctccacggtccttcctcctctcccgaaatcaggacccacccctcttgtttcctctcatttcctttcctttcctcttcgtttctttctttctttttttttgagagagtcactctgtcacccaggctggagtgcagtagtgtgatcacaacaactcaaacaactcaccgcagcctcgaactcctgggctcaagtgatcctcctgcttcagcctcctgagtggctggaacttcaggtgtacaccacctgcagtggtgagatggggtctcactatgtttcccaggctgatcccaaattcctgggctcaagcaattctcctgccttggcctcccaaagtgctgagattacaggagtgagccaccctgcccagcccactcacccttttctagccaacctgttccttggaccctcacgtcacccctgtctaatcccttatcccaggagtgctatgttactcagcctgggacctcacacacatctggggtcccacattccacagaggggaagcagcaggcttctccctgctcttcccatccccacaaccctgaacccctgcctctcctctgacagggcctctcatcatgcctatgcccacttcacctctgactcctgccttggttacaggaggtggaggccggaaaggtcgcaccaagagagaagctgctgccaacaccaaccgccccagccctggcgggcacgagaggaaactggtgaccaagctgcagaattcagagaggaagaagcgaggggcacggcgctgagacagagctggaggtaaggagtcggggggcccagagagctcaaggtggtgcttctgccatgaaggacaggccggaaggtgtgtgattgggtggggaggagggatcaggcaactgttgtcttgatgcagaataaaacgagacatatgtttgattgtgagtttcctagtggccagagcaaagtgggaacacagaacctttccaattgaagggaaatttgacttacagagacagaaattgaggatagagagggtgggtccttccctggagtcacaaatcaagtgagtgggagaggcagaattagaacccagatctctgtcccttttaccacctgcttttcctcaccccccagatgaggccagaccatggacactacacccagcaatagagacgggactgcggaggaaggaggacccaggacaggatccaggccggcttgccacaccccccacccctaggacttattcccgctgactgagtctctgaggggctaccaggaaagcgcctccaaccctagcaaaagtgcaagatggggagtgagaggctgggaatggaggggcagagccaggaagatcccccagaaaagaaagctacagaagaaactggggctcctccagggtggcagcaacaataaatagacacgcacggcagccacagcttgggtgtgtgttcatccttgttctttgtgtgtttttgttcgggcatgtgtgtgcttgcctgtgcctgcacattcatgagcctgagagagcatctttgatgtgtatttgtgtttggtgtatgtatctggggcagggagtgttcctgctcttgcagggtctacgctgtgaatgcagcttttggtttgtttgcttttgcttgcatatattttagtgcatacatttctgtgggctcctacgtagtggaaaggaatttcttctgcttttttgcgatactgcccatgaaacacggccctccccagcacctgtttttgttgattgtgtcctgttcatagacgggaacgctacttatgagtgccatctaaaagtcagagaaaactgagatttaaaatattaaaagccagggccgggggcagtggctcacgcctgtaatcccagcactttgggaggccgaggtgggtggatcacaaagtcaggagttcaagaccagcctgaccaacatggtgaaaccccatctccactaaaaataccaaaaattagccaagcatggtggcaggtgcctgtaatcccagctgctcaggaggctgaggcagtagaatcgcttgaacccaggaggtagaggttgcagtgagccgacatcgtgccattgcactccagcctgggtgacagagggagactctgtctcaaaacaaacaaacaaacaaaaactaaagtctgggagcagtggctcatgcctgtaatcacagcagtttaggaggccgaagtgggaggattacttgagcctaggagtttgagaccagcctgagcatcatagtaagaccccatctctacaattttttttttgagacagagtctcactctgttgctcaggttagagtgcagtggcaccatcttggctcactgcaacctctgcctcccgggttcaagcaattctcgtgcctacgccccctgagtagctgggattacaggtgagcaccaccacgcctggctaatttttgtttttttgtttttttgatacagagtctcactctgttgctcaggctggagtgcagtggcatgatcgcagctcactgcaacctccgcctcctgggttcaagctattctcctgcttcagcctcctgagtagctgggactacaggcacctgccaccatgcctggctaatttttgtatttttagtagaaacagagtttcaccatgttggccaggatggtctcaatctcttgacctcatgatccacccaccttggcctcccaaagtgctgggattacaggcgtcagccaccacgcctggccaatttttgtatttttagtagagatggggtttcatcatgttggccaggctggtctcaaactcctggcctcaaatgatctgcccacctcagccttccagcctttgggaggccaaggagggaggatcgcttgaggccaggagttcgagaccagcctaggcaacataccaaggccctgtctctacaaaaatttaaaaattagcaaagcatggtggctcatgcctgtagtcctagttgctcagaggctgaagttggaggatcccttgaacccagttggaggctacagtaagccatgatggtgccactgcactgcagcctgagcaatagagtgaaaccatgtattgaaaaagaaagaaagaaagaaagagaaaaagaaggaaggaaggaaaagaaaggaaggaagaaagaaaagaaagagagaaaggagagaaaaagaagaaagagagagaaagaaagaagaaagaaagaaagaaagaaagaaagaaagaaagaaagaaagaaaggaaggaaagaaagaaagaaagaaagaaagaaagaaagaaagaaagaaagaaagaaaagagcgagccccggcacagtggctcacacctgtaatcccagcactttgggaggccaaggcaggcggatcacctgaggtcagtagttcgagttcgaggcagaagttgtggtgagccaagatcacgccattgcactccagcctgggcaacaagagcaaaactccatctcaaaaaaagaaaaagagagagaaagaaagagagaaggagggaaagaaagaggaaggaaaggagggagggaaggagggaaggaggaaaggagggaaggaaatattaagggatttgccctagctcactcagggctcatattcagggatcttattgtcttcagatatgaggtgggtccccaggccaagggggctgtgggacagggttctgggaagtgagatgggggagggagattcttattcagtgctatgtctcaggaccagagttgaagaaaaatatggggcaaacaggaagtgtggttggagctgagattatttgttgattgagatacaggtttgggttgctattatgaagaatcaaaacaggatacaaagttactcctctcttacttagccccaagtcctcctgggttcaaatggcagctccattgtgttgaggattccagctatttttactcactgttctgccacacccaaaacatggcttccactttgaggcccaaaatagctactccaatacctgccatcacgtttgcatctcagcctgtggaaagagtgtggaagagacagaggaggccacacctcttcaattttagggcataatctaaaagtagaacacatcacatctgctccgaatgtggctacatggccacacccaactacgagagaggttgggaaatgtagcattgagctgcttagccacgtggtagccaaaacttgggcaacagcagggttttatgatgaaagggaaccagagagagtgaatacacgaagaagctagcaagaaacattgcccacatgcagactcaacagatgtcgggggagaaaactctgagattgggccccgggcagagcctgtttccttttcccctgtccctttcacataagccccacactgcagaacttggagtcagtggttcatggggacccaaggacatccacagaagaccgaagtacctgatagagcaggaacagatgcacgtcagactacgaccagcttgaacccttggggacctgtatccatccccttcccttgagtccagcctaatcacagccacagaatgaatccatgacccggaaggacatttaaggacctctggcccaactctccccacgcaacagtgggattgcctctgcttgtttgaataccactatggagggggaacttgctacatttaaaggttgctgaatttttttgttttgttttgggagatggagtctctctctgtcgcccaggctggagtgcagtggtgtgatctcgacccactgcaacctccgcttcctgggttcaagcgattttcatgcctcagcctccctagtagctgggactacaggtgtgggccaccacacctggctaatttttgtatttttagtagagacggggtttcaccatgttgcccaggctggtctcaaactcccgacctcaggtgatctgcctgccttggcctcccaaagtgttgggattacaggcttgagccacaccacccggcaaaggttgcctaattctatctcagggcaagtctgttcatgtgggctgaaatctgtctctcatacctgcccttaaataagcttctgtttttctggtcctttctgtctgagatgactttaattcctcccccgaccccatctcatgaggctcagcttagatgtttccttctcttcctccctgatggctgcgtgcagaagctcatacctgcaatcccagcactttgggaggccgaggtgggaggattgcttgggcccaggagttctaggccagcctagcaacacagcaagaccctctctctacaaaaaattaaaaattagccaggtgtggtggcttgtgcctgtgggcccacctactcaggaggctgaggtgagaggatctcttgagcctgggaggtggaggctgcagtgagccatgatctcactccagcctgggcgtcagagtgagacctgtctcaaaaaaacaaaaaccaaagttttccttaacttgcaatcctccacccatctcctgacctccaccccaggccgaccctcctctgggatcacacggaagcctgggcccagaatcttacagtctaccttggaaatccttcagattttgcctccaactcctctttccatacaagttacatattaactcaatcaatgcttattggatgccttctgagttaccaggatgctgctggaggcctgtgctgctgagagggacaaatagaatcctgatatgactggaaccaggaatagggccaccatcagctctagaacccagggagcaaatggcaggagcaacaccaggcagtcggccctcagcccagcacagacctggtgtgttggcttcagaaaatcctggaaacatctctgctgtgtttggagctcctattctgtgagaagtgttttataggctttgctccatttaatccttacgataacccaataggacatactattaatgatcccctttttttcagaccggaaaactgaggttcggagacattaagtaatttgcctaaagtcacacagccacatcctgtaggacttggaattatgaactcaggtctatctgaattttaaagcctggatttttccccctttgctacatgcctgggaagaaccatgtattgacaatgaagaatcctaaactctcgttaatttctggtcaattactcctctgggcctgggtttcctcacctgtcaaatggtgagactggcctctcttctgtcaaaagagaaaatgaaggctgggaagcactgtgtccctagctggaatggccactccctgtcctgggtcctttgacaccagccaggagtcctcacacactgcccctccctcctggcctctgattggcctttcctggcctcgccctcgcctggcacagcctctgcctgagaggcctttaagtggctgttctgggaattaaggcaattcttggaattgcagaatttttggatccgaaaggatcctacccagactcttcctcttctgtctccatcccctttcctaaaccctttctttttcttctggttgcatgtctgtttccccattttggggggatccccctgagaactagagaaatcactgacctctgtcctaccccaggggcttacagaattggccctgtcaggcttctgtaactcaaaggactcccgactccttgcagagaactgagaaactcaccatggggttgtctgtctgttctgcaagcaacctgattctcttccaccttcccctttctcaaaggccagctcacagatacaggagtacatttttaaatttcagaatcaccctcagttttctcctttttgagacagggtttcagtctatcacccaggctggggtggagtggtgcaatcactgcagccttgacctcctgggctaatttttaaatttttcgtagagatgaagtctcgctgctatgatgccaaggctggtttcaaactcctgtcctcaagtgatcctcctgcctcggccttccaaaagtggtgggattacaggcatgagccaccgtgcccagccccaaaattgattttttaactaaaatcccctaaagttaatgctaatgacagtaatagttccagctaccactattgataatctaccttagggttttcccaacttcatctttcccatagcacttttgtgattgatttctgctgtctatacattcaaactatactatatatattatgctatatttacttagcatttaaaaactacctcctgccagtcacagtggctcacgcctgtaatcccagcactttgggaggccaaggcgggcagatcacctgagatcaggagttcgaaaccagcctggccaacgtggggaaaccccatctctactaaaaatacaaaaatcagccaggcgcagtggtgggtacctgtaatcccagctactcaggaggctgaggcaggagaattgcttaaactcgggaggcagaggttgcagtgagccaagatcgttccgttgcactccagcctgggcaacagagcaagactctgtctcaaaaaaagaaaaaaaaactacctccttatccttttcactcaaatatacttaaaaaggaagctacagcatataaccaccaacaatggaaaaccatggtcatatgtcataattagaaattaattgtaggccagacacagcagttcacgcctgtaatcccagcactttgggaggctgaggagggtggattatctgaggtcaggagtttcacaccagcctgaccaatatggtgaaacaccatcactatcaaaaacacaaaaaaatttagctggacatggtggcaggcagctgtaatcccaggtactagggaggctgagacagaagaatcgcttgaacctgggaggcagaggttgcagtgagcggagatcgtgctactgcactccagcctgggcaacagagcaagactctatctcaaaaataaataaataaataaaataaattaactgtaaaggctgagcatggtggctcatgcctgtaatcccagcacatttggaagctgaggtgggtagattacttgaggtcaggagtttgagaccagcatggtgaaaccccatctctactaaaaatacaaaaattagctgggtgtgatggcacacccctgtaatcccagctactcaggaggctgaggcaggagaatttcctgaacctgggaggcagaggttgcagtgagccaagatcgaaccattgcactccagcctgggtgacaagagcggaactccatctcaaaaaaaaaaaaaaaaaaaaaaggaaaggaaaagaaattaactgtaaaaagaaataccgaagttagccagtgtggtggtgtgtgcctgtagtcctagctactcaggaggcttaggtgggaggatcgtttgagcccaggagtttgaggctgcagtgagctgtgattgcaccactgcactctagcctgaacaacagagcaagaccctgtctcaaaaaaaaaaaaaaaaaggaacacttaactaaaactttttttaaagttcatccagccaggcgcggtggctcatgcctgtaatctcagcactttgggaggctgaggcaggcggatcacctgagttcgggagtttgagaccagcctgaccaacatggagaacccttgtccctactaaaaatacaaaattagctgggcgtggtggtgcatgcctgtaatcccagctacttgggaggctgaggcaggagaatctcttgaacccaggaggcagaggttgcagtgagctgactccagcctgggcgactagagggaaactgcatctcaaaaaaaaaaaaaaaaaaggccaggcacggcagctcacacctgtaatcccagcactttgggaggtcgaggtgggtggatcacctgaggtcaggggttcaagaccagcctggataacatggtgaattcccttctctactaaaaatacaagaattaggtgggcattgtggcacttgcctgcagcctgtagtctcagctacttggaaggctgaggcaggagaatcgcttgaacctgggaggcggaggttgcagtgagctgagatagcgccactgcactctagcctggtgacagagcaagactccgtctcaaaaaaaaagaagaagaagggtagggcgtggtggctcacacctgtaatcccagcactttgggaggccgaggtgggtagatcacctgaggtcaggagttcgagaccagcctggccaacatggttaaaccccgtctctactaaaaatacaaaacaaaacaaaaattagttgagtgtggtggcacgagcctgtaatcccagctacttggaaggctgaggcagaagaatggcttgaacccaggagacagaggttgcagtgagccgagatcgcaccactgcactccagttgggtgacagagctgagactctgtctcaaaaaaaaaaaaaaagaagaagaagaagaaaaaaaattatgggagatcattgttttgggttgagctgctgcactttaggccccaacagataagaccaaaccaaaatgtagttactcatgctaaatgtcacataatcaaactgaaactttaaggaaggagatagatcccaaacagaccagtttttcctgaaaacaggagattccagtcaacctgagtcagtgtaatattggtcccctttgctttaactctcacaaaaaagtcacctgaaggaacctcatgttaaccaatcagcttttttcctattgttctgtttccttggccagtgagagatcttgattctgttttgtagaatgaaagctgtaccaattcatgaattgcaaataaaagccaattagatctatatccaaaattgttgtcattttgtcttttgacacggtgaaaggtgaataggagaaactccaccttggtttgtatataaaaatattatccaggatggtggctcacgcctgtaatcccagcacttcgggaggccaaggcgggcagatcacctgaggtcaggagttcaagaccagcttcgtcaacatagcgaaaccccgtctctactaaaaatacaaaaattagccaggcttggtggctcgtgcctataatcacagctactagggaggctgatgcacaagaattgcttgaacccaggaggcaaaggttgcactgagccgagaacactccactgcactccactgagccactgcactccagcctgggagtgagactgcctaaaaaaaaaaaaaatctagccacagccattattatcacactggatatttaccaaagcctgcactagggaaaaacacctgggtcacgggttcactgctggttggaggctgagccaagagcaaactaagtgtgctgatacccatgcccctgatttctagggagttctgtggccttcagggagtcccaggggagcaagattagagcacccagtccctgagtgccctgctatcagcggccttgacagaggcgatctctccttggtggctggaatcagcatccagggctctgtcaactattagagaaacattttattctttttgtaaaacaaaagttctcttttcttttctgattacaaaagaagttattgctgtggaatcgcaagataatccccatcctctggtctgtctgtcctttgttcccatgactgaactccaacttttgcaaaacacttacttttattttatgttttattctagagacaggctcttgctctgctgcccaggctggagtgcagtggtgtaatctcggctcactgaagctttgacctccagggtctcaagtgatcctcccacctcagcctcctgagtagctgggactacaggcacacgtcaccacaccctaatttttgtatatacacacacacacacacatatatacgtatatatatgtgtgcgtatatgtgtgtgtgtgtatatatatatatagtgtgtgtgtgtgtgtgtgtgtgtgtgtgtgtagagatgggtagggggtgggtctcactatgttgccaaggctggtcttgaactcctgggctcaagtgatcctcctgccctggccttccaaagtgctgggattacaggtgtgagccaccatgactgccctgcaaaaacatttaaattataaaattaatgtttctttgtcagcacttcatggaatcagtacttcatggaattctcatatcagctttgtatcctgttctcttttctggaaactagttcggaaagtttcatttcttttttttttttagatggagtcttgctctgttgcccaggatggagtgcagtggcgtgatctcagctcactgcaacccctgtctcccaggttcaagcaattctcctgcctcagcctcctgagtatctgggattacaggtgtgtgccaccatacccagctaaattttgtatttttagtagagacggggttttaccatgttggccaggctggtctcgaacccctgacctcaggtgatctgcctgcctcagcctcccaaagtgggattacaggcatgagccaccgcgcctggccagaaaggttcatttctttaactgtttggggaaatatcatttattccctcgacaaatactttctgagtacctaccatatgccagggaatagtctaaaact

SEQ ID NO: 1221 - DNA, 719 bp, Homo sapiens
cagccttataagctgagggagtggagaggcccggggccaggaaagcagagacagacaaagcgttaggagaagaagagaggcagggaagacaagccaggcacgatggccaccttcccaccagcaaccagcgccccccagcagcccccaggcccggaggacgaggactccagcctggatgaatctgacctctatagcctggcccattcctacctcggaggtggaggccggaaaggtcgcaccaagagagaagctgctgccaacaccaaccgccccagccctggcgggcacgagaggaaactggtgaccaagctgcagaattcagagaggaagaagcgaggggcacggcgctgagacagagctggagatgaggccagaccatggacactacacccagcaatagagacgggactgcggaggaaggaggacccaggacaggatccaggccggcttgccacaccccccacccctaggacttattcccgctgactgagtctctgaggggctaccaggaaagcgcctccaaccctagcaaaagtgcaagatggggagtgagaggctgggaatggaggggcagagccaggaagatcccccagaaaagaaagctacagaagaaactggggctcctccagggtggcagcaacaataaatagacacgcacggcagccacagcttgggtgtgtgttcatccttgttaaaaaaaaaaaaaaaaaaaaaaaaaa

SEQ ID NO: 1222 - DNA, 249 bp, Homo sapiens
atggccaccttcccaccagcaaccagcgccccccagcagcccccaggcccggaggacgaggactccagcctggatgaatctgacctctatagcctggcccattcctacctcggaggtggaggccggaaaggtcgcaccaagagagaagctgctgccaacaccaaccgccccagccctggcgggcacgagaggaaactggtgaccaagctgcagaattcagagaggaagaagcgaggggcacggcgctga

SEQ ID NO: 1223 - DNA, 54786 bp, Mus musculus
  misc_feature (8049)..(8121): "n" at positions 8049 thru 8121 can be any base
  misc_feature (28335)..(28354): "n" at positions 28335 thru 28354 can be any base
  misc_feature (36124)..(36143): "n" at positions 36124 thru 36143 can be any base
  misc_feature (50300)..(50319): "n" at positions 50300 thru 50319 can be any base
catagctttggccaaacagcatagctttggtcctgagggtagactaaagcagtcctaaacctttgtgtctttcccagcttgctgaacaacccaaagtagaaacagagcgcctactcagagtactagcagttttaaaagtttaaactccacacaagttcttttacaaaagagtccacccttttatgtacctttaaaaacatttagccactttattcctttgtgtctttgaagaggaaaaaaaattaataaagttgtagggtccttttgaatttagaaaacgttggcaatgtgggaaagaaaggcattcagcatttcaaagttctggtgaggaaggaaaaaaagattctgaataaaacaattttatgtgattttgcaggtggtttgagctatcattttatatgtacgtttgtaccactgctcattggaatgttcatataatactgacctaattatgcatagaaaaagataagccatttacttgattcatttcttctttttaaatcaagaaaggaacaaaaaggctcctattttctgaaagaaattgttcgcttttattgcagaaaagtagcagcttgtgcagagctagaactgtaacaattttatattccaaaggttttgtgtgtattcggttagttacagtaattatacccaataactgacagccaaaatcacgtaggagaaagcaaaggctgttttctcacacgggccctgctgcagaacatctgctgagagatttgcatattaattaacccatattaactctaattattctgggaaattatcaaataaattgaattttctaattttaacctttcttttacttgacgcgtgtcgaggctgagaggacgcaccaggccgtctcacctgggcaatgagcaaaggctcttttctccccctttgctcctttaggcctggggcagcctggggagcctttgtgtgccttgtgcttttttggcttctgtgcttggtagggtctccgtgcatttgttgagagagagaacatgtgtgcctgtgagcacagatggtggatttatacaggggtgaggaaaggtgctacctcagaacacttgagcaaaccttaagttgtttttgtgcgttgttttgttttgggtttttttttcttctttctttctttctttctttctttctttctttctttctttcttcctttctttctttctttcttttcctcccagcctgttgtttaggcctgagcaaataaatgggagtttaattcaattagagcctggctttagtcagtgcctcatgacagaaattattcaatatttttcccctcacattgtttggtttacacatcagtgactcccttccttttgtactctgtttagagtggccataatgtgttgagcttttgtgtctgagatgtcactgtccctttcaccgttgtctggttctgtcaattgtgaggtgcaatgacgctattttgcaaacaggcctctgagaagggtactgctatgttagccgaggtggcttcacagtaaattattttattagtctcacagacctgaacctaatcctctgggtagggagatgaagtttggaagtcatccttgggtattagacgtaacataaaacagagatttctaggacaaatcctgtaggggcggcatgaggagctcaactcactggcatgatcttgttttaggtgtttctttggggtaagagacaagatttaccaagattaagattctctgcatgtgattaagtttgtaatgacccatggttttaagccatggtgatcaggcgaaaactactgatttaatctgtatgaggaacaaagtcttccacaactgctttctgttgagccacacctctccaaagacagatgactctgtattcccccaatgatttcactgcccctacccaccaagatttattaaggtgatccacacccctggctgccttacaggggattattttcttctggaaaagctgtccttcctattattccacagctgggttagacacaccgctgcagcctcacagaacattacttagacccaagaattattattgacaccagtacactgcagcaaccaagaaactcaccaaataggtctgtccgactgacacatacttgagaacagtttgttttttttttttttttaatagattgactagaactggcacagaaaatcttttgctgggaaaacatttctttaatatgtttttacttcacgtgaggatatagattcaagttactctgtgtgtgtgtgtgtgtgtgtgtgtgtgtgtgtgattaatttggtgggatgaaatggctaagtgtatatcagtatctgtatcttagaaaacttcgctatcacagatgaggttcacgggtggggcaaatctgtaacaattggagaaaaatattaatagtttttctagtctgtaatttttttttttacaaaacattccaaagtatcctgaaagttactgaccttacaccttttatggactttgaaagttgtgtaaccttttcaggggaaggtgacagacacaatatctaattacacaaggacatacttcccatcttgtgatacttgctttattcaaggttttattcccaaggccttatgactataaaacttaaagctagacaaggtctgccctcatttctgataaaagaaaaaccccaaaacaattctgatggcccagagcatattattttctacttacaggtcctaaataaattacagttcttttcacatgcctcaggaatggcaatgaacattcttttcatgttgcctcttatgactttgctcgggccggtttacatatagcaactcattgcatgatcatgaagcccaatagttagagaatcttctaaactccttttgctctttggacatgctgttggtagacataaattcatttggtattaataagagtaataaggctctgaagaactgatgacgaatagatacacaatgtatataaaatggatttgtagagcaattgttttgaggttttccagaaacatgctatcaggacaggctcgctgatacaggtactttgggacacattgtttagccagtgatgggattagctatgtggtctatctttggactgcagatatagacagggagtgaagctgaaaaacattctgaaggatggaaataaaaactacaaagacttgctggataaaaacagaatggagcatgcttgaaccaacagtacaatgactactttcctttggcaggggttgagcaaggtgatcacaatcattgagtcatagatatacaggaaaaccaaacatatttactttaaaaaagaaaagaaaagaaaagaaacagatgtcaaagctttgggaaatcatggtttttcacttagaacacggtgacctgggaataaagtgtcttgtattaaaagataactgacttcactattacacattctttgactaatatctgttttatggagatggcaaagggagtcttgcttttgttcacatctgccatcaccttttaatgtttcctatgttaagcaagaagtttagaggggaaatcagatacctaagatgccactaccatgtgcaagtttaatcagaacctctataactttatggaaattttctttttaacaatcagtatcatactaaaatttggaaacagtagtgattccagttggatgagaagctgccagtctccctaagatgctcctgtaacagggtggggggaccctcagaatgttcccgcccacagaattgtggcaaggcagaaattcctctcttgtttcatttaatatgcatatttttacatagctaatctgaaatggaaacattttatctctacattcaaaactgcttttgttttatcagctgacattttacaactcattaatttataatgcaggtttaatgcctttgaatgttcctgggataaaaattaaagtgaccaagctagtttataaaggctcactatagtacgttggtaataattcttttataacagtgtgttgtacttaatagtgcattccatttggatgttttcagttggcatagtctctctctagtattaattcatattttcacatctgggtgatagataaatctcctcctgtattaaaatttagaagtttaagttcatgcactttgatgacatatgctcaaatttggaagaaaatctctgtttgaatctgtctttgccttgtaatgctcactagaccagattataaaatgagattgggccttgaatttgatcatgtgatcttggcccaccccaaagcagagagagttaacaaattaacaatgatgaaggaaagatgttcgtgatgaactttccccagaaaaaaaacaagagtcactgggaaggaaaaatccctgaaaataaaggagccacatcctgtcctgagtagcacatagtcagaaagcaagatgcttaggggtgggataggataacacctcaccagagttcagatggaaagtctaaggaagtcctaccacctctctacccagaaagaccaactaaggaagcaagccagggacctctgcttacagctccacccaaattaaatgacctccaagctctaaaacaataaggaaagcaaatgactcaaaattccaaagtccttctttaaactcaaggctgtatcatcagtggggacattttaaaattgaggctgcatgtctgggtcacatgtcagtagcaaacaagagagcactcttgtctgactctgccttgaagctaccttttcaatgacaaccaaggcgtggcactacccctaagtagtggttggtagatggctgcacctccttatagcttctccacattgcaagcaaaggaaaacaccagggaggtagtctatctttgttacagcagtggttctaacagttgcatcaccctgcatttccatattagtgtgtcatgcttcacgaaatgccatcacgtgcacaattttctagactcccgtgacaatctcggaagcagggaacccattatcattatttttacccatttgaacgaagtttccttgggtgatagaccaaggccacacagctggttacatgttggtgctgggacaagaaggcaagtcgcaagctcgtaattctgtgaactgcctctttatttccattgtttccaaactactgcaggaaacaagggtgtattgttagattctggtaattgatcaaattggtaggcttctataactcaaattaaggggatccatgaaagtaacaatcatcaaaacaatttaaaattaagcatctccatcttactgcacaaaaatccccccaaaatcccagggatttccattcttttacttgtgtagtttaaatttagattgcattctttgctggaaagttgtattattatgcattttttgagtagctattatttttgtgaagatttgctttcttgctggggcattgccaccaaatgatcatgtggcctttgcctggtcatttggcctcagtctgcctgtgttaccttctttgttacaagtcactagctgaccttggtgtccctctagcacagttttgggcttctgtttctctaggtaacttgactgtagacttcgtaaagtgatcagtgcacctccttgtattttcctaggtttattgtattgtaggtatttaataaatgtttgatgatggcattgaagatcctattggtacacttaacttgagcgatttataggaaatcactgttgaccgccttattaacaattagctgtctataatgtgcatatgtaattttcctttacatcaataaaacttctgctcctgctgtagatgaagtactgtcccttctcatcagttctttcgaatgttaatacattagctactgataccttatttgtaccgtaactgacagaataatggagagaaagaatctaagtaggagaaggggttagttaggtaacattgtatagggcatcttcaaaacaatagtcctgctgtttcaaatgtcaagctaattatcagcaatgtttaaatgctataataggccatttttgcaaatgttgaaattttccagcaggtatagacattataaaaatgtcacattttgctactgttcttttacatgtcacaggaatacaaaactctgaaaataaaagttatagctgtgaaaaataaagagaagccattacttattttgcttatgactataaaattaattgtcacgttgatacaatttagagtactgtgtacttgggagaaaggagagagaggatttaatagaatctggcaaggtgaaaataatgcttattatagatcaactatgcaaccttttaaatacaggtttttagtaatgcgtattcagatacatctttccgagactgtttgctataaagcaaatttaagcatcattttataccctttggtaaccccacatcacacatacagttctagagcaaatgaaactttaatatgattctacataaaatagtaagccatgccaataattcacatgcacttcatatgcaaatagttttgtcttatccatcaattatcatgtaaacatggtatcacatggcaaacctccctataatactgtacagtacctgtatataattatgagcgaattttgccaatgcgacagtttcacagaattgtaattaattcctctgaagattactgtgagagttttggatactgatgctgtttttggacatttattactgctctttagttggctttttgctgtgcctcagagacagatgtaaaattagtgtctattttgagccagcaaacagtacatcttccttcttgttcattgaattgcagagaggaattctttggactcccacttctttgtgtcttttgaagtaattgttttgtgctagcatgtagcatcaaaacatgtagaaaattgttttgtttatgctcagggtgatatatatgaccccatacaataaccaaccagacttttctaaagtctatggaaggatctacatgcttaagtttttaaaatagtttgcagtgtaagttcaacaaacaggtactctttaatatattctgcccagtgtccttcattcaaaacctggactagttatttcagtaaatgcctttaatctaagaagacataggcaggcagatctctgtgagttcaagatcaaccttgtctacatagtaaactccaggccagccaaggctacatagtgaaactttgtctttaaaaagatgtatatggttagaaaatatattgttagttattatataaaattaaagctcttatttatagataaggtttaatagaagtggggctaagtccaccatatactagcctttctataggaaaaaaagtttcgttttattttgttttgttttgttttgttttgttttgttttgttttgttttgtatttgatgaaaattgttcccaaactttctctgagaaaaaaaaatctaacttgagggaaaaatctaagaactcaaaagaggggataagatggagagcctgggtgcaatcagtgactttaattgtaatcatcggtgcatcaatccaaaagaacagaaagaaagaatctcatttaaattctaaagtaagaactaagtttgctatgaattactttacctggattaaccaaaaaagaggaggggggtaacacaatggcttatgggcatgactatcctactttgcccagccctggaaaagatggcgtactgcttctgtaagtggacttgacagcagttatttatttagtttaaaagtatttactagtatttgtgagtggaaaccctaaaggttgtgcagctttgttggcctgtgaaggtgatggatgctgcgctcctgaccctatatggtgagacatgacttcattgcttgtttagattgttctgatatttgggactccttaagggctgttcataaatcatctctctctctctctctctctctctctctctctctctctctctctctgtgcagaaaatatttcaattgtagtgctgcaggaacactcacacgtcacatgggatattgtagcccatgcagaaaaggaccttaaaaggcctggggggttttgcaggataaaggccttttaatgcctgtccagccttagataattttattctctccttactggacctttctttattcctnnnnnnnnnnnnnnnnnnnnnnnnnnnnnnnnnnnnnnnnnnnnnnnnnnnnnnnnnnnnnnnnnnnnnnnnncacactctacccccactcagtgttcagaaaatttgtaaagaatcttctgctcgttgctaagaaatggttaaatctcagtcaccagggggaaaaaagagcggcacattattgattgtcctaaggtatatgtgggccacacagctagagcagagacgttggaatatctctctttttgtagatctgagagcattgcccagcctgaacttgcctaagcccttgtggtcacacctcttgaaaaggttttgtttcccccgtcaattggtattcaaaccaggtcagcagattctgtttgcccggctctactgccgttttcattttaatttgcacctgttgtgcagttgttcggaaggcaagtgcagacccgcggattatacaaagatcatattatgagcagatatgcacggtgtaatctttttgtccccagcctcacatgacaaaaaaaaatctctctctttttgttccttttttactccctgggaacctgtcaaagcaaacagatatgactgactaaaatttgtaactagacatgtttccagaattcgccaaaagcattatgaacctgacacacaatccttttcattttttttccctccttttccgccacttttgtataatccgatagctggcgagagccacttgagatagctcagttgataacttagcgcaggattgctttattaggctcagagaaatcaaaatgaacctgaaaattgtttgcgctttttttccactgcctccccccctccccgtctctctctccctctctctttctctctccctcttgttcccatgatgtcatggttctgacttgtttttgtgtgtgtgtgtgtgtgtgtgtgtttctggagagttgggttaacagttcttggcaatcctgtgtgtgcgtaacggctggtgtgtttctctagctgagctaatgccccgtgtttattactctaatctttcttgtctggtggtaaagtggacaatttatgtactagcatgtaggccgagagcctgtgagggctgactaattcagaaacagccaccttcaattgagttcacagaccttatttacaggctgtctattttaagaaaagctactgagcgttgtagggactgcaggctgcagaagcagcccgcccgctcttgtgaattattttagcatttgtgttggtcttgcccgtgtcactttgaaatcttctgtaattatgacactatgaagacatctcaatagtagtattaatggcccagaagatatggcttttcctcattttctgcttaaaagatgaggacataaatgaccttagctcatgacggttgaaatagaagaaagactgagcatttcagactgtactggtttgtgtatgtgtctgtgtattgggcaaatagatggagagaaagagagagagagagagacagagagagagacagagagagagagagagagagaactgtttctaggaacaaaactacagttaaattactgaagtcatcttgtatttatagtacaaccttatatagtaaacacgtcatgtcactgagctaataaaactgtcaactgtagatctattttataagtttttgtgaagtgtggaaagtccaaactgcactatgtcttattatgtgtgcaatataagcagaatttaagcatgtgtacctctgttgcctttaaaattttccatcgttttcagcaaaatattgaaaataaaaagagtacacagctataatagaaataagaatacaaatgctatgcattggggatattgatcatgttttcctgacatggttgagtaattcagttacgaaaatattaattattttctattcacctgaatatgtgggggcactggtattttcaaagcagcattttgaatgtgcctgtgcatctcttcccacagtggtgaactatgacaacgtagtggacgcaggctcggagacagatgaagaggacaagcttcacattgctgaagatgatagccttgcaaaccctctggaccaggacaccagcccagctagcatgcccaaccatgagtcctccccacacatgagccaagggctgctaccaagagaggaagaagaggaggagctaagggagagtgttgtggagcacagctggcacagtggcgagattctgcaagcctctgtagccggtccaggtaagtgtctgtctgtctgccactgtgtggccccttcctgggccacctgcatgtcacctgtgcttcccagcagaacacctgcagccacatcattcaaatagttctttccatcgcccttctggagtagagagcagagctgttggcagatgatgaagtgatagcaatgtggtcacatcacgcacagtactcggattttaggaaatgattgtgtattggtttcaacccaagttggatatcaactctagtgtaacaaacacaaaacatgaagtacttgtacattttcaatgtgaaacattacagaacgcaatcaagatctctactctcatgacagaaagtataaagaaatacaaaggcttctctctctctctctctctctctctcccccccctgtgtgtgtgtgtgtgcgcgcgtgcgggcatgcacgtgtgttttgtgtgggaattgtgttatttcaaaccacataaaactgtcagttcggtgtacttcatgtctgacaccttctattggaattccttttaattctattgtaattccatctaatcattctttttttgttaagtgtgaatgtgatttcacagttttacctggtcaggtagctttcttactatttaacagttaagtactcgataatgattcttactgtttgatggtcatcttaagggaagttaaaaaacaaaacaaaacaaaacaaaacaaaacaaaacaaaacaaaacaaaacaaaacaaaacaaaaaaaacccaaccaaacaaacaaacaaaaagaccggtccagtgccaactgtgatagaagtaaaacagatcagtttcaatctgaaacttccgatgtcactgcacaaatggaaatgcctgagcctgaaattcccctggagtggaagacagggcatgctaacgaaaatccaagggcctgcctcggaagcttaagtggcctgtgagaagttttttaaaagtcccctctaattcagactttgtgtctccttcacctctattctatgacctaataagaattaccgttatgtagcccaccttggttttgcgttgacaatataaataactactgtttttgtttgtgtgtgtgtttgtttgtttgtttgtttgattgattaatgtgtgtagcgggccagacagagtttaactttacctctctgttattgtggtgttgcaggcgagcaaacactgtacagaagcagagcaattgtttgctgtgtgggaaggataataaaatcaggtctactggtaaagaaaattaagtgtgtgtgtgtgtgtgtgtgtgtgtgctcgcgagtgtgtatgtatgtgcgtgcgtgtgcgtgtgcgtgtgcgtgtgtgtgtgtaggggaagactaatggcagtttgactgtggtgtatttgtttctcatttccctaatacaccgtgccaagtttggtattctttctgtttccaattttgctttcggtgaaggtttctcgaatctcagcaatcccacacataaacatttatcgttacatccattaagacttaaggttttagattttcaactatgagggagaactcagccaaagatgcttgaaagataaatacgtttaattaggggcagaggatgatcattaaaggaagtctgactgctgcagaagtcattaacaatcttaaatgaaatttttatttttatgatagccatttacatgtataataagagccaatgattcttgggagcagtgtgacagaaacagagtgtggcgagaactcatgtaagacatactatttaaatgagctggtgttagctattcatatttgttaatgaactagatatgcagggctataagaacaaatgttcggatgctttaaattttaatatccagaaatcaagggtaaggaccaattaccagaattttcacccttaaaggaataattaataacaatataataaatgtacagcctcaaacttctttttaaaaagtttaattaaaaaaagaaagaaagagagagagaaagaaagagagagagaaagaaagagagagagaaagagagagggggaaagaaaggaagaaagaaagaaagatagaaagaaagaaagaaagaaagaaaggaaggaaggaaggaaggaaggaaggaaggaagaaagaaagaaagaaagaaagaaagaaagaaagaaagaaagaaagaaagaaagaagtcgatagtcgagaaacagccaaaacagcactgtcaggctatagtagtttgtgactgtagcagtttttttgtgtgttggtcatggatcataatctcaagcatctcaatgtacaatgatccatacgaatcccttacacagcctgctgtcacctggagttaatggagacagtgatgtaaatgctcttacctttatagtaaataaacaagcattctggagtccaaataatgaaataaaatgtaaatcctaatctctttaggacaagaaagtgacccagctattacctgtctcgttctgatgattagtgatgatttactgttctcttttttattattgttctaaaagcgctctgatgtggtgcctagatgtctaatgaaaagaaattagtcttaaaaagctcctcattgtttatcctgacttgtagataacacatttttcttctgataaaatatttttcttatttattgttcaaaacacacactatagacaataactctaattctggtgtgttttatttaggagtgttttctccccggtgcctggctgtctgcagtcctacctcggcacatagctttcccctgagataagctcctctcctttgctctttctcccctcgctctgtagtttgtctgcaggatgcaggtttttgcactgaagagtgaggcagagttcttactgtgcctttccggtcctagcacaatcaaagttttgtgtttggagctgtccttgacattctttcgtcccacaatggggtggacacagtgtgctggaaaccatgacatcattatcatggacacagacttaaataagtcacctgcatctcagcctctttctgcttattcaaggattcttcatcctacagaaggaagtgttctttatttttacaaatgcaccctttagccccaagggtgactggaaagtgcaaacttttacaagtgtttgaaaaataaatatactatgtggttttagacaccgtaatgctgagtcagaggtgtcttgaaaaaggttaagcatgaggaaggcggccagtgaggcttgccaggaattgaggggaggcattcctaaagtgctatcattatgtcctcttggatatggattcacatggaccctaacacctgagaaggctcagtgactcatctaactagaatgagcttaatattccaaaacaaaaatggccgggctcagcaagtcagctggggtaaagacattgcaggtaaaagtggcaccaacatctctaaacagtgtgcaatctttgggaaaagcgggttatagctagacaatgcacaaagggcctactattcggctgtgcaaatgacatttatgaatttgggaaacagccaactattgtaacttctcttacctttttataagaaaatgactatgaggaaggatgtccagcagaaatagccaatactaccaccattatttaaagaagtaaaatataaataaataaaaatagctgttaaccgttttcccttcggtgactcagtgttctctcagatggaaatcttatgattcttgtgactcttggttaccggaagtcatgtgagagagaggtgtgagggcgagaggcccagaggctatatttatatctagtactgaatgcagacatacctattttgtttcttttggggaccaataaaaataccaaaaagagcttcccaaaacattgactattacatttgacaacacaccgttcctgtgtattgaacttccaaatgtttcatgcaaaatatccctgtgaaaatattcctggaataaaggaggtgcctaaggtcaggagttaatttgaagtgggtgcacagtctaaataaatattattaaaattatgtgactgttttgaaaatggcattacattactctctctctctctctctctctctctctctctctctctctctctctctctgtgtgtgtgtgtgtgtgtgtgtgtgtgtgtgtgtgtatctgataggaatgtgctctttcagctttgattctatatacagatagattcaattttgctataacgttttctagccactgtttttccaccaaccacagcagtgtattatgtgataaacaaaaaaatgatcaggatacatctgagaaagagttcgactcacagttcctggtgttctaagtaaaaggattacagtacagaaatcctcgcctcggatcatggtctgctctcattagtattgtactgtacagctacagtttctgagagtccatgttatgtttgtttatttgaaatatttttaactggcaggctgccttgctctgccttcccacatactctataatatagtacacagagaaaattcccatttttctcccttatttgagagtattaccattttcaaaaatggcccttaatcattcatgaatttccaccttcaacattacatattttcatcttaattaaaacattgagctactgttttctctctattttttcatcaggaaatgaatatgattgcctgtggaggcataaatgctcaaaacaaaaagctatttatagaaatggggaggtatgagaaatagactttagaaatttatgtaaaacagtcaatggttatttttaatacatctgagatgttagtttgtaaaatctaagtattccaagttatgatatgcagaattgggattttcttttctttttttctttttcgagacagggtttctctgtgtagccctggctgtcctagaacttactctatagaccaggctggcctcgaactcagaaatctgcctgcctctgcctcccaagtgctgggattaaaggcgtacactaccactgcccagcagaattgggggttttcttaaaaggataccagcctatactaactccatcatagctataccaagcagaaagaacatgaaagcaaaatgagatattctggcttgccatgaagcacccagagacagcagctactgtgtctcttcataagttcaaatacttcgtcacttttgactcaatcttattgaaaaaaataacatctcccccctgtttgtcactagaactgccaccagaagaaaagcccttcgtttgcttcaaataagcacctctgtttttcacagcttgcagtaacgcttaaagtaaataagttcttgtgcagcctgcactgttgaattcattcagatgcctgaacaaagcttttgtttagagttttacaacaagcctcactgtttcccttcaaagactcctccttgttcctatgtttggcatgcttagaatagtaagcctttctgtaattttcaaatgctaaagataattttcccccacagaagaaatgaaggaagattatgatgcaatggggccagaagccacgatccagaccacaattaacaatggtacaggtaagttacgttcacatagcaacatcatgtttgttctgtgtcatgtggttttcctgaatctgataaaacacagacacatccatttgcacctccatgattaacaagaagttagacttcacaggtctagttttgtttcaattttgaatttgccatatctcttattttattaagcaactttgtcttccattcttataccctaactcgcctctatagctcgggaattttgagttttatgaatggacattcttacagcatgatttgtatggctttctagttttagcttttactttaaacataatttttatatcataatataatatgctggccttagctactacttgatatctgtcattgagaattcaagtgatatgatgaagtacaaattgaaaagtacctttcccaaatccacatttccataaattccttaaaaaattttatcacttaacttctctcagattctctcttcacttttaaatctctgcgtctactagaggtatcaagtaatatttctcagacagacttttaaacaagaattaaataaaactgatgaataaccactcaggacacagtaggcagtgttttccttggctctgctgtggctggttaagggtggcattccatgttcgcccccaaacagcatctcttctcacagcacaaggtgacatagattcactctgtgtgtatccttttctgtatggcactaccttcatgtttcaaacaatcctccacaccattgtaacaccattacaaatgttagcacagtccccaatacaaagtcattccctaaaataagacaagaacaaaaatcacataactgtctccattcagcgtgccaatgaaaaaagtgtgcactttaaaatggcttcagaagtatatttaattaagatgacattcacatttcccttaagtcgatatgcatcataatatactgttcatgctgtctataaatatgtttattaactacttaagagatatgggttcactgtcttgggtataaagtaagtgaaacaattttctaaaaactcctgacttactcatttgagtaatgtcaaattgagtacaaaactaaaagtatacaaccatatgggcttagagaaactgtggactagagcactgataattctaatttctagatgcagcttcaacaatacctagattacaaccttaggcaaatcaattagtctcttgggaactcagtttctatatctgtaaaatgcatatgttgagctagctgactgctcagaatgcttctagttttaatattctatgttgctgggatactgtttctataaaaatagaaacaaaagcgaaatgattttgtttaaaatataacaatgtaccctaaattaaggactctccaaaacctcccagtttgtgagcttcaagatggcctcaggttcccttgaagaaaaatgtctcagcttcaagcaagcattcataaaagctgattcatttccttcctgatcactgacagtgtgataaagtgacaatttagcatccattgtatatacctgagtctaacatgaggttaacaaaaagtactcaggtccaggaggtttgcaaatcaattttgaacaccctttcaccaggctttaagatcccctgtctcctaatactcagtgattcttagacttcatatgcatgcagtcaataaagaaatcaatacatagtcattgagtgttttcaatatagtccctgttgtgtgcatgtgacggagatgatggccaggaagactaagtcataattattatttaatttgggagagatgcccaatttacatgaaaagatgataaacagtaagtgaaaatatgtgataaatcaaatgggaggagtcataattatttgaattacagagattgacaagatcctgcagagtgggaatctgtctaggttttatgaaggaagttgaatttgaactaagtacattttcagtagtctggaaggaagaagtggaatatataaggtaaagagaaaacatagtatctaagtagaagataatgggcaaaagatataaattaaagggaatttatgcgaaataaagttataaaccgaagacaactgttagagaatataaagaaagcataagaagaaagaagttgggtcatgttgtaccaccatgatgtcttgggaaaatcaaactatagccgtgtagtcataaagccatgaagtgatttttaaaaaaagtttgtcataggcggaagtggggaattttcaacaagacttagtaggctggtctttaactcatagagatgcacttgccttatcttcaccaggactgggatcaaaggtgtgcggtcaggcctggccaacccagcatttttacacaggttctggggatcaaactcaggtccctgcttgcatgataagcactttactgactgagccagatctgcagccattgacgagacaattttgaaaacctttgatgtcctagaacatcccacatcaatttgaacatctctgcccattgttctgctgtagcatttgaggctcaagtaatgaaagcaagtttggaaggctcctagaaactacccgcatctacccagtgagtctcctcacctcatctttaactagcatccttaaattaattatagaagaggaaggtttaatattattcatatataataatgataaagctgtcaaatatttctttgttatttcataactgattaccatcaggattcatttttttttcttcagcttggatagccatcaataaacaaacactcttttctttcagtattcatcttaagcagacagaatttaaaccgatgcttgagggagggcaaactttaaagaaatggaatatttaatatgtgcccttaagaaacataaaattttatagggcaatggggaggtcaagtcataataacagaaagacaacatttgcaaataaataattgtttcttcattagctctgcaggccagtcatcatttattgagaccctactaagtgtagaagtattttgttcagctatgagcacagagcaatcagacaagtaaaagaaaaggcacagggatgagaaatatgtgccaaatatttaacacaacattgactgatatttattcattgctaaccagtgttataatttttactgctagtaatgtacgtatgtgttacattgtttcatttcaagtacagcaagctacgtaggtccaaaggcaaagtgtatactgcagagtttcttgacagagaaccgggatcatatgttagagctagagccatagacggatgcctgaagatttccaggcaagttcttcaggagaacagcttcatgagcatgcctgtgtgcaaagagaataatggaaaggctggacacacaaacgagaggaggctgaggaggctcttaaaagagcacgatggcaacagtggtagcagttgtttttgtctcagtagtgtgatctgagagaaaaaatgatacttgaaacgaattaaccaaatttaaggtgtaccggggaactctctcatatagcttatactcttgaagtggacaggaaaaaaaaaagagcttcagttactagcaaataagtaggagtatggatgaaatctcaagtagaaatggagagtaattgctctggacagcgtatacagtcagtcatcaagaaagaatattctgttttgaaaacatagcctgagattaagcatataaatatttaagtctctttccatatgtttggtactgtattagacacatagataggacaggaatacctcttagtgtgctaaggtaagagtggagtaagaatgaaaagacacatttcaaggtgaactaaggcaagtgcccagagcagacgggggatctgtctgcgcctggttatcagtgaagtgcctgcttaaggaatgaggaactcaatgatgaggatgggggatgagagcacgcatgttcctggttctggttccgacagattgaactgcctggagcttagggaagtaccaagactgaggggacaattaggcaccaactacttactacctgtttgttggcttgtttgttagtttgatttttttgagcagggtctcaatatgtggctctggctctcctggaactcactgtgtagaacggactgaccttgaactcacagagatctgagtacttctgcctcctgagtgctgggattaaaggtgtacactaacttgcctggaaggactactaccttttagccaagggcagcctggacaaaatttagtcctaggacataagtcattttacttgatctatatagatagtgcactaaaacatgctgcatagaaagataactttagacttcggaacattatagttatagccaggcatggcagaacacttctctaactctagcatttgcgagccaaaggatggtgagtctgaggccagcctgtgctacacaatgagcacaaggttctgtctgaaagaaacaaacaaaatgcttcagaaactttatagagtggagactctgagggtagatactaagtttgtttttctccatagtcccctcaacatgcgcagtactttatgtagtgctggtggttgataagcaggtcatatcttgagttagagaatgaattaatgatgaatgagcttgtaaaacagggaacagtgatttggatcagcagtgtgaattaagaagtagtttgacccagcctttttgctctgtgtttcaagaaagatgcaagcaggcagggctctgagggagaagcctatgagggatgggggattaccgagggctgacacaatttcatttaatccgaagaagtggagctcgtgtaggaggatgtcattaagcatgtgggggggaaaacaagtagtttgtgaaataagaaagcaaaacgaagcgtgaatgaagttcctttttggtctcttactctatattcagtttaagacatattttctttactatgcactcagactattaaaataatcgttcataataatgtatctttgcaagatgcttccaagagctataatttattgagtacatttaaaacttgattaaaaataagaaatactgaaatagggaaaatacagtccttatatattaaatagaaaggttaagcatctctaggacagaatctgaaaaaattcttcttttaccccattatcctggtttggtttctgttgctatgatacgcaacacaactaaaagcaagttggaggagagatatttgtttggcttacaggtcatagtccatcactgagagaagccaaggcaaccaaggcaggagcttgaagcataaaccaacagaggaatgttgtttgccagcttggtttcaggctcatattcaacttgctttcttaatacagcccaagctctcttgtctggggatggtgctgcccatggtgggctgggccatcctaacaggagttagtgatttagtaaatgccccacaaacatgcccgcagatcaacctgatgaaggcaatcaatccttcaactgagatttcttcttcccatgtgtgtcatgttgacaaccaaccaaagttagccatgatgacatgcagttactcaatctggataaccatagaaacagaagaaaaaggaaagaggggcagggcaaggaaagaatgaaaagatataagatttatgcaagtagggacactttcagcaaataagtaaattttaatttacaaaataaatctacagacataaagaggagtcatttaatatcatatgccactaaagctggcattttaattggcttttttaatactaactttatagtgtaataatgtggcatttagaattattcatgtccttgtgatctttttcagcatctaggtccttttcaaatgttattaaatcaagcatgataaacagcaactacagagatggagtctctctcttatgttgaatcactgtgatgtagttgaaagagcaatgggccaggagtccagaaacgtgatgtctggctccaggtcttctagaaacttcttttgtaactgtgtgaatcgttagcctcactacatcttgggggcatcagcttcttaaatgagaaaattaggctagaaattttgggcttcccaattctcatcctttctcctcatgaaattgccttgggaaacacaatttaagaaaataaaaactgtcatgatacatgggaatggaagtcctgtaagggccctgctctcttctgctctccctacgcagtgaacctcgccttgtaattggtccctaagctgccctgtctttggcttttcattcttgatcattttaagaactacaaacaaggtactctacaagtttcatatcccacccctccccgctcccagccctacaattcatctcttgatgtcatttcacagaacgcaaacagcagagtgtaactgtaggatgaatactacagaatcatataagggatttatactccccctaaaataacagttcagtccataaaataacaagaccagtgttctcatagcaaatgaaccctcaataataatccagaccaacagtggaaatctcatctgagccaacaacacagtagtttgactcctctgactgggttaagataaggcttattttctttgtggtttagcagccccaacatcctcttagttctcctacaatggatcttaattaaaggtttgaagttttctttttagcattttttttaaggttggaggccatgcaagtttgaacatcaggtatctcccagcataagatgagagactgtgacgtattagcaaacatacaggagtggagaattcagttagtacccaagttcccaaaaggaggacacacactactctactatcttgctacttactgtgaagcaagtctctagtttgactctgtcctgtttttcaaggctggggagattttgtcattcagccatacaattcatacaattcagccatacatctgtcatacaaatcatgagtttggggtgtgtgtgtgtgtgtgtgtgtgtgtgtgtgtgtgtgtgtgtgtgtgtgtgtgtgtgtgtttaaagtaaatctcctattttaaaaaaaatcaatgacaaaaaaaaaaaaagttgagaggagaaggagcgctggacaggacggacaggaattgtcagggataacccatcacaggtgtgcacctggaagagtgccttcacttcctggctcattagtgctggggttttattagcttcatctgcaattaggagcagccatctctactgcacagcaagagttcccacaagaaataacgaccactcctagcctcttcttgcatgcctccttcactcatttcaacaaatatttaataagcactgttctccttgcgatgccgcctgtggtttccaggcatctccaaaatattttttcttaatcgctgtgtgtggttctcccaccagaaatctgtgttattttgactttttaattgaaaagaatacagatgaaactctctagacttacctagggaatagacaacaaattgattatggcaattaattcaaagtatggattgtggttactttaaggatacccaaggaggtacatgttagttcatttcacaggtgagaaaattacgaaccaaacccaaaataagtggtccaaatggggagtcccaggctctgagtttgatattatctttcaattatccagaactagatgtgttctagacttcccagtaagtactggagacacatggcccacacctctgacagttcatatatgtggaagagaaagatgaaatgtgctatgaaccattcaagggttcacatgtgcagatggtagccagcaagcaaagcagaagagtgcaaactcagacttaagtgctcaggaggcagcccgatgtgaagtgatcccgtgaaattactcagaaccaagctgtgtgcagtatgagacagaaaagagagtcctaccagtagagattcttaagtcagacaagattttctctatggcctgttaaaacacagactgctgattctgtagtgggccctgagaacttgcatttcaaataagttcccaagtatattgacaccaccgatatgcaaaccaaaccttgaaaaccaatgactatccaaggcaaacactggctgttttatggctttctatgaaaagaaagtatgaactgctgagcaaagtcactgtcctaaagacagcaatgctaattccagatagttagattacatggttaagggaaagatgaacacatcttgtttagctagggaattaaaagtcaatacgctgcatcattttgtactgccgcacagcaaagtcattcaaaggttactgtaagcctctgggtcttgatgttcacaatcctctcatacaaaatcaaactttaaaattagatggcatcctggactgggctacttcctgctgtggagagaaatatttgatcttgcagactgctacaaattcccacctcccattcatttagcatgaatctctcactggtatttgaacatgccccctcagaaaaggccatataagagcaggggtggagagaccaccaagatgtctaattctctgcaagagaagaaacttctctgttgctcttgacgacccttctctggcctgatacatgcctctgtaccagtcggaggctctgagaagctgctgtgtgtctgtgccttgagaaaaagatcatccccttccccatttttgccaatatatgtatggtgatacttaattattagccaactttatacagagtagtgaaaattcatatacctttgcataagcttctttaaactaaaaaaaatcaatgtaaaattaaatattgctctgtcttcttttcatcaactagtattaaaggtgttgttttttcccaagggtgaagacggttatgcttgacacgtgactactgcttctcttccctttgccttgacatagcaatgtgaataaaagctagatttttttccaaaagacttacttatttatgttaatgtttgccaaagtggcttagtaataatattaaaatatatctcttcagtttttaatgaaaattgaaaacatgccagattttaaattagtggtaacagagaagctgctttcttgttctaaatacagaaaataaatggcaaaaggaaacaagaaaaaaagaaaaaagaatcagcttcggggtcacattataaactcgacggcctgtaaagtataagtaaaaatcacttttagtggtgttattgagaacatgttctaagcaactcaattatgggaactgactgattcctgagccagtcagtggtccttttctgctgaccctgcttgtttttaggacaattactttaaaagtcagtttagactaacattcgttatctaccttaaaaaaaaaaaagtcaatattttcccaagacagtcttaaaggtatttatgaaagtatcattaataagcacgactagtaagactgactaacatatttaaaagaaaagagagcctttgatgacttgaagggatctagaaatttatctaccaatattaaaacacatatagccatgaggaaacatttttaattaacattctctttttggatggagaaaagtttaactaacctcagggaaggttgagatatttgcacgacgttagggtaaattttaggagtaaatgcaaaatccccggagaagatatgggaagaaattacttgaggtttcttgtgaattttttgttatggtttgatgataaataccatgcaaatatcctctgtcagtgtgttttggcagtccttccaaggcagccagggagtgaagaggattatagaaggaacaaaaatgaggttgattttatactagaaaaacacagcggggaattctgtaacttcttagcaagctctccacctcagtcctgtgtccactacactgtactataaaatctttgggaaaacaaatatacaaacttccaaatacaatcaaaatttcatccttgccaacagaggtaaccaaaatgcacccttatcccttgctccagtactacaagcaagaagggttttggttttcagagactggaacatggcgcagttgagagtagaaaaggaagtttctggggcgtcatatataaggagaggtgagagtacagtcactagaagatgtagcccagcctcagaacacacagctggatgtgtggctggggaccatcttgtctaccttccccagcttccccccaaaccctccactcctaaatggaaaatatcagtcccttcactctgcatcttactgctgtagtcacctggcagtgggggaaccctgagcccggatgctcattttggaactaagtcctaaaatcatagggaagggatccatgggcttgcattgtctcttggcctgtcctggacaaattaatgattaggcttgtttcaagtgcaggtatgcaactgggaaaatgggagggggatcacactggacatagcacttacttgggtactgtaatgcttggtagtgtggacatgaagagctagatctaggcaaaggaaaattctaaaaaaaaaaaaaaaaaaaaacaaagagaaacttacattgcttttcatggtggatatgatggctcatttaagtttgtatgttagctcactctaagtggctgtgcatagatgatcgatagcagatccgcgcccacatgaatgatggaaagccctaatgaagccaatagacttaaatgattaaatgacatttcctcatgaagccccttttggatactcactgaagccatgtctaacttgtgtaagcatttatgaataccatgaaccactctgtcgcgttgtcttattacctgaactgacaattgaacaaaactctaaatccctcgcttaaccatcagataaccttgttttgttttgatggaaacatagtgttaaaggcacattattttccacatccacctcctcaatgtttcttccaaaactactcattccacggcaatatactcagtgttcaggatccacaggtgaccacagatgatccttaaacagaacatgtgacttgaagccctttcgccctcccctcacttcagttcacacagaaatctagcatggcgaagtctgatctagtaatcaaattcccttgccaaacaccagaagtgtatctagatgtagtttagtttgcctatccagaaaaatcagaatttttctcccttttaagcccaaagactattaatgcaaatccaattgaatttgcatttgattacatttctgatggaaacattcatatgcaaatgaaaattcatgcaaagatagccagataattcaaatagttgctgaaatatcaagataaaattaggatattaaatgtacatccatccacttttactgggttacactaaggtcatcaagtgggacaatattctgaaaagcctcgaataaattttttagaatattctaataggtatgtgttcagaagggagctgtaacattactttcagttgtcatagcacaaaaaaagatgtcagccactgttaaagttagtcatattgttttaaaacattcactttagctgggtggtattggtacacacctttaatcccagcactctggagccagagttaggcggacctctgagttcaaggccagcccagtctatagagtgagttccaggccagccaggactacacagagaaaccctcttacaaaaatgaaaaaccaaaactaaataaaaccatttattttacattttgttccttgccttctcctatcattaaaagcataataataataataatatttggtaagactattttaatgagccccaaaacgggcaaatagtttctgtaagctggtagttcccacacactccctaaggagtcaatggagcaatggagcaagttcagtgatgttatcattatcctttgaaagctcctatggccttgtgaaccgagcagctgagtcatgatcctaactgatggctagtaaatccaactaagaacagatataagcgaaagttcaaggtaaaaatgtattcatctagtaccttacattccaaactctttctaaaaggaaaccttggaattagacagctatccttgttaaacttagcagaaggtggagagagcaaaggaaaagacttgaggttacaacatgcagaattgttaccacctagtttggtggtccatgaaatataaagaaaattctcctgattgttcttctgtttgatctaatgtttgtacatgatttcaactctttagaattctagttttctctgcgttggcaaatatcactagccatttatcagactgaaagctacagatacagaagacacttcagcatgccactcgggcaagctggatctttccccaagtcttaagagattttactttgtaaatctctctcaattccagcaacttttttccgtctctaccaccgcttccttaatctttgtctcttcagggattttggagatgaacatgtccccagtcccaatcccactgtaccctcagccaactctgagcagaacctacccttccttttcttctgtccctgtcatactatagtcagagtcatcattaaaaagtacaagtgttttcattctgtaaaagtgtcatttttgcttaatatcctttgctagctgctgcttcttcttcttcttcttcttcttcttcttcttcttcttcttcttcttcttcttcttcttctccttctccttctccttctccttctccttctccttctccttctccttctccttctccttctccttctccttctccttctcnnnnnnnnnnnnnnnnnnnntcctcctcctcctcctcctcctcctcctccttctcctccttctcctccttctttttcttcctcctcttcctcctctctctcctcttcccccttcttcttggtcctaaaataaaaatgaaagaccttaggagggaaatttcccctccatgttcccacttctgcgatctgttccccaacatcctatatatttttttctttcactctgcactccaagttagataccaagatgtccctgttcctagtcacctgtgtacacactgctgctcctgctttgagagtacgttaattccaagttttcctcattaaagttttcctaatctttagagctcatttgattcctgtgttacctttgtttatgccacagtagagcaccaccaccataatacccagtcaaatcggaagcaatcagtttatttttgagattctgtcatttgaattactcttttctttctttctttctttctttctttctttcttcctttctttctttctttctttctctctctctctttctctctttctttctttctctctctctttctttctttctttctttctttctttcttcccctatcttcccctctctctctttctctctttctttctttcttccttcctttctttctttctttctttctttctttctttctttctttctttctttctttcttcccctatcttcccctctctctctctccctctctctctctctctctctctctctctctctctctctctctctctggtggtttcctgaaggataaggttagcgttggtcttcacttaggaaaataagacttgctgtttaggctttcaatcatcacatgttaaacaagtgggagcttcgattttttttctaatcttcttatctaaaatccacaagtttataatagtgtgaaccaaaggaaaaatggggaagaaaaagaaaattcactaacttgcttgaacattatcacatcataaacttgccaaggatatttcttataggaaaccctgcatgcttcttgtagcaaagaaaatatggtaaagatctagtggcatcagagggcactgctttcaagccacagtagcgtgagtcggccaggcactgtgcaaggccctttccccagcacccataaagaggaactaacagttactctttcagtcctacattatgtataatcttttatttgggatatgtaagccataacaaatttcagagatgtatctagagattttaagtacatcatgtcttgtgacacagattgttggaattggtccacgacaattatttcataaaaataatcgcaacttaagaagctaacatcatatagaaatcatgctgctgttttatcagtggggctccattactttatattttattttttatcagttatgagcttagttttattttaactatacaattctgagcaaggatcaacattgcagtgagagaaagagagagaatgtgagttgttagccaagtcacacttgtgcttgtagagataggtgtctctccctccattcacatctgtctcagactctgcagactttactctcttagaaaaacatagcaaaagcttttatttagcagcagatgcatcggtagagagggaggtgaagtttagtctggcttctcaagaaaattaaatttcctttttttgtgtgtttcagaacattgtattcaagggcttgtggaagggctggagaggcctacactatctactcctcagaggagatggtcaaggtttccctgtcactaaaagctaaatgcacttttcttaagacaaaaaagaagtttaatatagaccattaaagtatctgcaatgttatgttaggccatgtttaggaaattttttttaattcgattttaacattttttaacaaatacaatttaaattttctttcatttgtacatgaattatacagacggacattttaaaaaccaaatttgcctacttaaaaaaagtaagctcttttacctgtattgtaaaaacaagcatttaatcagtgtttggtcatcttctcttctgactaatgagctactttaagtcttactagtaacaagccaacctttgctaccaacaatgatctagcagacttggtcacctaggaagaagaccctgaaaagacctttctctcttgcttatgatttcagttaagaatgcaaattgcacatcagactttgaggaatactttgccaaaagaaaactggaggaaagagatggccacgcagtgagcatcgaagagtaccttcagcgaagcgacacggccattatttacccagaagcccctgaggagctgtctcgccttggcacgccagaggccaacgggcaagaagaaaatggtaaggctgtaattcatttttagccgcgatactgacctctgcagctgttagaattacaaatgcactacatgcctgggtgtttaccttaaaatttgaagaacagctgcagaggcatggaatttcatgagcaaagattagaactgtaattttagggtattgtgaaatttttttttgtcagcaaatttgtgtcatttgtacatccaatacagaataagaacaattacagcccatttctaagagataaaaatatctaaatgtattccaatctttcagagatattttacttttgaggaaaaaaaaaagtttaagatcaccgaccctcaccttttgttctctgacacctgaaaaaaaaaatctccttccctcctgtgaattcctgagttacatgtgagtctagggttcagggggactgtcagtcacccaaagggaatttcttcatttatcagctgtttaaattccccctccccacaaataagctcaagtaattaattaattttcgagcgcagtgtgagctgattcggacaagcctgccctgggtgttcaaggggtctggttgtgaggaggccggggcgcaatgatggcgctgtgcaggagcagattgcagcgattcctgtcatagcagcccgggcagccagcccattagctgccattgatttactgaccttttggcccgctcctctcccctcgcctctcggctacagacctgccacctggaactccagatgcttttgcccaactgctgacctgcccctactgcgaccgcggctacaagcgcttgacatcgctgaaggagcacatcaagtaccgccacgagaagaatgaagagaacttttcctgccctctttgtagctacacgttcgcctaccgcacccagctcgagaggcatatggtgacgcacaagccagggacagatcaggtgggggttggttctaagtgatttctttctataataaccccttagagaaacgatattgctttgattggcaatcattattaatttttcatggcattttgaagatgcagatcttttaatggtaatagctttaattgaggtctaaatgattttttgatggtctcttctaatatgatttaatagtcttatgttcacgatcgaatgagtgtgttaatttctaatttagaaattttatttgcactttaacttgactttagtttcatttttatgttccacaaaaagtgaatgaaattgtagcattttaattatacattattaaacatctcagcaattttaattccatttttcacctagttttgcttaggcatttttttttatataggacctaatacatagcaaaagaagtgcatatttctctcatttgtcacgaaacacttttaaattacttagaatactttacaagcttactaatttatgaaatatgtttttaaggagatagaaaggccatataagttatatgcatatacacataataaattggaaaagtgataaatgataaaaaacattggttataattaaaatgactccatctcaatatacatgcttgtagttaaatgccaaaattgttctgcctcttttagcctacttgttttaaaaataagaactctggcttggaaaggtaggaatagggtcttaaatccttgaaatgactgagtagggctaattcacagcatctcttaaatgtttcagcaaaactgctctttctatcctcctgggagaattgactgtgcaaattgatattatgatgtgttgggtggtcacagtaatggtgtttcataagtcacaataactggtcctacagatacagaattgcccctaaatgaactttgatattatatatttttgagatggttaaatatgacattctctataaaactccgatttgtcctcataggccttattgtctttgaataaggaaaagaagacacaaactcaattaagcaagaatggcaatactgtgttacaaatttttactatttaaggcactatatcacattatcacaccatttgtttctgattggacttgtgagttgaatgttttccaaagatcagctataagtaatacgcttgtgcagttacacttttgtaacagtttatcttctcatgcttctatgcacaaaaaaactctaggaaaaaaaaaaagcctagatatttatctagtataactgctttaaatttcacatgcagaagtgtgattgtgttggcgcattatgaatggtagctttggtgttgaaaagtcccctcatttgctcatggcatttacaattagtaaattaaaatgattgtatcatattaacagtggcacaactaaagtttatagtagtcctctgagggctgtgggggagacaaagcagctgttgctgtttgtttatgcaactcggcaacatatgagcactggtccctcaatggcgctcggcgggttgggctccgcttgatctttgaaggttgctgctgtttgaacaaacctccctgtgtcccatgtaacaccatctgtctcactaggaatgtgggaagattcagcacaccctagcagttgtcacaccgtttctgggctgtctttttgcaaaaggcttttgtgtcattgctgcagaaaaaggctggcctcctaccttgagcatccagagtggatgactgttgggttgttgtttttttttttcccccttagaatttcaagtcacactgcgtttcccccttgttcaaaaaggtcagcggtgttggatggtatctgtgctgcctctaacttgtcttttcagcaaacttttttttttctgttggttcttgcacactactaaaacggaaaatgaaatgtcattgaagtctttcctactgacttgtgataaagctgttcaagcagacataacccaagatgttgtctcttatttgataatgaatcaaatctgataggcagcacctaagaaaaacacagttaacatgggccagtagcacagtgaatgggatatttaaacaggcataccaaatatttatagtcaaagggttttttttttttttttgattttgtcttttatttgggggtggggagaggtctccatttctttaaatttcagtttgatttagtttacacttttacctggaaacagaaaacttcacaaaaatttgttttaagtgtgggttaaaagaaaagaacaattttataattttcaggaaagtatttttttcctcctcaagccagccgtgttttgaaaggaagcctttagggttcagattctgcactaaaccaaaaggagccatgagcatctctacaatcatactttctcatctcaagggtcaaagaaatgctgtagaaaaaagatgtcaggcgtaattgtgaagcaagggtccgacgtgcacgggaagcactttcttaaaagagaaaaattcccattttattaccagcattaccacttttattgcaactctgaaagtctgaccagataaataagcatgaactcagacctctcagcctgtctaaaaaagaggtcttgggaaagattcctaagcaagctcctttgtgcctcctgaacaaagatgacggccatttttctccttttacagcaccaaatgctaacccaaggagcaggtaaccgcaagttcaagtgcacggagtgtggcaaggccttcaagtacaagcaccacctgaaagaacacctgagaattcacagtggtgagtcacaggggggtcgctgcattgcattctttcctactagagaagattgtggagaccttttcagtgtacacagtcccgggtggagtgttgtgggcttacccctttatttcataagctctaggagtcttggagagtcttatggtatcctataaatgcttatccttcttacaattcacaagggctttgatttgtgttttctgctaaatctagagacttttacaaaaccgtataactttgacctggagatatttgggctgcaatttcagaaagatattcattttttttttgatacctaaacttacaagaaaaagtgggagaaaattggacaggaacttgcatatgctaaccatttcttgactcctgatagctatacatcataaacccacatcctaccgctgagatttctgctttatacatagtttgatagctctgccaagcattttattaccaaattggatgctattcaaagaactagttgaattggtagaatcaatggggtctccacagagttgattaaagccatggctacacttccctttaaatactgtgacatctttattgtgctattgaccacacattaatctgacactctgtttaaataggaggctgctgatggcctgacaagatttgggattctaactgaaaaaggcgtagagagcctttaccttccacagcttacatcttgaattatgtccactgggggtagataaaatccagagatagttatggtcatataactctgacgtaagcatctagaatgtagagtccacctacattcgacacctagattaatttcatttggtttcacagattcttatcttggcagacaactttgcatgttacctaaatgaagaaatctaatgctaattttaattatcctttcaggtgaaaaaccttacgaatgcccaaactgcaagaaacgcttctctcattctgggtcctacagttcacatatcagcagcaagaaatgtattggtttaatatcagtaaatggccgaatgagaaacaatatcaagacgggttcttcccctaattctgtttcttcttctcctactaactcagccattactcagttaaggaacaagttggaaaatggaaaaccacttagcatgtctgagcagacaggcttacttaagattaaaacagaaccactagacttcaatgactataaagttcttatggcaacacatgggtttagtggcagcagtccctttatgaacggtgggcttggagccaccagccctttaggtgtacacccatctgctcagagtccaatgcagcacttaggtgtagggatggaagcccctttacttggatttcccactatgaatagtaacttgagtgaggtacaaaaggttctacagattgtggacaatacggtttctaggcaaaagatggactgcaagacggaagacatttcaaagttgaaaggttatcacatgaaggatccatgttctcagccagaagaacaaggggtaacttctcccaatattccccctgtcggtcttccagtagtgagtcataacggtgccactaaaagtattattgactataccttagagaaagtcaatgaagccaaagcttgcctccagagcttgaccaccgactcaaggagacagatcagtaacataaagaaagagaagttgcgtactttgatagatttggtcactgatgataaaatgattgagaaccacagcatatccactccattttcatgccagttctgtaaagaaagcttcccgggccctattcccctgcatcagcatgaacgatacctgtgtaagagaatgaagagatcaaggcagnnnnnnnnnnnnnnnnnnnnatgaaaacatagtccccaacaaagctggagtttttgttgataataaagccctcctcttgtcatctgtactttccgagaaaggactgacaagccccatcaacccatacaaggaccacatgtctgtactgaaagcatactatgctatgaacatggagcccaactctgatgaactgctgaaaatctccattgctgtgggccttcctcaggaatttgtgaaggaatggtttgagcaaagaaaagtctaccagtattcgaattccaggtcaccatcactggaaaggacctccaagccgttagctcccaacagtaaccccaccacaaaagactctttgttacccaggtctcctgtaaaacctatggactccatcacatcgccatctatagcagaactccacaacagtgttacgagttgtgatcctcctctcaggctaacaaaatcttcccatttcaccaatattaaagcagttgataaactggaccactcgaggagtaatactccttctcctttaaatctttcctccacatcttctaaaaactcccacagtagctcgtacactccaaatagcttctcttccgaggagctgcaggctgagccgttggacctgtcattaccaaaacaaatgagagaacccaaaggtattatagccacaaagaacaaaacaaaagctactagcataaacttagaccacaacagtgtttcttcatcgtctgagaattcagatgagcctctgaatttgacttttatcaagaaagagttttcaaattctaataacctggacaataaaagcaacaaccctgtgttcggcatgaacccatttagtgccaagcctttatacacccctcttccaccacagagcgcatttccccctgccactttcatgccaccagtccagaccagcatccccgggctacgaccatacccaggactggatcagatgagcttcctaccgcatatggcctatacctacccaacgggagcagctacctttgctgatatgcagcaaaggaggaaataccagaggaaacaaggatttcaggtaatgagatgagtcactttgctctgaggaaaggcacataggataacctagttgtgattcccaggctgcccagtcctaaataaattgataaatgacctagaagatacaaaaggtgggggaaaaacactcagttggggtggggaaaccaggaatatgagagctttgaagcaagctagctaagccagtggctgaaaggataagcttattaaaaactaaggcaagaagattgctagtttaaggttaggcagcatagcaggatccggtctccaaaacaaacaaaacagaataaagaattctgagaattacgcatcgatgctagtagttggtcagcttaccgacatgcttgaaactgaagtgtgtaacagccacactctcagaaaggagtgtacgacttgaaggaattacatatttaaattttgatatctattttgttttataaagaagagttcattttgaagagaatttaaagaaatattttacatgttacataggacttcttgcctaattttcaaatggtcaaagaatttgtaggtggtagaatctgaaagcaggcattgttttggcattattttgtataatccctgtttgcaaaataggagccaaagtggcagtgcacggctgtaacagctgtccagtattccaatttacaacacatctgccctctttgtaaatgcatttaagcctatttaatcttctctagtattaattagtgcaaatatagtgtaagaaaactaaactgtgggctagcaaatggaaatgtatgttaccatgcaagtttgcactcctttggaccaagacaaaaataaatatcaagaaatttaataatttactgatccacattcattattgctcaatgctgaaggctgttttaacatagatagaacattgataaaaagtgttattaatattctctatttcaaattagaaaattaaatataaaaatatagcttaaggcttttagttggtagacatacatttaaatagattgtataataataatattttgtacctaaatataaaattcaattaaaatgaagcttctacagctaccaatcatttttgaagtaaagtacactggaaaatatggtaatcctgatatttaatgttcactcttgggttttctctggtattaaaaaaaagtgaaagatttaagaaaactgttttcccatctatggcagagaaggtttatgttttgttgaaaagtgaaacttccatgttgtttaggaaaaaaaaatgagaagattttagttataagatagattggcatctagcatttttgaggatctctagttgtcagcctatgcttaattgtttgatgtaaacacaaagaggagagaccatgttcaactatgtgattatatcacagggagacttgctggatggagcacaagactacatgtcaggcctagatgacatgacagactccgattcctgtctgtctcgaaagaagataaagaagacagaaagtggcatgtatgcatgtgacttatgtgacaagacattccagaaaagcagttcccttctgcgacataaatacgaacacacaggtatgagcgactttgactagctagctagagctctccggcctgctgtatatttcataatatttaatgagtgcacttgtgcgacataagatgtagcatatgctgacaccttcaacaagaaagaagtaatacttttgcataactcagtaggacttttgtgttgcctgtttattggatcattcatgtgtttatgagtgtgcttgtcttcttaactttcaagttatctgtaaaacaaatttgcctatcatgtcaaaggaaaatttaaaagcccagggtaatgaaatggcatgacaagagctcatttttgaaagtatcttcaaattcttaagctgtggtgaatatatatatgtgtaaaaattattatgataaatctggtccgtgatatactagtggactcatccaaacactaagtaagccatgctttggggtgactttctttggttttcataaattggccacttttgaaccagttataaatgttatttccataaaagaaaggcaagagaccaaataagccagtgaatcctataactgaaagactaaagtaatatatccagttcatgtgttatctattaatcaccaaccctgacaagacaacagccccagggctccctgggactacaggtggtatgttacgtttcctaaaagtgtaccgtgtaaagatactttccacaactccggatcagatctgcagctctgtagtagggtttccatcaacgtttcctttctccttcccatcttctgctctaaacaaagaaacctagtcttaccctgtccctaatccctgtccaagtcttctccattagaaatatgaatttgtctgtggtggggaaaagaaagtatagagtcatattcaaaatattgtaaatgggagcaggatggacaaagtgtagggaaaccttttattttaaacaagggcaaaagttagcattgatgcatgtggtgtggaagagaagaggaggtgttagatcttaactctctgcagatagggtacatcttaaagataccttgggaaactcgggtactccaaatcttcccagatccttcactagccatgggttggaggtagcacatgtgaccagaatcaagctgagcgctgggcgaaagtggcccatgctggaccgctagtgctgagagcactttgtgaagagaacccaggttgtaacagccttgctcctggtccaaccagttcagctcctttccctccaaccataatatctgtggttattattttaaaaggccaattaatgttaaaacaccccaaattggtttgcaaatctacacaatttttatacttaagctatatatttgaaacatcatttttttcctaccctgttcatttattatacttcctttaatactgagtcttatttaagtatttacagagtaacaaatattttcatgcctaaatttactttaattttaatcaacctcaaatatattttgtatttcattattcagctacaataggcacatcactgaaggcatctttccctctctgattggtcttattatatgaccatatgcaaactctatcatttactacatggtgagtgtaaaacttttattttagtgagggctctcatacatagtgacatccagtcagcatatttatctcctataaataagctagtccataaacttcatagatgtccagctagttgagagacccaaaagttgacaaatgcaaatgtatatatatatttattttttttaataaaagcacgttattttaaaagtaaaatatcttggtcctttaagatgagagatctgctacctagacacattgcctagcaacaggatgcgagtcattcaatggcttctctaaactggtgattagttatcctcctgttggtgacccagcttgtagagtttccagtctgttaactttttggtctcttgaccaaacatctcatgacattaatattgtcattgtattaggttccatccaagcaaaagtcttcatgaaatgtgtcagtatgatgtatatgtaaacttagcttgctttcttctaactgcgctccacaagccttttgcttatattaatatctaataatattttaaatgagttaatatgaatattctaagagagaactgtcttgactctaaagctgggcaatgaagttgatctgtcatttggttattatatgttgattataaatgtgtcattgataaagtatgtttgttatctgtctatagaactgtttaaattaagaagaaaattagtgtctatttattcctgggagtttgtgctcttttgccgtaatctactttaaatttattttctaggcagataccaaagtcatactgcttaattctcttaccaatggcttattgcttgcttgtttgctcggttttggtgggggggagggagataccctggatagtacagagaaagaaatactttgtaaatgttaacttcaattggaataattgtcataaataatgactgaaataaaagatctgaacctcttggtaggcactgtcaaggactcatttttactccactaaaatttcaacctgatatcgattggttactttctctgttgagacactgtggtaggtgctttcaaaccaccttattttgaaaagaaataaagatatttctactttgaagtagacaaaatctaaattttaaataaatttctggtcaatgttgttcctaagttatatggcaaaattaaaattagcccttattttaaattgaatttattaagtacttgttagtgaaagtcctcaagattactagactatttagtataagagttgtgtggaactctcagtgactcactgagttgtcctttgcagggtatcacagtactttatcctccaaagttgtctgtgatatataatgtagccctattacaagtacagtgtctattacccaatacatcctttgaaagctggctgcctgtccttataggacccacctcccatgcattctaaaagatctggaagtttgtcttggagaatagatgttttcagtccagatgctgctctcattctacaattttggaaaaataaaacctgtattcatatattctctccacaaagtgacctaactggttgaccacctttgatcctgagctgataagacagcagcataaaaaagatatcacgggatagtgttgttcatgcatcttttaacaactaaagaaacaagaaaattttcatgtctaatttttctccattcagatttacttcttgcatgtatgcctactccctgatgtatgcattttgcttagaatatagtagatggttgaacctgtattaatggacaagagttgagagatttaaccctaataggctgctcactacaaagtccttgtactaaacactttataaatcctgtctccattattctatctatggcctgtcctcaggctaagtccccaaattactttcctttatctgcaaagaccctgaacctagaagcagttgacatacccaagactgtacgtactccagcctgtcctaaaaatggatttcaatgtgagtccagagctcatcacccttattgagcaccattctgcccccatggaacaattgctatcaatgctgtacccttctccctgaaacatcatcattttaaatgtgcacttccaaacaaggaagaccaacactatactgtagcagcttgaacatttcctgaaaggttaaagaaagaataatacactcctaagttcttttcatatactcttgtgactcctattgttacctacccaaatgaaaaaaagtactgtgtatttccagattcctaccactctaccagaatattctgttgtccagtttccctcatagaaagcatcttttcccaaacttaaagactggttcttccatgccttaaattaaacttgttatcttcagcctattagctaacttgaagtaggttaatataattctgtctgcatttcccatttggtgagtacccacaatttatgtttgaattcttatcttacagataaaaagcaaaacaaagcaaaaacttcctactaaaatattgtgccttcccctatcactcaccactaatttatatcggatgttccagtaaaatgacaaccatcaatgaaatagcagctcaaactgtctgcagcgttttctaagtagtggcaatgccctggaggcattcaataacattattaaagatatttgattactaattgggattgtatatcaccctataactgaaaacctgaagtgtccagaatgggttcctaatcttataacatgacacttagcaaatgaaaacggggttggcctctactaatgccggtgttttaatttaatttgctgaaacaggagtttgtaggggaagtagaatcacctagcttcatgtacgatatgatgatacctcatgctccgcgccacacattgatttttaactctggcgcatcaggctgatctatctctctatttgtcagttctattttggaaataaagttttaagtatgacagctccaaaaggtgttgaaggcattccagtgctatttgtggcctggaatcaaccagatgtgtttaggcttggcagtggtttcaagttccaaacactggttagaaactgcctggaatgggaaaggaagcgctaggttctctagctcaggagtattttaacacgcaacaagtggctggcatcccatggaaaactctagcggggagggggggggggggaaacaccatttgcagctagttcagatcctatgaaacacatctttctagtttgcatttcagatggtttcttccctaagttttactcttagaatccaatgactgatcagacactcttagcatcttcttgcctccagtctgttctttcataacgtagcagtttgctcctgtttgagactaggcccactttcaaagcagctagctcatgatggaccatacaaaaccagtgatgataccatttctattgctctcactcaagttcttgccttaaaacaaaacaaaacaaaacaaaacaagacaaaacaaaacaaaacaaaacaccgtaaggatgagaagaattgtctggcggtaaaatgttgtaggccactaaaaatgtcttgtttcccaggacgtttttccgtttgagacagtgacaaagcctccattttgagttccccttcagcagccatctggttaaccaatcacattcgttagtaatcggtagaaaaccagattatgagatgaaaatggaccttcctaaccgacttgggttagaccgaagtgtgtcgatctttcagacataagcagacatgctcatgcctgagtcgggacacgatgacagaattcttggaaagagacttcatgccaagccactaatcaccctgtcgtcttgttctttctcccaggaaagagaccacaccagtgtcagatttgtaagaaagcgttcaaacacaaacaccaccttatcgagcactcgaggctgcactcgggcgagaagccctatcagtgtgacaaatgtggcaagcgcttctcacactcgggctcctactcgcagcacatgaatcacaggtactcctactgcaagcgggaggcggaggagcgggaagcagccgagcgcgaggcgcgagagaaagggcacttggaacccaccgagctgctgatgaaccgggcttacctgcagagcatcacccctcaggggtactctgactcggaggagagggagagcatgccgagggatggcgagagcgagaaggagcacgagaaggagggcgaggagggttatgggaagctgcggagaagggacggcgacgaggaggaagaggaggaagaggaagaaagtgaaaataaaagtatggatacggatcccgaaacgatacgggatgaggaagagactggggatcactcgatggacgacagttcagaggatgggaaaatggaaaccaaatcagaccacgaggaagacaatatggaagatggcatggaataaactactgcattttaagcttcctattttttttttccagtagtattgttacctgcttgaaaacactgctgtgttaagctgttcatgcacgtgcctgacgcttccaggaagctgtagagagggacagaaggggcagttcagccaagacagagttagatggagttggatattgtttaaaaaaaaaaaactgcattatgcaaaaattttgtacagtgttaaggcctaaaaactgtgtggttcagagactaattcctgtgtttaatagcatttatgctttaagcacaactagaaaattctaagaattgcactctacgtatgtatcactacaaacttaaaaaaaattatgtctaatttatattaatacattttaaaaggtgcccgcactaccatacatcagtattttattattattattattgttattcctgtttaatttaatgtgcccgcactacagtgcatcagtattacgattcctcaacactttcctttcgctattcatgaatttcccattgttttacagcctaagtaaccacacacttttaggcctcaattttttattttttatttttttctgtgaaggaacttgaagtgatgcatgtgtgaatttaagataccgaagtcttaaagtgacctggatgtgaaggaaaaagtaagatgagaagtaaagaaagcctttgtaaggtggttttaaaagccttatgcaaaccttttaatctgtgtctctgcaagtgccatccttgtacagtgttcagagggtaacgagggttacctttgcaccagcttcagtgttaagctcaccgtgttctttgaagcacccgtgtcagtattagacgactaggcagcagttccttagtttacatatgtttgtgcaattattttctgtacttttttgttcattaattttgtcagtattacaccaaactttttttgcaacaaaaaaaaatttttttttgcattcatttaattttaggtcaaataacattttatttatgtggctcattttatatttcctaattttatttatttcatactgtagtgtacagtattatagttcttcaatatatagatatattttagtaaaaaaggaacatgacgttgatcatttgggcaaattttacgtaaagagaagagcatttattgtgttttggaacattaattgtgagatgggatttttcaattttattattttatttttgtttttgtttttccaattactggagattccaaatttggaaacttttgatacaatcttgtgaaaacactgtattttcgactgaaaattccactttcttcatcttgttttttagctaacctcaagagggactgttaaatacaatgtatgataccatgacaaaaatctttcctgaattgtctttgtaaaagtattattgaattttcaatttgtaatttcttttgaaaatgaccatgctcgaataaaaatgtagccaaactaagaatgtagttaatgagttctgtacttttagagagctttccttcaatgaccattaacatgtaacatgcttatgcttataataatgctaattatgtttttcaatataattttagtttagcaataattttgactggtaccaataactgttttttaaaattccatacttatgtacagcaattttacagcttttctcaactgatcctgattccagattgtgtattttttatgtgaggttatattattcaaatttagtctatttactttacagacatttctacttttgcattacaagtatttagagattatgtgttaaaaactcacttttctgtccaaggggtctttgtgatttattcagaaaagtctaatttcaaaaagacagctattattcaatgttatttataatatgtaactttttttctaagagttgggataatttatctcactttttgaaatgcagactgtagcttatcctttatctaagattataaaatggggggtgggtgggaaaacaaagctaaaggcacatgctaacaaaaataaccttcattttccaagacagtctttcagtttttacaagacgaccctaatagtcagtatatgaatgtattcataggtttttacacaatgattttttttatcagaaaccagattctaattcctaaatctaataacaaagtcagaataataatacaaaagcagattaccttatgaaatttacagctcttgaatatacgtaactataatatagtagctgtccacatattttttctactttagaatcaaaaaacaaaagcatgattttgctattgaatttgctaaaactttaagtgtgacacctcaagttggcaagaaaaacatatttttattatttagccattttcctaaatttcataaacattgttccttgaaatgacacacacacacacacacacacacacacacacacacacacatacatgccccaagagagagaaaagatgtaatgactatacagaggcaattgagcagatacttgtagaaagcatattttcagctctatcttcaagcctggtgaggactggcattaggagagatggcataaagcattctgctcctgtcatcgctataccagagtttgcatgtttggaaagtttacagcattctttccctatttctccttctttcaatggcacaaataaatacactacatagaaattttcccgattttaaaggctctaggcgatatctttattaattcaacctgaaaatatcaagccattaaattttgtctgggtagaataaatccctgtggcctcctttaaagcaatgtaggtctctgctgcccatggggcatatctgtgtccctacccacaagagacaggaccaacaaagaacacatgagcaacatactctttctccccagaaagaagaaagcatgcatgagaaggagcaaaggggagcacagagtctccctcccctcctgaaatccctctttccaccattgtttttacaaattacttttcacaggaaggctcagaatacctgagtctgcaaggatcaggttaacacttgtaaattgtgacaatcactacaatgtcctatatcttaaggtttctttcctttttaaaaatgcaatttagccactaatagtattgcacattagagctgcataatcttccaactccagggaagactaaaacattggacttatcctaggattcctttccaaggtcataaacaagaaagccctccaaatcatgacacataatctccttttcttatcgaatactcttcccttgttctagtcttaagtattaccctttacccctgaggataggggctgggaaaaggtgatgaaatcctggaactgaacaccccgcccattttctcaagagccttttgtattctagcagatctgggaggttctttcttttttgcacatgacactgtaggcttagttctgagaaactgggcaagagagatgagatttctcagccagaactaacagcgttcatctcccttagcatgaacttgagcttgcagtggagtgggagggcctgaaggaggaaggagagaagggactatatttgaataggtattaataaatttattagatacttttcacaatcagataactttaaaatgttattttttatcttctaaggacataagccttaacaacatcaaaatttagtcataaatttgaagatattccccaataataagtttatatatatacatatatatatatttgaaataaaaaattgttagccatgtttttttgctccaggatgtgtggccatgccaggctgtgagccctggatatgcacacaaacaagtgtgtgtgctctgaagcccccgcacattgtaataaacacagctgcatttatttgagtatgtgttcccgtgtacatgtaaaaacatccaaacaaacacactcagcagatttatttcatgtgcaatggggcaattattcaaataaatatgctcaatacaattatttgagtctcgcatttgcatgctcatcactcacagaactaatactaaaagagggggaaacaccaaagaatttacgtgggggaaaatatatgtgaaagcaatgttattgtagatgttataaggtagccaaagctatggctcccttcttaactgaaacacaatgattttgtattcagtggcatttgtttctaacgatgaatagttatttcactcacttgatcattacatcagaaggactgcagtgtttagattcatataatagcaaactttaaggacctgaagcagataaggatgagacatctctatatttcaaaagcagaatagttctttctacatactttacatcaaaggaacactgataaattattatggctcacatacgtaactataaatttaaaatgttatacatatagaaaaacattcctacattttaaaacattaaaaagtcacagatgactcgtgtgatcattttatatattaataaatactacaatatatatgtgaacacattacaaatcatattggtgaacaaagaggctgtaaagcctctcttcagtatactgacataacctaatatactaaaatgggaaggggcttttagtcactgaatatgcatcgtgaaacaaagatgaagaaactacatggcttgtgcccatcacgaaaaagattcatactgaaggcttagctttggtttttattcaattaaattgtcaaactgtgcacagtgaacttttttttttttttagaacttgagacatttgtgatgttggctgtttaaatctttgttaccttcgctgtgaattgaaattgtacatatttagtaaatcatgcaaacaaaacaaactttttagacaatatttttattggagagttttcttttcctgtatccatgtttaaaaaaaaaagacctcctttcccaaaataaaaaatgtcaatactaaatttaaagaagtataaaggaataattgcttcctttagagcaaatatttaaataaacatggagagaattggcaacatgttcttttggggctaataggctgtgttcaattttttgggttaaagttccagagggcctctgtttcacattcaaagataatatattaatctctgaattaaagaaatgctcttaggtaacaggataaatccctcagtcttcatttgtgtgtgaagtgtagcattcatcagagacatgacattgagacgacatgatgctgaatatgccacaagctaaaacacctctattaaaacagtcacctaccacctataatccagtgtgacatattaaaatactccaaaatacagagcatggagaatgaacaccataattcccatttggccttgagaagaatatgacaaagattctaataatttttgtcaaagaaaatgatgatttaaaaatacatgaagattaaagtggtgacaaatgatcttttaagtatttctaattggtcatcctcattcatagctttgattccacagaaatcacaaatcctaaggcccctgacttgtgagtgcgccccgtcagctttcttcatgctacagaatgtggctgttaggtaggaaatgaaggataagaccccaatgtgttaaaaatagacttcttctccggcaagaagtttaaaattggcaaggacaggactcagaaagaacggccttcacatgaggaagcattcagagaaagattgttaccttgtgatctgaccatttccagaacagtcaaaaggctctctccctccnnnnnnnnnnnnnnnnnnnnctctctcaagtgtgtgtgtatacgtttgtatgagtgtgtttgagtgtataggagtatgtgtgtgtgagtgtgtatataatgtatatatgtataaatgtgcatgagtgtttgactatgtatgggtgagtatgtatatgtgtgagagtgagtttgtatgtgtttgtgggcatgtatgtatgtgtgtgtcagtgagcatgtgtgtatgtgtgtgagttagtttgagagtatgagtgtgtaagtatatgtatatttgtatgagagagtgagtatgtgggtatgagagtgtgtgtagctttactaagtttacgtgtataaaattggatagattgtatcttttaaaaaccaatattcaagagatggagtctaaacagagggcttctgagatactttctatttgttatcttacataaactgaaaacatttaaaatgttgatactggaaaaatacaaagttcttaagagagcttcataaaaactgaagaaaaaactgaaacaatttctaaggtatgtcaacaattaaatagagaaaatattaaattagcttttttccccatcacttagaaaactcagacttctaaaatagggcctttctttaaacaataatcattttttgcccattcttaaaatagttgtattatagggcaaataattacagtatactcctgtccaattttgtttagagaaagagaaatataggctttaaattacttgaaaatgctgatgaataaaagaatataaatttagaaaggagactcaagaacaccactaaactcaaaggaagcagggcactgcatttagtgaccacagcaacctggatcttggttttcacatgtcttctgaacaatattacttccaacagaaacatttcccaaaactacagggcagcccaagatccttgtgggcacacggggaaagcaccaactactgagtaaccctcaaccacttcctgccgtctgaaacactctgtggaggtctaccatctcattactgaacatgcttagaaagtgtgaggacataggattctggttaaaggcaggtcgaaagcaagagggaaaagcagaagtgcaagccaccctgcccaacttgtttaaaaggatattcctcaagtaagcatgcccaagagtaatcaacctcagttctaagcactcaccttccttttcctcaacatcaagaacgttgacaatagccaagacaatcccctaaaggggagcttttgaatcactttagaataaacggtggtggaatagtcaacataagcttccaacaagcagagttccagccacaagaactactgctacaggtgtaccaccttaattttgaaaatgataattaaactaatgactttttatatattaaaaaaaaaacacatttccactggcgttttcattataaaatctcatgttgtaaattccttcatgactgggacaaagttatggcatactatctacattaaaattgatttaaaaaagtgttcctatgaataaaagctttatgtttgtaacattgagaacgattaaaaaaaaaaagcaattaatctatcacccacacgttatagatgaagaaaccgaggtctgaaaatgcttgaaaacacacaagtgtttgtttttagcccacaataatctggaaagcagctaactgcataaaaagtctagtcctctgaaagagagtaacatagcctcttcaaagcatcacttcaaacaccacagtaaaatgttcttttcaaagggcccgaagaagcagcaaaagagatgggttagttcctgcaagaaggttttcttctggtctataagaacttttccatgcaagagcgaaatgaaaacaatctatgttggaagcctgtgttactctaagctgtgacaacatctgtacctagtcacttcttatcacgtagagtctccactgacaggcagagatgttctcaattttgagaaatactcttcaaaaatctgtaactgttgctgcttatagctgaagagactgaggtctgcaagtgcttgaaaacacacaagtgtttgtttctatctcacaataatctggaaagcagctagctgcagattgccaaaactctagccttctgaaacagtgttctgtactttctaaatacaccacagaaaaaggaggagaaaatagggcttgagctttgctccaaggagcagaagcagttggagattaacaaaccagtagcagcagaactgatggaagaatacaaaagaaagtcagagtagaactcctggacacttcctaacccaagccctaaccttcagatgctaaggtttagtgaaactaaaaccccagctcatcctgtagctacaggggacccagaaccagaggttgggtctctcatttttacatagatgatgtgattgcttttcattgttttaagggcaattgagtgaaaataaaaagccatccacttaatggtctagggatacagtggtatagaaagcaaccacacacccctttaagaatgtacattccaggtgggaagggagaacaattacaaggtcccagcggataggacagcttagttaaaaataaaagcaagtgagaaaataatgagcaagatggatgtgggggctaggatttggggtgtcaggaagaacctcatggggagttgagatgaaggataagaagaagtaaggcatgggaagagctggaacaaaggtgtaggaacaacaagtatagacacgaggcacaagcgaggctggctttgtggactagaaagtccccctatgagtgtagtgtaagaggggcagagataaagccagaagaccacaggcttttgatgaacttcttaggttatttggtccagtgtcttatttgcgtaggtgagaaaattgaatttagtaatctcttgagttttgtacagcggtagtctgaggatgggatcattaaccccagtgaattgcctgtaacgaattttgcagccctgtgttttggaatggggggaacctctttttctcagacgtttgcacctgccttgtatctcgtcacaggcagatccgtcacactggaaagcagaaattgtttggcccaaagaaagtttgtattctgaaaactgaagcactagctatggcaaatgggatgctggtggaagccctttccccagtaggcgttttccagccaactccccgtggttgctagtctgctcaaaacagctgggctcgaatcaggcataagcaagggcctcagccatttccccttcctctgaacttcttttaaaaaaaaaaatacaaaacctcacagagctgcgagagaagccaataagaagtaaggaacgtgcagcaggtggtaccatctgtgcccgactaattccagccaaaacaatctgctccctcgagttcccagttgtggggaagggaagagaatctgacagcggcagagtcaggggagggggtggaggagggcagcgctgagtctattattccggcgatccgcaggtgggaggaggcaggttattgatgccagtgaactattatctctgtcttttgctctttacaaccacggagggagatctctacagcgcgttcttgctaagctggcaactacatcccacacctgagagacagacgtgcaggcttgactgtgagcctgtcaccactgagatgggagggacagcttggcaagcgcagcccaccccaaagtgaaaaagtaaacaagagggcagggagatgatgtttattttattctattttcctagcaaccgaatgccctctgtctccatgttcattctttgaaaattacccacagcttaaactgggcttagtgtccacatgctttcaccccgggatggcattttccgaagcaaactccttgccatcgatggattccttacgaagaacgcatctcccttggcatacttaaaacctggggtgaataaatgcactagttcaaggataaatgaagtcgtctgcttttctttagagaggaacagaaagggactgagacagagcatacacaccgttgtagtgtcccaggaaaatacatcttctgaaaagattctcttaacccacggcaaaaattccaccagtgcgtttaggttaaggcaccatccaaggatcgtactagtatttgttaaaggcatctaaggagggacatttgcgttactgcatttctttccgctagcttacctttgctacagctgggggttgagctctaaaagatgggtgcattcgtccaagagggcgttcagaggcttgaagggagagcagcaagaagcattcatacatgaaaagcagtcaaagtgggagaaatgactggaaaggaaaaagtgcttgatcctaatctcagttagatagaagttcaccttccctcagagtgtctgctgaaatactgtggatacgtgtgagtacaaccttactaggaaacaggtctttgcagatgtagtcaagataagccgaggctactgtagtgcactaatgcaatatgacacacttacacaaggaggctttgacaagacagtggcaga

SEQ ID NO: 1224 - DNA, 3841 bp, Mus musculus
cgccgagtccatgcgaactgccatctgatccgctcttatcaatgaagcagccgatcatggcggatggcccccggtgcaagaggcgcaaacaagccaatcccaggaggaaaaacgtggtgaactatgacaacgtagtggacgcaggctcggagacagatgaagaggacaagcttcacattgctgaagatgatagccttgcaaaccctctggaccaggacaccagcccagctagcatgcccaaccatgagtcctccccacacatgagccaagggctgctaccaagagaggaagaagaggaggagctaagggagagtgttgtggagcacagctggcacagtggcgagattctgcaagcctctgtagccggtccagaagaaatgaaggaagattatgatgcaatggggccagaagccacgatccagaccacaattaacaatggtacagttaagaatgcaaattgcacatcagactttgaggaatactttgccaaaagaaaactggaggaaagagatggccacgcagtgagcatcgaagagtaccttcagcgaagcgacacggccattatttacccagaagcccctgaggagctgtctcgccttggcacgccagaggccaacgggcaagaagaaaatgacctgccacctggaactccagatgcttttgcccaactgctgacctgcccctactgcgaccgcggctacaagcgcttgacatcgctgaaggagcacatcaagtaccgccacgagaagaatgaagagaacttttcctgccctctttgtagctacacgttcgcctaccgcacccagctcgagaggcatatggtgacgcacaagccagggacagatcagcaccaaatgctaacccaaggagcaggtaaccgcaagttcaagtgcacggagtgtggcaaggccttcaagtacaagcaccacctgaaagaacacctgagaattcacagtggtgaaaaaccttacgaatgcccaaactgcaagaaacgcttctctcattctgggtcctacagttcacatatcagcagcaagaaatgtattggtttaatatcagtaaatggccgaatgagaaacaatatcaagacgggttcttcccctaattctgtttcttcttctcctactaactcagccattactcagttaaggaacaagttggaaaatggaaaaccacttagcatgtctgagcagacaggcttacttaagattaaaacagaaccactagacttcaatgactataaagttcttatggcaacacatgggtttagtggcagcagtccctttatgaacggtgggcttggagccaccagccctttaggtgtacacccatctgctcagagtccaatgcagcacttaggtgtagggatggaagcccctttacttggatttcccactatgaatagtaacttgagtgaggtacaaaaggttctacagattgtggacaatacggtttctaggcaaaagatggactgcaagacggaagacatttcaaagttgaaaggttatcacatgaaggatccatgttctcagccagaagaacaaggggtaacttctcccaatattccccctgtcggtcttccagtagtgagtcataacggtgccactaaaagtattattgactataccttagagaaagtcaatgaagccaaagcttgcctccagagcttgaccaccgactcaaggagacagatcagtaacataaagaaagagaagttgcgtactttgatagatttggtcactgatgataaaatgattgagaaccacagcatatccactccattttcatgccagttctgtaaagaaagcttcccgggccctattcccctgcatcagcatgaacgatacctgtgtaagatgaatgaagagatcaaggcagtcctgcaacctcatgaaaacatagtccccaacaaagctggagtttttgttgataataaagccctcctcttgtcatctgtactttccgagaaaggactgacaagccccatcaacccatacaaggaccacatgtctgtactgaaagcatactatgctatgaacatggagcccaactctgatgaactgctgaaaatctccattgctgtgggccttcctcaggaatttgtgaaggaatggtttgagcaaagaaaagtctaccagtattcgaattccaggtcaccatcactggaaaggacctccaagccgttagctcccaacagtaaccccaccacaaaagactctttgttacccaggtctcctgtaaaacctatggactccatcacatcgccatctatagcagaactccacaacagtgttacgagttgtgatcctcctctcaggctaacaaaatcttcccatttcaccaatattaaagcagttgataaactggaccactcgaggagtaatactccttctcctttaaatctttcctccacatcttctaaaaactcccacagtagctcgtacactccaaatagcttctcttccgaggagctgcaggctgagccgttggacctgtcattaccaaaacaaatgagagaacccaaaggtattatagccacaaagaacaaaacaaaagctactagcataaacttagaccacaacagtgtttcttcatcgtctgagaattcagatgagcctctgaatttgacttttatcaagaaagagttttcaaattctaataacctggacaataaaagcaacaaccctgtgttcggcatgaacccatttagtgccaagcctttatacacccctcttccaccacagagcgcatttccccctgccactttcatgccaccagtccagaccagcatccccgggctacgaccatacccaggactggatcagatgagcttcctaccgcatatggcctatacctacccaacgggagcagctacctttgctgatatgcagcaaaggaggaaataccagaggaaacaaggatttcagggagacttgctggatggagcacaagactacatgtcaggcctagatgacatgacagactccgattcctgtctgtctcgaaagaagataaagaagacagaaagtggcatgtatgcatgtgacttatgtgacaagacattccagaaaagcagttcccttctgcgacataaatacgaacacacaggaaagagaccacaccagtgtcagatttgtaagaaagcgttcaaacacaaacaccaccttatcgagcactcgaggctgcactcgggcgagaagccctatcagtgtgacaaatgtggcaagcgcttctcacactcgggctcctactcgcagcacatgaatcacaggtactcctactgcaagcgggaggcggaggagcgggaagcagccgagcgcgaggcgcgagagaaagggcacttgggacccaccgagctgctgatgaaccgggcttacctgcagagcatcacccctcaggggtactctgactcggaggagagggagagcatgccgagggatggcgagagcgagaaggagcacgagaaggagggcgaggagggttatgggaagctgcggagaagggacggcgacgaggaggaagaggaggaagaggaagaaagtgaaaataaaagtatggatacggatcccgaaacgatacgggatgaggaagagactggggatcactcgatggacgacagttcagaggatgggaaaatggaaaccaaatcagaccacgaggaagacaatatggaagatggcatgggataaactactgcattttaagcttcctattttttttttccagtagtattgttacctgcttgaaaacactgctgtgttaagctgttcatgcacgtgcctgacgcttccaggaagctgtagagagggacaaaaaggggcacttcagccaagtctgagtt

SEQ ID NO: 1225 - DNA, 3648 bp, Mus musculus
atgaagcagccgatcatggcggatggcccccggtgcaagaggcgcaaacaagccaatcccaggaggaaaaacgtggtgaactatgacaacgtagtggacgcaggctcggagacagatgaagaggacaagcttcacattgctgaagatgatagccttgcaaaccctctggaccaggacaccagcccagctagcatgcccaaccatgagtcctccccacacatgagccaagggctgctaccaagagaggaagaagaggaggagctaagggagagtgttgtggagcacagctggcacagtggcgagattctgcaagcctctgtagccggtccagaagaaatgaaggaagattatgatgcaatggggccagaagccacgatccagaccacaattaacaatggtacagttaagaatgcaaattgcacatcagactttgaggaatactttgccaaaagaaaactggaggaaagagatggccacgcagtgagcatcgaagagtaccttcagcgaagcgacacggccattatttacccagaagcccctgaggagctgtctcgccttggcacgccagaggccaacgggcaagaagaaaatgacctgccacctggaactccagatgcttttgcccaactgctgacctgcccctactgcgaccgcggctacaagcgcttgacatcgctgaaggagcacatcaagtaccgccacgagaagaatgaagagaacttttcctgccctctttgtagctacacgttcgcctaccgcacccagctcgagaggcatatggtgacgcacaagccagggacagatcagcaccaaatgctaacccaaggagcaggtaaccgcaagttcaagtgcacggagtgtggcaaggccttcaagtacaagcaccacctgaaagaacacctgagaattcacagtggtgaaaaaccttacgaatgcccaaactgcaagaaacgcttctctcattctgggtcctacagttcacatatcagcagcaagaaatgtattggtttaatatcagtaaatggccgaatgagaaacaatatcaagacgggttcttcccctaattctgtttcttcttctcctactaactcagccattactcagttaaggaacaagttggaaaatggaaaaccacttagcatgtctgagcagacaggcttacttaagattaaaacagaaccactagacttcaatgactataaagttcttatggcaacacatgggtttagtggcagcagtccctttatgaacggtgggcttggagccaccagccctttaggtgtacacccatctgctcagagtccaatgcagcacttaggtgtagggatggaagcccctttacttggatttcccactatgaatagtaacttgagtgaggtacaaaaggttctacagattgtggacaatacggtttctaggcaaaagatggactgcaagacggaagacatttcaaagttgaaaggttatcacatgaaggatccatgttctcagccagaagaacaaggggtaacttctcccaatattccccctgtcggtcttccagtagtgagtcataacggtgccactaaaagtattattgactataccttagagaaagtcaatgaagccaaagcttgcctccagagcttgaccaccgactcaaggagacagatcagtaacataaagaaagagaagttgcgtactttgatagatttggtcactgatgataaaatgattgagaaccacagcatatccactccattttcatgccagttctgtaaagaaagcttcccgggccctattcccctgcatcagcatgaacgatacctgtgtaagatgaatgaagagatcaaggcagtcctgcaacctcatgaaaacatagtccccaacaaagctggagtttttgttgataataaagccctcctcttgtcatctgtactttccgagaaaggactgacaagccccatcaacccatacaaggaccacatgtctgtactgaaagcatactatgctatgaacatggagcccaactctgatgaactgctgaaaatctccattgctgtgggccttcctcaggaatttgtgaaggaatggtttgagcaaagaaaagtctaccagtattcgaattccaggtcaccatcactggaaaggacctccaagccgttagctcccaacagtaaccccaccacaaaagactctttgttacccaggtctcctgtaaaacctatggactccatcacatcgccatctatagcagaactccacaacagtgttacgagttgtgatcctcctctcaggctaacaaaatcttcccatttcaccaatattaaagcagttgataaactggaccactcgaggagtaatactccttctcctttaaatctttcctccacatcttctaaaaactcccacagtagctcgtacactccaaatagcttctcttccgaggagctgcaggctgagccgttggacctgtcattaccaaaacaaatgagagaacccaaaggtattatagccacaaagaacaaaacaaaagctactagcataaacttagaccacaacagtgtttcttcatcgtctgagaattcagatgagcctctgaatttgacttttatcaagaaagagttttcaaattctaataacctggacaataaaagcaacaaccctgtgttcggcatgaacccatttagtgccaagcctttatacacccctcttccaccacagagcgcatttccccctgccactttcatgccaccagtccagaccagcatccccgggctacgaccatacccaggactggatcagatgagcttcctaccgcatatggcctatacctacccaacgggagcagctacctttgctgatatgcagcaaaggaggaaataccagaggaaacaaggatttcagggagacttgctggatggagcacaagactacatgtcaggcctagatgacatgacagactccgattcctgtctgtctcgaaagaagataaagaagacagaaagtggcatgtatgcatgtgacttatgtgacaagacattccagaaaagcagttcccttctgcgacataaatacgaacacacaggaaagagaccacaccagtgtcagatttgtaagaaagcgttcaaacacaaacaccaccttatcgagcactcgaggctgcactcgggcgagaagccctatcagtgtgacaaatgtggcaagcgcttctcacactcgggctcctactcgcagcacatgaatcacaggtactcctactgcaagcgggaggcggaggagcgggaagcagccgagcgcgaggcgcgagagaaagggcacttgggacccaccgagctgctgatgaaccgggcttacctgcagagcatcacccctcaggggtactctgactcggaggagagggagagcatgccgagggatggcgagagcgagaaggagcacgagaaggagggcgaggagggttatgggaagctgcggagaagggacggcgacgaggaggaagaggaggaagaggaagaaagtgaaaataaaagtatggatacggatcccgaaacgatacgggatgaggaagagactggggatcactcgatggacgacagttcagaggatgggaaaatggaaaccaaatcagaccacgaggaagacaatatggaagatggcatgggataa

SEQ ID NO: 1226 - DNA, 96589 bp, Homo sapiens
  misc_feature (9857)..(9876): "n" at positions 9857 thru9876 can be any base
ctgctgacacaaccctactcccaaatttgcaggcaggagagtgaagcaatgtctgtactctatacatagtcttacttttttcttttcttttttaaagtagctgtttcagcattcaactgggggcaagaggggttggggggtggaaaaagatagtgcaggcaaactttctcagtgctattccatccctctatgtctccccactccttcacacctctgaagttatggcaagactaggtaaagagttttgaacaatattgagaccctcttatatttaccttgaacaaataggatctttgacacttcttgaccacactcagctgcctgcaagagtgcttcctcctatagcaagtcatatcgggagaattcgctgaagaaaggttttttccttacaattgcaaatgaaagtataaaatagatcaccaaattttaaagtgtgcatatgtcctcatctcagctgttgacatcatatttataatcatgagcacgccaggtttcctacaacttaagaaattctatgaccatattacttttccaactttatcagtaaacattgatttctgtataatgcagaaaccagttaaataatttctggccgggtgcagtggctcatgcctgtaatcccagcactttgggaggccgaggtgggtggatcacctgaggtcaggaattcgagaccggcctggccaacatggtgaaactccgtctctactaaaaatacaaaaaattagctgggtgtggtggcaggtgcctgtaatcccagctactcgggaggctgaggcaggagaatcacttgaacctgggaggcggagctggcagtgagccaagactgtgccactgcactccagcctgggtgacagagcgagactccgtctcaaaaaaaataaataaaaaataaaaataaaataaaataaacaacacctaaaagacatgttacatccactctggttttccataatttaacttcatgtatttttcaggtaattcatgatagtaggaattactatttattgatacacctgctctgtgccagacattttgtatacagtcatattttctttaccacaaccagcttgaatctaagtactcctttaccaattttttttttttttttttttttttttgagacagggtctcgctctgttgcccgggctggagtgcatggagtgcagtggcaccatctcggctcactgcaacctctgcctcctgggttcaagcaattctcttcctcagcctcccgagtagctaggattataggcatgcaccaccacgccgggctggctgatttttgtatttttagtagagatggggtttcaccatgctggccaggatggtcttgaactctcgacctggtgatccaccctcctcggtcttccaaagtgctgggattacaggcgtgagccactgcacccagctcctttgcctactttaaaaataaggttcacatgggtaaaataacttgtcctcaatacacaattagtatttaccaagcagggagccacatccagtttatctaattccaaaacctgtatctttgtcactataatatgctaacattgaggatctagtgtcaaatatactaatgtccagtttccagtcaacaagtgctaacagaagttgtataagaaataaaaactattccacgacatctctggaccatgatgtctccttcatcactaacttgtcctgtgcctgggcccaatgttggagccagttgagctagcaagaacctcccatgggagcttttcctaagtcgggtgcctgggagaagagactggaccagaaaatacactttatctgggaagccagaggcaccaaagccagagaaactttggctcaaggacttgagccaatattgtaactggaaaaatgagcctaagtgttaggtccaaaaggcaaaataagccatacgtggaaaaacaagggccaatcacagcatccaggaggcctggaaatgggtcacaatgtgcagagcgggtgggcacaagtgggtcagaaacacatctgggaaaggtaaaaagatgttggatgtcacatgaatatggtgttggccctgggggtggacgtggcagattcaaaagcacaccaagaaccagatgcttgaattgtggggagtcactgactctccctaagccacaattttctcagctaataaaatggacccagttgtaaccccttcagatctgctatcagaattaaatgatacgtgaaaggatttagcatagtgccaagcctagaaaagcaggggttttttttccttagctattattactttatatttgtgattgccatggagatgataataaattttgagagtaaagtttttacatttaagtacctgaaagaaccctgaaaaaaaaaattcacccttagaatggtacaaaattaaaactgagtacagaacaaagtttatagtttgagccttttaacagaataaagagtattaaagaagaccttgaagcaagcatgaagtaatttccaggtcactagacaatttgcaggtgcaaaccatttctagtcccattgtcagagggagaaaaaaggtacaggtcacacccagtcccctacgctgatgtccaaatgtctggtttggtagttttgacctaaaaggagcatggaatggatgctttcaaaatagaaacaattaacagaccctttaagaactacagatataagtgttttgagaagtcttaaagaaaacaagaacaaccaaaaactatcagtgttagtattacatcacgatagtttttccccctggcatttgcattgatttttcagttttacatcaaaaagaaaatctggccttgtggacatttaagagactagggaatttcattttccacttaatacactgattttcttcaccactctaggtacttgaaattagcgcaaaccccaggacagctacaattccaaaagggaatgctcagttcattatgaatggtcttaaagcaaacagtgctctgacagccaaattcctggtcttcaaatttgtaagtttgccctttttttcacaagtcttactcaagaccgcttctgagcttttgcacatttaacccttacactaaaagacaatatgttactaaagagcatgggaaacttcaagttcatacatttggactaaattccttttcaaaagaagtctaatatttataaccaaattatgaccatattgaatacactaaattaactgctgaactaacagaaaggaaatactgtatttattttcacttctgtggctacgcatcctttgaacagttcgaaaaaatcataaaccagccataaatcctaaaatgcttttcattttctttcttcacgtaataacacagcactgatttttcaataaaaaatatactgtaaatagttgttatttttaataatcaaaattaatttgtaccatctttagttgatctgtatatttgtttaacctttcattataataataaagctacaatatagtgaagttttatgcattacttcatttaattctcaataaaatcccaagggatagcattattagtgtacccacattggagattaaaaataaaacaagcttataggagactgcttataatcacacaggtagtcatttgcagggctagtattcaaaatagatattaatactttggactttaactggcacaggagaataaaaatatcagggatacacttacttaatcatttttaataatttaaatcagcccatatgttagtaagtaaaagataaaaaatgatcctaaataccaggcctgagttatttgtcaattgctgcaattttccacttttagacttgaattaatagacataactaaaaatttaaatgacaaaattccaataagaaaacatagtgcataattagtgcacatctctggatttggggaggagagtgacttgattttacatagagtattgtttttcctaattaattgtagtgtgccacatatttgtatgtgaatgcctcataaatggtttacaaattgttaagaagtttatggatatctagaaagaatattacagctcaataaataaacttttacaagtgtagaagagaaattttgcattaaaatgtgactttgtttcttcatcctgagagaatgaatttttaaaaaacacatttaaaatcaagcattagatatgcaaatatgtgttcagatcagagatactaaaattattcaaatgattaattattcatcataaaatgtcaattaataattatgaagcagaaaaggcatctttctaatacatctttatttttcttggcctaaaaagggctaaatatacatgttcaattgacttctatcaagtttttaaaattcaacaaagtaaacaaattgtaaacaagtgaaaactctgaattttaatgagaacaacaaatatgcccaaagtgaagggaagagcaaaaaataataataaagaaaacaaaacaaaaacagttatgttcatgacatatgccgcctcatgctcactcacctgctaggtaacggacagtaacctagcctagtcaagaaaataacccaacaacccaagttgtgaatttgcttagtaatgtgcaaactacgtgacatgatgatgtttctctctgaattgatcaatctttgttggggttcaggaggagtgctttgggaattttttaccctttgcaaatagtcatcagaagaaaagcgcagtttaagtttcataaaattacctattgtaatgtctaaagtctgttaacaaattaagtactactaaaatatggctgtaaacaaactttttcacattgccttaattctaaagaatgcccctatgccaagcattatgcattttttccaggaagactatatctattatatcttgtcttttaaaattatcagtctgagctgatgtgataatatagaagaataaaccattatggtcactgaaatattgatttattttatttttattattattattttacttttcactgacacctggtgaacttgtcgtctctgagacccggggagttattttagtcagggtgtccctgccctcctgctggtagattaattacacattaaacgttctgttttcaaaacgaaatgataaatctggacacataaaagaggcacaaaaagaatcacagcgagggagaagagtggatgttaagaaagaaaacaagaaattgcaaaagggagatatcagatagaaaggagaacgtaggaaatgcaactgggaaagaatttcaagaaaataaggataaagggcagggagggctgaaaggagggccagagggaggaaaagcaggagggagatttttggttttcaattccctggtgaggctgctggcgtccgcgccctcaacgccccagccttccaagttgaggcgaaagccacctcctcgggcctgcgtcgcatccaacttactccaagttttctggtgactcctacagggcccctttccgtccccccccccgctccccgccccccaagccttagtgagattgacagtcgcgtggaggaggcttttccaggcacagcctttctcatggtaatcagcccccggcatcacctcccggccgcggctgcgcccgctcggagcgcggctcgcggaccccggggaccggaaacagggcggcgggcggggagcaggcgagcgagccaggtcagctgaccgggcggcgggcgggggtcgcaggatcccgggcggggacaggtctgggggagggcggtctggtgggagggggccgaacaccgcccccccccgcgacgcgctcctccgcctgtgcagcggggcccttcctggagatcaaatgcagggaccgaagctggcggcgggggttggggcggggtgtgtgggggggggagtggcagagcgcgcggaaaattggggacaacaaccagacctgtttagcatcaataaattaagatgctcatttgggtcctgaagtttgctggttcctgtcagtagagacgttggcaaaagccctgaagccgagattcagcctttacttcaaaaaaataaaataaaatcaacccctcagctggccgccctgctggggccaggtgacgtgcgagattccacagcctgcgggtctcgcagcagggatgttagggacggtctgagcttctctggtcctgttttggttttgtttgaaagggcttctcagagagatgctcctgatttttttttttttaatagactttcccctcctatcctaggctcaactccgaatggattggattgcgagtctgcacgtgagaaaaccgtttggcttggcttggacccctgccgccccccacctcctccacacacacccagtccaggggtcccctttatcaccctttgcttgcaactccaaaagaagttgcccacctcctgagtcacaacacaaggtcgaataattcctctagatgaaagatcagtttcatttcaaaacgagaataggttcctttttttattttctccacatggtacaaaataaacagaatttgctttaaaaaaaatcattagctgtggccaaattcgaattccttctacagcctgtgtgttcaagggcagaaacattgtatctcttcgggcatctgggccgccaagctgagcggggggaggggggagcggctgtgaaagttgaggaaattgacagactgagaggtgaatggggggacaggcaccaggtcctggctggagggaattggaaaacaaaagtgcatccttctcaccctgcctgggtggagggaatcctgagggaggtagtttgttttgcccatggaaaccccaaagaattatttttcccccttcaatgttgattgcaatattatttcacatttccgtgtatctgttgttttaatctctttcgtctgcgctaatctcgaagtggattattaatggggaagacagagaaggagagattcatttgcaggacttattttgctgtgtgaggagccgaaagccagcagcccccagtcctctctcgacttttctctgcgtcctgtgctcctgcatcctcctgatcccacgatccccattgtccccgaactggccctcggactgagggagtgttcggaacaaatttatattccggcttcctcccgaccccatcacctctgccacgttgggaactctctcggccaaatgcctggggaggggcgtgccagtcaggaaccaggggcaaggcaacctagccgcagcgctcacccctcgcggagacccttcccgtgccaccatccaaatatctaccttcatgggaacctggaagactgctttttcaccccaaatcaaatactggctagtcggaactcccagtgataaatgttggggactgcctcctgccacttgagcaattcctgagtccagggtaatcagatgattaggtgtttttaatggaaatacttagggtttttttttttttttttaagtcagatcctaagtaacctgacatttaatatacataataaagacaagcgttttgttagctattcgattggatcctttgacctgaggttatgcttgtgtgtgtgtctggtctgtaagcctccaatggctacctgggtgcctgaagaggagtcttgcctgtaataactctatgcaaagggctccttcttccttaggagtggtggaagggtggctgtaaagcaaacgtctagagaaagctggattccaatcttttaaattaaaaaagaggaaaaaaaggaagaggaagaaaaatggacatgaacagtggtgctaaatctcagaagaggaacttgataagtcacacatatatttagtatagatatataataatgaaagaaatgtaaaatataaaattaagaatgtgcctgacccatgttgaaaatctttgattttatttattaataatttttaagctgaagatcctgaatgcctttcttctatagacactttatctgtgatggggtggggggagagagttaatttatccagcagctattttcattataataaatacttaaattaggaaagaggtgagtaaccaactgtgaaaatctactttcttgcatcctagaacaagatctagctgtggtcgtgctaggtagctattaaccacccccaccccactccccccccccgcaaaaaaaaatacaaaatacaaagacgtatacctctgggagtgtggatgtggcaacccatgtggtggcttgtccctcctttgagtgcaattgccagtgactcttgcattcaaagtcttgctttaggcacacattcaaagcacagttcaaagcagtttatcttaatatagtgttggatcagggtattatttgtttcagatttcatcagactggaaacaggagggtgtaacatatttaacaatattaaagcttaaaaattggtgtgaggcagctctctggtcctcttaacacctccacctttacctttccgaagaatcctaaatgctgtgaggctagaagtttatttgtgctctgaggttctcaagcactttcactctttaggaaaaaaaaaaaagtctcacagttatttaagaaattgagcctgaaccatccgaggataggagatttcttccttttccgataaatgcctgtgctcagcatcctcaaatttggctgtctttatttacttctatattagttccaattatgtgcagtgtaaaccagctttttgattaacaaaacagcagagcattggttaagaacacttaaacttcaaaaaaattcccctgggaagtgggctctgaattggttaataatgtgcagtacttgctaaattgctgacttccagatgtggaaaatatctttcttgtttaggacctatgtaacctgattggattacgacagaagcgtcacgttggaagcttttgagtgattatttaattaaccatacagtagaaagctgtattctccaggaaatcccttccatatttgcataaccaatcccttcagagcaaaggtggagtcttttctttttaatcttactttaattgtaatatcaaaaaatatatactccaaaacttagaccccatgccgtttaatatcatgctctcccttccctgctaagtttctctatggcctttctcgtttctcctcctgcctccctacacactctcccttactttgtagtgaggtctccccgaggtgtagagagattcagagatcggccaaccgagtgttctattttaatttacttagagaccctttattaaaatgccaaactactttttaatattgggatccagtccagaaattcatcatgcacacaccctaatacacatgccctaagatgcagctcccatgcagcatttttttttctggctctggtacctaaaaagaaaaaaataacaataagagaaagggcagagaactttgttccagaagctgtactgagatacctacacaatttgatgtgcatctcaaatctggtcattagagatatctgtataagaagagactatctggattgaggacccgggatctttccctttaactttcgccccttggagttctccagttctgtgaatggtgtgcaccgttttccgccctgtactctgtaggatttagtgatgaggataatgatgccaaaggcttgacgggctgcccattcattagggcatctgattaacatagtaaggaatgtttattttcagtacataaaattgtagaactttgggagcatcgtctgaattgtcagagctgaacagcgaggagcttagtgagacatgagaatatagagaggtagctaatgtgtgggaagctgagctagttgatattctatgagaagttcgtcgtgtccatctcatgctgtaggtgtagggaaagttgttcaggtgctgctcactagtcctttgagatgcaggtgccagtggtctgatctctagttgatgatgagagagcatctactttcacatactgagtgtcttgaagtgatnnnnnnnnnnnnnnnnnnnngaggcgaaggcgaaagggagggagaggaggaagggagggaggtggaatttcatttcttccactaaagcgtttgcggagacttcaaggtataatctatcccagatcctttcccagagagaaacttggcgatcacgttttcacatgatgctcacgctcagggcgcttcaattatccctccccacaaagataggtggcgcgtgtttcagggtctctcgtctctctcctacagaaaagaaaaagaaaaaaatgtcattagaagaggcgtaacacgtcagtccgtccccaggtttgtgtttcctggagtggccgaaagagatcagttctaacctgctctgcaggaataacggtcctgcctcccgacactcttggcgaggtttttgtacagtttgctccgggagctgtttcttcgcttccacctttttctcccccacacttcgcggcttcttcatgctttttcttctcaccatttctggccaaaactacaaacaagacttcgcaggtaggttttttttcctccccttttctctctttttatccctttttggtgtgctcgtcctccatcctccttttctaattttctcattttgagtggggatgtgagtctgaagtgagaaggggtgtccgtgggtaggaatttcaggtgggtttagctcctttatggcaagcttttctcaagagtggcttcttcgctttctcttacactcacactctctctccttgcttttctctcctttttccctcccccaaataatttcccctgtacctgttcattcaggtaaccaaaggtgtcctttgctatccagcccaggaaaagttttattgagaattatatggctggaataaaaactcatcaaggggagaggtcctgctctattttcgcatctagttccaattcattatattcagcaattaggacttggcaaatacctgttaataattacaaaacttggtcagttacagacctacaaattcgggggcaagtctttctcttagacatggcagttcatcctctcccaccgagaaggctgttttctaagcagaaagttgtctgtttttgtctgcttagcgagtttcatttctttatttcattctttgtgtgtgtatgtgtgtgaagtaacacctcacttctgtgattataaataaagaagtgaaagtcctcatggaacttgagtcgtttaccaaagtggaggggggggcactacagctgggaagaaaactgctgtcaggatatcagggttttaaattaggataacttttaaaattgtatttttagtggcaaagtaatatagacatggatttaatagaagacacatacacacatatatcccattccatactttggcactgaaaagtcgagagagagatagcaggagttcccaggaacagtgatgagcccggctaacatgaatgtgtttatctcccacctactgatatattttacatgctccccctgtaatgatgaaggcaagattactaactccagacttaggagtaacaggcaaagataaagtttacagcacaaatgccctgtctctctctctcacacacacacatgcccataaaactagcaacttactttattaaacatgtatttatatgcagtcgtgtgtctcaggatgaatatagacaggccagctgtttcatcccagacacttgtgtgaccatttctttatttcaggatttcccctaacaatttcaaatcaataggacaaggaaagaaatgataaaatatgtcaaacttaaaagtctcctactatgtatgcctaggtaaatttaaggtgctttctaaaatatccacttccccttctctctgcccccctcccttcacccctctcagcaaatgtgtggaaactgatactcactttccaggttttctgcaaagcttctagcacaggagacaataggtgtggggcgtggggactgagtgtgcccggcagagaaagggttaatggcccttgtgttacagtttgcatctgttacatcttttatagccccctgtttaaactaatcctcgaggcacagcatcttcccaacctccaccgagttttcaggattctcctcctctcctgcctgcctccgaggtcccccttctccaagttttgacagtttcaactgaaaaaatgcagcgcctctctcgatttttaggtacaaaagtttcgaagccagaaaggatacgatcatttagtagagcttaaaagtattgccgtagtggttggactttctctttcctttcttaagggaaaaaaaaaattctactggaactatttaagggaaccagtgtgggggagcatgtgtgtgagtgaggtggggggaaatacttaagtaaatattgtcaaagtggcgagggggggtggggtaaaggacagtgtccaaagaggcttataattatatttatcattgcggcgtaaaacgggaaatcttaatttgggggcgagggtggggggaggaagagacagtgcctcgataaactccaaaaggggaggggagggggcgctgggcgagtgggcttcctataattactattatcaatttgcccgagtgtgcttcatccaggggctgtttcgcgttgtttgtttgtttgtttcctctgggaattggggggtggggggatgagaaaagatgagaacgaaaagaaaacctcgcctcaccccaagttcccgagccgggggctgaggacttttcgaaggaaagggtccgcctagccctgagtcaagcggtcttactgtaccgccgtgtgcattccctcatacggtcaggagttatgactcattttgaagatgtaattcttgtctctctgatcccctcgcgggtgcaacacaccaaacagtaacaaacacaaagcgcctcggggccaaggctgggggtggggggcgggaagagcggcggccgaagtttcgctttggggttggggggcgcggagaggtgctcgccggggcggtggcgtgggccctgggcggcccgcgcgcgtttcaatgggcgcgcgatgcccacattgtcgctgtgtttggttgctagatcgagcctgcgtgctgccgaagcagggcgccgagtccatgcgaactgccatctgatccgctcttatcaatgaagcagccgatcatggcggatggcccccggtgcaagaggcgcaaacaagccaatcccaggaggaaaaacggtaagaagcagcccgaaccaaacttttccgggccactacgcggctcgagacccagggagaaggagggggaaagggaaaaggaaccgaggcggcggcggcggcggcgcccagggctctagggcgagcctccctccgcggccggcgccggagcccggcgcgcgcggcggctggaccggggggtgttggggaagtgccgggcaaagtgagcgtcaggcacccgggggtccgagcgcgggggtccggccggggccccgcgcccccagccccgctgcccccctcgagcccctgcctccgccctccctccgcctccgcctcccgctccgctcgcgcccggcccgccgggtctccggccgggcttcgggagcgtccgcctggggcagggcgggggcccaggcgctggatcgcgcaggatcccggggcgggggcgggggtggcagagagactgcgaaggcaggagaggggaaccgggtctgcgcctcagcgaggcttaaagtttcttgccggagtcgcccggccgcttctcggtgcgccaagtaacggtccgcgggcagcggggcccggcccatcgcgcccagaccccggggtgggagggagtcggccggccccgcgcggggtccggtggggtcgatgatggctcggggacggatgactcctctccagcaggctctggcccccaggccggggactgaaggagtcgcagggcgcagcgagacttttcccggcagtttctacatggtctggaggagcccgttatccaggctgagtcaggaaggaggaaggagaaaggagatgggggttcgaggggcacacgcagatcagaggtgggatattaaagggggggggtgagagtttggtaggtccgttttggagacagccagagaagggacgcggggggacagagagaaacagagagagaggaagagagtgagagagagaccccctaggtattaccccaaacaaaatcgtgggaataaaagagaaaagtgattggcaagagcgcggaaggcgcctgggggaggggagagggctggggactagcgagggtgccgggggggggtgggggagctgacggaggataactgagtttaaaaagaaagaaaccaacccccgaaaacaaacaagcgaacgagcgccagcccagactcggaaaggaaacttctcgctcccctcgctctcagcccgatcacccggcgcggggccgcgtagacgctcccgaggcaggcgctgggacgcagcgcccacccggcctcccggcctccgcagccccagcccgcgcctcgcggggaccgcccgggcccacttggagcaactttcctctagagaagacaattgtgcgcgcccccggcctgccccagagctgcgcggcgcggggagggggcggctgggggcgcagtgtgaggtgctggaaggagcaaaacacaaagacgagagaattttgattagagacaaatgatgcttttctctctctctctctctctctctctaggttttgtgtgtgtgtacgcgtgtgtgtgcgtgtgtgtgtcttttgcttgttgtggtggaggtgtcgagccatatgggggagtgatagaggaattttagtcagaaactgttcgttacgttatcctgcctttcccctttgtgctgtctttgatctatttgcttggcttagtattacagaaaaacaagtacaataatatattccgagctgcttccccaagattcagttcaggctgcttctttttaagtctctccctctctctttctccctctctctctctcttaatttaatttttttttcactctggtgtctggcattatttaaggtggtccttacacaggagacctccccttccccatctctgagtaatttagtagacactaaaattacacctaatgtccccctctcctctcttgtgtttcctctgttccttttattaaatgttggttattgattttctaaaatcaatgtctgttgtggggcttttttccccctcttacaagtatctaaagcacgttgctgatcaactggataacaaaagctttgtgtcaaggaggcttttttccctcttctgttaaacagtcattttttttttttgagagaaaaagagaatgagatttaaaacaaggctcccagaagtgttcttttgcagggaagactatttaaagtgtgcatttcttcttgccttcctccttccacctccttcgggattttgccaccgttgaccagcctggccctagcagtgaggtcaggccagagcccaggtctaaggaaatagagggatcctggcttcctgggaacccctaggagacctggcagagagggaggcccgttgggcgcttcgcaggtggaatggagtgccagagatgtccgcagtcatggacactgcaagtatttcccctccacccagccactaacttgggagaagcctccacattcagaagtggaaagttgaattgcacattttaaggcatttagcccagatcctgcacacttaatatcaagcctgtccattgcttacagcttctctaactttgactgttacctgtctttttttccaaataagctgtgggaaaacatgctgtatactggttattgtaagtgtttttcactgggtttaatctgaccgagcaatgttctggttttgagaagcaggtagaagagtactaccaccccacccctttttcattttctttctcatcaaacacatatccaatgcctttccctttgggaattgctaggatttatctgaactgagtggatttttcttctttcctggattcatggaaaagatgtcacttttgagcttgtgtctttgctgataacactaaatatgatgatgcttatcaaaatcatatagaaattcctggaaagaaataatggcaataataatcgtataagtagaagctggaagggaaaaaaagatggtcatccaggaacctagaatggcactttatataattttaatgaagtcaacagtgtatatatagactaaggcgacaaggagataaaacgtgtaaagcagtgtgtgtgttttaaaggctggtcaagaacgtgagttagaagacaatgctatgtacatttaataaaaagcaaaggagaaggaggcagttgaagaaaaataaatgtacaaagagagaaacaagtatctgaaatacaaccttccagattctcaggctagcaagatgcctggcagaggcagtgccagggccaagttaacccatagcgggcagtcagtctcctttcccccacatggaaaggatgaaatctcttcccagaaaataagatgtgcaggaggaaagagggagtggggtgagggggaaggaggcaaaaagcgagttgcccgcagacaagaatgtgtgtcggtttcaagaaagttcagtcagatgatcctcagtcgcctgactcactttgtaacactttcactgacgctggagaggagggggaaaacccagcccccctttttctttcccctgattataccccactatctccacacagccttggagtcagaaatgagcactcggagcgggagatgccctgctgctgcttgccaccggtgcggcccgtttgtaacttgcaaagtttgttgcttttgcccctgattcgggcagcgggtcctgggatgctcctgcttccctcctgcctcccacggagcccgggaagagggtctgcctccccatcccgccaccttccagcatcagcctctgaaaaatctcacagagacatgcacgttgtagcaaaaatcaaatccggaaactgcttgtttcagagaaagaaatgaagttgtcttttaaagaaaaactgaattaggaggagagaaaagggaaataggagaagaaaggaaaagttaaatttgatttttctccagagtttccactaaagggttggggacagtgtgaaggagaaggggagctttttacaaatgcctttggtctctgaacttcagtggcaaagaacagggatcaagttgaatgttctcagggctttggatcctagaggagaaacaatcagaagagcagaaatggttatccctgtttaaaataagccctcactctttaccacttccttaaaggagtggaggtgctggtagtgatggttagaggcaatgagggacggagaagttgctcccgtttcagagatgcttaaatgaaaaggaaagaaaatgcagtcaaccccttctccaggaggtgcctcctagctctcctccctgagaggtgaagttgggatggggcaacgagagtcatacacacttagacaaggaagtttccttcggatcactgtcagtccagacttggttatctttgcaaagtgtggaaatctttggcaagtagctttcttcgtaaagttgatgagcttctagggagcctgttttgctgactttcaaagcactggggcaggttgtgtggcaggtaccagttctgagggcgctccaaagatatccatctccatccttttttctctgtggagatcttctgcaagttttgtcacgctgcacacacacaaggctgggggctatgtatctaggctgatctatttgttttattttggtctggaaaaactaagccaattggggtagaaacatgctttccttcgtagcagagccagtaggctgctggtgtccatagagtgacagtccaccaggactaagggtgggctgaggattttaaactttacattgtttctctgttaccagatacaaataaattcacgtcttccaccatttgttttcaaatagggtaaaaccaagattaaagttccctgctcaactgctatgtcataggtttcagtgtttcccttccttcttaatttgcttaaagaaaattccaagaggttattaaagaccttgatgccatattaagaatatttcctgggaaaaatgtatgtctaccctgaaggtaggaaaggagggcgttgctagcctctagcagtgccgcgtttattctaagatgtgggagattcttttccttgcaacagtttttgtcatctgcattcttccaaggcttttaaggtgcattttcttctgtgtgaaaggaaattctttgtccttttcctctcagcaccgtggcttcccaaggtagacactattttgtgcctgtcacagagagagggagtgcaggtttgcaatgctcacagacaattgattgtctgccctaatgtgtttcatttacatgtttataacgtcaatggtgctggggtgtccactgtaccattcattcccgcattcccacaagggggcaattgtctgaatggccaagtcagacacctttttgattgctctttggttgtcttttcagagcaaagagataaaggaggaaaatctgtgatgcagaaacactagttgaaaatatacagaattaaatgtcaccacaaaagcagatgttaacataagcccaaatatgctttttagccaagatgtgaaggttgaaaaaaataattcagagcagagggaaggatgatttaaaccaataaatatagccctattccccctctttacttcttttctgtctttagcaatcagaagatgaaatgtaattttccttttcatttttaagccttgaaacatccaggcacctcctcattatttgtatgtttgctgtgatttgtgaattttgtatatatttacatagctctgtttatgccaacagcatcagcttaccacttggaaaatctattgaatgactatttgggctgtggggagggtaaacttttaaaaagtaagatccaagtatttcttcatcaagcagtttttaaaaggaaaacgataataatcagtaggctccatggaagcctttgccttaatagctatgtgccaaatacttttatcttgtgtgacagtcatgtcagagtgaaatctctcaggaaaagtgtaactagtagttacaaagtaaataaaggatttcattttaaggtgttctgtagtgtttttatgctgtgtatgtgcatgtgtgtgttttgtcttgtgtttcctctgaggaggtaagaagaaaagccatccatgcgtgtatcttttggcttttctcttctttccgttctctcctacatattatgcatatatgtagcccacatgaatacacctgtttaaaagaaaatcacagttcagatggtgccttgctggttcatttaggaaacaacagttattagaagttggtctgatttcgcgtgtggtccatgaagacagaaaataccaactcttgtgtcatctggtgggaggcaaatgggggaaaaacttttataattttgtagtaaattagagaggggaaaaaaactgccagtctgtgaaaagatttttgcctctccgggaagacacacacacacccagtagctgcaccgttagctgaacccctgacacggcggtcttttgaatgccttaggtatgatttcactttcgctcacatcaatgctgacctgaatgcctttcatatctgatccgctgtgtctctcccagtaaacatcccctgaggggagaacaaagaaaggagctcttcttcttcttaatcacaattcagccctttcaccgccggcaggctccatttgcattctgccacagaaagccaagatgaaaagaaagagagagagaaagagagagagagagagagagagagagaggcacagggtagtagctgagtaaaataacttaggtgtttgtggctgtttgttgggcttcccctagttaccagccttatatagctgatgctccaccaggccctgtccctcctgacaggcatatagtgttacaagatggcatgtctgtactattcatggccacccgctcaacacttgaggtaaaaagtgtcaggaggggatcgaattctcccccagaagcctgttagatttggggtcaggtgtgtggacttcccgcccttaagtgctgcctacgatttggctttaataagtctgattgtttaccagcggaccagagaggtgagggccctgggggtgggagggacgggcgagctggagactgggcccctggtctggtttcagtgacgggtcctcacacccagcctgaacacactgataaatcctcaggaaaactggaaaagactttcccatttttccccctgactttttatgataattcatattttcaaatgaaaggggaaaaaagccaagaagaaactctcaaatgagccaaaaaggaaaaaaaaaattctctgaaaagaattttagggggaaaagttgtgctattttaaaaagctttgagggctgtaaagtgccacgtttttcacaccttctccatacttttttttcagatttttttagtatgtttaacatttgtgagatgacagcctttttgtatctcaaactggatgcttcaggatttgtaggggaggggttggtggtattcacgttctcttgtgagagaaagtttgtgcctaaaggcctccttcctgggaactgtttaaaccctcgcaggcagacctgtcaggttttactgtgttatttgccaccattttcaacatgcaaaagtaacatgcagttaatggtattggaatgagaccacagcaagagcagaaacctctcgtgacaacttttcagcgacattatcttgctcctagactgtcttgtctttttcttcccctttctgaaaccacttttgagataccaataattttctcccaacaattagattaaggatacaatgcgctcacacacatgcaccacacacacacacattcacacacacaaacacacacacaaactttggaagtgcaatctcttccaacagcagagtgaatgatttgaaacgggggcttttccaataacccttgtggaagatttcacttataagagcaaaactaacggatatattagaagttgtgcgaacatgtgacacagattcctgatttttttttctttttcccagaagatttacagaatttacaaaaagagattatccctacaccttccacccctcctatccacccccatgacccaagcaatgaaggatttaggcagatttacttcagtaaacacctttggacacttgcggggaaagtgggagtctgtttgcaaaaggaggcttttgttaagtgaggtacggggataatgctttaccaggcagctgtgatattaacctacccagcaatgcgggaacactctttaactctttgagtgcctggccccttgcgctcagcagataaaatcctggctctccaaagacactcagaattctggctctagcagtttattattcagacaagtcttataggcatgaaaactgttcaagcttttaaaacaatgtggtttaattagatgaggtggacttacattgctcataagccctccaaatggtggtttataattggcaagggaaaaaaaaaagatagaaaaaaggaatcaaggcagcacattaaaaattccaggaaatatctttagaaaagctattttcatttctagcttttaaaatattagactacggtagctagagggaatgaagcagctggggcctctctccttcctataaaagacaccagaagtttgtgatgaagaaaggggcttcaacttgaaaagctatgagaggccagttcggacagtgatatgatctcagccttcgcatcttttcaagggggaagtactgcctatctgtccaaacctgggaggtcatgtgaacctcagagtcagggcctcaggctggccgttaccaacttgagactttccaaagcaagcagagaggcatttatgaggaaggagttaatggttattttttgctgggcacaagaataactttacaggtgttgcatttgggcttaaataagattgccttatttagtttcgaaaaagagtgtaggtgtcaacattcgagcagccacaaatgtgtgagaaagtaaagggtatgagacatgacggaattaaaggtgtttgctatgttgttacaccgtgtgtcaggctgcaagctccctttgtcacagcctcctggtgatttgacagcgcagatctacttcccttctaggtgagacagcatttttaaacttgagttataaatatggtacacccttcgagttgcaccctgcctcccagatccgtgaatcctatttgaaagcatcttgccctgagacacaatgaacaaacgcccgtatacaaggaggctgtgggctcgggggcccgggcagcgccagcatcacagtagctggcattgactgttgtttggcaagaaggtcctctgccaaatcatccaataattaagttttatgttatttgtatgaacgaccaagcatgcagtattccttttcaaatcaaagggaggcttaaaattactttttgaacactttcagaccatggtcaggtcacagtttgggggctgaattaaaatgatctcattcatgatctaattgaggttggcaaaaccttagcagtagcaggagtacataaatataaatcaaagaccaaaatttagcaaatcatatcatttgctagaaatctgctcatgaattattctccgattgccaacccagaagttaaactttgtctcccctcagcaacagtaactgcgcatattttttcaggcttctgacaggaaagttagaggatctgaaaagagaaaggagaaggaagatgatcactgtgtcatcagatatggtacatttgtgacccaagaaactatgagagctgataaagccatgtacgtttacagtggctgctgcagccttggttagaaattaatatgggtttctaaaaaccagactttggaagagcaggcagcacagacacattaagagtgtaaggggagcaaacgtttcaagaagggtctgattgtactttgctttcattttttcaattgaggaatgtaatcatcataatgattcatgattatttacaaatttagttctatcactgagctgggtccagggattgagatttgaagtagtggttagaactagaagacgatacggagctgttagtgtgcatattcaggttacctttcattctttctttctttttaacgctgctataaaattaagactccaaataacttttcctataatctgtgggattaaatgtcatactctattgtatctaatccatttttaagttgtaaatttttcttgtttgctgtgtatgatttcatcttaaacccacacaacactttactataaactagaagaggtctaattctacagttgaatcttttgaagttaaaattttaaatcctgtgtaaaagaagatgttcttttaatcaaacagtaaacacagaactggtcagttggccacctttatatatcacaaatatatgaaggtatacttttaaatcttcaggataaactaaggtgggaacatttaaaaataatctcaggtgagagaggtagatgaccacattcctgggaataggtaactgtcattaatgatttcctaaaatgtattctacattaaaaaaactgtaatggatttctctttaatagttacgttgcccatagacaacatagtgatttttgttctttatatactgtttcttatttttttataataactcaaggaaaggtactcctgacaagatgatagccaccccctcctcccaaatatgaaataatcagtaatagatgaacagattaaaatattgtgctatataaaatctgaggtttttttctttctctcaaatggatgagtaaatttcaaggaattcagtgcccaagtgatctataaatgtaatatattgctttcaatgtttcttagtttaagaaagtatttattgtcttgtatatccaagtaactgtaatcaaggaaattgcaattgcctattcttggaagtacctaagtttctattttagacaccatgcacatcaatggaagtgtttcacatcatgagaattctcagttttaagaggtgaggtttatatataaggaactcagtaagctgtgttttcataataaatagacccattaagagggaaatatctctgagcaaaatggttgtcctctaaagatttcccatcacctttgctctgctgatgggaatttgaaaactaaatacagcccatgtgcacacattcccacatgcacacaaacacaaatgcaccctaggatccaaactctgagaattttcctctttaactttcactacagtcatctagcttgtgaatgaaatacacttaaacaaaaatagtagaggcgaagaattaatgtagattcttgtttagtaggatttattgtaggggggaaatgtgttccctatgccacatgattcttacgaaacttacacctattaatctaagctttaagtgtattatttaggataaattactagctttctgcttttgtactgttttctcccattttccttcagtattaccaatcttaacacagattatcctaaactgattgcaaattattatggtttttaaaacagcattctggagtcctgaataaagatggtattttaaactagtgtttacaatatacagaataaaaaagggtgggggagatttaaaaccataccgaacacttagaaatgtgtggagttttatacttgtgcagataagtgtgaggtagccttgccctgtgaaaccaagaccacaaatgatacgtgtcagtaggttctttgatagggcttctggccacagtgtttttgtgctgtcaaactgctatgttgaacaaacacctcctctgggacagagtgataaatgcagagacaggctggcttcaaccagtctcagcaacctcctcaaccacaccccccactcccagcccacctcctacctcctacaatccagccacctcccactccactttgcccctttacctgaaattgacatttatatagaggtgcccaggattttttaaggtgtcagtggtgagtaattgttgatactccccaaatcttatgaatcagtactctgaaactgcaggcaaagtcctttttctggcaggctttatctagtctttttaaatggaactggactgagcttctaaacttttgccaacttgaactttttccacctttgcttaatcacttgaaaaccacttgctttccttgtctttcccccagtcgctttttattttctaatgttcaagctattacattgtgcaacacagacaaaattttgccttaaaaaatccaaacactattacctcttacttttcactttctagcattcttttagggctaacatttcaaatgtatagtcaactggtctttttttttttttcttctctctcttggagccattattctctgactaaaacctgtttactggtgcctttgtgtgtgcgttttttccccctgacattaaatgaatttccatcttctacttctgcaatctctaagaaatagataaaccattatattttttccctgctcgtattttaaagtggtgatcctgacagcaggacgattattgcactttatgttttagtggatgtttgctgttgctagttacagcaacacttatcataagacagcaagaaaagagtagtccctggtaattaaagtaatgaaatattcatttactctaccttttctgtagtctcacaaattaggctgctacatttaatgcctgcactgcctctgtttttattataatggcagctttcgcatctgcaattaggactaattctgacagttacaatttctgagggatggtaaacagtgaacgagatgtgcagcagaggtattacacgtgaaaagcccttgtctctttaaccttgttgttttttttctcgcagaggttaccttttcccgatggtgcaaaatcgacttgacataactgttcatcagtttcagggttttccctggaggtatttgcatcaaatcagcccagtcaagcttcaagttgaaattggcaggccagaaactcacagggtagagactggaaaagagacagccaaagtacaggcagcaaactgacagcagcagagtgaaagacagaggggtggggggaggttgagagcgagagcttttcaactttagtgtgcgggaaatctcagctcctcctgtactgatctcagcagcaccatatcctgaaggagcttgaaaggttgagattcagaacaccttcagctaattcttaccactagggctcaccagccttgctccgggggtttgctctcacttaatctgattggatgcctaaagaggagtgggcacacttaattaaacggaaggaaagttctgaggcacctccccagcacttattaaagcttgaaagccaaatctcatgatcagtgttataggaggaaattaaggtggtttgtttttttttttttttctaattgttaacttgtaggaaagtgaacaatccctctctttaccaggtttgttttcttgggggttctcttctgagtagattaaatgttcacagagactagagctcaggggactgtccattcaaaagctaatgcattttggctaacaaaaagccagtacaagtagcaaaaattatatttgaagagatactcctttgaatgacatgggtttgcaagttctctgtcaaataatgccctactatcctggtaatatgagaacacgtattaagttgtttaaaaggtcaaaaaacatggcaaaaccttaagatgtctaagatactcaacttttactctcaacaaggtcactttaagaaaaattctatgattgcaaaacttgtataattgcttttacaaagaaaacaaatatgaaaagtgtttcctttgcctgagaacattttttctccttgatgtcttaaaaaaaaaaattgtcatccttccccgtctcttctaactttggagtgggagggggctggtgtttttactagatgatttaaaatcctccttactttccaactagacttgggggtcgaataagcccttgctttcaaaccgttttctagctctgtgtatgacaggcattggctgatctgctgatgcccattcgacaggcactgttgaactaaagtggtgtgacggcacagttttgttaagctgtgaacaaagggctgaagatgccttgctggcatcatccatgtgcatattggccttgtcacagttttgcttgatttaatgctctgtttattcctagatattaaaacttaaattctgaacaatatgttttcaaatactacataccaactttattttaaaagctttaactttgaggaccctagggtccatttgctcatccagtttctgtgtagccaacattaaaacacagctttggaaataaatagattgccagtagcctcttagctgttatccatttaaaaatgggattccagtctttaaaagtcttattaggataaaagatttatttttctttgatcattggttgaaagtcattatttatttccaacactggattgtcacataaattcctaaggaagagttaccttgtgtgtactcagtgcagtcagagtagactttttaaaatgacaaattattaaagagatattcagtaataaaagaaagcctataagaatacctataagggtaggcacatcaccactgagagaaaaaaaaaaatcaagggagtttatgttaaagtgagccctatttaagagatagcagaagaattaagattgagacttaaaaacaaaataattgttatgaaaatccctgttccagaggcaacagctcgcctatctaaagaaatcttaagtttggtactaaatttagattccagcgtcccgttgaatgtgtcttgagctttatctacgctgggtttttgttccccctctgcctctctttccactcttcaggttttcttcaagtgtttgctaagagattagttagcaagtttatattgaggaggtagccatgggaggcagctctctgcttgaaggaacgcgcagtgggtcagagtgagaagatacagggagctaagactgactaaggcctgggatcaggtactttattttctctcaaagacaaaccgcccatagaaaggttggtgggatggcatctgccagcaggagcacagatgttaccacttttagaaacttccaaacaagcattattgctggaataactttatgaaaaaaaaaatctgctgccagaatactcctttttcattatgtaaagaggctataatttgagatattcaaggttatttttacctccattcataaaacagcatctttcttgagagctgttacgagttaggtgaggaaggtggcaaaggagagaaaaatactcagcagcctaaaagtattgctgctgctaataaccggtgagactgcactaagaatctgaaatggaatctccggggtaaaacacatccacatttctacctgccctaagcgtgctttcttagcagtgactgagatgaattgtccatttcttttcagtggtagtttttctccatgttcacttatgccaaataattcccacagccagaaagagtgatacaggtcggggtggctaggaaagaataagcctttattgctagtttttgtataacatcaggcatgagaaagacacttgctaacagcatagattgcaagacactctgtggcctgttctcttagtttcatgagaaaattttgtccaatcccataggtgtgaacaagatttagacatgtaatctccaacctggaaaagaagagagcttttaatatattaatagggcagattcttacttaatatataaagtgaattttggcatcagtttggggtttcctattaatactttgttagcaactgtttatggaagagacaaacagcagttcatccaaatagtcctccttccccaacccccaacccctatcttggtattaactgctttgtcctgtcagcttataacattctatctttaaattactctaaatgaagtcataattctagttatgttttgtaacaagtccatggctaggaccaacatgacttctcaccttttaatgaactgttctactttaggatcttctaaggaatagagtgtaaaaagaagcaaagcaggagatgaagaggtctcgtaaatagtttcctttgaacatccacaattgcttacatggccttttccccttttttccaggctggcagaaatggcctagcccaggactcattcaagtgagcacatttcagaatgactcattggatgattggagggagacacaagccctacgataccaatgcagtgtattaatggagaaagttcctgagattgggagtgggtgtgacattaggctagggtattcctgaagggctctaattcatgtgagaatattaagtgtagatcttctagctatcagttagcgtaaggtttcataaacaggtaatgatggctctttccccccgctacccccccatccaatttctagctgagtgaggaacaggctctgcttcatataaatacgatctttgaatttatctgcaatgaggtacagctttaatgatctgtatctgcaagccaggagcatgaatgtgatcttattgtatcatagtgtagagatgagataggctagcgctacagcacaccagtgcattgtgcctgggtgtcgggagcaatccttccatttccaaagcagcaactctttatttttcatcattgtttctttacctcacttgtatgctccttgtgatacagatctgagtgagttgtgcaagcttcagacttgccagcccccagctcccaggcctagtacagagtaattcataaacttaccatattagactatcagattgaaaccaagggtttctactgtggtggaattggaaagcccattgttttgattatcatttcatcagccccaactgatactagtatgctcaaggaaaacatacttcagttacagttgattttcagattccaaaatggtgctgcaaagcctgtgcatctctaattatattttatgctaggctgtgcaataccaaaatatacgccgcagcaatcagtgagtgaacagtatcaatcaatttgtaaacagatgaagtcactcattcccaaactggttttccaaaaacaattactaaattacaatagaaaaaaattgtacagttactgtatttgtgtgctgtgttacaatcaacataccagggaaacaaaacaatttaatgcagaaaaatcatcattcatctacattataattgcttctttttcacatctacagggcggttaattaaaattgtgattaaatgcggtcgcgctgcctaagatgtcttgcccaaaacaggtggtacagaatttaaaagtaaaaaaaatgtaattagcattggaaattgagaaattgcctgtaagaatcagtgttaatttcagtcagtgatgaggtaatttataaatgaatgcagtggaggctgtgcaaatgcacaattgccttccttgccattcttagcattctcagcatgcaggtgaaaatgttttcaaaatattgaggtaatttgaaaatcaatccatgcattctgtatcttttttctcccatttgtaccaaatgctgaacaaatgctgccatagatggcacaatccatcagttttttactttctaaaagtaatgctgcacatattttagacctagattaagaaatataacaacacaaattgcaagcctaaaattgttacacgggtcaaaattgtacacctgaacttctgactaatggagatttggttggctgtgaaatgctcccatcaataaaatagagacatggggggaaatctgtccatggtataggtggtacaaacagaatgactattaaccaatccaataaatacttgagattaaatttttaaagtttaagaaagaaacagaaaatttataataaggctgatatttttcttagaatcttgaaccgtaactttgttattccatctagaaacatctaaaaccagttaataaagttatcactagaaaaagcgtttacagaaattaactgtttttcaatgtcatctttcctttcaacaaagatgcaactttctacaaaacattatgctatcaacttactatatttcaagcgttctattggcaaatgagtggattctatagattagatactggttaaaaattatttctatttacgctgtatttttactattaaaccgctagacttttaaaatcttttaatggaagaaatttaactttcatgtgcttattctgaccctctgaacaatatgaatttaaaatattttaataatgaattgagaatatggggtttgagtatctggcttgataccactggagttaagagactttgtggggctttttaagcatcctcttctgtgtttggcattctgcaaaatgatctctccatataaagctcatcctaagaatatgcttatttaattgtggcagatcaatctgatgatcaaattctctcatgtaaaatattctacgtgttttttgctgtttcaggcagaaatcaataatttcacttcactctgaagttatgttttgtggtaatacggacattttcaggagaaaggtgaaaaataagaaatactgtatctctgggagtgtcatctttattcattcattcattcatttttagagacagggtctcactctgtggttcagactagagtgcagtggcaccatcctagctcacagcagctgagattcctgggctcaagggatctctgggagtatctttctatcctctgatttcaggcctagtttcgggccttccctcatgacccttcctgatcatttttaggacacaaatgaaaagtgcaatttagaggtgacagctcagctggttgttccaagtggcatgccatcgtttctctcatatttaaatctgtttcccatttaatattacaagtagaaataaaatgagacctctaaatggaggaaactgaaaggtcaccagttaactccatgatccctctcctttcaccagctcttgcctcccactaactgtgatgatgacgatttcatattccagcagtcagttcactttcagcgagggtgggtgcagacttcatcaaagaatggcttcctggatttccttcaggacctgtgaacataagatccgcaaccacatggggcttggctcaaatttcagcagagtggtgggatggaggaggtattatgacgtgctccaggctgcactggttctgagtttacaaggggtcacaagggttagagaatcacagatgtcaatagagcgcgaggaccttcctaccccttgaaatatttgcagtagaaatcttacctctttacgtttggttcgtagtgccccatgagcttagcacggcaatgtggagttacttgtgagatgccaccaatgtttcatatatatatatagtatattatataatatataatattaatatatattatataatatataatattaatatatattatataatatataatattaatatatattatataatatataatattaatatatattatataatatatattattaatatatattatataatatataatattaatatatattatataatatataatattaatatatattatataatatataatattaatatatattatataatatataatataatatgtatgataatgacatatatatatatatgttgagaatgacagtgtctttttatacaagctccctccaccaagtatcatctctgtactcttacagggtcatcaagattgtcagaaaaggcctggactacatgcctgtcccagcactagattggtattttttaagtccttttttgtttcaaagtttgccatgtgagcttaactcagttcattctgctgttattacaagcatcacctctttgaagctgttatcagattcatgaaagaaaaatgcgcattttctttttctactgagggcttctttcacctttattcctgagagtgatcagagctttgaattgtaaaaaaagaaaaattttctcattgtacaataattgaaaagtatgtcatcaggtcctttctaggtcttcctgtggtatgtcagcagaaaactacagtgtttgttcattttgcattaattacacacctactatgtgcaggctctggctgaggtctgtggatcaaaaaatggatgctagagcctgggcccctgaggagcttgctgtctagtgggaaatgggggtgcatttaagatatgatgaaaatgtggcaagtgccacaaagaactttctacccaatacagagagagtacagaggatggcacaactagatctgggagaaggtggtgaggggtcacttcatggcagaggtgacttttgaggagactgttgtcatataacatggatttcaccagcaagtgagggcacagcacgctgggctgagaggatggcatgtacaagccaggagaaagggtgaacagcgcaggcattgtcagccaactgagatgtctgaaacacagggcatgagcaaagaggatgggcttgatttgagtctgcaaaggtggtcagggagcagaagaatgtcctatcccatatttttggcttgtatccagtaaataggtgatggtgagcttgcgaaccatgttttatagaagagtgacataattatatttgcgtttcagtgacacgtctctggcaactgtacgaaagatattatcatctaacatttgttgagtacttaacaatgtgctgggacccgtgctaagaattttgcctatgtcatctgatctcgccccaacaataatgctgtgaaatgggtactattattttcatactatttttactgatgaggaaattaaggtttagaaagggcatgagcctggagtcaggaagaaagtctacggttacatgttactgtaatcatggaatttctagaattacaagcaacacaggcaataatgatcattgactagaaggacatttggaaaagaaaacccagcgtttgaaaaagagtgaggcagtttgattctgtttctctgagtgaatagtgagactaagtggggtgtaaggatgtttcatcctcaaaatttattttttctttcattactatgtcagtttgaaaaagaaaataaaaaatggttgttgatcctgaagaaactaatcctagaatgtgctacatctttgagagtttggaaagagacagttaacatacaacccttcaaaacagtggaatttggtaaaccctggaacactgttcttgctgatctaattcatgacattaaggccttcctcggccttatgaggaagcagatgaaaataatccttttgcgatgactattttcccccttttctgatttaactcttccattgcctaagactcaccaattctcaaacttctaaattctccacactgccttatctctgccatcccatggcaagtcctaaagctgctaacattttgtaacaactatgtgacaaattgttgtgcttttattcaggtcggacatctttgccaggcttgcttgttgtgttttctgtttggctgtgtcatgggaccaaaggtgcctgcctttgtacagcatgtcaaatctggttaacatgcagccatttatctttaaaaccactcctgcacaatggcagaggtgggccaagccacagggctctaagcacaacccaatttttcagaccatcttttctgcatatagggagcacgttggacagcagacaagacattttgtgatttggggaatctcttagagacaaattgtagagtgcaagtgcagtgtaactggactgctgggtgcccagtgaagtgaggaaaatcagatacagcacaggctgaaagaatgaagcaagaattcatatctctgtgcagaacatgcacagtactttgctcacacagagagttcacacatagacaaaagcatgtttgcttgtgggttattttcaggggattctatagccacagtctaggcgtatatatttgcacgtaagctttctttctgcattttgtactggtaggtgtgtctacatgtgaacatgtaaacatgcttatatgagaagacaatttgctgttgctgatttaagacacgggaaaggcctcctagttcactgaggcgtttccctcctaatgtagtagaagcagaatctttttgttttctacaattgttttaataaaggactctgtgtgtgtttaaggaagactcagagccagagtgtcaagtgctgcagtgaaaaatactgaagatttttctttccataagacagctgcaaactttataacccagttcactctgggttttcatttctcaattgtttcaaggtgtcttgggaatgatttgcccttaaataactagttatcaacaaaggagaaaaaatagcaataaaaaatgtgataaacctgcatagactagtttaactaaaatgaagaatttccttgcttggagcagttcaaggaccgaacatagcaaaactgtgtgatttaaatgaaatattcagagtggtcaacataaatacacatgtagacaagagatagtatatgtgtgtgtgtatacactgaggttacttcttgaagaaataggcattttttcctttctttttgctttttctttcttttctttttctgagtaaaggaccccagagattgtctttcactttgaaaacaatctctaatatcaggaaaatgcgctgtttgtttatgcgtacataatgcaagtttgtccgcctgggaactgcagcaaatgggagaagtatgcatggatttcacaggtaacaggattacgtgggcacataattgatccatttggagaaaaaaaatgacagtgctctaaagatgcctaggctttggagatggagtttatgaaacaggcatttgtaaattcaaaggaatcaatatgtcaattttattacatctcagaaccagctgggcattaaaggaacagtagccttaaaaaaaattacagctgcatattcctacgttgtctacctttcttaaaggccctagaatttaaggaaatgaacttagagatgtgtaccttttcagaaatgaatttacattgtccaaagagaacaacaatttaacattatgtcagttatcaacctaaaaatttgattgaaatgtctgccttatcattacaattgaagtctattaatagatacagataataagcagaatagtgattttcacataggttgcactgtcaaggattcattggaattcatatttgcattgtgcttttcaacagtctagattttacctcttcactgatgataggacatagtttaagagctagcctttgggtgtcccacagaattgggtctgtgcatgtgtgaaatattcctgttttattagagtttttgacaatctatttttttttttttttttttttttttttgagacggagtctcgctctgtcgcccaggctggagtggagtggcgcgatctcggctcactgcaagctccgcctcccgggttcaggccattctcctgcctcagcctcccgagtagctgggactacaggtgcctgcaaccacgcccggctaattttttgtatttttagtagagacagggtttcactgtgttagccaggacggtctcgatctcctgacctcgtgatccgcccgcctcggcctcccaaagtgctgggattacaggcgtgagccactgcgcctggccgtttttgacaatctaaaaagaccaagctattttaaattattaagttcctaaataataggatttggacagcagccataagagaggtgaatgggatgggaatttaagatactattttaatatcacaaagaggttacacaactaaggatgaaagttagaagctatgaattggtccacatactctgcatgtgctgtctgctagaggctgcaaggcgagctgcttcactgtttcatgttccaatctccaccacccagactcctgctccaataacatctctagatctattcacttgtaacaaatggagcccagttctcctccctccccaaggaggccagacactcgatacaatgaaaagaacacaggattcagacccaaacaaatttgtgtccacattctgattctgccatttactctccatgccatgtgcccctgggtgcgtttcttaaccactctgaacttcggttcttaatgcttaaaaatggggagcagtatttgttttatagaatctttgggagtattacacaaaattctaaagacagtgtctggagcctagaaaacgctcactaaattctgattatgactgtttcaaggtgtgactaatcaggatgccaggaaccctacgatggaggcacttcagtttctgggccttgctgaaacattcttgaaaagaggaaacaataaccgtagcctgagatattcgttccttttttttttactctttggagagtacttaaaaaaagaagaaaaaagaaatagtcatagtgattggcatgctattctacctctacatttccaggaaatatacatggtactttttcttatagaaacagcatctcctccaaaaagaatacattctgagatgacttttgtcacagcacttaaaatatctgattcctatttgtctccccacaaatgtgtaaatggcttgagggcagtcttgcccatctcagctcaggccatgacatacaaaaattgtttcgttaaagcaaaggtataatgaatacagcgggtatattaaagattcagtatacattatcatatgtagaaaaaagctttgggtaactttatgtcagattccctaccaccatattaataactttttgaaattcactttgtgacagctatgttattttgaatacttgagtgggtttgctttttgtttttgtttttgtttttagtttgtatttaaatcaactggctctctgcctttctcaatgacacctttgagacttgggagtcagggaggcagagaggcagtgtgggtgctcggaagagtgtaggctttggacatctgggctcaaatttggtttctactttcatacaagccataagacctgtagcaagttgttcagtctaactgcatctctgcttctcataataatactcatgttatagggcagttgggaagaaatactggtaacaggtaaagtgccaagcacatagtaggtgattaatgttctgtccccttcctccactcttctttgtcacttgagcattcactttgggttggcatttagtgagctccttctgcccgtcaacaagtcaatcaacatttaatacataccatgggtagatatcttacccctgttccaaatttcattatgaaaattgggctattttctactcaaggaaatgagcatgcagaagtaccttctgtacttagaatcacaatcattttagctattttccgcttaatctgacggtttctttgttcccatcatcttttttagtgaagcactttggtgtttctgcaatcctttgctatcattctgtgcttgggtatctcagatctctcttctcccccgatcctttgaagacatcagaaaagaagaagcacaaggtctcttgactatacgtttgccacacaactgtgtggattggttagttaatagagttgattaaaacactttgtttgattctgcttaagcataccagaaatacattcaaaatctacagctacaaaatgtaaagaaggtagtccaaatatagtactacataatgaggctccctgttggtagtatataaagcagtttagagtatagcttcaaattctaatgaagatcattttaaatcttgcactgaattgtgaatttaaaattcccatgttctccataagtatctgaagaggggcatgtaaataccataagtgaattaattactgccttaagttggtaaagcatgtgtgaatccaaactttattcttgaacttgcacttctcttcccaaggttttttgaaccatttcctatatgctgagttctgagtacctatttaactactgaggacatatgaagaaggtagttttctttgcatggattaaatgtttcaatctctgaaaatcaccaccaccacaacaaaaagtctgcccggcaccatctacatgtacatgatgaaattcctaaagcagaaaagatatatttataatctgaaacttataaaaacatgacaaactgttaccttcacttttgtgcccccttttttcattaacagtattaggtcgtttttttttttttttttctcttgagaagaaacgaaagacgaagtggcaagaatatctttcacttttgctcacgttttggtggtgtaatattgggaccactgaagtaattggacaacttttccgagctgactcttctgaagtaaacccaaggcaaagggaaaatggagctgctgctaggctcaactgatggcgcccacatggcgcccaccccagctccttcagagactccatcatttccacagaagggccagaggccctgccaatatccgcacatcactggcatgatagaccataacagcttcttctgagctgttccggtctatcgtgtcaatgcgtactcggggagtcctcaacgcacggatcactgacacggcactacataacggctccttagcagccattattgggtatcaagtcaatgcctactcagggaggctttatcgcagaggcctgcacgagcagacacattccgaatactaaaattccttaggaaaattagtcattgcccatgtgtgatagctgttttccattttgaattttaaccattttgggaaaaggaagagaatgggaaataccagtatagtccgaaaagcccttaaaaaatgagtgcgaaaagtggaagggtggagtggacataggaagatgatgaacttgtcattttttcctttccatagcttcattttattgtgtcaaagttgcagaaagcacttcactttcatcgaggctctttttaggcagggtacagccaagaaaacttttttatggctcagatgtaaatcctagaaaacgtagtagaaatgatggcaggatctctaactgtaaaataacagtagtgttagtagtaagtgtcattataataacgttatagaactctgcacatcaaaaataccacattttatcatgatctctgcaagagatttctgttggtagtcattctagacttctaataaataatacgttgagtaggaaaggttctgtgaggatccaaataataatgaaaatgacagtggtgatattaataataatagtacagctcccatttattgtatcattattatgtggcaggcatttgtatacattatctcatttaattttctcagcagatgtgacaaatcaggaaactgtggcttagcaaagttaaataacttgactgatgtcatgcaaccactaagtgacagtggtgggatttgaactatatctggggagagtcatgctcttaccattgcattgcctctaatgatcatcactttcagggaactaggtgtttaattagaatatcccaacccattgtctgcttactgatcaggaaactgaggcagggtaattttagtaattcccccaaataataaagagagtcagaatgaataccagaaagcaacaagaggcaaaaacagcctttctctctgacaacatgttaaccacaaacaagacatgggaatttcagagcctccgtttgtgtttcagaaggaatgtccactgttgccatcagtcctgaaaagatttccttgcaccaaatcaaaatggttcgagtttgctgttgttgatattttttttccttttgtgttctgcttactgactgacatctgctatcatgctaagcaggtgttcctatgtaaacgaacgtgccctgtttgtgtttcgccatcctcgctgctgcgcacccaaatgagcagcgtgattaagaatcctgtaaatttttgaaaggaaacggatggctaccctactagaacataattacaccgttccaacatccgcagctcactgctgcagcagagttggagaacagcagaaattaataatatataatagcatcattctagtaatttataaatgaaataaagtagagaggagattctgctgatatgcattttctccttaattctaaaagacaaagtatagattagaattttagtggggtgaaacctggccagcagtctcccactagttgcctgattcatgataggagtgtttttgcttagggaaaagagctaatatgttttattaggccagaggaaaaaaagaaaaagaaacatgaataaacaaggccctctaaaggcaacactaaataaagggggtctgaaaaaatctctgtggattgtgtgcccactgtatttaaaaagatattattactttaagacttcaacatgtgctgcattttttctttcattgtaataacataccaccataggtcaccccttctgagaaaagagggactgatcagttaaagatgtggcccaacataaactttatgttaaatagcactcgtgtaaattctagagatctgctgaacaacaatacacccatagttagcaataatagagtagatttcatcttgtatgttttatcacaataaaaaagaacattcatgcctttttaaaaacattattttgagtacccagtatgtgcaaaggagcctcttattacaaatcatcgttagattaagggagttgatgcttttagtcaaccatgctggagaaagaacaacactttctaaagaggcaaataaactatatgttaaaagtaaccagtccatttctctgtctcatagggttgtggcaggcactttagaaactttaatgtttttctaacttcatttaccgtaggtaagatgcctaacaaatggatgagctcagttgtttcaagagtttgtctcccatgagccaatgcccatcacacacacacacacacacacacacacacacacacactcacacacgagcaattatccttaagaaaaataatatttatagcacttaaagtgttatttaagcaacttttcctgcttaattccaaagaatgacaatacatccaaaaaaaaaagtcatggattttcttcctttaattaaacttagagaacatgaaaatactgtttgcctttcaagagaagcatgtccatttaagatgcttattcatttaagcagtattcatttaaaggtccccttgagtattactctatgtgttttgatttggttcagagaaaataaattcatttaatagatttatttcattaacaggtatttatttaagtgggttccactgtatttaaatctccaaacagtttccattacttccttagctcacttgctccatgttgactaattttaataagcctaaggtgcctagggtcttattgagtgttcagtttgatcaatatggttaaattaaaattgtgcaaaatataagcaaatgtactctaacaacacagtgaaaaatgtgctgtgcactaagcattgattggtatgctgtggacacagatatatgaagctgggtgggcctctgaactacctggaaactgccactctcctccaaagctcccctggctttagatacatccatgtgatctcccacccgttcatggagacagcagctcagatacccccattgaattagaaggggaaggagattcatgtcaggtgttttgctttttgatttaatggaaaacagcatgtaaggctcacagtgaaatcctatataaagaaaaaaagctaagattttataaaagttcaactttgagtattgctgaaatgctttaggtaataaagaatgcaggccctagttctttttcacagaataactttttaccgtaattatccttaaattttaatcatttggtagcttgaattctttttcagagatcttacttgtcaagtttgttttagcaaattacaaaaaaacaaaaacaaaagccaacctgatttttaaagtataccaaaatcagctttgccattggtactgcatttgaaaacctagtaagctttctaacaaattcattgctttctatataattgtaaagttaaatagataactgaatatttttagtggattccttttagtatgaataagtttgtatcttctattcctaaatcaatttctttacctttccctttttctcttctttttttctccttttttgcctgttttatggcaagcatacttaatattcagtgtcaatctttttaagcttttcaaaaatctaccacaatcacttaccaatcataagtatatatcattcaaaattgttcctgatatgtgctggctgttggggcagtttctttttcctacctgttgtgtgcctttgtacctatctttaatctcttcttgctaagtgatagctaccatcacaacactggctttccttgatagcatatcttcctgcatgtccaaaacttaagttcacatgagcagaagttgttcttatcaaaggtaaatcagaagttaaaaaaaaaagcagagagataaaaacatcaaaaatgtacatcttgcaagcaatgatgttgaatttgggagaagtgtgttctattgaaatgaaaatcattttctagtttaaactgatcacggaagtttatatgcataataaggatttgaagtttcctatcaaattaagtacagtgtttgagcttcctaacatttaataataccatcaccaatacacctgcaaaataaaataatgtttgagccccaaaatcatcagaaatatgtagaccaataccagttcagaagaattgactttatttttgtaatggggccaagaaaaattcttaggtttttgtttagttttgtgcttgttaatcttgatttttcccagtgttttgcatgttttgagtttttaatatcaaaggtactgctctttgtaaacaagtgtaagtttacccaggcagcttcacttacacccttcccttgtaatcagatgtgaaaattacaccctcccttttggatacatgataattacacatttcaacatgcaaagaattgtctctgtttcagttgttggaatgaaaaagctgagacatttcagtaaaatatattattatattaaagatcatttccataattgttttcgggatttgtaatcaaaaccatgatcaaggtagtcttagttttaaaaagaatacacatggaaataaggagaggataaaattaattgccgagttccacttgaatgaccattcttttattttatgaaaatacagttaagtacattatattctttctttaaaaaaaaaaaaaccttctagtaccttatttgacattttctttctccatgttcgttgaattacctattttttcaggtcgaccaaaaaaatgtagaaatacacatttttgtgatcaaggtgaaaaatttagtcagaagagagatataaatacaatgaaggaatcttttcaagaaaagatgtgtttgtttttgtttgcaagagtgcttttcagccaaatataaaattttgtaaactcaggtaaggcacctcacacttcacaatcagacttctggattcatctagagtatcactcatatcataggtaaaaatatatgtcactattggtataaaatacactgaagccttaaaaatgcagaggttttggcaaataacactaactcaaaaatatcttgtatatccaaggagagggtttaaaatcaccgattcctttttactttcttaagctaagaagaaaaggaagagagaggccaggcgcagtggctcacacctgtaatcccagcactttgggaggccgagacaggtggattgcctgaggtcaggagttggagactagtctggccaacatggtgaaaccccgtatctactaaaaatacaaaaattagccgggcgtggtggcgagtgcctgtaatcctagctacttgggaggctgaggcaggagaacagcttgaacccagaggcgaaggttgcagtgagccgagatcatgccgttgcaccccagctcaggtgacagcgtgagactctgatgcaaaaataaataaagaaataaaagaaaaggaagagagaaggcagcattagatggctgatgttatggcttcgtgaaacagtttatggcataaagaaataactccccaactccttagttttccaagtatgtaaatgtttctgctcatccaaacactagcataggtaagtgaggacacatatttcatctagcccaaatatattttttaaaagaatccctgcagattttttgcttctataaaaaatatcccaacccaaatttctaaaaattttgatttttggaattaaatgataatactaattagcatttacctatacatccttttctattttaaaatcattgcataatctggcatttatatttaattttctaaatcattttccctagagagcattcatgtaattttagaacttggaaggaaccaggatttcaactatactcatccacagacttttcccattgggtagaaattgaaacagaactgacagaaccaggatttgaataccagccttttgactccaaatcagggacaagatgcagttttgtatgttaattatttttattggttttgatattgtggccccaagatccatagtcttattttcatgctaagtgactctttactctgaagggccaggttataattgccatgtatgccaagagtgaagggacccaggaccagaaaattcagtatgcccgggtggtgagtttttagacttatggagctgcatgttctgaactccacgttctttggttttactgctcctgtgttttttgacagttgcttttttttttcttcataatttctgtacaggctgggcagagagttcaggaaatgttccaccgtgtactgacattcccctggcaataagtgggttcccacttcagtcgcattccactaagcctattttggcaccatagagagggtgatgagagggaagagtcagtggaggagaagacaggaaggttgccaggaaggaattgaaaggcatatgctcctggccccattgcctgtgtctgccttcaccacctttagcttcacaagcagtggccatggcaaataggaaaaggtttgggtgggagaaacacagaagaagccattcctgattaggccatgtgtcttccactagtttccatcagagtgggctgaccgatctgtgaagatctgggatcatgactcagtataacaagaagagtcctacacatttgattcaggaaatttgggctcctggcccacccagccctgccttccaatctcagcatggccttggacacatccttaacctctctgggcctcacattcctaatgataaaatgcagggactggacagagattgcaaactggtggctgacagatgtttgatttgtcccacacagtattttaaacacatttgaattggttgccaatatttaaaaattgggctatttcacacacacacacacacacacacacacacacacacacacacacacacacaaatccagatttccagctcccctggagaactcagatgatctggtgtttcgggcccacatagctgcatggaaagaccatgtgggaacaactttgagttccgtaagaaaaatcaatcaacttccctcacctgcttggcctgtgtagacatttgagtgtgggaccccaattctctccaagactcctttgaagctctagttttagaattccaaatatgatttgcttgaccataagaaatatacttaatccatagtggtttctatattcacggcagaatgctaaggtatttgtttatacaatcagcatcaggtaaaagttggaactatcttaggccaaataaatcagccccatttagaacaaatgctgactttgaaatttgataatgggaggcaggaatagttcagcaaagatagcctttgaggtagttacaagaaagatggtttggctcctgactcactattacctacacagcgaactgtgtattttgcaaattatccaaaagtagattctttaaaacccaaatcaaataatacaaggcccttcagttaacattttttcacatctcccactctaaactaacatcttcataaatattgagatcatgaactttttctgttcatgtaattgcaaacaaattatattggcctgggaactgtttgatcttcttcaaaagtaaaggaactacattgattttaaaagttatatttttgtaaatcatgtttccaaatgtatccactttaaacacaaaaggtaacatttgcgactcatggttatagagtgtttaatattgtacaaggtgcattgacaaaaatatctcatttgatctttacaacaattgtaggagctagacagagaagacatttaatacaaatgaggagtctgagacccagaaaagttggatgactattggaaaattggcctattacttgcttaatgtgaaaaagagccgggattcaaatctacagcttttggctccatatttaatgttttccatgccatcagtatgcttccagtgtcttagggtatgtgtgtgtgtgtgtgtgtgtgtgtgtgtgtgtgtgtgtgtgtgtgtcttacctaaacactgactttttctctctctctgtcatgaacaagaattgagaggttaaatgggaattgtctcatgaattgtctcaatgttttctaagttgaatgaagaatcttttttggtagctattcttaagtgaatgctggatttttattaagggaagctaacagatatttaaaagcaccctccatatataaaagcacaatccatggaagcatagtgcaaggaataatgatatagacaaatggaggaggggcaataaaaagtcataaaacaggcaggtagaggtttctggaaaaataaggtggtgagggaagagtctaactgtaaaagtaaaaaggtagaagatagaaccgttgaaaaaaaaaaagaaatatcagaaatataaagagaaataaacagcaagaagactccgtagtaatttaagaagtgaaaacttttaggacagaggtaggagagaaatgggaaacactggagaggaagtaacaactaggaagtgtggaagaaaaacctgcaggccagaaatctgagcaaagacttgagagaggatgatggtaaatgtgaaacattgaaagggatgttttaagggattcagacattgagaggaaagtaaattttcatcacaacaccccatgacgacaggctcaacacatttggattatgagaaaggaaattaacatggttagaacgaaagaataaaaattagtaagagaaatctttggatgtcaatggagaggaggagaaatgatattaaaaggaaagaaggcatgggtggaaagtagaatgagatgagaacctatggtaggtggaggtgaaaaatgaaatgcgtcagggaagatcatgactgggaccgccgcacactgcagtgatgaagacggagaagctattcttcagggaacctgcaaataaaaagaaaccttaagatgtatttggagggaacccaccccagcaaggtgagaaagcaagaggttacattctgcaaaaagagaaaatgaacggggagaagggggaaaactaggggaaagagaaaacagcaaatcaaagttatggagcgtacagcattgaaaggaatgaggcattctgttggaattattcatttaagcatatgggtattggcgtcccttttctaaaaccggatcctctcccttatttctcatttttctataacactattataataaattcacatggaaaagtacaaggatgagcaattttttactttagaaatgtttcaaaaggggaggtaaacttgatggttatctgtctgaagggtgacgcactatagtggcatgtgagaatgaggccagaggtaatcatcagttttgaaattgttctttcaacaaattcataatgcatataaagtaactcgtgcacacatttatggcaaaacatactctagatattaatttatattgcttatactgaagatctcttgagttttcaaaaagtttgatttacagatttttcacatcaaaaattttttgtagattctattttgtaattaagatgtgtagactcctcaataattctttaccttgatgctgtgtatactcatttatctagattaaaatacttccttgccctgaatgttctaaaagtgtaccccttggggctctagaatttagaagtctcccttccccaactatttctagtctaccttttcaattgagttaatataatggctttagaaatacaatttccatgttgctataaaaatggggttaaaagtcataacaggcacaagaaacaggaggaaatgagaattgtgtactttcagtcacacccgggccatgtgctcgggccacatacagcatgcagccctccggagtgggctgtgtaacccggggcacacttgaggtcagggcacatagaggattaatttactgaaggtggtagacaatccctctgccacaaatgcaaacattttttcataagcgcctgaagcaattagttctcttcaataataaatttaatcttttcctccttcctttctttcctcttcgtttctcctctttcttctcttttcctctataaatgctggcctttgtctaagatcttcaactcaaaggtgtagatgccaggaaagaaaaacaaaatcaatgtattgtggtactaacaaataatgctataattattagaaaaaaacagattgaagcaagatacaaaaattctcaaaagcagctatctgtatgaaaatcttttctacttctagagagtatgtgaatgactgtatctttcatatcgtgaaagcagatgcttacatgcaatcacctttaaaaaaagaaacaaactatcacagtagtgacattgcctattttatatgagtagggaaactagccaaatagctttgggaacatttattagccttgtcctttttttttttttttaacttttagtatagagagaaaatagagatgacaggtaggtggctaagtaaggtgacaggatggcagacagcattcctatcagggcagaaagaatttataagggagctgccacttatagcgtaatagagctaagttaagaattgcaaacagagtagggccaagcaacattttaagaacaattgtccttaaacattcttgtaatgctaagtcactcatctttgtttcccacttgcttcctagagttaagaaaagttctttcctaacttgggttgctatgcagagatgtgaaatttcattggctccaaatgcttttctgtctagtagggactactgggaaccctgctaatgtgcatattgatgtaccctgtagcttcacagatgatgaaagagcatattacttatttccacaacaacaaagctaagagaaatttgaaaggagccagttattttacctggggaatttctcccaggtgatggggctatggaaccatggaatttaaatatgggggccgtcctattttctaaaaagtttttatggggagccataatatcactcccaagcagaaatcaaatcaaataaaagactattgctttcatttgcatttatttagtcaactatgcctaaaatacggaaaagatattatcatgctcattcagagtgtattttattcgttgtttactagactggactgacatgatatgatttgtgctttgcggggtcacaacaagctactagcaggacaatttgctgaatcaagaggatgattgtgtctggtgccagtcagtcgcaattaggaccaggatcagggaggcccggggcttgtgcatcgtcttgggcaagctgcatagaaatcagctcacctgaaactaattgtcacaacagagaccttatgcaaatgagccctggggttagcgtgggaaaagaaaaactgtcgcaaagataggtgacctgctgagcagggggtctgttgctggggaaatctttgttcaatgagtttaaaaatgttttcattgttcaaagtccaccccccgccccccccccccccaaaaaaagtagcatacacactcactaagagtatggcaaacacactcatctaaaattccaataaagcagaagcctgctttggagcatgccataaattgggagtctttataagggctacagcaggagaataatttccctttgcaagggcctttaaagtttaggtgctgcggattgcagtgtggcctaccttgaaaattcacttgcaaggtcaagcctattgctagcctggcaggacccgcacagccttttctccctgcattccagcaggccacctccacacagccgtgaggggtgcctgtgaactagacaagaaaggcctagtttctaattgagctttactggtatctcaggtagaagagaagggccaggagcactctcttaacacatggcaaaagaatccggggaaacaatggcagtttcttgaattgtggtttctcaaatactcacaagttcaaatgaaatgcaagcattgtgaaattccaggaatggtaatgcagcccaagtggtaatagatcataaaaatttagcaaaagaaaagtaaaaattatttttaaactatgatttactttgtttttcaatccctgacaaaaacacgtataagttggaaatgacgtttgattttattgtagcactcatttggaataatctttaatatgttttactttagaaaaccagatgaagaaaagttattcaaaggtaatgataaacatttttatacgttactgtagcaaagttgcctttgggttcttcaattgatttttagcttttcaatcttgttttcataaaaacatgggctaacatattgatacttcttagctttacactaaagatttcccagtgacatagtagataatgtatattcacacaggagtataaatataatatcaaggaaatgaaatagagtgttctaagctttagcagtaacagagagcatagatattttgcatctaatgatttcaaagaaagaataatttgaatttaaaaatgtaggtgagagaaaaagaaagtttcattgcattggcgttgaatacaaatgctattttgtttggcaaattactggacctaagaaagtgttttcattgtgtttcctaaagggctggattgaaatttggacttgtacctgataagcaagctcaggaattaacttggtagccaccacaaaacctaaagaaagttaggcttagaagtgcaacttaatcacaatttagattaaaacacacacgcatacacacacatatacaactcttttgtcccttcaccactgtctgaaataatttccacataagagacatttcacagtgggtacgaagtgctcagctttcactcatcaaactttaatcggaactgcattttagtttttgaataaagaacacttaaaaaatttagatgcaaattattttgcattattcatgctctaagtgtccttgtagatttaaacacttctgaggccaccttgattcaagtaattacctaggccctcactgctccgtcatgaataaggtattttgtacaagtaaagtatgcacccgatgagcttttaaagtggctttacactgaacttgtgtattgcttcttgtgcatgagtgagccgaacatgtgtcgcaatctgtctcaggtgggaaaccctggctgggcatccatgggtgacgggatgaaacccgagcgtctccttcacacacatgctcttcctttgtctctacctaagaatgttcctgcctgattctagtagttgttttaagcattaaaaaaaagcaatagattctaggaaaagagacagggaaagtgacagtgattccgcttaaccccttcatcaccagagattattggaaatgcccacttttcaggcctcctcatctccatcagcaaaggcttccttgtaaggtaataagtctctctcattttacatggttctgtacatctgtctccccatctgtcagcccagcatcctgagctattagagctaggtgctacctccaccacggtattcacacgaaatggagcaggcttcaaactcaaaagtagctgaagaatacttacaatggaaatgaaagtgaccatagagcatcaatctgtaagtttatccacacacacaaaaagagggtttgtaagagttaaatgtaactggctgaagcttatagctggcgtttgttacaaagtacccaagcttttcctttccaacttcgtggctttgaagaattataggaattttatgatgtgctgttggagttatactggcagagattacagtaaaggggttaaagttggtttatggtagaaaaaaaattatgcagaaaccaataaaaataaacacactcaagtagactaaacttgctgggcttttagttttacttttaacaaaggaagtttagatgaaagtaaatgttgcagcttttagaaaattagttgacactcatacttgatcatctttactatacagtggtataattaatatttaaacattctaataatgcagcttgctttgcatgcacttttcagcctcacaacattatattttatctggaattgtgctagcattttcttgggtagtgcccattttcatagagttaaatttaaaatagggtagggcctcagctcttattgccagtaaaacatcaataggagagtgaacaggtttcatacatctaccagacagtttattattaagaacaatatttatttgagataatagataatatataaattttgtttcattgccccatgaatgtttttaaatgatcagaatagattaagtttgaaagttgcatttggctgttgtccactcactgttcaaaacaggaggattttgatgatgtcaaggcagtgcgaaatcagcaagtgatacatgaaacatggaacccccatgcctgcccattcattagggcatctgattaacatagtaaggaatgtttattttcagtacataaaattgtagaactttgggagcatcttctgaattgcaaaagctgaacacccaggaacttagtgaaacaataaaaatatagagaagtaagctaatttgtgagaagcctgagctagtttattttcctatgagaagtttcttcctgttccaatctcatggctgtaggtggtagggaaaagttgtttcaggtgctgccctcagctagtccctttgaagagtgcaaggtgcccagtgttcctgatcttctagtttgaatgatgagaaagagcattctacctttccaccatcacttaagtgtcctttgaaattgaatttgcatgcacatatttactgctcattctttttaagtgagtaggtgtgctgagcttcaagtctattttgagactcagcccatgttaaccccttgaggcccacttcatgataggtactgccctgtgggaatcctgtcatttagtgaagcatgaagccataatagatccacagccataccaccattggggcatctcatttcgattaattccctgaagcctttggtgctgtggtttgcagaaatcaaatggcgcaaatgagaactacaaaattaggcaggttaaatttcgcaagaaaaaaaaaagataagtagtagaaaaaatagccagtgtaaaatattagtacacaggagcagtaagtaaactaagttccacactgaaagaaccaccagatctcgagaagtagatatcaagaaacagtttgcactggctgttttatttccttatgtcagaaggaagtaggtttttacagatccttggacatgatcatctttgtttctgatattcagaaacggaaccaacagtttggtgtctatttattttatttggtttgtttttgagaaagcgagttaaataaactcagcttacaaataattaacagcccctggactatttaaaacctgctactgaggtggtagagataagttgaatccaacagctgtcacatgtatgggtttgacagataggtaagtccaagagtggacaaattaaaagcatttttcatatgctaatctccacctgcacaggaataattttttttaaggaggcagtctactggcagagcaaattcaagagctatcagtagtacattacttctaggaattatgacatgcaataatgaataaatacttctatgagaaaagtctgctgtggaatcttaattccagatgggtgtcctgacagcaatgtgccagcaatattgtggaaagaaaaatgacatatatacatacatatatatatacacgcacatatgtatatgtatatatatggcttttaaacttgaataataatttcttccatgtgtaataggttcacaattatatctaaggaattacttttttagttgcgaatagagatcaaagtgaaaacaatagtcaaccttgcccttcaggtggcagttacatgtgagctgcatagtgagtgtgagagacagtcaaggatgtcaatcagaacctacagattaacccacagcagtgaaatctgagatggtttataacaagtagataacagtttcaggcctatgtgagaacgcataaactaaaacttcatgctgggacaaaacagggcaggacatttgaggtagagagtgagaaaaccatacttttattatgacaaagcctctcccatacttgttgaaatgtcactgggttgttattaaatgctcaccatttctctaggttttatattatcttacaaaaagcttttggagtttcctttaattttgataaacattcaaatttgtgcataatttctgcacttcagctttgaatgacagaaaatttcccatgcttgttgagtttcctttcaagtaagaaagtaattcttgtaataaataaaaatgttatatttctttcttccaatgttatcaagttaataaacccttaccttagtttataaagtcaaaatttactaatgtattgaaatgagaaccgaaatactcaaaaagaaatcttaaacatcaaataataacgagggtaatgaatgaatggtcatggttatggatggtgatgatctaatgtaaggtcctatctctttttaatagagagtcctcaggctcagacaatttagggttaaagtgcctataaccagatcagaatcctcagttattacgtagtactcttttaagacccgtgaattaagttataatcaatgattacaacactggtatcatttattaatgtacccttctcttctagggtagcagagatcagtttctgacaccttagaactcttcatgtgcaagaggaaattgaaacaataacaacatatttaggcagtaggcaaaatgatttgctttggctttacctacagggaaacttgggcaatggtcattagacttttttaatggaacttcaagtctgatgccttgtgaccaggtgctaacatggaaaagagttagcatcattgacattctttgattcggaagcacataagaggtagataaggagacaacacaggcgacccacctccaggccaggagaagaggacagttcctggaatgtctgcaatgtgttactatttttgtcacacctatgtgaggccatccatctggtctgaatcaatcagtctcatcccagggctctgctcctctcccagctgaaataatacccttctttcctcagtgctgtcttcaggaggggcgctgctcaggactgcccggacaaggccaattaatgagcctgtgtatttgcaaacgatgacccaggattagacactggagaaaactttctttaaattctctataagctctgctctcctagaaacagtacttgagaaaaccgggtgaatcattagacaaataattgaccccagaaagcgaaagactgatgctacattactttgcatacgtacatcttattttttaaagaaaatgtccttgccttgaatttaaaccatgaattggtctgctgttatacccaaagtagataaagcctgggtgtgaggcattcaccacgacttagcctgaagtattttcttcggccacttcactctcctccacgctacatgttcaatttccctgcacctctgtaacaaccctacacctctgcttctagatcatcttcttggcattcctcatgtgcacatcctgttctctagcagtcccttatccatgccgcctcatcagattcctgcacacctgacagcctcttgcttgctatttcagctactagactactgacctctattgtacatgcctgcaatcccagcactttgggaggccagggtggtaggatggcttgagcccaagaatttaagaccagcctgagcaacatagtgggaccctgtctctaccaaaaaaagaatcaaggtatgcaccagttaagccagccacgttttaggaccacatagcactcttcccacaagagacctcaaaacttaatgacattggctttggcaaattcaataccatgacataaaactactcattttccctatctgcctagttttccattgcagtgggaaataccaccctatcgtggacctcccaaccaggaaccccatggttatttttgtctcactgctgtctttctcactccccacaaccagtctgttaccaaccgttgctactttttctttgccaatgtttcctgaatccacccctttcctttccattctcatagttgtggtcttagtctaggctttggccttggcccatggggactttgcagccttctttcccctctcccaccacattcacatatcaaattccagcttactttatttaataacactgacaaatttttttttctcttgtctatgtttttggtccattcattctctctgagctccattgagactgccagctgctctctggactggcttctaatgttcacttcatacatgtcacctcttcatccagctacctcctaattgttccaatcttttttctttctttttggaggtaagctcttctggtacttctttttttatcgttctcacacttcttcagaaactcttctcatggtatacatgttcctggtacacaccactcaagggcagattctgacactttctttcggtagtccatccgtgcttcctttctgatgtagcaaagtgtcctctttgtgagcacgcccaggttcaaaacttccatttccaccacttgctacctatgacattgggcagttacctgacagcacttcacctcagcttcctcatctgtaaaatggattgttgtgacgagtaataagatcatttatttagagcactgctggcacacagtaagcactgttaacatgtttgctattagtattattatcatatctcataggactccccaatcacaccccgcttcaatcaccatcatgctgtatgccatattatccttgcatgtaaattttgaggaccacataactgggttttaaaaatctggttctaacagtagtttatgtcttagaaatcagggcaaagttaatcgaagatacctaatatcaaaccaggtaatgatgaagactttaaatgctttttgaggatgattataaagaacattatgataagaatgatgatgatatgatgatgatgatgatgatgatgatgatgaagaaaacatgaccaaatgcttctttgggttaatactctgcttataaaacgaagtgtccaggaaacatacagtattcctcctgaaattagtttttttttcccattaaatggaaacatgttatgcataagaacatatattgtgcagtatgcatgagatttatttttcagaaagcagagaaatggcaagaattttaagtgttctacatacttatttagatctcacatcaggagataaaacaaatgaaaactctgacttgttaataatttacgttttggtggaaaattcatacaagctgttaagatacctctaagacccaacacagaaaatgcaaataacatatatccactgtgcactgaagaaaatttgtctgaaaagaaaataacatcaattaaaaaaaaaaaacacaagtgatttcaagggaatgttgaccacatttacagggctgtaattgtgcttattaattttagatgtctcttttgaaatattcgtgtaaatgatctctccacttaccaggtgtttcttacagaaagtccactgggctacctcactacctaggaggtggcttacaaataggggatttctttttagaaagccacaccattacttttctctaacagcttatgcaaaagttttgtgggggagggaaaaacccaagccaaaaaaaaaaaagaaagagagagagagagaagagtgtgcatgacaataactacctctgtcccttaggtttttgttcttttcatgtcatggaactttttagctgtgctgcctgggtaactgctctggaaggttggaatatctgttgttgaaggaggtttgtgattgagggccctctgacacaaccttttgttgcattgaggtgtttgatcctctttccctttcttctaaaaccaatcccatccctttaaaaaatggataaccagcacttcttttacttattgtcagcttttggaaagttactctgggggtttgtagaagtttaactagttaactctttgcatgctgatgtcctgtcgctaaatattcttcttctttctaaacaggaaggattttaatcacttacatcaggtaactaccgctgttatgcaggcatagcaagtgaaacatattaaggtccagaaataaagcatttgtgttcaaggtcttcaaatgtgagagtgattcaggctttgcaatgagacacatccttattttctttttgtcctagaaccgaaacatgtgagagttatgactctgccacttgaaaaaacatgatgatatactaatttttcattgaagaacaacaggctttggtaataagtaaatgcaaagggttacttcagaactggggtacataactgaatggcaacaaagaaagagagccttagaatgaaaagtgtaggggtcttgttccagtctgctgactaaatgctggaatatttttttcccaaaagaagggacacaacccaggctctaggaaagaaaagaagcttaagtggattatttaacaaaaaagcaacttatggcttctagatagtgacctacattctgcacacaataatgatgttttacggtggtgatagggttaataacctaacatcattcatgtagtgttttttgaaaattgaattttactgctacaaagtaaatgtaacagccctctggagacaatattacaggcactttattgtttgctaagctgatgtcatctttctacagactgactttaaaacaaaggcagaacatttattacaaatatcactgtgtgaaaggaaatctactgaaatattgtttagaaggtgagctgataaaaaagtattaatacttggctttgatcatcttgtactataaagttatgacttcaaattttttctcatgtgatctctattcaaggcaaacttcatcctggcaattcctacctgtgtctctaacattatttgccctcaagttgaaacatttgtttaagattcatgcgtgttttaaatacatttttactctctaaggcaatttcttaacagagttgatgagtttttgagagagagagattaaatagcatctttcagagataatatatgtatgattttaaaaacaaagtatggagattaagctgtttagtttatataatgaactttcaaaatcacctgtaagtggtgactgcaaagtttgcaatttaaataagctgtttcaggcactgccaagcaagcattctgcatcacaggttgcttgcaactcagagggtttggtctctgtatctgatgcacgtgtaatacagcgtgaagttgtttgtggatcacacaggagcttcttagagcttcatttccacactataacccttgaaaatgtatcaaatgagcagatgcacttggctcttccttaaaaggcacaagtaatttgtttgtaaatcagttacctttcaagaaaagttaaattagggggaactcttgtttctttgatgttttccctcttagaaagccaaagagcaaattaatgatcattttgaagtaataatgataatgaggaaaatataatttagtgagctacactatcccaaaataactttttcaggtacagcatataaataacagcccaaaggactaaagcagcctgatggtgtttttctaagaaaatgatttactgctctgcctttgtctctgaactctggttagaaggaaaacacaggtcaaggaaattgggttaagggaaaaaaagcctgttatgggctaggtgtagaattatatgaatagtgactaattgggagtctgtagcactcagatcagtgtgtgcaatgctcagtactggctgatggtatttatatcagtcaaaaatgaagctggatacatctttgcgtgctctatgaaggcagtgtgttagttggtgaattggccgtgaccaggagaaagctaccagtagtactatgattgtgactaaaccaagaactgaactgcaatgttttaaaaatttattttactaataagtgtacttctgtatagaaaaatcatttttaaaaaaccttacaactattttgaaacattttactataagcctgcctttgatttgtttgggaagctattttatagtcactcaattcatttattgtatttgacaaatactagctacttaccatgtgccagcaccaaaggttcaaaagtgagccctcacagagccttacagattagtgtcagaaagaactgcttggcaagggtaagagtgtgacacattgtgagtattcaagaaatgtttgttgagtgactgatagaatgaattgagggatgatcaaggtaagtcctcgatttggtatatgtacaaggaggaactaagagtttccctccctgaacaggtcagaaaggacatgcttgagctggccttaaaaaatcacctgagtggcatgtagcatgtgaataatgaacaggaatgggccactggtggtagaaacagcatcccagaatatgctctgagttttagcagcacagcccatttctgacccctgcatgcctcaaagccactttaagaatttggtctttgcccttctgtcctcacccccgttgtactgtaatacacgcaaacatgtgtgtgcatgtacacacacatgcacacacacatgtgctaactccatcgttggaattcgactgtccaccccttcaagaatcaaagcatctcctaaaaaaaggaaatggcatgcctgttccttacttgtatccataaaactcacatttgagttgtctatcatgagacctcagttttttgaccaaacattgtccttaagcatcagacacataagaaaaactggaaagaggaacaggtaatatttaaatcacccactattcttgtaatgaaaggatttttcaaacatcaagatgaaatggttttatcaaattattaaagtttgctttttgtgtccgacttagcaacaagtcatggatgggacactcaaaacaggccaatttgggacagttccaactgtaggaggccttgtgtcattacctctataaatggaatcgagcttcccttcttctgcagctatacattttcttgcctttgatttcccactctgctttctctcccggcaggctcttcctgtctcctctatcagttactctataggcagatgtgcctctttttccatttgccagatccccccaacccagatcttccaaactactcccctttgaagtctctattaccgatacaatcacttttgtttcccttccatcccctctctcactgctccagtttcttctctccctaaccccattagttacatctgctgcccctaccattcagcctgtgttaaatcgtaatgcgcttgacataacttcagtttgtctgctaagtactcaatcagcacgcattgctatcttctgatttgtaggaaagggggcaagactgagtaagctggctcagaattctctgagtgattcagctctgcccaattagcacaaccaaagtgggaaattgacaactaataataatgaaagaaatgggttttagttgtgaatataaatcccacaaacttggttcctgatgcctgtggtagatactgtatgcttcatatggtggtcagatggctcagagaatgcagaagtggatgaatgaaggagagtgtgtcaataattgcaatatttattagttgactgggattctttccctggaattcattaatggattttttaaagactctgcaaaccaccagaaattgtatgtaacatttagtatattgatgcatttttttcctgggcagtgggtccatacgtttaagcagattcttaaaaggctctatgtctccccactatccgcctccaaaaaggtgaagaatcattgctataagtgaagacacctatttggtctatgttttcatgtggtctgctttttttcccagcccattttaacattccacatgatttgagcagttcagagagtagaaacgtagggttttaaaggcaaaatttaccttctttaagaggaaaaatgtttaaaccacctaccaggttatacaattcacattttaaaaattattttagttttaccacaattcaaagacaggcctttttttttttatttaacaatgggtataatcacacatctgaacataagaattagttttatgcagttccatagaaaaccaaaatcttgaggaacactttcaaaacaaccagagaaaaataaaccattccttatgtcagtcttgttagggagggattaagaaactggcaattattttggcgaccttaattgttgcgcggcaggaaaatatgtaattagagcacgttcccaggcctgcacacctgcagcacatcctacagcataatgtcagctttcagtgcctgtcggtgccaggttctagcacaaccagtcacagtgacgctctgagaacatttcggactcatgtaatgtggcttctgtgtatgaaagaagcaggcatttacactaccacacaatggagtgcattgctgcaacactggtttcattattttctgacgcctaccttcagcactgccctggtttactccgtttgaggttttattgttacggtataatagtcctgtacatttttgaaattcccttattattcagcttattaatacagtactgacttgattatcaggctgcagttgcacagcggaagattcagtgcattagctaagtcagaagctgagtaaattcttggtataatgagaacaattgtttgacatttttttatgtagaaagatgggccatggtagttctctatatagttgcattttggaattcactctatattccctatatgttgttgagtattcgtttttcatataaagaaagcttaaaatgtgttctcactaatttgaaaagtgtttcagggtatgggaggactccatcatgattctcattagcttttttcttctttttcttttattggcttttctcaacaaaaagaaactctgacgttagaaaaagtagtgaaaatgaagaaacagtatgcacgatgcctatttttcagataattccataatctggcatagtgatagttaacagacttttcccccctaagggagatacactgtattttgctatctgacatgttgtcatatataaagaaatcaattggtaattaaatgatgcaccttgtgaagatgacaaaaggcatttggttgcgaaaagagaactgggttttgaggggtttgtagtgaaggcctaatgactattcataagagattttcagtccgttgatccacttgactggaaagttctgccctggagagttagtgctgtcagtttctctcacctcagaaagccgccgcaatcgacggtgtagaggatgagcgagaaattatctagtagttgctctaggcctgtcttaggtcacgtgcagaaggcacatctggcttcctgtaggtacaacctcaggacataaactttgactaatttttaaactataaatatgtacgagtgacactgaataagttaccttttattcatatttcctttattttagaatgcatgcaagttgtgtagtaagctgccattttggccttatttttcttccaattttaactgttacacacttgcttgttaagctaagagtgactgtttatgaaagttgtcaaggaccaaatgataacagtctccttatgtgaaatccaacaactctgtgtttgctgagaatatgccaaagttgccctgcaggaagctcacctgaaacaaatacagagtatatgattggatagcgctcttggggggtgtttattgccctatttggcaaaaggcagtaagatatcaaaatgtacatacataggactggatacaaggctgccaccacatcaagatctctagaattgcagaacattgttgctccagtgtcttcataaacacaatcacaaaaactacgatgaaaattcatgcattcaaaacagaccagttactgtccaccatggaccaggcaccatcctagctttggaggagacaaacatgagggaagtaaaatctcagtgctcatagtttactgaggaacagacaaataagaaaacagttacactacaacatgtaaagagttatgattgagttgtataatagcacagagtttagaatccaggaaagggttttctgagaactgttggggtctacaaacggggtaaagatttcttatacgagctactctttccattgccaaagccaaattagctggcggaaaggtgagttggacaagtgaggtgtttctgttgcatgtggaatctcaacagaacagtagtggccagcaatttctgtacatatttactcttggaaagtgcttctccatgttatcttatcaagaagctcacctaatcaaaggtaaacacatttatcgcctcattaaggcttgttttatggccacttcgatgtcatgtttgaggtagaagtacctgtcacagtctttgtctggaatgtatgtaaaagggatttcatggacactgcagaggttttaatctttcaatatcaaaataatttaatgcataatatgtatttgagaagatgtcactggtgattcctacttgtgtactgtgtgtactgagttttgctgacacatttgctagagctgtcaaggtggaccaaatgaatggacagatgccaaaaaaacaattatgcttattaatgtacattgattgcttgtttaggttataaaacaaattaaaaaaaaccattagtatttaaacccttttatagctgagctaatgattgcttgtaatatagtgtctggtaaagaatattctataatacctgtaaagcccagctatgttatctaattagtagactttgatttaagtggctgtaattatggaattgaatagttgcctttctaaataaccaaatggtagatttaaatatataaagatgttgacttgattatttaatatttgtagcaaagacaaaccacctaaatagagagattaattccacatcagtgcaacattaaaagggagagaggatgccaagaatcccattaatttgggatataagtgtctgaaatttcctcaaaacatttacgccaaggaataccaacaagacaatatcaagcagctctccctaaggatagagaggtaaggcaaacatgattttaaactgcacaatatcacacagtaaaattaaggacaatgtgttccaccagatgctaaacacagccatttatcgagctacaaggttctagactaagtaagtgttttgtatacatattagctccatattacctccatgacctctttccccatgaagccttccctgagcctcagtatccactctttcctgtaccatgaatccatttttcttttactttttcttttctttctttcttttctctctctctcgcttgctctttctttctttctctctctgtctttctttttttgttttttgttttttgttttttgttttttgagacagggtctcactctggcacccaggctggagtgcagtggcacaatcatggttcactgcagccttgacctcacaggctcaaaccatcctcctgcattagcctcccaagtagcttggaccacaggcatgcaccaccatgcccagataatttttttttttattttttgtagagacggggtctcactatgtcacccaaactggtcttgaattcctgggctcaagtgattctcccacctcagcctcccaaagtgctgggattacaagtgtgagccactgcacccagcccatgttttcaataaagatggtgctatttgaaactatggcatgtcacgtgtatattattttatttcaccatgtgtttaaatgagataaccaggtgccaagaaagcttcaatatttgcttaaatagccaatgtgacggagaataggtaacctcttttctttttttttcttatgatttgctttggctattagttttgaaacatacatgttatattcccaattagatctcgttacatccttcacaggctgtccaaaaatttccatacttctaacaagaacttcggttgactgagtttatattatatagtttttctgtcctttgccctatttctttcaaggcctttgagtcagaagcattcagcaccacggcgtacgatagccaccatttgctttgcccttttaactttgggggttacttctgaccatagtccaactgctcagaagggctttttcacaaattgtttaccgtggcagttgctaccctattggggtttgcattcagaacccataagcagagagcaatggtgtcagtataacaaataatgtgtacaattttttaaaatgctgaatttaccaaatccccatattatgttttcacactgctctttcagaaactgtgctaatacaatactcctataaactgatcttggtcctggcaggccctgttggaactaatggggcctgacagttcttcagttaaaaattatacatgagggccactttcccttaaattatctattgtatgccagctgttcacaactgcactgcttcactttctttgcagtgctagaaatgtctaattttctcataatatccatagcaactattctcatggagggcattgaagttagtaagacttcaaacacaccttcacagaaatcatgctagagttgcagtttccattttctttaattttttggttctgaaaaatgtttagatggctcattttgccggtttcatgccatagcacttgagttatatcataatttctcatttgctgcacaactttattctatttttatgctcctaaatgacgcagctctaagtacccgtgagtggcacttccgtgctgtgagtgctatcaaaggcaacctcagatggataaaactcctggttttttgttttcttttgttttttgttttgtttttgttttgtttttgctggggaggggagaagcggagtcatcaccaagggccttcttttgtttttcaggcatgttaaaactgtataaccaacagaaccatttaaaaggaagaaaaacatcacccaagttccgtgtctgaatgaaggctgtcttctcaaatgctcctcattactccagagcagttatatttggattataattaaaacgaggcttcttttttttcttttattcttcttttttcccagaatgcctcaagtgaagtattcctcccaaagttattgcacctctttactaacaagtgctgggattttaataagcctgtcccccctccttaccctgtacagaggaaaggatggcaaagagtggctgtggtacaaaggttacatattcagtgatattttctgcttttattggtaaaaatggggaggtgggtggaggatttcctttaattatgaaataagtgtgatgttagtagttatttctgtaacctggtgaaaatgctgcatatttcaggcctaatttttagcatatgttaccacgtgtgtaataaaacggtgatctgcgctctccgaatcttttggctgttaaggagcactctgattataactagttgctgtagaaacctggtcatccagatgcttatcaagaatgcattattattttttaaaccttggtggagaagccacagactgcagcagttggacaaggtcacatatcgatggaagtgacatgtctttcctctttccattgtgtgatcgtccagggcctgggggcattaatatgcaacggttctgtttttctttcagaaggacttgtaaactctttaaacagaggcacacagttgcaattgttgcggtactgagtgggtgtatagaagctagggctgcagccttgtccagttgcagatagaataaaactgacaatgatgcaatgggcctggcatgtagacaactctgtgggatggatgaatggtgcggctctcgctgtccctccggtggtggtaggccctgtaatagctagcgtaggaagggtggtgaaaattgatatgcactattactacacgtataaaacttaacactggggccattgcacaggtggggggttcctgtttattgatttttatgagtttgttagaacatgcgcttaatgcttttatactccgggagctctgggagggctcaccttaggtaataaacctttccgtactttgcaatcgctcacaatttacatggggactcacattatccagtacaaagcccagcattccccttctacttggttttaggagtgtgataaaaaaaaaaaaagaaaaagaaaagaaaataactatagcacttactttgaattttttgaaaacctgtccactcccgctatgaaaatggcccctaattctaattactcatatttccaagaaaaattagtcacacaaacttatgttatgtgttgtctcagaggttgaaagcaaatcaggtttccaataagacagtacatcaaacaaagtagcatgttcttgatgccgatgacttttttttagaattatggttggacatttttggcagacagattgtcttttgctctatcaaaatgacagtttcttttgtaactgcaacattcataattagaaggagagaagcaatctgcccaatttaatatactaaaagaagtttagagtctctgctagtaatttcattatttttaaatttgaattaattgacttaaaataatacagttaagaagtataaccagcaggattatggagaaaggtttctttttccttaaaaaaaaacagtgctctcagtgttacacttaagatgagattgaaattttcttttttacgccaggtgccccgttctaagattcagagcagcaatgtgaatattcatccttgcagtggagctgagagaagttgtagggcaaatcctgggaacaaggtcactttaaacaaaaaagttctccaagtttcccatgcttataaggctggctgggcttaattaaagtcaatggatgaccaaaaaataaataaataaatagagagagagagaaagaaaagaaaatgaaagaacaaccacccaccccatatcagtctctttctaggcctcacttcacattgtataccttagccgttgatgttcaagctctttacatagatcaagaataatatttcttaaatcccttaacaacactgacgtgtccatggtttaatcactcttccccagtccacatctctaacctacgtcacttgggtggccctcacccacagcaccacaacaaaaacaaagccagaattgcattcagaatgaaatcatcataacatagcaaccttgttcaggatgtgacctttgggtttcagcaaccctgtcttatgcagccctggccaaccttaacctttcctgttggctcggagggtaacctttcttcatattttcttcaggatctctccttacgggacccagtatgttgcatgcctatgatgcacagggccaaaagtttcggagtgttaaaatctacgagcctgttttcctctatgagagaatgaagcctgcactcattttaaagaatacatacgtagcaagatctctttttacccttcctgtataattttggttatgcttaactctaaaggaaaccaattctctttagctctgttaccttatttcgtaccttagctgattgtcatctttacatgagcatcagatatggatgtgacaaagattttttagaaataataacgaccagtgctttatgagttgtgaagtgtttttctctcccacaagaaattacaacacaaagtgccctatgcatttttttagtatgttgataagacagcaggaaattttttaaccctcaaaactttctgattataagctgtgctctaaatttacacgggcagtgttccaagtcccacactcctttacaagtatatcattacagacctgcaagtgagaaggtaaatttccccatggcagttctgaaatctgacttcaggctaagaggccatggactgagagggctgattgtgctgggtacctacatatcaaaatctcctctagtattttagtagttccttctgtcctttttgcagccccgtgtcctacagaagtgacattttgttccattttcatttatcttactctccttagttgtatatcaaaagatatacacatttatataacccaagaagccagggattaaagcacaatatttcttaacacagcttcctctaagatctccagtagctacctaatgcttaaagcttgggctgacgtgggttatggggttatagtagctttatagatatttctatttgtgtatgctatgtttatatatgtaatacatatatgtgtggcttagggctatactgacatgttattttctatgtgttcatttattataaacagcaggcaagcagacgtttcacctcacacctcactctggtctctatcattcaaaaaatattgcaagattcccattctaaattaaatacatccgagcttacgtcttttatcaattctttattcttggtatctcaaaattctggtcttcgtcctttgtctcaaaaagggaaactgctgaaagcatttccacctggatgtttaaattatttaagttgcaggaaccagaccttttccctcctgagtagttgtgggttttaaaggctaaaattgcttcatcatgccaaagtgaaagtatgcataaattatttagttaaacctgagaaaatacagacttttcccagtgatctttcaagggctgcctacttaaatttcagaagaatgggcaagatttttttttcattctcttagaaaattgaagtatctcttgtgtcttctgtcagttggaatgtgaacaaaattacaaaatggtaatttttttaaaattccaagcttcataatatccagtatatctatatcattccaaggtgaatactgtgataatcaatcaataccaggaagactcctccagctggcgagaactgcaaaccctctctcaatgtattcttaggaaaatcaggcaacttgttataggtctttccctagtgccaacctaaagactggggggcatttccgattcaatttctagtcatccagagttggtatttcagttttaaaagtagaaagttaggtaattttaagatgttatgaaaactttgttgacatttttaatttgctttttaaatttacctttacttcagtaaataaaaataccagaaaagtgtgaagttgtgtggtggtggtggtggttggggtgtgtgtgtgtttgtgtgtgtatgtgtgtgtataagatagataatattaaagtagcaatgaaaacagcccagaaatataggcaattgaggcccaatttcaagtttctgtagcataaggcatgtatattacagaatgtaccacattatgtatctgatctctaaattcgccttagtataaatgctccaagtacattcttatgaccaagaaaagaatggtatttttaattgaatacctaacctcaaatcctgaaagaaacattaattgggacaggacaaaatgtcaacaaaaaagtacttatgtgagttatttagtatacagctgtctgttcatttgtagaatccatttgaattttatgttcagagaaattgggagatgagagtaaatatggggggagattggcatgtaaatttgttgagttttcatgaaaaaataaaaatttaaaaaaccttccaagcaaaataaaacctgttccattcacaaatgatggatgtcactgatcccattaatacctgttacataccaggtcctcttccttatatctaacttgctttttctcccaatttcagtgtagttgctcttgaccttgcctttgttcttctctcctccttctctcttctgcccaggcacagttatgtccactaaaccagatgaacaagatttcatactgacaccaccatactctgttaaatagttaaaaatcctattttggcttttgtttgctcacttagatttgtacacccaaggtgatgaagagagcacagatagaatctagagacaaatagtttctggagtcaggaatcagatccagattctaacacgaggtgatgtgggaaaaagtcagttaaaatttctgagattcaatttactcatctataaaatcatcctcataataattgctccccccttcaaaggtttgttatgaggagcaagtggaaaaatgtctattaacgggctctgctgtcagtagattaatgcataaatccaggtattattatataatcaaactgtccttttaaatgtagaagaaaagggtttttaaggcacacatgagattctggaaacgtagacgttatagaaagtctatagggactaaaaatgcattgtcttctatatgcatttatcttgccagaggtacatgcagacctttggggggtgctgctctggccaggacagtggtggagagctctgactcttgagtgtgagagctggaacgattgagaaaagacaggagggaaacttcgaggtcaggtgacttctttctaactacagcaggttctcagatccctaggctggcccaagatgagagaacagtcaccaaagagagtctggcacagtaagcctaagtctcagtgtcatctgattgtgaaatctgcttgtttgcatactcatacagtaccagagcttaagccctggccactgtacggatgactgtacaagagcagaatctaagaccaaggggttgtttttactaaggaagaaaaatttattagagttacttcaaggaaatctattagattatctcaccaaatacattaatagcatcaattattgtattttacataattttttttacaccagatacacagtatattaaagaatttgtggaagtcccccatgtgaaccagtattaaccatgataagagtaatcaggactggcccaagaaaggtagaaatgagaatttataaacttgtctaattctcattgcttgaagaaaattgaaatgaaagaatccaaaaagggatttatgaatattttttaaagcttaaaaagcccacatacttatcatcgaattgtctgcttacgataggagctggaagagtcccttatatccactcaactgtacttacattttaaatggttgttttcctttctcttacactactacaagagaaaggaaatgcctaggcaaataaactcagttaaaataactttatggttgtgacacagtttgacaaaagcaaaggaaattcagagtcactgctcacactgtatcctcagctgattccaactgtggaaaataaaatgctttaaaaaaaaaaaacaatggaacaaacttgggatggatttagtcttagtcttagaggcagccttcttaaatgctgaatctctgagttcgccatctttaagttcttataagagttgcaatatctgtattcatcataaatctagtcagagttaaagaagagtatttggttaagtactgcttggaaaatatgttgtccttttttaagattatgtgattctaactcaaagctgtaacttcttgggggttaataacctaccttgagatatactttaagtaataataatggcttcttgggattaggaaagatattaaacttacccatttccaacgatcctgtactattgcaggagagatgtggggagggagagaaagagaaagagagagagacgagagaaacattttgaccaaaattccatattcactattgctatgcaaattataaacctaacagagaggtgatgtatcatttttattaaacttatgctgcacaaatagtgtttacatagaagagtataaagttaattccctcccgggaagcatttctaaaaaatataaattgtattttgagagttaatcaatttgttttttctcttttggcattttaattgaagcttccaaaccgtatgcttcctcaaagtatcagaaggcaaatatcagtcgtgtggttataaaatcaactcttaattttctttcaatgaagtagcagatagtcagcctgtaaattttacctacattactatggagctgcagtgctataaattcaaaacagtgtgcaggttggtggaaattgaggtccaggcagcaaggcatgtccataaacttttctcaggttattggaacagaacgaatcaaaagcggttcctggttgtatgatattctcttttgatagagcaggctgcttgttgttagcaatccaagtgcagaggttagtcagagcagaatgtaatttctagcaatctgacagacctgcggattgaagcggcaggttttcccttccgatttcagggaattgcttcttactgtgacaaatgattagctgttatctctgactgaatttgatttctacaagcagctgagtcaggtaactttgcagcgtttgagggggttttttacaggaaatgaaatcggctccctagtcatatgtggaccaaatgaaatcttctctgtcagggcaaaattgtgcttttggttaattgaaggcagatttagcatagagggtgtgtgtggtgatgtgtgtgcagggtgtgtgtgtgtgatgctctgatggtgtaggcaggcacacccatgtgtgtacatttacaggaacgagggatcatttcatggattctctcccaactttgaaaatcctgggttcaaacaaaatccctacattctgagcagggttgaagcttttagaataaactataagtggagacagtcatgtgggtgtcagaataatgagccttcatataaggacatcctgtttcaaaagagtttgaactgcaatattaatcaaaacacaatagatactcactgagcatggttttcacaaaagtattcatcaaagggcagctgcattcaaagcaagagatttaggtaaaataagttaatccttgatctcatccaggtttgtgtgtaaattttgaatagggaggggttctagtgatagcaagcgtcctctggatgataaaacaaaaaacgtggcatgggaaattccaggtttatcttgtgcttcttgttcgcttttgatggaatcttaatagtgactacacaattaggatcaggtttatccttctgtttatagtttgtaattgctctggaaatcctgagtttcagtagttcaacttttagtttttaagcagtcggtgagttttttaaaaagttactatcggataatgtttcatagtttctaatcctattacagcaatgtaaaataaactgtatttcccaaatacgaagcaacatcttttattcccagacctcttactttgcaaagaggaaacaccatctttaaggtcatactagtaatactccttattttgtgatgaacataatatactttgtttataaatcctagtttaaaacaacagagatttgtggtaattgacgaagagtaaaaaagtcacaaatactgaatcttcatttttcagatgtgagcacaacattcctaggtatgtactaatatattctaacacggcattgcgctgtcatcaagacttttgtctaaatgtcaccactattatgagcaatacttttgctaaattctttagttgtattccctaaatggcagatacctttggacctctctctcattagctattaaaaagaatagttctttgaaaataacagttctgtgctccctaaacttcttttgttttttgttgagtgatgtcaacttagagttccacactgattgcccttcctccttgctttgtcgccacaaaaggggtgagggggtgccggagtttgacccacacctctggttagtattaatcacacagacatcaggtaatcacctaagtgcactcagacatactaatagaatgatttacagaccaggccctttgtgtttttctaaatctcattttaatttatttaaagtgacagtgaagctagactccaagctaatgagtctgcataaaaatgatttctttttccacctttgtgtttgctaaaactttctgactctgaaatcctgtcagtgaaaaattatttgagatgaaacactgcaaaagaaggtaaggggaaaggagacaaagaatatgatttgatcatcagagacctgccctgggtccaagtgggcctcatggtagccacaagtgtccagatcagacaaatggggacttttgcatatatgttttagtgcttcatccagacttgagtgcttcacagagtctgtgaggcaactcacatcctttggtagctaacaaattggtcctttctgaccagcaagcagtttaagaaagctaagctgtgttgtatgcgtattaaatatagcacgaactgcttggctttgcttaaccttagttgtattaacagattgtttgttttgatgactgcgccgttagcatgccagatgataaggaaatggttttggattagttaggacctataatatagaaactaaataagatgatagacttacaaggatatacatttcctgtaaaaaaaaatgaattcccttatcaggatttacttgaaaggaatatgtcttattacagaaggagaatgccttgaggaatgtgggaaagattaaaggcttttgtcagtagtttaggttgggaccaggtttcctgtgtagccagcccccctgtccccacgtaaatgttttgcttttcctcctctctctctttctctttaaggggaagagtaagcccttctcgctgcctggcggtgtcagattaaataccgagatggcgacaggaaaaaggctggaaggaaaaacaaaagacaggggggtgagagttatcaggttggcgacggaactgcaggcttgtcggactccaatttacagaaatccaaacagattttagttgacacgatctgcaatcattaccgccggagcagagctaattaagaaattagctttcctgattgcctgttctcacagtgatgagtagttgaataatgttgtatggctgaaatgttctaaaaccagacagtttaacaagtgtttagccttttgtggtgatgctgtatttactttatctataatatctgtgctgcatcactatttgtttcctctccttagaagcaccccttgactttttttttccttttccttggttcaccctcttcttcttggcattaagtcagagcttccccccttacttcagccgcgtataggagagaattatcatacagatttgtggcatgtggtacagaaaagttatcggaaacttgtggcacattcaaaagcatatttcctacccgtctaggcatttttcacaagaaaatatcaggtccaaagtggcatttgaagtttctgaatctgactaaatgcagaggtgattgtgaataaataacattaaaaggctttagtcagcaaagatacagtacgagtgagtggagctcattagaaactagccgtggaccccagatatgtcaaaggggggtttgctgagaggtgaccacgcagtcttcataacttcctcatctctcccacaactatcaaacacataggaagatgttatttggagaaaaaaaatagttatgtttaaaaagcttgacaaagaaattaatcaaaatgagcttcatggaccttgtaaaatatggtccaggcacatgtaatgcatatgtaataggcatgcgtaccgatgtgtccatatggacaaatagaaaacccaagagttaaaagtttctgcaaaaagacaacaacttctttccaaattaaatagaaggcttatttgaatataaactttctcgcaatacagcaaaataacaaagattggacaaaggtttccaggtgtcactgttgaaactgcaatgggaggtaagagtattgctagcttcccaaatgaaccacagaaggggaagttgcatcattcaagatgcttatcctttaggatttccaagttttaaaatgtaaatattcatctatggaaaaaccaaaatttccaagttttcctagtacaccttcaaatcatttctacacctaagaaaaataaatactaatttttcttaatgaggcctaataacacctttaacttaccattttaagagacgctaagtcaatacaatgtgcaggtcccttctggatatttattttcctaagcacaaattcatttataccgaaaaaacagtggatgaaatactagaaaaatcttttctgcactggacctctcttttccagatttacctaagagaatcttaccaggaatggagatagacttttacttcctaagtagatttaaatttaacaccaatttattcactctagtatttctatatgggaactaacagcttctataggacctctacaaagtgccagaaatatgatctcatgtgtagtaataaatttaaatgtgttttcttttacatattctatccctccgtattttcccaatctcttccttttttatgactcccccactctcagtttctaaaatcacttgtccactccggagacccaggggcactgcctagagaaggagctaactttaaaaaaaataaaccaggctggtcacagtggctgatgcctgtaatcccagcgctttgggaggccaaggcaggcggatcacctgaggtcaggagtttgagaccagcctggccaacacatggtgaaaccccatctctactaagaatacaaaaattaaccaggcgtggtggtgggcgcctgtaatcccagctactcgggaagctgaggcaggagaattgcttgaacccgggaggcggaggttgcagtgaaccaaggtcatgccactgcactccagcctgggtgactgagtgagactccagctcaaaaacaaaacaaaacaaaaaaagcaccatactcagagctgctataagtaacatgcagttgtaagccacacacttctttgcatgattcttattttaaagattggaaagtagaattcgtatttgtttgttgtactaattccagtggtatacctggaattaataaatggtactaagacactaaggcgttactttcttgcattattctaaatcagagtgttgattagagagaataatccaaaggtaaaatagtcagataatttatttttatgtaagtttaaaaagagaaagagattgatttttttgaagagttataattacattcagtatgtaccttttgtgcattgaaataattttagattttctgaaaaggaaatattgatgtaattcagctctcaaaacacttgatgccatgcctttcttcctagtgtttatgtaaaagcaagtggtcaattgtcgctgcatcagagctatgacaagttcttctatattaggtgggcatcactcaaacacttttccatagtagatccagtggtatacctggaattaatacaatttattaagtactaagctatgttgtatttattgtattaattccagtggtaatacaattccagtggtaatacaatgtattaattccaggtatacctaccactggaattaatacaataaatacaacatagcttactactcaagtctattacacgccatctaaaatagctaatcagaaaggctgtatgtctgaaacacccaaaagtcactcatcctctttcttaaagcattaaaagttttggcaacttttctgaatccgagttgtgtgagtcctatactgtactaagctggacatcttaagggctgcaggttttaatatttacactgccccgactcagttggtaaccgctagcaaatcatctcaccccagtttttgtccttttcctgaagaaagctgaatttggtttcatgatcactgtttgctgaagaagacagtcccaacaatggtccaaagcaaggccagcttttaaaacagccaccaactctgagtcaaggcatctaccttcattctaatcaagaagggaagatacaaagtttcaagaccagtcttcaccttgcactgaatctgacggggtcttactcagccactttccactacctttcaacctaaaagccaagaaaagcaaggatttggattttaaagctgtacttgttataggtgttcatgggttttgttagcattgttgttttttagggatgaggggtgttactggagtggaagggggagctgtgttgcttttagtttgtcatttaggatgttaaagttagtatgggtttcagtttgcattttaaaaattagaatggtaatgagcaaggtgccagaaggaaataacaaagcacattttcctgaatagctccccctgtcttctgtgttcagattctactctgacttcccaacccggcttcctctcccgcctgctcccttctgaggtgcagtgtagaagttcattctcaggtttctctcagtttgcaggacgagatgctgccggccaggccaagggcagttatgccagctcagtgtagtgcagcttccttgccccagcgtgcgcaggctgaaagctcagccagtttctctttctgaggctgcttcacgtcttctcagggatttccaaggcacggacgttcatttgcctaaaactctcttaaactgcctgacaaaaaaaataagtacctaagtacgacataagtggtacacccacgcaggataattaggattgatgtgctcttttagaggcaccagatcctcaacctccccttactagtggcatttctcacctgctcatgtggtgcccacctgtggcttgctggcattgccactgcctgcgagtggggagatttccaagttcaaaatgaaggcctgattttacatggtggaacgctgtaggactgtgtggagctctgtgaaggaattaaggatggcatgaagtcctagtttatgtcactgctcccttgtttatgttctttccttgactattcccacgccccctctccagattttgcatggcttttatagcctctagtaattatatcagcagcatggagtctatttttatctcttctgaatgtgtgcaacgtaaatgtcaaaaaccataaaggccctttttagcatgtaccttgcatgcacagtttgaaaagtgtgatgcagcgttcagagagatgttgcattttgaggtgagacagatgaaaagtggaaaactcaatttcaccacttagctgcgtgaactttcagtaagtcctttatcatcttgaacgtttagcattttcttctgtaaaatggagtccggctgcctacctcatagggtggcagcatggaacctagtttagtgtctgggatgccccctttccacagcaggtgcccccaaactcctaaattatatatttcatgcttaaatgtcatgacctttcaatgccctgcattgccctttatccaacttagaaacggagtaaaaataaaatcttaccactgtaagtcacaataggattgtcacaaaattagcatgtgaaagaatgatacggaactcactgtcaccaaaaaactgtccctagacttggctaataattataataatacctagcatttattactaagcactttctgggagctggtctctaggtgctttacatgtaaccttcacaaccatccactgacccagtggatagatattcttgtcctccacttaataaaggaggacatggaggcaggttagataacttaacaaaagtcacaagttaggaagttagtcagctggattcaaattgaagcatcctgatcccagaacctacagaaatataaaatgtctatcaggcaggagcattcacatggctgagctgccccagcttctaggcaaggttgtttcctctctttgcacttcctatttgaagttgggccctgaaagcggctagatgggcccgtcagaagggcatgcgaagctgcagtcccttactcagctacgagttagggaccatcatgcttcaaaggggaaatggcctcagcatgtttaggtagtccagtaccatggtacagtttttatggctcattaatttatctttaattgaagataagttgggagaatttagagttgtgagaaaatgtgttgttttctagtcaaaaattctcctgtagttgtgatgaatggacaagatgggagtaactgggggatgtggtaagggataataataaataataaagagcatatttgtaggccctcaacaaaatctagtgatggaaggaagaacatatataggcatgttagacatatgagaaatatcataatacattttatgggtaagctaagaagaaccagttatgcaaattttctctacttttttatgaactacttattgattaccccagtcatttttccattgctaccactgcataaagcagaggaagccagtgcagtcagaaccctcttatttatacagtaaaggctattaccgaccaagtacttagcagccagagaaatcttgcgtgtaaaacagaactgggatctgaagaacttagaatatgtcatttaaagaaatatgatcactggtatgtactaaagtgctccaactttttaaaaactttaaaatcagttgactgaaatttacagttattaaacttaattcttttttttttttttttttgaaacagtgtctcactctgtcacccaggctggagtgccgtggcgcgatctcagctcactgcaacctccatctcttgggttcaagcaattctcccacctcagcctccccagtagttgggactacaggtgcaggccaccatgcccggctaatttttgtaatttttggtagagatggggtttcaccatgttggccaggctggtctcgaactcctgacctcaggtaatccgcctgcctcagcctcccaaagtgctgggattacaggtgtgagccaccgcgtccagccaattgttagtctttggtacggtgcccatgagtcatcaaactcatatgtggaagtttttgaaagaagaaaaaaaaatgagagtagattgattaatgactattaaaaatagcctgggatctacgaatacccatagtaaagagcaccaggcactggatagataattggtctaaagagcctggaccttgctgaagataatatatacatgtaacatgttttgtgaaaatggagtcctgaagatgaaaggtgtatcttttccatattgactacgtgacttaattgctcacttactaggctgagaaaggggagcagaggggatgtggagagggaagaaggagggaaggaaggaaagaaggaaggaaggatagagggaggaagcaaggaagggagggagaaaagaagggaggaaggaaggatgtggaaggacggaaagaggggaaaggatgattcaatatcctttgactactaacatatggcctatttggggaagtagacgatggtgcatggagtctcctgaaagcatcatatgaatgtttgaaaatgttattgcccacacagtgcaagtgcatttaggtatgttttaagataggtgggctaactctgaactagggattcccaagtttaactgccttatgaaggttagaatttgagcacttaagttcagggaaggaaggaaggaagggggagagagaagaagggagacggcactgcaggtagagtatccccacatgtcttacctcttctgaaaggctgatgcaacaaatgcgactgaaaagccaaagtatggatacgttttcaatttatttctaaagagttcaatttaataactgtctgagactgaaaccattgacacagcagagcttctagtaattataattctgagattccccaaagtggaaagtcctaggaatactgcctgaaatgacagtgcatttgctgttcaggtaaaattctttaggaattttctctgattctgatttctatttctaaaattttcgatcatcttcaccattttcccccaaaaaatgaggggtgcatttctgtcattttgtgtgtggttgggtggtattgttgcgtctcagttaggggttgtgaaatggaagctctggagggaggaaaggcattcttggtttgcaactgagagcaaaaggtaccacctaagcatcttctgtgagactagggtgcttcctttagataaatgtgtatctgtaatcagcttaactaagcaggtaaggtgttcattagctaggcagggttttcaaagagagagagagggagagtgagaggaagagagagagaatgaatgtggaagagtgagaagaacaaacaagtcaaagcatttgttcatgctgcaatctacacatcaattatcccgctgtgctaattaccacctttccataccccaggtacctaagcattcacacttactcactttcatgcctctgatcaaaaaaaaaaaaaaaaaaaaagaggaggaaagaaatgatagaagcaggggatgatgaacccagaggagaaatacattcttagatcaaaatttcctttacatatgaaagtataaataaggggtcttctccatcttgccattgttgttttagacaattaaatatttgcaaatgttttaattgcaaaatattacttactgtcaggcttccaggagtgcttccatctcatcagcccttgtttccatacttaaaagaagacagagaggtgagaattgctggtcttgcctgagattttggggttgtgccattagaatgagatcagatcattaaaagtcagtgactactaattatcaggctacttttctgaggctattcaagaattgggcagtgaggagccagagagctacctttgtatcaaaaccttggtgttccccctcaccgactgaaccttcatctaacaattaaacattctttattatgatgaaatctgggcttggaatccctgttggtttgtgggcttccttgtcagggtgctcattttctcatttcagagtgaagttggataaaaagaaaacctatttcctgtagctcatttgatacctggtggggatgctattcaggtgacaaggatacaggcacagagggggaacagatgtgatttacacactcattatcatttgaatgaaagtgcagataggcctgttcaggggcctgggcatcacctggacagctttccttctgatctttatcccatctgagaggccaggtccccctgacatctttaaatccccgacccccagctggtgacacacagagttttatgacagtcagcagtcctctgaagctccaagcacagatgccattcagaattgtgcttcacactgtttttttcattgtgttcaggcttaatcaggaatatatccaaaaaaagcttaacttgaataatttcttttggtacttctccagaaacctgtttgccactcgaagtttgtgtatagtattctaaagggcctcagattttgtgttcttaaagttatgtgcatacgtagctgcttcagctttcgaaaaaggacaacaaaatggaaaggaccataagttatagatgtcatcaaagtcttatgtttctacgactatcagatcagatgagcttagtattgtggtagatgcagtcagaatgttagagtgcaaagacaatagaaagtttggatgaagctaccaaaaagaaaagtttctgtttggcctcttttgctcttcataaaggattttcagcgtctttgttttgctacctggaatggctgctgtcaccatgatctctcaagcattttgttacttatttgtgggatgtgtgaataacatggaaaaattgctatgtcatctgaagacctcaaatgatgagtcctgaacagtacaaactgtttttttttttttaaatacattttcaagaaagcttgctttcgttcaggacaagaatgcacaacaaccttgaataactttgtttttaaccttcccttatctcaggcagcctgacagttttggtggggagcgaaaagtgaaaggaatctgtgagaacaaatactgtggtgtttcatgattttaattaggtattgtattaaagagaaaaatataatgaacacaagcacatacacattttatttcccatctaacattaacagttaaagaaaacaatcactatcaaattactttgttacagtccataattacaactcaggttacgcttaactgttattaacagaatgtacagtaatatgttctggcatcgtaatatgttattgtagcattataattaatcttacaggaagtataataaatttacagtatcagattgaagcaatactgcatatagatttattaatgcttttaatcagttctggcaaaattaattttgcactgattgcttacattggaatttgcatatacttagtgaaagtaatttattttttatggattcctttttattaaaatagggcatatggccctttagctaaaaaactttgtggattctttagctaaaaacatttctaaacattttgaaatgccatatatcttccctttaagataattctttctcttaagatttatttttaaattatattctttaaaatacttttttaactcttatttcaatgatctattttttgaaactgtaatatttatttccctattgtcattagcctacttttccccaaggatctaagtttgaataaaaacacaggccttgaaaaatatctacattgataagggactgcattaacatttcagaaagtgtcatgtgaaaattaaatatcattgaaaaataatgaaattttactctttgaaaagtccagtaaaaatgggacagcacatgagaattttgccattatttctaagtgcaactatgttacaatactccaaaatgctttctgtgccacgcaatgtatgtgcagaaaaaaggcgagtgcagattttttaaaaaaacttaaactgatatcagtgttgtaagttcaaaaatagtattgagaaaaatatacctaaagtgtctttctattaaaatatacatgctttgtaaggaaaggtaaattattcaccaaaaaaaatcaagatgtcttcataaaatatatgtttactatatcttaacttgtcaggcaatttgaaattttgaataaactcatcacttaaatctttattttacctctttcaaaaatagtaaattaggtgttcctgtaggtattgattaatttattttgcaaaaaatatttgaagaataagggaagagtgatttcttattcttataagtcttaacaataaatatgttccttggcttgaaaattgagtgagcctaacagtacatagctttcttttcctatgttagtgagttacattatgtaaagcatattcatgaacttatatagattctgggtagttctgatgatatgaaactaaattttttaaataatttaactgaatattttgatattgcttgtatcaggaatttcttcactaaaagagcatatatgcaacagtgtgacctctttgggctcaatacaaaagtgatttgtacagtgattctgtgattttccaccataataaattgagaaaggcaggtcttggtaaaactttatagtcatgtatgaatacccatattcaggtcttcacctccaagagacattcattttaatttatgtcgttgtttatcatcaaggaagattttgaacttttgagaattggcctttatctgtcctaaacctctaacattccactgtatcttaatgaaacggaggttctgttctttctgcccagggcttctgataagtgtttgcagactatgtaaacttctgaataataactttcagtaaggcaggagtcttaaacctcttagtatcattttgtgcagtattattctgctctgtaagataatgtgttatcaatacttcataagataactttggccagagaatgaataaaatttatagtcactttcaaactgctccctttttttagggtgtgggtcatagatcatgcagctgtctgccaacagataatcttgatgagtaaaaagaagctaacagagaaaaaggtggcttagtctaaaacacttaggaaggacttaaaaaattatttcccaaagaattagggagtaaaaaaattgtaagtacatttgtttacagtaaaagagtggtctctttgtttgaggaattttccttgccacctcagaaagtgaaaatttactccttttttttttttttttttagaaaattaatgctggtgtgattgtttaacttgtgtaacctgttccttgaggtaaaatgaggaagaagcatatgatttggcctctcttttcagtgaaggaaggaagtccatggaaattactgaaccaaactagagatctaaagcaaaagcccttttgtgacacagatgaactcaatagtgcactgtgactatctgacttttgccacgtccaggcttaggccgccaagcggccagggtcagcaaattccactacctgaaaatgacagaaggcggcagggaaggggaattgaggcatggggagaagcagttgaagcatactagggaggcatgaggttctctctctctctctctctctctctctctctctctctctctctcgtgcagctaaaggaagagaaggaaggaaaagagggtgatcattgaacgactttaggggcaagtctggagttaggcgctgtggtgtccaagcagagccgtgtctggtggcggcaaactagattgctccaagcatggagcgccctgcttgaggacacttgttgttggactgtttgtttacatgcagtttgggtggcaaaaaaaggggaaagtctgggtgacatcagctgcaagaagacttaaccatatgccgatgtcatccaacccccaattatttgaacattgtgaaggttaagacatcaatccatccatttttctttctcttactctgaatcgtgacattattttctctagttcattgaccttgttggcaatttacaccaccaatataagcctcaggatccttttgtaaaatgagacttgacactaaattagtcaactaaaaatttaaagggtaaagggtccccccagccacccactcctgcccctccctgtactaaagtagaaaatttggacaaggcacaccatgcgtgtgactcaattgttctggccaaaaaatgggatgaataattttatttcatagatgcttggtgattactggactttacaaaagttaaccactagttaaaaaaaaaaaaaaaaaaaaaaaaaaatatatatatatatatatatatatatatatactgcttttgggtactgaggttgaacaattggtcggggataattccataaaatggatttaagtatttaacaaataatgtaaatgtatagagcaggcctaaaatttctccactgcctttgagtatacctttagaagtttacaaatacatgaggataaagcagtttcaataaaatgatcaattgtacaaagtatagaaatataccaagcgtctcttaagtaaatgattacaacatttagaagtattcatgagtttgacatatgcaaagcagcctatctctcatgagtctgagttccagcctccctgaacctttgtgcatttcataggctggtgaacagcccaaacatgtaaataaatagccattcaaagtgcaagcatttttaaaagtttaaaactccacacaagttcttttacaaaagagtccacccttttatgtacctttaaaaacatttagccactttattcttttgtgtctttgaagagaaaaaaaattaataaagttgtaggatccttttgaatttagaaaatgttggcaatgttggaaagaaagacattcagcatttcaaagttctggtggggaaggaaaaaaaagattctgaataaaacaattttatgtgattttgcaggtggtttgagctatcattttatatgtacgtttgtaccactgctcattggaatgttcatataatactgacctaattatgcatagaaaaagataagccatttacttgattcatttcttctttttaaatcaagaaaggaacaaaaaggctcctattttctgaaagaaattgttcgcttttattgcagaaaagtagcagcttgtgcagagctagaactgtaacaattttatattccaaaggttttgtgtgtattcggttagttacagtaattatacccaataactgacagccaaaatcacgtaggagaaagcaaaggctgttttctcacacaggccctgctgcagaacatctgctgagagatttgcatattaattaacccatattaactctaattattctgggaaattatcaaataaattgaattttctaattttaacctttcttttacttgacgcgtgtcgaggctgagaggacgcaccaggccgtctcacctgggcaatgagcaaaagatcttttctaccccttttgctcctttagacctggggcagcctggggagcttttgtgtgccttgtgcttttttggcttctgtgcctggtagggtctccatgcatttgttgagagagggaacatgtgtgcttgtgagcacagatggtggatttatacaggggtgaggaaaggtggtacctcagaacagttgagcaaaccttaagtttttttttttttttttttttcttcctcccagcctgttgtttaggcctgagcaaataaatgggagtttaattcaattagagcctggctgtagtcagtgcctcatgacagaaattattcaatatttttcccctcacattgtttggtttacacatcactgactcccttccttttgtactctgtttagagtggccataatgtgttgagcttttgtgtctgccatgtcactgtccctttcaccgttgtctggttttgtcaattgtgaggtgcaatgatgctgttttgaaaacagggtcctagtcagggtgttgctatgtgagtagggtggctgcagttttaaacatactacacagtaaataatgtcattagcccaatagacctgaatctactgctaagccttaagagaaatcctttgggtagggaagtgaactttacatgcctttctcaggtattagatgtagcttaaaactgagatttcaaagataaatctggtcagggcagtatgaagaattggactccattgcatgatcccctttcaggcatttctttggggtaagaggcaagattgactgagattagaattttttgcatgtgatcaagtttgtaacgacccatactttaagccacagcgatcaggagaaagctactgatgaaacctctaccacaagcagatctccagcccccctacttcgagccacatctcttctaaagacctatgactctatttccccctcaatgatttcacttctccccatccactaagatctattaagatgagccacacctcttgctaccttgaaggtaattgttttcctctggaagagctgttctttcccattatttcagctgatggagtagaagcattacggtacctccatgtaacattccttagactcaagaattattattgacttcagtaaactgcagaaaaccaagaaagtcaccaaataggtctgttggatggacaaatatttgaaagcaattatttttatggataggctagaactccagtctcctttttcatggaagcatggaatgccttttgcaagaaaaatatttctttaagagacaagctgttgctacttcagatgaaggtatgggttcatgctaaggtttttgaggggaggtggtttaatttcgtgggactacaatagctaaaagtgtatttcagttatatctgtatcttagaaaaatgtacagttacagacaaggtttagggtggggcaactaaaacaatcagagaaaatttttatagtttttctatttcgtgtttattttttacagcacattccaacgtactctggcagttactgactttacaccttttatgggctttgaaagttgtgtaaccttttcagaggaaggtgatagacacaatatctatttacacaaggacacatttcccctttctttatattccgtttattcaaggttttatttccaaggtcttattactataaaacttaaagctagacaaggtctgccctcatgtcagataaaaaaaaataccaaaacaattttgatggctcagaagcttattttttcatacttccaggtcctaaataaattacagttattttcacattcctcttgaatatccttcaggcatgatagtgagcatattttttctgtaaagccccttaatactttccttctgatggtttgtatagagcaagttgttgaatgatcgtggattccaataattagagagagtcttctaaaatctttttttccttttgacatattgttggaagacatatagtcacttgatgtatttatgaaagtctgtggaattattggcagtagatgtacaatatatatgaaattatttgtgtatagcagttgttttgggggtcttccctcagcatgccatcatgctaggcttgctgatgaaggtgctgttagactttttagccatcaaagggcattattgacttgtgttctggaatatagctaagtattatgtccttggattgtaagcatattatagatgttgacagaaagtgaagctgaaaaaatttctaaaggatagaaataactacaaaaactcactaaatgaaaggagcggtcaggggcctgtatgtttgaaacatcaatacaatgactagtttcctttggtaggagttaagtaaggtaatcaaaaccattatgagtcctagatatacaggaaaacccgaatatgtttacttttgtaaaaaaataaacagatgtcaagtctttgggaaatcataaatttcactgagaacactgtgacctagaaataccgtgtcttcttgaaagaaagtgaatttactgttacaaattcttcgaccaatatctgtttttaggatagcttgacaaagggagggtccttgcttttattcttatttgccattatgtttatatttttgatattaaggaagaggtttggaggggaaaattacatatctaagatgttattacctgcatgttggagcctatccagaacctcaacaaatgtatggaaatttgaacctttttgaaaatcaccagcatactgaaatttgaaaacctctcccaggtaccagggaacctgctaatatttccagagggaatgagtggctgccatcttcccaagatgctcctgtaaccaggaagttggaggagcctcagaactggcctctctccactgcaaccatggcattgcagaaattctgctctcattttatttaatatgcgtatttttttacatagctaatctgaaatggaaacatttttatccctatactgagaactgcttttgttttatcagctgacattttacaactcattaatttataatgcaggtttaatgccttcgaatgttcctgggataaaaaattaaagtggccaagctagtttgtataaaggctgactatagtatgttaacaataattatttataacaatattttgtattggatagcacattccatctgaatatttcaaattggcatggtcccttctaactggcattaattcattcatcttgcatccccaagtaataaagttattcccatttttaaatggagaaatcaagattcatgcatttcagtgacagatgttcaaattcagaagaaaatctctgtttgagtttgtctttgccttgtaatacgtatttgtcactaggcctccattattaaataagaaattgaaccttgcatttagtcctatgatctttacccacccaagcacggaggtaacaaggtaactgtgatttaaaaaaaaaaaaaaagtcaatgataaatccccccggatgggcaagagtcactggacaaaaattattgaaaaatagctgcatcctctcctcagtagcacatacttggaaattgaaattttgtggggaagacaaggaggaataaaggctaaggttcaggagaaaagtcttagaaggtcttcccgacacttgccacatgtaaagacgttgtaagaaagcaggcccacaaggcctttaatccactggctcaaacataaatgatctctaagcatgtaagcataagagatttaggaaaccaaatgattcataaaattccaaaacacttcttttttttttttttttttaaagacagggtctcattctgttgcccaggctggagtgcagtggtgtgatcatagctcactacagcctcgacctcccaaactcaaacaatcctcctacctcaacctcctgagtgactgggactattggcatgcaacaccatacctgactgattttttatttcttgtagagatggggtcttgcccaggctgatcacaaactcctgacctcaagaaattctccctgcttggcctcccaaagtgttgggattacaggtgtgagccaccatacctggccaaaaggacttattttaaatttgaagtcatattaccagcagagacatttttaaaatgaggttacatgtctgtgtcacgtctaagctgaaggattaggcatggtctctctcatcatggccttcctacttgaggaagcatttgcaaataaatttctaagtgaagggccaacacaaaaattgtgactggcacaagttcaaatcttcctttttcctcgtagccaccacacattgcagcaccagagaaaagacaacagacactgaaacaatggtatttcagtgattataccagttacatcaccttgcatttccatgttactgttttatacatcacacagtgccattgcacatacaactttgtaggctcctatgacaacctcataaacagggaaccattatcatgatttttactcatttctaccaagcttccttggatgataggccaaggccacacagctggttacacgttggttctgggacaaggcaagtcttcaagctcataattctgtgaactgcctctttatctctattgtttccaaactattgcaggaaacatgggtgtattgttagattctggtaattgatcaaattggtaggcttctataactcaaattaaggggatccatgaaagtaacaatcatcaaaacaatttaaaattaagcaacaatctccatttttgtggcatgaaaatcccaaaaagtcccagggatttccatcccttactctggtcatgtggggtttaaacttagattgcattctgcactgggaatttgtattatcatgtatgtttttgtttggctgttgtacacctaaagacatgctttctggtaccggctttgctaccaactagctgtacggcctttgacaagccatttgacctcactgtgcctgtattacctcctttgtcaaagagttgacttcaagtgtccttctggaactacaattttgtgattatatttctccaaataaattgtaagcttcctgaggtgagaatggcacttccttctatcttctggatttgccacattgtgggtatttaataaatgtttgatgatggcattgaacgatttattggcacgcttgagtagagttataggaaatcattattggctgccttattaacaattagctgtctataagctgcatatgtaattttcctttacatcaatagagtttctgcttctggtgaagacgaagtattgccccttcacatcagttcttctgtatgttaatacattagcaactgatatcttatttgtactgtaactgacagaataatgtagagaaagcatataagtaggaaaaggggttagtaaggtaacattgtatagggcatcttcaaaacaacagttctgctatttcaaatgtcaagctaattatcagcaatgtttaaatgctatgataggccatttttgcaaatgctgaaattttccagcaggtatggacgttataaaaatgtcaaattttgctactattctattacatgtcaccagaacacaaaaatctgaaaataaaagttatatgtataggcaaggaagagaaaccattatttgttttgcatatgactgtaaaattaattggcatagtgatataatttagagtattgtttacttggaaggaagagtagagaggatttaatata

SEQ ID NO: 1227 - DNA, 5523 bp, Homo sapiens
ggcgatcacgttttcacatgatgctcacgctcagggcgcttcaattatccctccccacaaagataggtggcgcgtgtttcagggtctctcgtctctctcctacagaaaagaaaaagaaaaaaatgtcattagaagaggcgtaacacgtcagtccgtccccaggtttgtgtttcctggagtggccgaaagagatcagttctaacctgctctgcaggaataacggtcctgcctcccgacactcttggcgaggtttttgtacagtttgctccgggagctgtttcttcgcttccacctttttctcccccacacttcgcggcttcttcatgctttttcttctcaccatttctggccaaaactacaaacaagacttcgcagatcgagcctgcgtgctgccgaagcagggcgccgagtccatgcgaactgccatctgatccgctcttatcaatgaagcagccgatcatggcggatggcccccggtgcaagaggcgcaaacaagccaatcccaggaggaaaaacgtggtgaactatgacaatgtagtggacacaggttctgaaacagatgaggaagacaagcttcatattgctgaggatgacggtattgccaaccctctggaccaggagacgagtccagctagtgtgcccaaccatgagtcctccccacacgtgagccaagctctgttgccaagagaggaagaggaagatgaaataagggagggtggagtggaacacccctggcacaacaacgagattctacaagcctctgtagatggtccagaagaaatgaaggaagactatgacactatggggccagaagccacgatccagaccgcaattaacaatggtacagtgaagaatgcaaattgcacatcagattttgaggaatactttgccaaaagaaaactggaggaacgcgatggtcatgcagtcagcatcgaggagtaccttcagcgcagtgacacagccattatttacccagaagcccctgaggagctgtctcgccttggcacgccagaggccaatgggcaagaagaaaatgacctgccacctggaactccagatgcttttgcccaactgctgacctgcccctactgcgaccggggctacaagcgcttgacatcactgaaggagcacatcaagtaccgccacgagaagaatgaagagaacttttcctgccctctctgtagctacacgtttgcctaccgcacccagctcgagcggcatatggtgacacacaagccagggacagatcagcaccaaatgctaacccaaggagcaggtaatcgcaagttcaaatgcacagagtgtggcaaggccttcaaatataaacaccatctgaaagaacacctgcgaattcacagtggtgaaaaaccttacgagtgcccaaactgcaagaaacgtttctcccattctggttcctacagttcgcacatcagcagcaagaaatgtattggtttaatctctgtaaatggccgaatgagaaacaatatcaagacgggttcttcccctaattctgtttcttcttctcctactaattcagccattacccagttaagaaacaagttggagaatggaaaaccacttagtatgtctgaacagacaggcttacttaaaattaaaacagaaccactagacttcaatgactataaagttcttatggctacacacgggtttagtggcactagtccctttatgaatggtgggcttggagccaccagccctttaggagttcatccatctgctcagagtccaatgcagcacttaggtgtagggatggaagcccctttacttgggtttcccaccatgaatagtaatttaagtgaggtacaaaaggttctacagattgtggacaatactgtttccaggcaaaaaatggactgcaaggctgaagaaatttcaaagttgaaaggttatcacatgaaggatccatgctctcaacctgaggaacaaggagttacttctcctaatattccgcctgtcggtcttccggtagtgagtcataatggtgccactaaaagtattattgactatacgttggaaaaagtcaatgaagccaaagcttgcctccagagcttgactactgactcaaggagacagatcagtaatataaagaaagagaagctacgtactttaatagatttggtcactgatgacaaaatgattgagaaccacaacatatccactccattttcatgccagttctgtaaagaaagttttcctggccccatccctttgcatcagcatgaacgttacctttgtaagatgaatgaagagatcaaggcggtcctgcagcctcatgaaaacatagtccccaacaaagccggagtttttgttgataataaagccctcctcttgtcatctgtactttctgagaaaggaatgacaagccccatcaacccatacaaggaccacatgtctgtactcaaagcatactatgctatgaacatggagcccaactccgatgaactgctgaaaatttccattgctgtgggccttcctcaggaatttgtgaaggaatggtttgaacaacgaaaagtctaccagtactcaaattccaggtccccatccctggaaagaagctccaagccgttagctcccaacagtaaccctcccacaaaagactctttattacccaggtctcctgtaaaacctatggactccataacatcaccatctatagcagaactccacaacagtgttacgaattgtgatcctcctctcaggctaacaaaaccttcccattttaccaatattaaaccagttgaaaaattggaccactccaggagtaatactccttctcccttaaatctttcctccacatcttctaaaaactcccacagtagttcatacactccaaacagcttctcttctgaggagctccaggctgagcctttagacttgtcattaccaaaacaaatgaaagaacccaaaagtattatagccacaaagaacaaaacaaaagctagtagcatcagtttagatcataacagtgtttcttcctcatctgaaaactcagatgagcctctgaacttgacttttatcaagaaggaattttcaaattcaaataatctggacaacaaaagcactaacccagtgttcagcatgaacccatttagtgccaaacctttatacacagctcttccacctcaaagcgcatttccccctgctactttcatgccaccagtccagaccagtattcctgggctacgaccatacccaggactggatcagatgagcttcctaccacatatggcctacacctacccaactggagcagctacttttgctgatatgcagcaaaggagaaagtaccagcggaaacaaggatttcagggagaattgcttgatggagcacaagactacatgtcaggcctagatgatatgacagactccgactcctgtctgtctcgcaaaaagatcaagaagacagagagtggcatgtatgcatgtgacttatgtgacaagacattccagaaaagcagttcccttctgcgacataaatacgaacacacaggaaaaagaccacatcagtgtcagatttgtaagaaagcgtttaaacacaagcaccaccttatcgagcactcaaggcttcactcgggcgagaagccctatcagtgtgataaatgtggcaagcgcttctcacactcgggctcgtactcgcagcacatgaatcacaggtattcctactgcaagcgggaggcggaggagcgggaagcggcggagcgcgaggcgcgcgagaaagggcacttggaacccaccgagctgctgatgaaccgggcttacttgcagagcattacccctcaggggtactctgactcggaggagagggagagtatgccgagggatggcgagagcgagaaggagcacgagaaagaaggcgaggatggctacgggaagctgggcagacaggatggcgacgaggagttcgaggaggaagaggaagaaagtgaaaataaaagtatggatacggatcccgaaacgatacgagatgaagaagagactggagatcactccatggacgatagttcggaggatgggaaaatggaaaccaaatcagaccacgaggaagacaatatggaagatggcatgtaataaactactgcattttaagcttcctatttttttttccagtagtattgttacctgcttgaaaacactgctgtgttaagctgttcatgcacgtgcctgacgcttccaggaagctgtagagagggacagaaggggcggttcagccaagacagatgtagacggagttggagctgggtattgttaaaaactgcattatgcaaaaattttgtacagtgttaaggcctaaaaactgtgtggttcagagactaattcctgtgtttaatagcatttatactttaagcacaactagaaaattgtaagaattgcactctacttatgtatcactacaaactttaaaaaactatgtctaatttatattaatacattttaaaaaggtgcccgcactaccatacatcagtatttttattattattattgttattcctttttaatttaatgtgctcgcactacaatgcatcagtattatgattcctctgtactttcctttcgctattcatcaatttcccatttttttttttcagcttaagtaaccacacaattttaggcctcaatttttttttttttctgtgaaggaacttgaagtgatgcatgtgtgaatttaagataccgaagtcttaaagtgacctggacgtgaaggaaaaagtaagatgagaaataaagaaagcctttgtaaggtggttttaaaagccttatatgcaaaccttttaatctgtgtttctgcaagtgccatccttgtacagtgttaagagggtaacatgggttacctttgcaccagcttcagtgttaagctcaccctgttctttgaagcacccatgtcagtattagaagaataggcagcagttccttagtttacatatgtttgtgcaattattttctgtacttttttgttcattaattttgtcagtattacaccaaactgtttttgcaacaaaaaaattttttttgcattcatttaattttaggtcaaataacattttatttatgtggctcattttatatttcctaattttatttatttcatactgtagtgtacagtattatagttcttcaatatatagatatattttagtaaaaaaggaacatgacgttgatcatttgggcaaattttacgtaaagagaagagcatttattgtgttttggaacattaattgtgagatgggatttttcaattttattattttatttttgtttttttccaattactggaaattccaaatttgggaacttttgatacgatcttgtgaaaacactgtattttcgactgaaaattccactttcttcatcttgttttttagctaaaaagagggactgttaaatacaatgtatgataccatgacaaaaatctttcctgaattgtctttgtaaaagtattattgaattttcaatttgtaatttcttttgaaaatgaccatgctcgaataaaaatgtagccaaact

SEQ ID NO: 1228 - DNA, 3645 bp, Homo sapiens
atgaagcagccgatcatggcggatggcccccggtgcaagaggcgcaaacaagccaatcccaggaggaaaaacgtggtgaactatgacaatgtagtggacacaggttctgaaacagatgaggaagacaagcttcatattgctgaggatgacggtattgccaaccctctggaccaggagacgagtccagctagtgtgcccaaccatgagtcctccccacacgtgagccaagctctgttgccaagagaggaagaggaagatgaaataagggagggtggagtggaacacccctggcacaacaacgagattctacaagcctctgtagatggtccagaagaaatgaaggaagactatgacactatggggccagaagccacgatccagaccgcaattaacaatggtacagtgaagaatgcaaattgcacatcagattttgaggaatactttgccaaaagaaaactggaggaacgcgatggtcatgcagtcagcatcgaggagtaccttcagcgcagtgacacagccattatttacccagaagcccctgaggagctgtctcgccttggcacgccagaggccaatgggcaagaagaaaatgacctgccacctggaactccagatgcttttgcccaactgctgacctgcccctactgcgaccggggctacaagcgcttgacatcactgaaggagcacatcaagtaccgccacgagaagaatgaagagaacttttcctgccctctctgtagctacacgtttgcctaccgcacccagctcgagcggcatatggtgacacacaagccagggacagatcagcaccaaatgctaacccaaggagcaggtaatcgcaagttcaaatgcacagagtgtggcaaggccttcaaatataaacaccatctgaaagaacacctgcgaattcacagtggtgaaaaaccttacgagtgcccaaactgcaagaaacgtttctcccattctggttcctacagttcgcacatcagcagcaagaaatgtattggtttaatctctgtaaatggccgaatgagaaacaatatcaagacgggttcttcccctaattctgtttcttcttctcctactaattcagccattacccagttaagaaacaagttggagaatggaaaaccacttagtatgtctgaacagacaggcttacttaaaattaaaacagaaccactagacttcaatgactataaagttcttatggctacacacgggtttagtggcactagtccctttatgaatggtgggcttggagccaccagccctttaggagttcatccatctgctcagagtccaatgcagcacttaggtgtagggatggaagcccctttacttgggtttcccaccatgaatagtaatttaagtgaggtacaaaaggttctacagattgtggacaatactgtttccaggcaaaaaatggactgcaaggctgaagaaatttcaaagttgaaaggttatcacatgaaggatccatgctctcaacctgaggaacaaggagttacttctcctaatattccgcctgtcggtcttccggtagtgagtcataatggtgccactaaaagtattattgactatacgttggaaaaagtcaatgaagccaaagcttgcctccagagcttgactactgactcaaggagacagatcagtaatataaagaaagagaagctacgtactttaatagatttggtcactgatgacaaaatgattgagaaccacaacatatccactccattttcatgccagttctgtaaagaaagttttcctggccccatccctttgcatcagcatgaacgttacctttgtaagatgaatgaagagatcaaggcggtcctgcagcctcatgaaaacatagtccccaacaaagccggagtttttgttgataataaagccctcctcttgtcatctgtactttctgagaaaggaatgacaagccccatcaacccatacaaggaccacatgtctgtactcaaagcatactatgctatgaacatggagcccaactccgatgaactgctgaaaatttccattgctgtgggccttcctcaggaatttgtgaaggaatggtttgaacaacgaaaagtctaccagtactcaaattccaggtccccatccctggaaagaagctccaagccgttagctcccaacagtaaccctcccacaaaagactctttattacccaggtctcctgtaaaacctatggactccataacatcaccatctatagcagaactccacaacagtgttacgaattgtgatcctcctctcaggctaacaaaaccttcccattttaccaatattaaaccagttgaaaaattggaccactccaggagtaatactccttctcccttaaatctttcctccacatcttctaaaaactcccacagtagttcatacactccaaacagcttctcttctgaggagctccaggctgagcctttagacttgtcattaccaaaacaaatgaaagaacccaaaagtattatagccacaaagaacaaaacaaaagctagtagcatcagtttagatcataacagtgtttcttcctcatctgaaaactcagatgagcctctgaacttgacttttatcaagaaggaattttcaaattcaaataatctggacaacaaaagcactaacccagtgttcagcatgaacccatttagtgccaaacctttatacacagctcttccacctcaaagcgcatttccccctgctactttcatgccaccagtccagaccagtattcctgggctacgaccatacccaggactggatcagatgagcttcctaccacatatggcctacacctacccaactggagcagctacttttgctgatatgcagcaaaggagaaagtaccagcggaaacaaggatttcagggagaattgcttgatggagcacaagactacatgtcaggcctagatgatatgacagactccgactcctgtctgtctcgcaaaaagatcaagaagacagagagtggcatgtatgcatgtgacttatgtgacaagacattccagaaaagcagttcccttctgcgacataaatacgaacacacaggaaaaagaccacatcagtgtcagatttgtaagaaagcgtttaaacacaagcaccaccttatcgagcactcaaggcttcactcgggcgagaagccctatcagtgtgataaatgtggcaagcgcttctcacactcgggctcgtactcgcagcacatgaatcacaggtattcctactgcaagcgggaggcggaggagcgggaagcggcggagcgcgaggcgcgcgagaaagggcacttggaacccaccgagctgctgatgaaccgggcttacttgcagagcattacccctcaggggtactctgactcggaggagagggagagtatgccgagggatggcgagagcgagaaggagcacgagaaagaaggcgaggatggctacgggaagctgggcagacaggatggcgacgaggagttcgaggaggaagaggaagaaagtgaaaataaaagtatggatacggatcccgaaacgatacgagatgaagaagagactggagatcactccatggacgatagttcggaggatgggaaaatggaaaccaaatcagaccacgaggaagacaatatggaagatggcatgtaa

SEQ ID NO: 1229 - DNA, 44990 bp, Mus musculus
  misc_feature (21533)..(21552): "n" at positions 21533 thru 21552 can be any base
  misc_feature (23415)..(23434): "n" at positions 23415 thru 23434 can be any base
  misc_feature (26984)..(27003): "n" at positions 26984 thru 27003 can be any base
  misc_feature (28474)..(28493): "n" at positions 28474 thru 28493 can be any base
  misc_feature (30246)..(30265): "n" at positons 30246 thru 30265 can be any base
  misc_feature (34991)..(35010): "n" at positions 34991 thru 35010 can be any base
  misc_feature (37458)..(37477): "n" at positions 37458 thru 37477 can be any base
tttgatcctggaaaggcatcagaggctggtgtctttggtaagaagggctgtgtaccctgaacctgggatatggaggggtctgatgggtttgggggaagaagctgaagaagttatggcatgtcagagcaagcccttaaggtcagtttcctgcctccctcctccagggtactcagaatccaaccagcttgttgatttattatctttctaactgtcactgtcaagaaagtcctctccccgagagggacaaagggcattgtaggaagggcaaaaaggatcccatagttggagatgcctgagcggatccagactttgcaggtaacattgtgtgtatgtgtgtgtgtgtgtgtgtgtaatttccacggaggtgtagcagtagcaagccgtatcagaggcagtacagacactactgtcaagataggcaacaggtcacatccataccctctctcctgacaccaattacaaacctagggatccctgaggccaccctcacatttaagaactcactgggatctctgtcactcccagtcacaggtaaaagcaactcaggaaagggtcaagtgggcaagaccaggaggcgtcccagggaactgtctgccgtctcctgcagatggagtcccagctggtgctcactgctctccaaatgtgccaactcacacggagcaccatccgctgcctcaggtgctacctaaagcgcatattggggttccatacttgctgcctgtgaggtcaacaccagtccttcagatagtctaaggcccagcttcgtaagcttggctcaaagctggtaaccatggcaatctcgttgatttacactgtaaggccaactctctaaatgaagatccgctcctagaacagcactttgtggaagctaagggcaaaggccagacctccttgtagacaaggttaagaactttacttgaatgtagataaattcaacttctggcctgcattaggctgcagaggccattcttcaggactgaaaccccccaggacatggtcctcagctgcacagactgtagaaggaagcccaggggactggctgcctgcttgcatgctgtagtcacctgtcataccctgatggcatgttgaacaccagctgggggacagcgtcctggaaagggacagggtggacaagccaaggccaggcctgaccccagggcagcattgattccagaaaggaagttagcaaagttgccattaggtattgagctctatgatggaagcaaaaagccaagttcaaaacaatgtggaaggaagaacctacctttgaataggagtagaggaagtgaccacctggtggaggatgtggttccgttggcagagtgcttagtgtctagcatgcaggaagcccacagccctgggagatagaggtaggaagatcagaagttcaaactcatccttggctacctaatagtgagtttgagggaagcccgggctacgtgagatgcagagatgcagtgtcaaaacaaaaaacaaaacaaaacaaaacaacaacaacaacaacaacaacaacaaaaacccaaaaacaacctttagtcctagcacccaggaagcagatatagatgggtctctttgggttcaaggccagcctggtctacactgtgaattctataacagctagggctacatagtgagactatgtctaaaaacaacaaaattcccccaaaaaacaagaatcaagtaatgcttgttcaagtcttctttgtttttgtttgtttgcttgtttgttttttgttttgttttgtttttgtttttcaagacagggtttctctgtgtagccctggctgtcctggaactcactttgtagaccaggctggcctcgaactcagaaatctgcctgcctctgcctcccaagtgttgggagtgcaccaccatgcccagcacttgttcaagtcttaaggagttgggttgttaagtcaaaggacagaggcaggtacagctttgcccctagggcaaaccccatgcatctgttcacttgtgtagcctgaggagacaatgctatctcttgcagtagtatggtatcttagccaatgatcgattgatcgatctctctctctctcaaatacacacacacacacacacacacacacacacacacacacacacacacacatatgcgtgctgagcagagaaactctggcttctttcccacttaaggtctccggtaggaaggcagcctctgacaatttcactttccacactccagcccaaattggagagcctcacagctgccagggcaggcagataagtttgccacccaatagcagaaacgaccgcacttactccaaaccctaatcattccagtgcagcaaatggagaaagagcctctgtctttattaagattttttttaacttatttttattttttgaatgtagccctggctgtcctggaactcactatgtagtccaggctggcctcaaactcacagagatcctcctgcctctgcctcctgagtgctgggaatataggcgtgcaccaccacgcccagctaagaagagattctaaaatacaagtgtgtgtctgtgtgtctatgcccatgagtgtagtgcctgctgaatctgaagactgaagctcgagatacagggacatgggtcacgggtggtggaatgctgacgagggtcttctagaagagcagaaaagggggctggtgagatggctcagtgggttagagcacccgactgctcttccgaaggtccagagttcaaatcccagcaaccacatggtggctcacaaccatccgtaacaagatctgaccccctcttctggagtgtctgaagacagctacaatgtacttacatataataaataaataaataaataaataaataaataaataaataaataaataaaaaagaaaaaaaaaaaaaaaagaagagcagaaaaggtacttaactggtaccttcagcctcctgtcccggatttgagacagggtctcactctgtagcacaggctggcccacatccatagaggcagggagagcaatggggttccaggggcagaggaaaaggcacagggaggcatctgatgatacaaagtttcagctacacatgttacataatttccagagctgtacctgctgaagcgtccatggctaacagtcccgggacagggatggctgctgtcctgtctatttgatggagtttacaatttgtaaacctgggcatgccggtgagggagtttctagagtgggttgattaaggagggaagccccgtcctaatgctgggtggcatctgctcaggggcttagcctacataaaaaggagaaagtgggctgagccaccaacattcatctctcccttcttgctgactgcgaatgccctgtgacccactgcatcatgtggctcttgtcatgtctttcctgttatgatggcctgccttctcaactcccaagccaaaataaccctgtccttccttgagttgctttcgtcagacactgtgtttcagtaagaacagtcactcatacaatggtggattgtaagtttaagttagatgtgaagacagatttttttttccctttggttttgttttgttttgttggttttgaaagacaaagtttctgtgtgtagccctggaacttactctgtagacccggctggcctggaactcagagttctgcctgcttctgcctcctgagtgctgggattaaaggagtatgccaccactgccctgcttgctttggttttctgagacagggccttgctctgcagctctaggctggttttaaacataaaatcttgtagcttccctcatgcacacacacactgccactaatataactaattataattatataataattttttaaagtttctgaaagcagatggtagacaagatggctcagaagttaaaagcatttgctgctcttatagaggactatggttcagttcccagcactcacggggaggcacacaatgatccttaactcgtttcaggggatctcgcgccctcttctggcctccatggacaatgcatgcacatggtacacaatcatctatgcaggcaaaacacttatcacataaaataaaaataacatataaatctccttttaaaaagtcaggagaggggctggagagatggctcagaggttaagagcaccgactgctctttcagaggtcctgagttcaattcccagcagccacatggtgacttaaaaccatctgtaatgggatccgatgccctcttctggtgtgtctttagacagctacagtgtgctcatatacattaaacaaacaaacaaataaacaaacaaataaatctttaaaaaaaagaaagccaggagagattggttagtgggtagagatgcttactatgggggcctaactagtctttggaacctacagagggaaactgactccatacgatcttctccaactgtagccccctcccctaatattaattaaagcaattgtttttcaaaagatttctttagttttatgttatgtgtatgagtgcttgcctgcatgtatgtagatgtaccacatacttgcctggtaccctcagaggccagaagagtgttagattacctggagctgaaattacaggtgtttatgagccaatatatgggtgctgggtcctctgcaagagcggccagggttcttaatggctgagcaatctttctttcttgtccctaagatcagtcattacaagggaatgtagggatgtggttggcatctgtacagcttgttgatggagatagatggtttcctgggtatttgtatctaatgtcatggaaatctatgtattaaacatgtatagttttttttatatgccaaccacacttcaggaaaacaatttattcttattttgtattatttatgtatatacatgtgtgtgtgtaggggttgtgaatgtgtgccacatgggtacagatacctacagagaccagaagagggcgatagatcctctccagctggataacaggtgggtgtgagctgcctgaagtgtgtgtgtgtgtgtgtgtgtgtgtgtgtgtataactgaactcaggtcctctggtagagcaggaagtgctcttaactactgagccatcttcagccccaagaaaatagattaaaaaaaaaaactctttaatcccagcatttgggaggcagaggcaggagaatttctgagttcgaggacagcctggtctacagagtgagttccaggacagccagggctacacagagaagccctgtctcagaaaaccaaaaactaatcaaaccaaaccaaaaccaaaacaaaaaaaaccctgctagcctcgaatcctaggactcaggaggtagaggcaggaggatttctatgagttgaggccagcttggtctgtcaatatagtgagttccaggcaaccaggagtatatagagaaaccctgtctcaagaaaccaaagtgggtggagatatacctttgtggttaagagcactgattgctcttgccaaggacctgggttcaatccctaacatccatatgttggttcataatttttaacacatgcatgatagttcacaaccatccagagctctaagggatccaacgccttcttctgacctgcaggggcatcaggcatgcatgttgcacacagacatataaaggcaacatccttagtgtaaaagaagtaagtctttttaaaaaaataatctttgctggggatgatggtacatacccataatcttaacagttaggaggttgaggcaggaggatcacgaggagttagtcaacttcagcaacataccaagactatgccttagagattgaatatactcacagggccccaagtataggatgggcatcgctcgcccttgttgggcctgctataacttgccagcagtcagtactgtggttacaataatgtggatagcgttataattgctcccattaatattatgaatgaagatttcctcagaggaagcctctgagacactttagcaggctgaagatgatgggggtgggtcaggacctagggccattttattccctcaatccccaggactcacatggaaaagggaaagaacggatccctgcaagctgttttttaacctgtgcatgaaagtataacgtaaaaacaaaattctaggcctttaggcccaggcttgggaatgtgacctctgtgacttaatgctccaaggtatgctaatcataaaacagatagcgacattcctccacccgccagcttcctgggttcaaagagtgttcattcacagaaagtcaccctgaccattgctggaacccgctatgcaaatgtgctattgttaggggctcttagaaactgtcttgagagataacaggaataattaccaggtattccttgtgactcttgtgactttgtacttccttgggactcttaactggtatctttggtattttccaacaaagccctccccacttccttgagttgtggtttcttcctttaaatacccccttacccagctacttggggtgccacggtcctctacccctgcgtggtgtatgaccgtgggcccgagagcgctcttgaataagagtcctcttgcagtttgcagcaagaccgtttcttgtgtgatttggggtgtcgcctctcctgagtcagaacgtgggggagtcctcacgttgtgggtctttcatgcacacataaacaaaaacttaaaatataattttttaaaagaagacctagtataagaaagaacttccctaaggtgaagaaaaaaaatacttttttttttttttttttgagacagggtttcatgtaacctaggctgggtttgaggtcattatgtagccaaggatacagtaaacttctgatccagcctctgaaataaaatagtctcacacgcatagaccatttcattattaagagaaaactgcatcccctctggatggtttactttgttctgtgcaaaggaagactgcaactgattttgcacctaaaagaaaatacaatgtaaataaattaggcaaaaagaaagaaagaaagaaagaaagaaagaaagaaagaaagaaagaaggaaagaaagaaaggaagaaagaaagaaagaaagaaagaaagaaagaaagaaggaaagcaagcaagcaagcaacccattactcaggtagctggcaaacagcaggagaggccagatgcaggtgcacactagctgcacagctaatcttaaccctagcgtcagttttagtctattttcacagctagagaactccagggtctcagtgattcctccccagagtcaggggaaagagagcaggaggactctgtcacttgtcagctccaactccaacgaagcctgtgcatgagacaaaagtgaaatagggtcacttatcccaacagacctatggtcaggacaaaagtgacatagggtcacttacccccaacaggactatggtcaggactggcccatccccacaagtcaacaagacatctctggactcacatggaactgaagtagctctggggaccccaaactcaggagggggatccatgaggaaatgagctcaaagcgtcttgcaactgcacagtgttctgcttgcttttctgggccaacagagatgcaagcctgccggaggagttggcagactcaggacatcctgctgtttccctaaagcttctggatttcttaatttgaatctgcaagtaagaacccgactggccaggcttggatcaggttttctgtctcaggccaatcagctttggcagactccgtagaggggaggctgggcagagtccagtttaaaaaaaaaaaaaaaaaggtgacttgcttttcccctccctgcaggctgtgactgggaagaaagatcaatgaataacatttctggtgcacttggatttcaatcccaggggctcccaggtctcctccctattctggctgattttctttgcctttcttgtgtggctaattctttggatttaaaaccttcccttctggaaggaaagagattcataaaagtcaggttcagtcctcagcactagaaagttaaaaacaaacaaacaaacaaacaaacaaaacccaaaacatacatggcttgggaagtccagctatcggactcacgaggtccctctagtcaacagttgctggagagggaactcttgagctgctgataagtcatgcattggtccagggatgcatgcaggtttgttagttgggggcctttggggtgatctttttagttaccttgagttaccttgtaaataaattaaacactttccctggtttgccgacgtagactttgggtggaattctttaatctgtcatctgtgccttctctaccgcaaatagctgtctgtctccccagcaaaagtgacacaagccactcgctgagttttaggtaagtgccttaccagtcctctgcatctccattcattttaaattaaaaccaagactcccagggcgctgaacggaggtggcgcacaccgcctttaatcccagcacttgggaggcagaggcaggcggatttctgagttcgaggccggcctggtctacagtgttagttccaggacagccaaggctatacagagaaaccctgtctcgggaaaaaacaaacaaacaaacaaacaaaaaacaaaaacaaaaaaaaaacccaaaaaataaaacaaaacaaaaaaaaaaaccaagaaagactctcagggcgaagttccgagaagccagactttctgcccacccacgacacacagccctgggcatcagggctctgggtcaagtgttaagattcttggagacaaatcttgtgtccccaggtcttgtccttccgactctgcctccctgtacgcccctgtgactcagcagctttccctgcctggctttaactccgggaatgggctgggtgtttgttgccgggtagatagagctgcagacttgggaacaggttctttctaatgcaaagcaagccctgtaccacggagctatctgtttgcccacattctatttcgaagggctttccctcatagtcttaactagatatgggcttaggcccccttacattccctctcctcggcctctctctctcttggttcccttcctttagcccacggaacagcattttcaatctagagtggctgcggatgcccagctgtcttgttcagctacagcaggttgtgagcaaccacctggcgtctcctctactggaccccaaatgcctgaattctcctcggacgtctgttagtagaaggcaaagggtgtgaagtcttcactcacatgtgatttcacaaactctccaaacctgatttggttagtcttggtgtggcacgctcaacagggcaggaggccacgtgctgagaccaggctgggaaaaagtgtccgccctctctacactgcaggaaagcagacatccagaacccgcgtgacctcacgtagcgagactccgcagtctcacaaacccactttgtcttttttaatttcttaaatgcttgggaaatggcggaaagaggctttgacactagggaagattgcacgcaactttacagtgcggagccggctctcgggagagtttaatttgcaactgactcgctgacgcacgcgggcgtgtcgcaggctccggaaatcaaggttggagcagaggggacagtagccgctctgacctatacagcgccacttccagagcccagtgtccccactgggcctccgagtgacttgcagcctcggcgactccggcgacactatccgctgaggtccctaggccaccgctctgtgtgccggaagctcccctccccctcttcccaaatgcttccagcagcctggaggctgcaacagtgacccgcgtgtccccgcgcacgcacacacctcacgcacgtcagacccacgcctccctatcgccccgtgccagagtgcacgcaggcctttacgcgcggccacacatgatcacagagccgcagagggcgagagcgcggctcgcgagtgggaagaagaccccgagactggtctgggcgctgtccggggtggagccgagggcggagcttcggggtccggcgcgcagagctggggcgtgtccgcgccgccgcgatctgcgccgctccgccctcggcccgttcgctgcgctcccagcctcctcgccgcaacccccgccgtagctgccgctgctcccgccgtcaccgcctccgaggtaggcgcagcggagagggcctgggctatgcctgagtccccagggcctcgggtcgcgctcctgggaagtctccagggaggcgatcgagggaggttcgggcgagggcgctgggcctaagcgcttggccccgggaagggtgaaccagggacgatcattgcgggcctggaggggcagcgggcttgtagaggaggcctggagggcgggcgcagagcggatctcccagattctagctcgagcgttcagagcacctgcatttggaagccaggggcggttcgaacatgcgaggagcggaagggcaagggcggccgcgtggaggcccggcgggccgcgggtctaggtgaccttcccggcggcgccctctggctctagatcccgtcggtgtggatctggtagagaccctcccacggcccaagcccttccccaccagctccaagggcctgtgcagacccagcttcctccgccgagaggacgaactccaggcacggccatgccctggatcccccagcccctacacgccctagccggcccacgcccggagtaggtggcgccgggtccctcccgcgcatgccagtgtcttcccgggcggaacgggctgccctgagtggacttaggccgcaggaacagggacctgggcctggactgagagcgagaccccatagggagccatacgcttggcctccttggcctcggggacggagtccgtgttctgtgtcgccaaatgcaactgtgcattctggaaactgttttcagggcctgacatcagattggaggcccgcaactctacacggtttgtccaaggtcacactggtaggaagatttaaaacttcaatcttctcatctgcgaaataggagcaattatatacacttcactgagtttgggggaaagaataaaatgatccgattaacacgaagccttggggcatgcacaaggacaccttagaaaccttgacatttgcctaggagacctaggagcttttggggagggttgaactcatcctccacagacttttattttattttattttttattccacatggtgtacaggaagggactccatgaatatacaggcgtattattttaatgccattattactaatgtcagaagcaagcatttgtgcagcaccaggtattgagtcattggagaataattcacgagacactgtcagtttgcagattgacagctgtcaggctggagcactaaatctgactgcagacccagaatgcaggaagagtgtgggcttagctcaggtgtgtgctgtccaaaacttctctttccttgaccagagatatgggtgaggggcttaactccggcttgtttactagcaagccaggcataactgcggagggcctgcctgcttttctcgggactgacaaaactgaagggccaaactcaggcttgtcttcagggacttgggtgggaccacttggcacacattaggtggttaagaaaggtctgtggggtaaattcatttttaaaaaatgtctatttaatgtgtgcatgcttgtgcctatgtgagtttatgtacatacatgcaggtgtgagatgcctcatgtgggtctgggaatcgaacctgggtcttctgcaaaagcagtaagcacttttttgtttgttttgtttttgttttgttttgtttttttgagacagggcttctctgtatagccctggctgtcagcagtaagcactctttttttttttttttttttttttaagatttatttattattttatgtaagtacactgtagctgtcttcagacactccagaagagggcgtcagatctcattatggatggctatgagccaccatgtggttgctgggatttgaattcaggaccttcagaagagcagtcagtgctcttaaccattgagccatctctccagccacagcagtaagcacttgtaacccctgagctctctctccatttttttttctttcataccactcttaactacccaggcatggtaggtgcacattcaatcgtggaatcttaaaacagccattagatgacctagacagctcactcacttctagaagctatcctgtcctagccgagtcatagatgtcataagagctgtaatcgtacatactcacctacagcagtagtcatgagagatgagaaacagctcctttagcattctacaacttcccaagtcctgggggaacttgtccaactggtgtttctgggcttaaagctagagagtgatatgggtagatgggattctggccaaagctgtggggcctgtagcttcttccctttctgacaggtgtgggggtatgacagctcgagtaaggtgccagtccccacttgtagtagctcacagctgattcgctttatttctggtttctagaatgaggctttggacaggggctgtctggggccatgcggtcctcatgctggacctgagcccctaggattccggaaaggttgtactgtcgttgtagctttgcgctttccccaggttccttcggtacctgaaaggatggcagaggcatgcttagctagacctgggtgtgggtctccatcccgcagttaagtcacagcatgtgagcactttacctagggctgagctagaaaaagctccagagggcagcctgggctctcagttctgatctgacaagagccacagagtctagctcaggtgaaatagctttctcgtgtcttagttcctctgttataatgtggtggattgattgattgattgattgattgattttggcttctgtttttaaaaaaattaattgtttggaggtggctagcacatgtggaggtcagaggtcaacttctggtcttcctgtctccactcaggccttgggatcacctgggtctgcagtagaactgtgactgtcagtgctggccattctggtgttctgcggccctgctgtgtatacttggtgcttgggcaccagtcctccgctagtatccccacactgcactgctgctgtgttctgaggaacccataggtgtgagtgcctctgcacagcagaagttaccaactggttgggaaaggagagaggtagctgctgtgggccatctgtagtggacggtgctcatagaaatcatttgccctggggtgagataggaggtgtccttccgggacctggccagacagtatccggctaaacaatacctctctatgggtgggaaggactctggaccccgtggttcagggtgagcttctgacaagatgctcagaaaccattattataatagtagatatacaagaccagagcttggttagattccctagccataaatatagcaatggaaactgtctattggactggcttgtgtgggacttagtagaatgctagcccagcatgcagaaagccctggattcttccttcaacactgcagaaactcagtatggtggggcacacactcagaggtggaggcaggaggatcaagttcaaggtcatcctccgtgacatagtgagtttgagactcactgtgggctacattagatcctgtttcaaagccaaaccaaactggctggtggtgcacacctttaatcctggtacttggcggggtggggcaagggggagggcacagaaggcagacagatctctgtgagtttgagaccagcctggtctacagagtttcaggacagccagggctacacagagaaaccctgtcttgaaaaacgaagaaccaaccaaccaaagaaaccaaacttattatttatttgtctgctcatctcagatgataagttgacctgtcatctgtcatcttaatagaattctacttgtgtttgtttcatggcttctgcatgtaccagccgcagggatgtataccaaggggaattgggtcagagagactgactttggggtcttttacttagaaagggagtaggatatagacccatatgtccttgattcccaaggctgagcacttaaaaaaagcgctgactgtgtcaaccccctatgccttgtggtgcctgggctatcctggagccctggtgtacctggctggaccctagaccctggagtgctgctggctgcctgcatggccttctctccacaggtgggtgagggagagaaggcaggttgccttgagtcaaccacagcctccccagccttatagaaggctgtgctgctgctggtggcccagcttccagagggttttaaaatagaagcagagcctggaaagccagactgtccccctgtgagactctgtggagggggaggggaaggcagctgctttgggaactcagcctgcttccagagcagaggccactgccttgccagatgtgtgtgtgtctgtgtgtgcctgtgtttatgtctgtctgtggtgcagggaagctcctgaactgagcctgctttctgctgagaggttgatttttgcccctggtccctagcgttggagaagtggttgattttgctgtaatctatcatgacctcttttttatttgttattttaatttttagatatatttattcattttatgtatatgagtacagtgtagctgcctttagacgtaccagaagagggaattgtatacattacaaatggttgtgagccaccatgtggttgctgggagttgaactcaggacctctggaagagcagtcactgctcttaacctctgagccatccctccagcccccaacctcttgatttctttatatgtataagggttttccctgtacatatgtatgcatatcatgctcatgtagtacccacagagtccagaagaaagcgtccatcagatcccctttaactggagttagagaatattttgagcccctgtgtggatacagggaagcaaacctgggtcctctgcaaaagcagccagtgctcttaatggctcaaccgtctctccattcccttgatacctcttttgtttgtgggtcaattttttgccctggcaaaccatccaaaactgttggagaaagagcagagccaaaagttttcccatgattccctaacctgggatggtgatggtaacatttggtggctttggctcctgacagtagctatgtactgttaaccggttattcatgcagcgtaataaggaagtcacttgcgggtgtacttgagaaagggtgggctctgggtcacacccaggggctcttctgccaagttgatgactcctccatcatcatctgtagttccctggatggtctgagagatgccaccgtaggtggctcctgatttttgggaagctgatcttgtttcccctttgcttttggagatgggggtctgagctcactgcgtgtttccagtgttgaggagactctacttcctggttaggcgtgagacctgtgttagcctgtgttagcttggggttctggtgggtgcacagtgccgagtgaggctagtctttttttgtagtccattgccaccctccctcaggctgcttgatagctgccctggcagtttttatacacattgaagataaggagctttgccctgttctttgccttctgggcggagtggcccagatgttggtggctgctcgggagaggaatatgcccccataggccttgcccagtgatagggctactgtctcagtttgaatcagtccttagaaccagtatgaacactgtccagacaacttttccttcctgtatcttaaaatattactcttatgtcaatgggtgttttgtctgcttgtgtgtatatatactataccatgtgcatgtctggtgtcctcaaaggggattgaacctccaggaacaggagttacagatggttgtcagccaccacataggtactgggaattgaaccctggccctctggaaaagcagctattgctttaaaccaactaccatttctccagttctttctcttaaaaaatactttatgtgtacgtatgtgtactacatgtgtgcagtgcccgagaagccagaggagtgcgttgcagctcctggagctggaaacccaaccctgatcctgagaagagtgggcagtgcccttagcctcggagccatctctccagccctttggtgtcttgactgtgatgacatgttggaaggttgctgacttccaatgttttctgctcttcacaacactatttcaataatgaagtagaataaaaaatggaaaccacatctgaattccgcatctacttttcccaaaccacatttctccctgaggcagccatcctgcccagatggggcccctctttcctgatttctcccactcactcacaagttcctgaattgataaaggacccactaattatgcagaattagaaatttccctggcatgttcttttcttttctctccttttcttttctttctttttaaaaatatttatttttacttttttaaaaaaaattaggtactttcttcattcacatctccagtgctatcccaaaagtccccacccccaccctcacccccacttcccggccctggcgttcccctgcactgaggcatataaagtctgcacgaccaatgggcctctctttccactgatggccttatgttcactttttgaggcagtgtctcattatgcagctctggctggccttgaactcagagatctgcccgcctctgcctcatgggagttggggttttaaaggcccgcaccacaacacccagcttggctttctcttttcattaggtggtacataatgttctatgttctcacatataaattcaccactgttaattaattgtgttgagatagactcaaaacccaggctattcgtcccctgtatgaccaacaataaccttgaacttttggtcctccagcctcatcctaagcgctggaattacaagttttctgcccccgtatccatctcccctcattgctttttgatgactctttggtgatccttaatttgttactatcgtactttttttggttatgtcatttttctaatgatgggcatattggtcacatctaggtttgtgtgacacaggcaatggggtagagaatatgttctgtaggtattttggtgcctagaacacttagtgcgtggggttcctggagtaagattaatgctgagttaattgtttatcaattattctctaaaaaaagtggactgtattcacattccgtttcctgacatttttccattcttggggtcgtcagtgtacagcagctcctggaataaaacccatagctggttttaaggcctgaagcacccaggataccccctgagaggtccctcaccctggcctcagctctttcctagggggcttgctgctctggggactcctggtctggtctgctctgctccgcgctggcttgccagctgcctctgggggggtgggggtgggggtaggggaagcgcccacttcctggttacattgtaatttacttgttcctattgtcagacaccaagtttctactttcctctttttgttacaatgatactttttctttctttctttcttttttttaactgagtcgggctctggcctgagtcctggttcatctagaactcaccttctggactatccctgtttgtttttcatcctttttttttctctctcttaaattttatgtatatgaacgttttgtatgtgtgtacacctgtgagccaccatgttggctgattctaatgaaagaacagcaagtgctcctccctcacctctgagtcatctctctagctcctcctctccactgtttgttttttttttttttttttttttttgagacaagagtcttatgtcgcataggctggcttcgaactcactatgtagccagtgatgacttagaacttctggtcttcttgcctctctctcctgcaggctgggattattgtcatatgctaccaagcctggtttatgcaatgcagtgatagtactcagggctctgtgcatgctaagcaagcattataccaacggagactcatcccaccccttaagctcgtctctggcctcagcctctgaaactgcggcagcaaaaagcacgaagcacacccggcttgcggtgatgctttgggagggctgatgaggtagctcagcagttaaaggcacttgctgccaggtctgaagacacagtttcagttctcagaagctatatggtggaaggagagaactaactcctaaggtgtcctctgaccctcacaggtgcaccacggtacacacaggctcactaaatacacgtaattaaagatataagatgtgttactcactgcatagtaactcacgaatgcccatcatgtgctgggccttgacttctttatagacatttgggtaaacatatgcttgacgggctccgaggagctttgagttcagggggtgtatggtgggaggaggggtagagggtgggagcacggtgagtgagcagctgtcactgccatgtagttgatgagtcaggaagatgttgtcctccctaggccccaagatggaagttacgtaagtgggttgtgtgaactgctaggtgatacacaatccttccctctgcttccagtatggctgggtatccattccttaggctggagtggcgtttgcataatttgttcaaggtcagccagggaaggcttgggttggtaggctggcagacaggggggcaggggagtcggggaggagcaggtgtcccccgagccccccccccccccattgaaggcagtatggtggaatagaaagaaagggagcctcactgagcctggcccctaccctgagctcagaagttccgactcactccctggttgataatctccttagagctgatgcagtagctggtgtttgctgtgggtagtggtttttttttttttttgttttttttttttcctcttttgacaggtggctttccatgctgggtttgaggattagtgtcaacagactgcatttggggaacactaaataatgaatgttctgtcttttcctcaaggtgggatctggtctagatgcctgcagggtaggggctctggggggctgtcttttctgtgaggtcagagaagagtagcaggaaagacctggcttctgataggctcaggtagacacaggaagatcagaagttcaaggccattcctgtctgcatagtgagttggaggctcgattgggctacataggaccctgcctcaaaaggaaaaaaaagaggcaggtgtgtaggcacactttcaaggttagctcaggggttaagtaagagcactgtatttttgttgttgttgttgttgtttgtttgtttgtttttttaaactttggacctgcagttttgttcccatgactacctttaactccagctccaggggatctggtgcctccttctggtctttacaggcacctgcacacaagtggcacacacagatatatatttatatacacaaaaataaaatgaaatcttaaatattggttagagtgtgtgcatgggcgctttagtgttcttggatgctgcagatgggcccgctccccctctgatccttcctctaggggagagacagctctgtctgtagatgtttctttttgtttgctttgttctgttaggggttttcaggtttatttgattttatgtgtagaagtgtttttgtgtgtgtgcgcgcgctgggtcccctagaactggaagtcatggacagttgtgagccactgtgtgggtgctgggaattgacccctggtcttctacaagagcaacaagaagtcttagccagggagccatctctcttgtttttgtactttcacggatggctcttaatccagcagagatggagaatgttctgggctctctgccaagattttcttctgcaggtctgctgggctgggctgcctttcagcccaggattgcttgggggtgacttttcttaggggaagggctaggcccatctggcctgagggggaaggggaagaggggagtccccagctctggaagagcgggtggggcagtattgggtatatctctgccctctcttttgacctgaccttaatgtgggctggtctgcctacattaggttccagcctgttggtgggcgagaggtaagagccgcagcaacacaaagaaggctcgagcagtctctgaagatgtgaaccatggcctgggccgcagattccattcacagtggaggctatggctgtttcttctgtagtgtttattgggtttggccgtaggctgtctttagttatttactgaaggattggtttattatgtggaggtaacttttgggagtcccgttgcatcctgcaggttccagctgtgccagcaggcaccttcacctgctggattaccttgcaggtcctgctgtgagctctttgtggtgtccttgattcaggtgttggtcagttgatattgtttccctggaatcatttgaaatcttcagtgggcgcccactcgccaggaatataccatagtatattcgtgtttgtgaatgggtacatgtgtcatgtcagatgtcgcctatgcagatccagtttgataaattaggtgtacagtttttgttgttgttgtttgtttcttcatttgtctcctcacctctgagacaaggtttctttgcataacagacctggctgtcctggaattcactttgtagaccaggctggcctcaaactcacagagatccacctatctctgcctcttgaggagctaggatcaaaggtgtgtgtcaccctcacctggtaggtgtgcagtattttaaatgaagggaaccagctgaggatgtagctccactggcagagtgcctgcctggggacttgaagtcctaaatttgatcccagcagtgcagaaactagatgtggtgatgatgcctgcaatttcagcagttgagggatggaggattagaaattcaaagtcatccttggctacatagaaagttccaggccatcctggactacatgagatcttgtgtgtgtgtgtgtgggggggggttgtgtggtgggaatggaaccactcttctggttagtgacattatggttctgggatgggactcttgtcactcatgggtccttctcttcaggacagaagtcacagtgtgtgctgtcccagagcaaggtttaattttttctacacagcttgtcaacataaaaccttccaggaatataatgtcacagagaccattagagttattctctttccctgaccactgtgatatttaactaatatttgctcactaacttaattatgtgtgacaactaagtcctgcttctgacctcctagggtcccagcacccatgtgtgtgtgtattcactcatagatacgtaaataaaagagatgatagcacttttgatggaacctggagcctttcatatgctaagcagatgtgctaccctgcactctagtctcagctccctggagagtatttttttttaagatttattttatttatatgagtacattatagctgtcttcagacacaccagaagagggcatcagatcccattacagatggttgtgagctgccatgttggtttgctgggaattgaactcaggacctctggaagagcagtcagtgctcttaaccgctgagccatctctgcagcccccaagtagtattttatgtgcatttgggtgttttgcctgcatgtgtgaggctgttggattccctgaaactgctgttgcagacaattgagacctgtcctatttgagtgctgggaattgaacccagctcctggannnnnnnnnnnnnnnnnnnntggctcacatacatacatgtgtgaacgtggttcacatatatacatgcggaaacacataaggtgaaaaagaaggggctggagagatggcttggtggttgagagtactgctgctcttctggaggtcctgggtttgattcccagcacccatgtggcagctgaggttgtctgttaccccagttccaggacatccaacaccctcacacagatgtgtgcaaaacatcaatgcacataaaatcaaaagaaatcattaaagaaaaagccaggcagtggtggcacgtgcctttgatcccagcacttgggtgggcttgtgggagtgacaggtggatatttgtgagttcgaggccagcctggtctacagagcaagttccaggacagctaggtctacacaaagaaaccctgtctaaaaacaaaaatcaaatcaaaacaaaacaacagcccccccaacccaatatttaaaattgttttgtgtgtgtgtgtgtgtgtgtgtgtgtgtgtgtgtgtgtgtctgtgctcgtgcacatatgcacacgtacatgggcacatgcatatagaggccagaggacaacttgctgggggaactatatcattttctcagggattgaactcagggagcctggcttggtaacaagtggcaaaagagccactgagccctcttgctggtcccttcttttgtatccttgtagtttgtttctttctctctctctctctctctctctctccctccctccctccctcccttccctcccttccttccttccttccttcctttctttttttctttttttgagacagggtttctctgtgtagccctggctttcctggaagtcactctgtagaccaggctggcctcgaactcagaaattcgcctgcctctgcctcccaagtgctgggattaaaggcgtgtgccaccaggcccggctatgatacccttcttttgtagcatgttgttggacttcatttcctgtgaggagatacttagctagcttgtcatgctgtaaagaaagttttgtggagctgggcttgcagctctgatacttgttgaaggaatgaaatcagaaccatgtgaaagatacatcgattgccatgggaagcttcaatttatccgtgtgcagttaccagctgggcggccggcattttgtaattactggcaagagttctgcggttcagtatagtggctgactcctgggaatatgtcttggatggttcattcattcatcaaatattgactgactccttgtgctctgggtcggtgcttgggcctggcgttgctacagtcaaaagcaatcactaagtgtccccagctctagcctcaggggaagggtgagacaactcagggcacacccacatctggcacacccacatctggatgcctgagacttagagctgagtgatttttattggttgtttaattatatcaaataagttttattggtggtaaactaatttccataattacctatgtgttcattctttctcgtgcttttgttgtggcagaacatggccgtgcctcccacatacgccgatcttggcaagtccgccagggatgtcttcaccaagggctacggtgagtgtcggaggagtcgggagcaatgggaagcctttcacctactaagggagttggcatctttgtgacacttgaggtggtcagttcccagctgacaacttatatgtccagacaaaaggatgagcttcctgtggctgtgcgccacccagtggtgaggctcaggcatcacaggggcaaatggcagatctagtcccttgcaagctccagcgtctgccccagtagaacactgttctaaatttaccctgatggtcccacctctgatgactgcctctgccagctgctggaacctgccccacagnnnnnnnnnnnnnnnnnnnnctgcaagggcacaggtcaggcctgtgtttgtgtctgccactgttgccctggcttcctttaagtattttcagatagctaggaggaaaacagtggtgtcctagcttcaagctattattttgattatttttttttttcctcagtgctggggtcaaacctttagcttgctagcaaacattctgtggctgagatacacctccaactcctggcttaattagttaacctgattttggctgtttttccttctttaggctttggcttaataaaacttgatttgaaaacgaagtcagagaatggattggtaagtctctccacttgcacgggacgttatattgtcccttaccaggagtgggtactgtggcccgggtggcagagccaaaaacagttgcctgcttggattgtggctgttagtgcttgtcatcgaagcgctgttccataggtggtctgggactatagtagcttttaatgctttttttaccagttattttatgttgtttgaaatcaaaacttctggcctaatgtactgtaggtgtgtgctgtacccactgatctaccctgatccatccttgatgcttcttattttaaatttgacctctccttcccccgcccccctcttattttgaggtagagtcttactgtgtagtagctcaggctggcttcaagtcacagaaactctcctgccttagtctctcatgtgcttggagtataagatgtgagccattacacctagctttgacctaggttgttttgtttctttatttaaagacttaatttatttctgtgcatgtgtgcgtgcctgcaggagtttgtgcaccatatgcatgcaggaacctggggaggccaaaggagggcattagattccctggactggaattacttttataggccattgtgagctgcacagtgggtgctaggactcgaacccaggtcctctataagagcagtaagtgagtgctcttaattgctgaaccatctcttcagccccgctgacctgttttttttgttttttgttttttgtttttttttgtttttgttttttcgaaacagggtttctctgtgtagccctggctgtcctggaactctctctgtagaccaggctagcctcgaactcagaaatccgcctgcctctgcctcccaagtgctggcattaaaggcgcgcgccactaccgcctggctttttttttgttttttttttacttattcatttatctttatttttttgagacattgtctatccacatggccctggttgctctagaactcactctgtagactaggctggccttgaacacacagagctccacctgtctctgcctgagtgctgggattaaaggtgtatggcaccacctatgtttgtaatgtttcattattatttaggaaacatttctggtgttgattgatacagatacaggtatctgtagcaattgttggagggaaggggtgtgttgctctgtcagtagtagctccctctgaggctggaggcaacatggaagctgggtggtttcctgttcagactttagggcccccaagggaagaaggaagctgtcttccaacaaagacctttccagtaggtttccttgggtagcagacctctcactcctctgtatttccagtatgtaattgaactgtagaagtagttctgcctggacacgttggggactctctgttgcttaagggcctggaccaagggcagactggactgtaggctaaggtctctatctctctctcctttaaggaatttaccagctcaggctctgccaacacggaaaccaccaaagtgaacggcagcctggaaaccaagtacagatggactgagtatgggctgacgtttacagagaagtggaacacagacaacaccctgggcactgagatcactgtggaagaccaggtaagagctccctgcctgctggaagtcctggctcctctagttcccattgagacatcctgggtcctgtctttggttaacctgtgccacctttctcttatttgcagcttgctcgtggactgaagctcacctttgattcgtcattctcgccgaacactgggtaaggttctccttacccacgaggatattctgagatgttatgggccctggaagtccattacagcaaaggatttttgggctgacatcatgccaaaggtagcctcttagctgggaggctggagggtggaaggaatcgtgtggtcaggaccagccaggggtatgtagtgagattctacatcaaagaacaaaaaaccaactaggtagcaacaacagtaaggctgccttggtccaagtgctacatattctggtctgtcgtggtgttctatccaggacatgaagatacaactgttaagggacaatgctgtagcaagcatttaaaaaaaaaaaagatttatttattttatgtatgtgagtacactgtagctgtgtagagagttgtgagccatcatgtggttgctgggagttgaactcaggacccctgctcgatctagctctgcttgctccaagccccgctcgctctgacccaaagatttatttattattatatgtaattacactgtagcagtttttagacacaccagaagagggtgtcagatccccttacagatggctgtgagccaccatgtggttgctgggatctgaatccaggacctacagaagagcagtcagtgcttttaaccgctgagccatctctccagcccattgcaagcattcttaatttaggaaatgtatttctctagcaaatggttttgtgtgttcctgtgctcatttggagactgaaggtgtctgagctgggatactatttgccccaaggaacttcccttttctttttgtcacagggtctcctatagctcagactggccttgaacttattttgtaggcaagggtgacattgaacttctggtcctcctgcttctgtctcttaagtcctgggatcatgggcatgtggtcccatacccacttatggggtggtaaggatggaagccagggcttatgcagtccatttgtgacgtatgctacgtctacaccgagctgtgtctccagggttaaggattgtccttggtagtggaggactcaggccagtgtttactgctaagatcccacaaagccactgtgtgcctggctgcaggccacgggctctctgtcccagctgatctgtttcacataaggatgccagtcaatgaaagtggccaaggctgaagggcagaggtgacatttggaatcaggggctgactggtcactgttgccagcctattttgtacatgtggagggctcttctcccagttttctgagaccctgagatcctgagagcttaaccacaaggtggctcctggggctgccaggtcctccggccagaaatagtttaggcttgttggttattgacacatcagaggacaaagagagcaagctggtctgcctctcctgagtgctccacagggcaaagaaggaactcttctttgagttcaggcttttactaagtttcaagctttgagtttttgatttggcaggtgttttgcttgtttgatttcttttttgtttgttccctttttttttttttttttttttttnnnnnnnnnnnnnnnnnnnnataaatattggtagttgacataaatccttgctgagggacagtgggtcttgagaaacagctgacagacactgaactaactgggcttcgatttaaatgtgggctggacctgagacctgaaggactcagggtcctcatcagtatccagaactcttgagttgtgaactcagtggggtctcacgactatggtggcaaaaggtctcctagcatagtcactaggcaagggaaagacccattgtttattttatgtgtatattcctgagtgtatgactatgtatcacatgtgagggggagggggaggggggacctgaaggtgtcggatgcccaggaactggagttacaggtagctgggagctgccagtgtgaatgcttgaaactgaatctcagtcttctgcactcttaactctgagcctgatctccagccccggggtccgctctttccagcctgatctccagccccggggtccgctctttcctttttcgctggctactgggtgaaccacaaagatgaccatctccctcaaactgctgtgtgggtagctttgaggtacatgcttcttttctttttttttaaagatttatttattattatatgtaagtacactgtagctgtcttcagacactccagaagagggagtcagatctcgttacggatggttgttagccaccatgtggttgctgggatttgaactctggaccttcggaagagcagtcgagtgctcttacccactgagccatctcaccagccccacatgcttcttttctgtaggtttggaaaacagctgagaggcctaatagatgcctgtgtcaggttttgggttagccgtggggagaggctggaaaaagaacatggttggcactcactttttgatctcttcccatggtgtacacagtgctgatgcggcctttttcagaccgaatttgagctcaggagaagttgtgtcctgttggtggcttagcaggtgtttagggacaactggccactgacctcacttctatttcctggcttctacacaaactgggaacaggcaaaatgtttaccgttcttgcatgattgtatcgagatgagttagctcggctttaatacactcttccttttccctttaggaaaaaaaatgctaaaatcaagacagggtacaagagggagcacatcaacctcggctgtgacgtggactttgacatcgctgggccctcgatccggggcgctctggtgcttggctatgagggttggctggctggctaccagatgaattttgagacctcgaagtcccgagtgacccagagcaacttcgcagttggctataagacggatgaattccagcttcatactaatgtgtaagtgtatgtggggggttgttttagttgctttcctgttgctgtgacagaataccacgaccaaggcaacccgtgaaagaaagtgtttggttagacccaccgttttagtgtgttacagtctatgagggcagcaggaacnnnnnnnnnnnnnnnnnnnncccaccttttggcatccatggttcagcggcatgtgcgtttttatcttttgtgattctgggctttttttttttttttcttttctttttttattgcccacctaagcctcttcagtgctgggattaaaggtatgagctgccatgtgggtgcttggaactgaaccttggttctctgcaagagcagcaagtgctatcaactgttgagtcatctctccagccccctgaatttaaccttttcttttgaaatagttttaaagtttttttatagggaactgtgatacaagcagtatgtagagctctcctctacttctcccctacctccctctgatgttgaagttttctatctgccatcacattataacatactatataatatacagctattcattacataataatatttcagtcaagcacctataggactgtggcctctgagattattacagagctgaaaaattcctgttgcttattgccatcaaaacacagtgcatttattgagtctgtcaaaattgacatgaacaccacccactctgttatctccccataaatgtggagcaggtataattttgctcatgtaacagtatttggacccagtgtgtgcctctcttgtggactcactccctgtgttcttaccattagagcatgttttttttttttgtttttttttttatataaaatatttactgtgaacccacgtgctatgttacgtgggggtgccttggacatctgtctcttgggtacatgaggaggtcatggttgagtggttaatcatggtcatctaggtttctgtaagtgcaccctgtgatgtttgcttaatgaccaaatggcccaacgatgcaattttcagaatgtgtccctgtcattaagcaattgtgactaacaaagatccatgccatcaagtgaccattggtaccacactattaactgatgtcctgctgatatcatctctctggcctggaacctagttctggatcctctattgcatcaagctctcaggtctcctttgtggcctctccctgggacacactctccatctttctctgtctctctcgaccctgacattttttgaagaattgctgagagctctttgcagagtgtccttctgtttggattggtctgatatttcctcctgagtgtattcagttgcatctttttggcagctgaggaagcggcacctcagtgtgctgtctggaaggccactattgtgtgtcttggcctgtgataccaaccctgattatgcggctaaggtggcatctgctggatctccgctgtaaagctgtcagtttccagctttgtgcttagtagctgtgttacggggagatactgagactgcaaatattctctctcatcacactttgggttacatggaagcatcctttgatgcttgcctgtgcaattattggtaggtgttcccttccttcttttcttgtttcttgagacagggtttcgttctgtgtagccctggctcgatctgtagaccaggctggcctcgaactcagtgatcctcttgcctctgcctcccaagtgctgggattaaaggtgtgagtcaccaggggagccatcattcctttcttacttatgggcttttactgtagggaagggcagtcctactcctcccttaaccagttttagtttttattttgatgtattatctttatattttgtctatatatgtgctttgtctacatatgtgtgtatgtatgtatgtatgtataccgcttatgtgcctgatgcctgtgaaggtcagaggatgagnnnnnnnnnnnnnnnnnnnnttagctcggctttaatacactcttccttttccctttaggtaaaaaaaatgctaaaatcaagacagggtacaagagggagcacatcaacctcggctgtgacgtggactttgacatcgctgggccctcgatccggggcgctctggtgcttggctatgagggttggctggctggctaccagatgaattttgagacctcgaagtcccgagtgacccagagcaacttcgcagttggctataagacggatgaattccagcttcatactaatgtgtaagtgtatgtggggggttgttttagttgctttcctgttgctgtgacagaataccacgaccaaggcaacccgtgaaagaaagtgtttggttagacccaccgttttagtgtgttacagtctatgagggcagcaggaaccactgagagctcccattttgatccacaaccacagggcaggcagaaagagggaacagtgggggtggtgggagacttgtgaaaccttctccagcaaggccacacttcctaatccttcccaaacagtttgaccaactgaagaccaagtattcaagtgcaggccatgagtgtttatgtgtgtggctagggtggtggcttttcttttcctaagtttggttttcagtcatttgggtcaatgggccccacggcctgtgagcatttttgtttcccgtcacactgaggataatcaggcactcattctctccattaactcggttaacagcttgctggacagtggggtgctgggtgaagggctggcctataggttggggagagtctgtgcgtggtcttggaggttgaaggacattgatgacatgaggtaacaattttagtcataaagacaatctgatttggggccggaggaaagctcagcagatgagaacacttgctgagaggataaacagtttggatcccagcattcctgtcatgcatggctcacaactcccagaaactctagctccagggggtccattgctctcctctgggattggaaggggacatccccccaggccccatacatataaaacttttttttttttttgaaaagtaactttacttgggttaattcgatgaagtactaacctgttctttccactagagggcgctaagtaaatagcttcttaaattcagaccaataatggtattagtctaaacaaatactttttccattaataacaattaaaaacatgtatatgtatgtatgtgtgtgtgtggggtctgtctgtctgcttgtctgtctttctgtctgaactcctatgcctcagtgtaggtgtggaggttacataacaactttcagggagtctgttgtcttcttcctcatccaaaccacagtgcttgccttccaaggaaagtggcacagaactttcttgaccattctggctgtatcagcttccctcctaccatctttgacacaaccattaaccaaagtgaatacacaaacacagtagacagcagaaaactctgtaggagtctaattttctagtttctgctttcatttggaaaaaacaaaacaaaacaaaatggtttatttttgctcactggtgtgtatgtgtgtgtgtgtatgtgtgtgtgtgtgtgtgtgtatctgtgtgtgtgtgtgtcacatgtgtgcaggtgcccatgatggccagagggggttctggatgctctagagctgagttatgggcagttgtgagctgcctgatgtgggtgctgggagctgaattcagagcctttggcaaagcagcgagtactcttaacagctggacatctgttgctatgcttactcacaggaatgacgggacagagtttggtggctccatttaccagaaggtgaacaagaagttggagactgctgtcaatctcgcctggactgcaggaaacagtaacactcgcttcggaatagcagccaagtatcaggtcgaccctgatgcctgcttttcggtgggtacccgagaatcacccatctcacaccaattctatgcttctgcttagacattctctcacagggcaaagacaagtcttgtgtttgagatacttgagacagatactttttacaaagtctcactatatggccttgggtggtctggaacttactctgtagacctcacagagatccacctagtctgcctcagcagcgctgggattaaaggtgtgcgccacgatattgacctccatggctttttgtttttgttttttgttttttgtttggtttttttttttttttttgagacagggtttctctgtgtagccctggctgtcctagaactcactctatagactagaatggcctcaaactcagagatctgcctgcttctgcttcctaaatgttgggactaaaggcatgtcaattttgcttgacacctgcagttttttttttaatttacttattatttatttattatatgtaagtacactgtagctgtcttcagacactccagaagagggcatcagatctcattacggacgggtggttgtgagccaccatgtggttgctgggatttgaactttggacctttggaagagcagttgggtgctcttaccccactgagccatctcaccagcccacctgcatagtttttatatcttcagaattttcacactggagacgctgaacgcttatggaggtcgattgggtagcttccttaaaggcacatagcaagtatgtgctgggacctggctgtaagtagaccgctctgctattgagcctctcttacttaagtgtttcactcttcctctcctttccatttggttttcagtctctacatccacattaagacatcaatggtcaggatgatgtattccagtggtagagcccttgcccagcatgtctgggcttcagccacatttctgggaagaacccaaacaaacagaaacaaggctgggatgtagctcagttggtagagtgcttgcttagcatacagaaagcctgtgctcggtccccagaactgcggaaacagcaggcagaaggatcagaagcaggccattcttgcctatgatgtagcaagagttcaaaggcaactttgggctatatagtgagatcacatctctaaaagagacaaaaccaggtggcctcttgtcttgcttaccccgtggtacccatcagggttccggaatggctcaggttttgttgtgagcctatttgagctggcttgtgttatcactctgtaggtggccacctttttgaggtgggctgaggaagtgtcatgctgcagaatgcttctgctggttggtgtgcctcacagagagtctattttaagtctcctgacctgggaactgagtgctctcaacatgaggcatgcatataaaactgaaagacaaaggctctccttgttgggatgttgggagcataaaggaacagttagaagggacacggcctgctgagagcccttcttctcctcgctctgtccttcaaagttcacaggagcaggaaagcacacacacttgcacatgacacatctcattgagttttaccagatggccatgagcagacaggaacacagttctgatacctgtgacttgcctaagatactgtcaccaagtttggaggtacacctgtgggacagttttcatgggtgaggaacactgtcttcccttggacttaatctttttttttttttttccaggccaaagtgaacaactctagcctgattggcttagggtacactcagaccctaaaaccaggtatgtgttgttgcccatgtgcaaagctcgttctcggttgcattttgctgatgtctgctattgctgagggacattataaacgagtatatataagcttttataattaaatgtttataaaggaagttgtgaagtcattgtaaaaagaaaaagagagtctgagaaatagaaagcagaaggaacctgtctgggctaactcacatcacagctctagttattttctcctttcctttccccagtatgtgatatgtgatagctgcttccagactgtagtcaaaactagcctgtcagtcatcctcacgatggaaagactagggtatagggatgtagtgggtcttctatgcatagttattccatcctctcactggtgtgtgagggctgcagaaatcccactcaaggctgactatgtaatatgaaaatcaagttcttccagggaaaaccatcccgtttgatctaaaattacaagtaagccccaggaaaagaagtttattgtttttttttttgtgtgtgtgtgtgtgtgtgtgtgtgtatgctcacgtgttatgaaagtgaatgtaagactcaggctgttacaagatagggtttccctccaaggcaatactgctcaagcaacttactgagttggggcagcagcggatggcacactcattgtaatgggactgcaggaggctggaagggagggggattcggaagtacgttccagcagggtctctgctctgtgtgccagtgatggccgttgcatgtgttgattcgaggatagcagcaggtcaggttgtattacagagcacaccttgaagggtcgcctcgcttggccactgctgactgcacctggaacagattctgaccttgattctgaccttgatgctaacctctcttctctttcctttgtctcttgcccctttctccctcctccgtcctctgtcacccctccctcccacacctctgtctcaactccccacaggtatcaaactgacgttgtcagccctgctcgatggcaagaacgtcaatgcgggtggccacaagcttggcctaggactggaatttcaagcataaatgaatattgtannnnnnnnnnnnnnnnnnnnctggcctcgaactcagtgatcatcctgcctctgcctcccaagtgctgggattaaaggtgtgagccaccagggaagccatcattcctttcttacttatgggcttttactgtagggaagggcagtcctactcctcccttaaccagttttagtttttattttgatgtattatctttatattttgtctatatatgtgctttgtctacatgtgtgcatgtatgtatgtataccgcttatgtgcctggtgcctgtgaaggtcagaggatgagcctatagtccctggaactggagttacagatgtgtgagccaccatgtgggtcctgggaatggaactcatgttttctgcaagagcagctagtggtgctcttaaccgctgaaccatccatctctccatccctttattatctgaaaaaaaaacacatacacatagatatgtatatatgcacacacataaatacacacacacacacatgcagtttcttctgtgtgtgtgtgtgacagtgtatgtatggacatcagagaacaacttggcaggtttggtttttttcctttttccatgctagtcccagggattcgctcaggtcattaggtttgcctgcaagcacctctacctcctgagctatcttgcctgcccctaatcatttttgactcatgtatagactaatggacatttattcagttgcatcatttagacggtggctcaggctgtgacagtgtggcactccttcaggttgacatgtgtgggctcctctcactgtctttgaggcaccctgtgtttcttgttttggagttgtgtgaagttcatcttagggtctttcttccctggtccttctgtcagccatttgtcctaggcgccttggcgccttatgttgggaatgctgtttaaaggcggtgctgaggccctaggtgtgttgcagatgaactttgatgactttggctcgctgggaattaacactggctttctgaaactctggtgataccgggaaatcactgaccaccctgagccaaatgtaggcactactggatgggaccgcagggccttccttacggattagcacccacccaggagttgccttctacagatagagcctgcttgctaaccatcaatccgtgctgtgtgtctcttgagtgctcgtcaaattagcaccactccttaagtagctaaaaaaaaatcccagcaatttgagacatttgagaaaggaaaatctccatagctgtgctctgggcagatcgcagggggaatctgagtcactgcccctcctctgtccattttcttgggattcttggacccttagctagaatcctatgagaattgatgtgggtggtacccaccattggtcagaggctctgccacaggcaccacactttgtggtcaagggcagctttttgctggttttgtcttttgagagaaggtctcctgtagtccagtctggccttgagtttttatgtgtctgaggctggccttgaactcctgatcctcctgccttcatggccaggtgtgtgccactcatgttttattgagacaggtctgattatgtagcccaggctgacctccaagttatgatcctcttacctctttgggagttggctccctcctccctccatcatgtgggtctgggcgattgaactcaagttgttaggcttggtggcaagtgccagtaccttaagccatattactggccctaaactaattttttttgatgtattttagtctattgccaattcttgtcttaccgatgctaacatttccccatctttgaaggccttgggtggaaaccttattttagcaattagatctgttggcccaataattcctgctaatctctgatagcttaaagagccgcttcaggtttactttgtatgtttgctgccttggatctgtaactggccatttcccaagaaacagcaaggcctctgggtttagagccatggtctgaaagccgcagatgaacccttaatgtcactggataaggccaggaatgggcaactatgtgttgtcttttggagctctgagtcctggtttctgtggtttaggctgagaagcagttggctaggaagtcatctcttttgtaagcctgtgatgtagttctaattgtacttgacagatttgatcttaaaaaaattttttttatctgggcagtggtaggtggcctttaatcccagtacttgggaggcaaacagatctctgagttcaaggctagcatggcctatagaaagagttccaggacagtcagggctgttatacagagaaatcctgtcttgaaaagccaaaaaacaaagattttttttttttaaattcacttgtgtgtatgtggcctatgtacacagtgcctcggtgtgcttgtgggggtcaaaggaaaatctccgtgcttcattttcttaaaacaggctggcttccttccttccttcctttaaaaatactgcatttatttttattttatgtgcattggnnnnnnnnnnnnnnnnnnnnaagcatgtacacacctgcgtgaaagggatgtttttagactgatcctcacaccctgttcccatcgtgccctgttcccatcctagcccatcacttaacctgttttacaccaaaagtagtctttagggtgtggttagctatttcttttgtgccattttagggtggagagggtgggcgtgatggagccagtcattcaggacttaattcttccttgtgttgtggtgtggttttctttcttcttcttcttttttttttttaattccttctttcgccattgcaccagagtatgaaatagcttccgggttctccggctctgagctgggcggtgattgtggtcacaccctgacaacactagggatctcaactgactcctcttgtagcctcaccactattttttagcagtttaatgggtacattatagagtcttccattttgtgtggaattagctcctccccttcaaatgctgtaattaacatcacttaaaataaaacttgaataaaatactgaaacctcatcctcttgttgtttttgttaaaatacgaaatggccagggcattggtttggatttgtgctgtgctcctttgtggtgtctatcaataaatctaacctgatggtagaaaagaacacttgggaggctggagaggtgactcgggggtttatagtgtttcctgcgcctgtagacctgaagcgctcacaacttcctataactatgggtttggggtatctgattccctcttctggtctccttaggtacccacacacatgtgacgcacaaataaaaataaatcttaaaagcacttagggttgatgtagtggcacatctcagtaccttggagattagcacaatgagatcagtgaggaggaaggttgcggggttcaggagagcccacccttagttgaggcactgctggcattgatgactgttgggtgagagtcagttttctttgggggtgtatgcagctgccccaggaagctagggccgctggctggatctaaggagaactgcagtcagtcacaggcagtttgatgagggtagtgggaacgaacggaaccagggtcatcggcaagagcatccagcactgttgaaccaccaccgcctcttccaataatacataataatctcactgttgtagaaggtgtgtctggttgctttgctcaggtttgaatgagaatgtccccttaggctctggcttttgagtacttggtctcttgtaggtgcagtgtggtaaggcttagggggtgtggccttgccagaggaagtacgtcactggtgggtgggctctgaagtttcgcagcttatgctgctcctagtttgtactctccaattcttgtttgtggtttgatgcctaggctttcagtttgtcattcctggtgccaagcctgtccgctgccacgcttcccggccttgatggtgatgggctgctatccctctggaattggaagccaagatgattgccttggtcacggtgttttgtcacagcaataggaaagtaaacacaactaggctgcaccttcattcagcaagagactttgggtccttttccaagcccacgaggttatggtagaatccatttgttgtgaaactgagtcccttcttgccggcttgtttcccgacgaccacgcagtacctggagagccccagcatttcttacattgtctcccgtctgcggtgtatggaacagaaagactcgctgtctaatccttactaggctcctgttctctaggaccaactctgtctctattaccggctcacgattaggcgaggctcccctttataaggataactgccatgaaaagtaagctcaccacacttataactctcattcgcaggctttcccttgtgggccatgggagggggtcgttttgaagtttactcttggtttttcaagacaggattttcctgggcagtcctggaacttgccctgaagaccaggttggactcagagattcacctgcctctgcctcttaagtgctgaggttaaaggtgtgcgccaccactgcctgtcttttttcttttctttttttttttttttttttttttggtttttcgagacagggtttctctgtatagccctggctgtcctggaactcactctgtagaccagggtggcctcgaactcagaaatccacctgcctctgcctcccgagtgctgggattaaaggtgtgcgccaccacgcccggcaaaaatttgtaacgtcttttttctttccttttttttttttagatttatttatttattatatgtaagtacactgtagctgtcttcagacactccagaagagggagtcagatctcattacagatggttgtgagccatcatgtggttgctgggatttgaactccggaccttcggaggagcagtcgggtgctcttcccactgagccatctcaccagccccccaccctttttaaaaaaaaatatttatttatttgatttatttttattcatagctgtcttcagacagacagatccgtagagggcatcagatcccattacagatggtggtgagccatcatgtggttgctgggaattgaactcaggacctctggaagagtagtcagtgctcttaaccactgagccatctctccagcctgcttttttttctttttttgaagaaaggtttaattgcttctatttcacaggtatggatgttttgcctgcatgtgtttgtgaaccacatgcagtctggggcctccagagaccagaagagggagtcagatcccctgtgactggagttacagatgcttgtgagctgccatgtagagctgggaactgaacctgggacctctggaagagcagccagtgtccttaaccactgaaccatctctgcagcccccctctactattaacattttttatgttgtttctccttgtgtgtgcatgtgtgttacagagaacaagcgagggagtctctttcttcctagtttgtgggtcctggggattgaactcaggttgttaggctcggtggcaaatgtgtttacctgttgggctacctcgagatttttactaaatcgtgagttcctccacggaataggaattctacccgcacactcttcagcttctataggaagtgaagtggagacttctggtttctttggaaagtcagttatgtcagcgttttgctggggcacccaggtgaaaggatggtttgctgaagcagatacaggtggaaggatgttctgctatagcagacatgtgaaaggacacatgaagtttagaaggaacataaatctgaccccacggacagtgggagctggagcattggtttgccttgctctcccttgctagtttttgctgacatcatggatgcattggtttgccttacactgcattgctgtgctttgcatgcagtgacttcatagagagaggcttgcaaaagaaaggtccctgcggcttcttgaggcttccgtggcatggggccagttggtgagcctcacagttccttctggattcaactgcagttgctgattcctgtgtggtatctgctgagtggactggactgagaacaacagagactggaatctccccaaagagctatgactaaacatagcttatcctaatagccttccttttccactatctctgctggttggtgggctaagaggggaggttgaactcttattaaaggaggttgagaaaaatatatgcctacaaggaacattcttttttcttggcaggattcctttaaaagaaagaattttattactttctttactctgtctggacatgtgtgggcatacatttggagttcagaggacagttattggaaccattttccccctatctttttgtgagttctatggatgaaacttaagttcaaggttgtggcaagtatcatctgctcttgtgtgagagttgaggcttgttggtcacatcgacagcactaggtatgtatagacgtgcagctaattcttgagtgagtgcttaggctctgaccagagactttaaagaaagtggtttcccggggctggagagatggctcagtggttaagagcagtgactgctcttccaaaggtcccgagttcaaatcccagcaaccacatggtggttcacaaccatccttaatgaaatctgatgccctcttctggagtatctgaggacagctacagtgtacttacatataataaataaataaatcttaaaaaaaaaaaaaagaaagaaagtggtttccctgtccatgtagttgaaggccaggcatagtgtaaagtgttgtgaaatgtataaaagacccccctaagtatgatgggatgtcattcaccaggcacttattacatcatgcctgcacacagtctgcagtgtgttagatggaatttcactgcaaaatgccttgagttcatagtatctcattactgaaaagaactcagatggggctggatgcttcagcaggtagagcacaagatgttcttgcagaggacctgggattggttcccaacatccacgaggctgctcacaactgtctgcaactcccgttccagggcatctgatgcccgtttctagtctctgataacactactcccatgcctaagcctcgaaagatgagacatatacacagacatgaaaaataatctgaaaaatggactcagctgatccatcactgaggacagaagaacaaagtagattagggaggatgatagagggtgttgcagaagccgatcaattgaaaaccatctccaaagaggcagaagctggaattgagattagtctttgtaatggtttgtataggctcagcccagggagtggcactattggaaggtgtggccctgttggagtaggtgtggccttgttggagtaggtgtgtcactgtgggtgtgggctttaagaccctcatcctaggtgcctggaagccagtattctgctaacagctttcagatgaagatgtagaactctcagcaactcctgcaccatgcctgcctggatgctgctttgatgataatggactaaacatctgaacctataagccagcaccaattaaatgttgtccttataaaagttgccttggttcgaaacacacacacacacacacacacacacacacacacacacacacacacacacacaaagagtggccttggtcatggtgtctgttcaaagcagtaaaaccctaactaaaatagtctctaaacactggtattttctagactggcagaaagcaaagctttggggtgcttggagggactgtacctctgctaatctggaaggtttgggcaccattccatgtacatgggctttatggcagactgtgaaatgaggtagatgaatggcttcttggtttgtttaacagaatctgtgtgcttttaagatgtcttggggtcagagaaattggctttgggaaaacacaagctgtttctggggagggaattgcagagacagcagtgaagctgttgggggcacaataaatgccaactgctcattttactgaaaattagtgaaatgaacatatatgaattgaaatctataagaaacattcacacaacatactcacagatggaaactgtaccaaggctctaggcaaactttctaaattcacacttctcttctttctttttctttctttctttctttctttctttctttctttctttctttctttctttctttctttctttcttttttcctgtgtgtgtgggcagggaaagggggagaaagcatttctctgtgtacccctggctgtcctggcactcactttgtagaccaggctgcccttgaactcagatatccacctgcctctgcctcccaaggtttatattttagtgtttcatcaaatatttaacacttctccgtagttaagggtgcatcaataaacaaagtaaggtcaagttggccttggcaggcttgcttttgtgtgtggggcgctgtaagagaggataatatttaaccggatgatagtgttataaaagaaaagcaaggaaattggctagaaagtcagaaggagacactggcattgagaataggttcaaatgttccaaagacatacgtctatcactttttacattttgtaaaacaaacctctcagtatacaaaaatataacccagcaagtgggaggtgaaggtgaaggagttcaaggttatccactgggtagaaagggattttgaatgccggtgcctggcaaacacagaagtggatgctcacagtcagctattggatggaacacagggcccccaaaggaagagctagagaaagtacccaaggagctaaaggggtctgcaaccctataggtagaacaacaatatgaactaaccagtacccccggagcttgtgtctctagctgcatatgtagcataagatggcctagtcggctcggccatcattgggaagagaggccccttggtcttgcaaactttatatcccccagtacaggggaacgccagggccaagaagtgggagtgggtgggtaggggagtggggggggggggatatgggggacttttgggatagcatttgaaatgtaaatgaagaaaatacctaattaaaaaataaaattaaaaaaaaaaggaattttgaggccagcctgggccacttgagatcttgtttcaaaaccaaaaccaaaagggtgctggagaaattattcaacagtttagagcaattgtgcttgtagaggaccagggtgtggttcccaggagccacatggggtggctcataatcacagcaacctccagctccaggggagtagacgccctcttctggcactggagggcatttgaacttacacacaattttactctttctttattgtttctttaatgcttattttatcattattattttttgagacagggtttctctgtgtagccctggctgttctataatcgctttgtagaccaggctggactcgaattcacttagatttacctgcttctgcgtcctgagtgctgaaactaaagatatgcactatcacacctggctagttttaattcagaaatgattgcttgcatatatgtttgtgtaccccatatgcctaatgcctgtggagatcaaaagaggtcttatagtcagatcccctggaactggagttagaggtggctgtgagctgtttaatctgagtgctgggaaccaaacccagtcctttgcaagagtagcaaatgctctcaacagctgaacattctctccagctccatatatatatatataatctttcttaagtgtattaaacttgtgtgtagttgttttacttatgagtttctgcatcagttatacgtctagtgtttgaggatgcctaaagagggcaccgtataccctgggacagatgggtgtgagtcctcacatacaggggtgcttggaatcgaacccaggagctctgggggaatcagccagtgctcttaagcgatgacccctgaaatacatctcaaagatgacaacgataaaccacagagcaaaacaaaaaaccaccagttgaaaataaatccgtcccattcgcctttttttttttttttttttttaagcacccttttctacactcccacgctaacctttcgggttcagagatgcaacgtcatcacgccgggacgtagctgctt

SEQ ID NO: 1230 - DNA, 1767 bp, Mus musculus
ccgtagctgccgctgctcccgccgtcaccgcctccgagaacatggccgtgcctcccacatacgccgatcttggcaagtccgccagggatgtcttcaccaagggctacggctttggcttaataaaacttgatttgaaaacgaagtcagagaatggattggaatttaccagctcaggctctgccaacacggaaaccaccaaagtgaacggcagcctggaaaccaagtacagatggactgagtatgggctgacgtttacagagaagtggaacacagacaacaccctgggcactgagatcactgtggaagaccagcttgctcgtggactgaagctcacctttgattcgtcattctcgccgaacactgggaaaaaaaatgctaaaatcaagacagggtacaagagggagcacatcaacctcggctgtgacgtggactttgacatcgctgggccctcgatccggggcgctctggtgcttggctatgagggttggctggctggctaccagatgaattttgagacctcgaagtcccgagtgacccagagcaacttcgcagttggctataagacggatgaattccagcttcatactaatgtgaatgacgggacagagtttggtggctccatttaccagaaggtgaacaagaagttggagactgctgtcaatctcgcctggactgcaggaaacagtaacactcgcttcggaatagcagccaagtatcaggtcgaccctgatgcctgcttttcggccaaagtgaacaactctagcctgattggcttagggtacactcagaccctaaaaccaggtatcaaactgacgttgtcagccctgctcgatggcaagaacgtcaatgcgggtggccacaagcttggcctaggactggaatttcaagcataaatgaatattgtacaatcgtttaattttaaactattttgcagcatagctaccttcagaatttagtgtaccttttaatgttgtatgttggggatgcgagagttgataaataccacgttagacctccaggctaaggatgactcggctttaaggtgtttaccatttcagaggtacagcagaaaccccattccagaaagggtcctttttagctgtaggcgtgggttggggaggagcccctgtagagatgccaggctacaagtggaaagctgggaacatgtgggtcctttgtaaatctgtatccagtccccagatgaaattgtgacttcccgagcatcgaaccctggtgtccagatcctatctgctcggaagcatgtacacacctgcgtgaaagggatgtttttagactgatcctcacaccctgttcccatcgtgccctgttcccatcctagcccatcacttaacctgttttacaccaaaagtaatctttagggtgtggttagctatttcttttgtgccattttagggtggagagggtgggcgtgatggagccagtcattcaggaattaattcttccttgtgttgtggggtggttttctttctcctcctcctccttttttttttaattccttctttcgccattgcaccagagtatgaaatagcttccggttctccggctctgagctgggcggtgattgtggtcacaccctgacaacactagggatctcaactgactccttttgtagcctcaccactattttttagcagtttaatgggtacattatagagttttccattttgtgtggaattagctcctccccttcaaatgctgtaattaacatcacttaaaataaaacttgaataaaatactgaaacctcc

SEQ ID NO: 1231 - DNA, 852 bp, Mus musculus
atggccgtgcctcccacatacgccgatcttggcaagtccgccagggatgtcttcaccaagggctacggctttggcttaataaaacttgatttgaaaacgaagtcagagaatggattggaatttaccagctcaggctctgccaacacggaaaccaccaaagtgaacggcagcctggaaaccaagtacagatggactgagtatgggctgacgtttacagagaagtggaacacagacaacaccctgggcactgagatcactgtggaagaccagcttgctcgtggactgaagctcacctttgattcgtcattctcgccgaacactgggaaaaaaaatgctaaaatcaagacagggtacaagagggagcacatcaacctcggctgtgacgtggactttgacatcgctgggccctcgatccggggcgctctggtgcttggctatgagggttggctggctggctaccagatgaattttgagacctcgaagtcccgagtgacccagagcaacttcgcagttggctataagacggatgaattccagcttcatactaatgtgaatgacgggacagagtttggtggctccatttaccagaaggtgaacaagaagttggagactgctgtcaatctcgcctggactgcaggaaacagtaacactcgcttcggaatagcagccaagtatcaggtcgaccctgatgcctgcttttcggccaaagtgaacaactctagcctgattggcttagggtacactcagaccctaaaaccaggtatcaaactgacgttgtcagccctgctcgatggcaagaacgtcaatgcgggtggccacaagcttggcctaggactggaatttcaagcataa

SEQ ID NO: 1232 - DNA, 53413 bp, Homo sapiens
tatattgcatggtgctgaggtttggggtatgattgaacctgtcatccaggtattgagcatagtacccaacaggtagtttttcaacccttgcccccctctctccctccctcccctctcttgtagtccacagtgtctattgttcccatatttatgtccatgtgtatccaatgtttagctcccacttataagtgagaacatgcagtatttggttttctattcctgcattcattcactcagaataatggcctccagctgcatccatgttgctgcaaaggacatgatttcattattttttatgactgtgtagtattccgccatatatatgtaccatattttctttattccatccaccactgatgggcacctaggttgactccatgtctctgctattgtgaatcacgctgtgacaaacctacatgtgcatttgtctttttggtagaatgatttattttctttttttgagatgaagtctcactctgttgcccaagttggagtgcagtggcacgatcttggctcgctgaaacctccacctcccaggttcaagcgattctcctgcctcagcctcctgagcagctgagactgcaggcgtgtaccaccatgcccggctaatttttgtatttttagtagagacggggtttcactatgttggctaggctggtcttgaactcctgaccttgtgatccgcctgcctcagcctcccaaagtgttgggattacaggtgtgagccaccgcactcagccatgacttattttcctttgggtggaatggtagttctatttttagttctttgagaaatatccaaactgctctctacactggctgaactaatttacattcccaccagcagtgtataagcatcctcttttctctgcagcctttccaacaactattttttaactttttaataatacccattctgaccggcgtgaggtggcactcattgtggttttgatttgcatttatctgatgattagtgatgatgagcattttttcatgtttgttgaccacttgtatgtctttttatttttatttttttgagacggagtctcactctgtcatccaggctggagtgtggtggcacgatctcgactcactgcaacctccaccgccccggattcaagtgattctcctgcctcagcttcctgagtagctgggattacaagcgcgtgccaccacacctgggtaatttttgtatttttagtagactcggggtttcaccatgttggccaggttgtctcaaactcctgacctcaggtgatccgcccaccttggccccccaaagtgctgggattacaggcgtgagccaccatgcctggctgtatgtcttcttttgagaagtgcctgttcatgtcctctgcccactttttttcggggggtgggatgggagacggagtctcactctgtcacccaggctggagtgcagtggcacgatctcagctcactgcaacctccgcctcccggattcaagtgattctcctgcctcagcctcccgagtagctgggattacaggtgcccgcaaccatgcctggctaatttttgtattttagtagagatggggtttcaccatgttggccaggatggtcttgaactcctgacctcaggtgatctgcctgccttggcctcctaaagtgctgggattacaggtgtgagccaccgtgcccagccctctgcccactttttaatgggggtctttgttttttgcttgttgaattgtttacattccttatagattctggatattagagctttgttagatgcgtagtttgtaaatattttctcccattctgcaggctgtctgtttactctgttgatagtttcttttgctgtgcagaagctcttaagtttaattaggtcccacttgtcaattttgtttgtttgtttgtttgtttttgagacacagtcttactctgtcaccaaggctggagtgcagaggtgcgatcatagctcactgcagcctcgacctcctggactcaagtgatcctcccacctcagtttcctgagtagctgagactacaggtgtgcaccaccatgccaggctaatttttgtattctttgtacagacgggtttttgccatgttgttcaggctgatttttgttttgctgtaactgctttggaggacttagttatttataaattctttgccgcggttgatgcccaggagggtatttcctaggttttcttctaggattttaattgtttgaagtcttacatttaagtctttaatccgtcttgagttaatttttgtatatggtgataggcaggggtccagtttcattcttctgcatatggatagccagttattccagcaccatttattaaatagggagtcctttccccattgcttatttttgtccaacttgttgaagattagttggttgtaggagggtggctttatttctgtgttctctattctgttccattggtctatgtgtctgtttttgtaccagtactatgctgtttgggttattgtagccttttagtatagttggaagtcaggtaatgtgatgcctccaattctgttatttttgcttaggatcctttggttattctggctcttttttttgtttaatataaattttataatagttttttttctaattctgtgaaaaatgatgttgttagtttgataggaacaggattaaatctgcagattgcttttggcagtatggacattttaatgatattgattcttccaatccatgagcatggagtgtttttccatttgcttgtgtcacatagatgatgctttctaactgtgtctttacatggtggaaagggtgaacaagctctcaggcctctgccctaatgataattacatttcaaaagctctgccttctaataccgtcatcttgggactcaggatttcaacatatcaattttgggagtaaacattcatactatagccccattctaataaatcatttctagaattgtcttttagaggttgtatattagtttcctattgctgttgtaacacttcctattgtgttgtaactgtgaaccacagactcagtggtttaaacaactcagatttatcattttacagttctagaggtcaggagtctgaaatcagtctctctgggctaaaattaagtgggcatcagggctccctccttctggaggccttgggaggagaatctgtttccttgtctttttcagcttctataggttgcctgcattccttggctcatggctccttcttacatcttcagagctagcggtgtagcatctccaatctctctctttctttcttctttttttctttctttctctttttctttctttctctctctgtctctctccccacccctgccctgctctgcttctgtcattaaatcaccttctctcactctgaccctcttgtcttcctcttataagaactgtaggccgggcatggtggctcatgcctgtaatcccagcactttgggaggctgaagtgggtggatcatctgaggtcaggagtttgagaccagcctggccaacatggtgaaacctcgtctctactaaaaatacagaaattagccgggcctggtggtgggcacctgtaatcccagctacttgggaggctgatgcataagaattgctggaacccaggaggcggaggttgcagtgagctgagatcacgccactgcactccagccagggtgacagagtaaaactctgtctaaaaaaaaaaaaaaaaaaagaacttgtgatgacattcttgggattacattgggcacacttggatgatctaggacaatccccccatgtcaagatccgtaacatctgtatgatctcacttaaatgtacaatctagaataatcacactcatagaagcagagagtacaatggtaatcttcagggctggagggaagggaaaatggagaggtgatgatcaaagggtataaggtttagttacgccagataaataaattctggagatctatgcatctgacaaaaggtataatatctagaatctataaggaacttaaagagttcaacaagcaaaaaaacaaataaccccattaaaaagagggcagagggggctgggcgcagtggctcacacctgtaatcctagcactttgggaggctgaggcaggcagactgcctgagctcagaagtttgagaccagcctgggcaacatggcaaaatcccatctctactaaaaacaaagaaaaaaatgtgggcagaggacatgaacaggtgcttctcaaaagaagacatacaagtggccaagaaacatattaaaaaatgttcatcatcactaatcatcatctactatacatcacagtgcctacagctaacaatactgcactgtatacttagatttgccaagaggatagatcttaagtgcccctacaaaaaaaaaaaaagggaatgggggtaggggaggaaactttgggaggtgttgggtatgtttatatgctttacggtggtgatggtttcatggaaatatacttatctccaaactcatcaacatatatatattaaatatgtacagctttttgtatgcaatcctatctcaatgaagtagtttttgttttgttttgtttgttttttacattcacaggttccagtgagtaggatgtggatatccttggggggccattgttgtacttaccatagtttgcctccacagtttttaatgttggggttgcagtaatactgaacatagattgccttccattaacattgtaacagaaatatttccccacaggaaatttgttgttgttgttgttgttttgagacaaagtctcgctcttgtcccccaggctggagtgcaatggtgtgatctcggctcactgcaacctctgcatctcgggttcaagccattctcctgcttcagcctcccgagtagctgggattacaggcgcctaccactatgcctggctaatttttgtatttttagtagaggcagggtttcatcatgttgaccaggctggtctcaaactcctgatctcaggtgatctgcccgcctcagcctcccaaagtgctgggattacaggtgtgagccaccacgcccggacccccacaggaagtttttgtaaccatatttcctcaaggttgtgagtgattcaatatgcccaagctggaaaccaggttgtgttccgtcctgggctgctgtccattttcctgcagcaggcattccccatacttacaatgatggtcttagcgtgggttcccagcatcaaggggggtggaataggattatgattctgatcgcatatagcctaattgcttttcagaaggattgtatcactttacacatctcctgatgaacctcatatgactttcttaaagctgaaaaaagttcgctctttttataatcaaggtattatgtcctcattaaagcatatttggaggctgggcctggtggctcatgcctgtaatcccagcactttgggaggccaagacaggttgattacttcaggttaggagtttgagaccagcctggccaacgtggcaaaaccacatctctactaaaaatacaaaaattagccagacgtggtggcacgcacctgtagtcacagctacttgggaggctgaggcatgagaatagcttaactcgggaggtggaggttgcagtgacccgagatggtgccactgaactccagcctgggtgacagagggagactctgtctcaaaaaacaaaacaaaacaaaacaaacaaacaaaagaatatttgggaaatgtaaaaagagccaaaggaaaaaatcactcatagtctcataaatagaaacacaacttaataattatgtttcaatttataagaattgatcaattctggctgggtgcagtggctcacacctgtaatcccagcactttgggaggcggaggccggcagatcacaaggtcaggagtttgagaccagcctggccaacatggtgaaaccccatctctactaaaaatacaaaaattagctgggcatggtgtcgtgtacctgtaatcccagctacttgggaggctgaggcagaattgcttgaaccaggacctgggaggcggaggttgcagtgagccaagatcatgccaccgtactccagcctgggctacagagagagactccatctcaaaaaaaaaaaaaaaaaaaaaaaaaagaattgataaattcccataaatacttcattaatacttaatacatttctttccaatatttgtctctctgtgtatatatatacaaaattcttaaaaatcatagctatgatgttggagcttcttggaattgttttagattagatctaggacacctcatgttttgggatatgcaggagaatattatcaattgtgtttaccttgggatgctttctgtcctgtttccccaagagattactgctgtcactcagaacctggaggcccagctgggtccttccctggatgctgagtgtcagggcacagtgtggggagtgtggcctgagatccttgaccacaaacacgccatcttgattcttcctacccagactctagtctgaggagttcactggaaaatgattggaaagttaggttttatgacaatgcaactttataatccaattaattgatgctggttacaagcagaatatctttctctttaaaaattaatttacataaatgactaccatttctgccttcatgaacttcatcttcaagctctggtacttagcacagacaatgctaagaaaccacatagaaatccagggacatctggctctgaaaagagaagagttgggagtgtttcatcctatgttcttgaaaggggggtggaataggtttatgattctgatcataaattggctgctttccactttgataaatatctacagtagaagccctaaggctgtaagttagagataagacaaaaaccaaaaactccctaaaatgaaatagtcttacattggtaacccattccaatattaacaatgaaagaaaaatctcattttccctggatgttttacattgttcttcttgaatggaggagaggaactgagttagcatctggaagaaaacaatccaaactggactaggcaaaacaggaggccgttggctcaggcagctggtaagtacagggtgtagtctccggcatggctagattcaggacctcatctctgcctttctcttatgggcttacttcattttcagggagtctttattcctgtagccccaggaattctcatctggtctcattggtccatccctgcggggcggggatcgggggcggtgggaggccaggatgtgggggcggagaggcgggggcaggagaggtatacagggctctaattggtcagactgggccatgtggccactcccaggaaggctttggagtcagggatggagtcagctccatgaaagcttgctgaccaaaaggagagggaaacagggtcattcgcccagagaaaaactgaggttaggattgtcctgtccccacaaacctccttctccacccaccaagatttgactgtcttcgccagggacttgctctagctgggtcaagctcaagtggggttattgaagtggaacagggaaacccacgcatggcaagaacaggggggcactcaaggaacaggggcccagagccaccctctgcagcggctgctccattctctgttctgtgaaaagccctcgttaacttcgcaacaccgacagggatgccagacccaggtctccccaagggccttgaaagctcccgcattttcccctctgccatactcatccctgggtttctcagttcaggtttgcaagagaggatctgattgacctggcttgggtcaggggcccaaccctgacccaatcagctgtggcagatggaatggaggtggggctcagggggtttcccctctccctcagggttgtggtgggtcaatggattctagtgattatggcacctgcagatctcagctgattttgttttttaaaaaattactaatactatttcttgagacgggaacttgctctgtggtccaggctggagtgcagtagtgggatgctagctcactgcaccctcgaactcctggcctcaagccatcctacctccttggcctcccaaacagttgggattacccacatgtgcctctgagcctggcccagttactgatgagtgcctactcttttttctttttttttttttttggcagagtttcgctcttgttgcccagactggagtgtgatggtgagatcttagctcaccgcaacctccgcctcctgggttcaagcaattctcctgccttagcttcacgagtagctgggattataggcatgtgccaccatgcccggctaatttttgtatttttagtagagacggggtttctccatgttggtaaggctggtctcgaactcccgacctcaggtgatccagccgcctcagcctcccaaagtgctgggattacaggagtgagccactgcacggggccgagtgcctactctttatgtgtcccattttaaacttacaccaacactctgaagctgaggctcttagaggccagccttcttgcctgggtcacgcagccactaagtgagtggttaatctgaaactagcacctaggggagctggcgaaggggcccagggtagcagaggccatgaagaactctttccaagttgttgtttttttttgttttttttttttgggggggggggacaatgtcactctgtcagtcaggctggagtacagcggctcaatctcagctgactccagcctcctccttccaagttcaagcgattctcgtgcctcagcctcctgagtagctgggactacaggcgcgcgccaccacgcccgtctagtttttgtatttttagtagagacagggttttgccatgttgcccaggctggtctcgaagtcctggcctcaagtgatctgcctgtctcggcctcccaaagtactaggattacaggcttgagccactgcacccggcccagattggttctttaaagcggagttgagaggtggcgctggaggggaggaagcccttcgacatttgctcccagcctcaaaactgggttgcaccggcatctgttcctagccctgtggggttcctggagccccgccttgtcccgcccggcctccctgagttcttgtcctccccctgcccaccagtctcagtgtgcggggtggggaccaccaggctgggaagcccagagttcccaggcaactcgtgcgcctgggagggtcatagaatccgtcctacactcctcaggatcttgaagggggctcttccttacattcccagtcacccctcccccagcccctacacagggcctaggtaacctgtctgcaccccactcccactctgtatcagctgccctcttcctcagcaccctatcccactggagcaccttttccaactccagtcgccacttttaatctgccgccttttcccagcagccagtcctgattgcctcctccgtagccccagttgcccactgctttagatagtgtcgcagctggctgtgaggagtgtcctgattctgtaacccggcacctcctccacagggccctagacgcctcaagccttccaggacgtttgttgatcaaaggcgaaggatgtgcagaatcttcgtccatctacgaattaattctcgaaacctgcttcgagtgggcctcgcgcgtaacacaggggacactcagtggtgaacgagaccactcgcttaggcctagcagcgaggtgaccgttcactcaacacacactaactgggtcccgcaggacacgccccggctggtcgcgggggttacccggggtgccctcagtcggccggccggccataaccggcgtgatctcctcgcgccgagagacccagcagggacctcgcaaaacccaatccacgttttgttttattttgtctttttgcctctcaaatgcatggaaattggctgctagtagctttgctacaggagaaaatcgctaatctgtagtgcaaaatcggcgcacaggggttttctctgagattgtctagacgccgcgcgggcgggtcggaggcgccagacacattgtatccggagcgcggagctcgggagcaacagtcgccgcctctactctgtatctgcgccgccccaggcgcccagtgtccgcgctgggcctgggactgccctcgggggatggggcccacgcgggctttgatggggggccgggggccactttgtccacccaggcgaggcttgggtccagcgccggccacatcaactcccgggggatctagcagcgcggaggccaagcaggaggcccaggagccccgcgcgtcttccattagcgcagggacctccgggccacagctcagagaatcggaaggcctcctcccccttcccgagcgctgccactggggccgaggtttccagcaagaacccgcgtgtccctgcgcacgcacacacggtgcacacgtcagtccggcgcctccccgtgccccgactcacgcaggtcctcccgcgcgcccgcaacacgcccgcaggctcctgtgtctgctgccggggcagcggggcccggaagggtaagaacgcggctcgctagcgggatggggaccctggcccggcctggacgctgtcccgggcggggcctgggggcggagcgcgccgggccgggcgcgcaggaggggaggcgggtccgcgccgccgccgtccgcgccgccccgcccttggcccagccgctcgctcggctccgctccctggctcggctccctgcctccgcgtcgcagcccccgccgtagccgcctccgagcccgccgccacatcctctgaggtaggcgcagcggaaaaggaccccggcttccttgcgccctggacggcgggggccaggcccctggggagctgagagggaggcgctgagggaggagcgggcgaggggccccggcagcccggccgcggggagggatcgcgagcggccggcgcgggcctggctggtgagcgggcgggcagagaaggccgcacaggcgggtgccgaacaggtctgggctggggagcgcgaggccgagggtccagagacgcctgcggctggcggcgagaggcggcccgggcttgcgggcggaagtgcaagggcggccgcgtggaggcccggcgggccgcgcgtctaggtgaccttccccggcggcgccctctggccctggatcccaccagcgtgcatccggcggggacccgttcgccgcccacgctcgccggaccaggccagcgggcgggtgccggccacgctgccgcctcggggatgagctcacgtgacgaccgtggccccgagtccccaggcccacgcgccctggccggcccacgcccgcagaagctggcgcccggcaccgcccgcctgtgccagagccttctagagcggaacgcgccggccgagagtcgacttaggcggtagaggccggagctcgggcctgggctgaaggtttggcctcggaaaaggaggccccacggggaaggatgtggccttcttggtcttaggagtgattactggttcggtcgttcattcattcgccaaatgcggcggtgcattctggaaactgtttcggagcctgactttggattagaggcccgcagtcttagtggtttgtacaaggtcacacagctgggaagtccccataccttcgttttctcatctataggacgggagcaattgtacctctccttcgatgagttttggggaataataaaatgaattaattagcatgaaacctttagaacagtgccggtgtggagaagggctaagtagaaaccctgacacccttggggctttttgggtgaatccagcccatcccccgcagaccattttgctacacgtggcgttgtggaaggggttcaataaatgtagctcctgtttttaaacattctttcactattattgacaagcatttgtataccaggtattgagtaactttcagcttaatttatgaaaaatcttgtaagtttacaaatggacattgtcaagctggagcagtaagtttgcatgtggagatcttgaatgcaggagcagaccctggtttagagcccgttccgcccggggtccctgtccccttgactagcctcccctctcctggggagataggggaaagggctcctctgttgcctaaacttctccactgaggcaggagaaggccagagcagactaccgagggccagccttcattctgcccaccccagctctggaccaactcagctcctaagggtcagactgaggcactgaggccctgtgctactttgtcttcagtgcctggggtggtgctgcctggcacacagtaggtgcttgagaagggtctgtgggggtaaatgcactcttgtgtcagaatccacccatctttactgacagagttttactattccagtacatggcccatagtaggtgcttattgagtatttgtggaattattgaatgggcatatgaagggctgcaggcccagaccatagtcctttgatcctggactttttttttttttgagacagggtcttgctctgttgccaggtctggagcgcggtggcaccataacggctcatggcagcttctgtttcctgggttcaggcaatcctcccacctcagcctcacagagtatctgggatcccaggcacacaccaccacgcctggctaatttttgtatttttagtagagtcggggtttcaccatgtttgccaggctgatctcaaactcctggcctcaagcaatccacccgcctccgcctcccaaagtgctgggattacacgcgtgagccaccatgcccggtcctggacatccttttgagggacacagacatctcacttgtggaaaacagcctcacctagcagagagtcacaaatatttaaagaactgtaacagtatgtatagtctcttgaaataagtgctttaaacacatcgtcttcattctctggttttccaagtcccgagggaaacttgttgaactggtgtttctgggcttgcagggagggtgacatgggtgactgggattctacagaaggtgttgggcctgttaccccttccctcatggtgggtggatggacagcttgtgctggggttgtcctgagtagggtgcctgcctgtgggtagtggggactactccttgttgattatttagttttatttttgctattctagagtggggctataggcaggggttattcgtagctcagaaagtgggggaccatacagggatgaggtgcctgtgggcccctggccttgctgaacactaggcaggtgtggacagtgaactccatgctggggaggtgaagggcatccaacctctacccttaccaggaagatgctcctgaagcactgaagtccacttcgcctttgatggaatttcccgtggtgtagtgtcttcggtggtagtgactggaagaggcgcatgtgtggttgaggaccagccgaagcttggaggcagcccctcctggtgctcagagattctgtagtctgcggctttgggttttccatggagtcctgtggtagccactgagaaaagttgaccagtgggctcctcagctgggtctgggcgcatttctccattttaccacgtactcagggggtttgggatgagtgggactttaagttctttactcagaactgtgctggaaagagcactggagagtagcttaggcccataacacaggtctggtgagccatagggtcggtctcatacaggtcaagtcactgtcttgtgcctcagtttctctctctcttttttttttttttttttttagatggagtctcactctgttgcccaggctggagtgcagtggtgcaatctcggctccctgcaatctctacctctcgggttcaagcaagtctctgcctcaccctctcgagtagccgggattacaggcgcctgccaccatgcctggctaatttttttgtattttttagtagagatggggtttcaccatcttggccaggttggtcttgaactcctgacctcctgatccacccgcctcggcctcctaaagtgcggggattgcaggtgtgagccactgagcccggccgagtttgtctgctataaaagtatgattgtcgtcattacagtgattgctgattgagggcttgctcagcacctttctgggggctcaacgaatgttctgtgatgttgagttcaccaccctataccctgggagagagatagtgtgtttccatttcacaggtcagcagactcgagcacagagaggtgaggtaacacagcctggcaggagtggagttgggattcaaggcctggtctgaatggtggtgctctcacattgcagttgcactccaagggacccttgcaaggtgctaacagatgtgaatgccttttggaaagtcaaaattggtgttcagatgggagacattatttttccacaccagtcagagtgaacttgtgcatggctgtgtgcgggccaactggcagtggacaatggagtcacctctatttcttgcaaggacagtggtgctgagtgtctattataagggtccgttttccctgggatctggtgggaggcattctttcaggacctgttcagctaaacaatgcctcattgtggacatgaaggactctggaccctgtggttcagggtgaccttttgaacatgcttagcagccattattataataaatatacaaaatgaaaacttgtgataaaatactgtgtgtattccctgcttaccaagcgccagccactgtaccaagtgttgtatattaacgagctaattcagtcctcacagtgacgccaatccaggctctctttctccatattagagctgaagaaaaaggagtagagaggttgcgacttgcccaaagtcacatacctagaaagtggtggggtgggttagaactcaggtctatttgattcccgaggcttcctgcccaagcactgtctgtctcaaccctacctggtcaagccaagcagtgaggctccagggaacttgaggtgccttaggtcaggtaggagccccaggtatgcctgggatccagaccatagtgtactggctgccagcgcaggccatctccccttgataggtgggtgggcaggctgccctgagtcagcaacctcctgagcccaggagctcagcatggaactcagctgtgctggtggtggcccagctgccagggtgtttcaaaatagaagctacccctggaaagctctactgcccactgcgagactgttgtggaagaatggagggagagaacagctgcattgggtacgcagacctgctaccagaacacagggccatcagcctttgccagcatcctggagcttgaaccaggaactgttcccctgggttgtttcttcctggcaagaaagagaaagtgctggagtgtgtgtgtgtgcatgcgtgcatgtgtgtgagcgagctgctgattgtgttcgcccccatgttggcttttagagctagggttgccttctgctggggaagttgcttttcctggtcctcagggctaggaagaggtgctgtttctgtgatcactggctggtctgatacccctcctataggctggcctagttctgccctgacaaaccacctagaatggtgttggtgaaacagcggggccagagacttttccatagtactctcttccttggcagaatcataagatgatggcaatgatgatgatgatggttgtgattgctctgttggttagcgtctttgcagggatctggtgcacacttacacttggtaatccaggagagtttaatgaagacatcatttgcaaagctgtggatggggtgtcaggtctggtctgttaacaccctgaggcctacaagagagggagcttcttggcaggagctgtggccttgggtagaggaaggtagtcattgcccatctgaagcctagcagggagggagactcggggtgagtaccccgacttcattcttccctaaactcccgtcttctgcaagtacctcacgttgaaaggctaagcccaatcataagcccatggacagcagtccataatgatcagttctgggggcacagagcagggtggaagggaggagaatggatctggaggggcagacagagtatccagtgtagtggattatggttattactgccatttgttgaacacttactccatgccagatacttctgctgttctgcctgtttcactcattccttgtaacaacttccttaggcctaaggcctttcctcccagctgtttttagctgagtcttggagacccatggccaccctgctccctgtatcaaccattgcagtagttgttggctctctaggggtgcaaagctcatctgcctgaatccttctattattactatttatttctttttattttttatttaaaagagacagggtctcactgtattgcccaggctggtctcgaactcctgcattcaggcgatcctcctgcctcagcctcccaaagtgctgggattagaggcgtgagccaccatgcctggcacatgcctgaatccttttgagggagcctctgcagagaagagagcatatttctaccaggcgggggcctggtaggtgcttagtgcaggaaccgccctgagctgctgcttctcagtggcacctgggggcagccctgcctgttaggcacaggctgagaggtagggcaggaggagttccatctcttctggcaggctcttcttgaacaagcgcctccggtgattcttgtgcaccctgaagttagggagctctttcctgctcatgatttctggcagggtggccaagccactagtggtcacctgggagtgaaatgtgccccgacggaccttgcctgataactcttccatctcagtgtagtttaaatctgttcttgcaatctgtatggacactctaggtagccttctggcattgctactgcagcagccttggaacgtgatttgggacacaacacagctcaatttcaggcacagtggttggcttttaaagtgctgtttttttggagagggagtctctcgctctgtcacccaggctggagtgcagtggcacgatcttggctcactgcagcctttgcctttgggttcaagtgattctcatgcctcagcctcccaagtagctgggattacaggcacttaccaccacgcccggctaatttttgtattgaaattctttatccttaaacaaattattagtatacacaaacagcttaaataatgaagcagaacaaaaaatgaaaattcgatttgaagtgcattccttccctaaacctccttctccagaagcgtatctaagccagccccaatttgcagattggcttgtatccttccacatgctttcccatccattcatgaacatagaaagatgtgtaaaaaggttttcctccaattacatggaattacaaattttctgacttttttcatttaactgtatcatagctagctagctttctttcttttttttttttttgtttcgagacggagttttactcttgttgcccaggctggattacaatggcgcgatctcagctcaccacaacctccacctcccaggttgaggcaattcttctgccccagcctcccgagtagctgggattacaggcatgcgccaccacgcctggctaatttattttgtatttttaatagagacagggtttctccatgttggtcagggtggtctcgaactcctgacctcaggtgacccgcccacctcggcctcccaaagtgctgggattacaggcatgagccactgcgcacggctatcgtagcttcatagctagctttctatgccaccacatacatccaccttattcttttttttttttttttttttttgtgagacagtctcgctctgtcatccaggctggagtgcagtggcatgatcttggctcactgcaacctctgcctcctggtttaagcttgtgcctcagcctctcaagtagctggcattacaggcgtgcaccatcacacctgggtgattttttttttttattttttttttatttttagtagagacggggttttgccatgttggccaggttgatctggaagtcctggcctgaagtgatccgcccacctcagcctcccaaagtgctgggattacaggcatgagccacccaccttattctttttgattaccatatggtactccttagtttgcaagtatagtaccttaatttttattcattcattttccttttgatggacttttaggttgcttctgggttttgtgttacaaatactgctgcagtgagcatcctcatatacacatctttgagtagtgccttggttgctacagtggggcaggttcctagaagtggaattgccactagggttaatgctgggttaattgctctccaaaaagagtgtacctgtagtactcccccttggcgtgaacaagagtgactgttttccacaccctcactgacactggatattatttacgtttttgccagactgctggttaagtgagcttctgaaacacagatgtggtagtcactcaacagtggctcttggtggcccttagaataaaatccatgcatggtattgaggtcagaagcaaccagtgcttctgatggcacttggtctcctcagcctgagatcagctctccttaggccgaggtgggagcaggcagggagtggaggtcattgctagttgagggtctccccaactcccccactcttggtgatgctgcaacagtgagcctgcagagggagctcttacttcctggttgcattgtaatgagttcctattgtcagattccaagtttctacttttttccccattgctaaataatactttgatgctcattgctcattcactcatcaaacacatttatattgaatgcctattatgtgccagggcttagcatctttatatacgtaactttttccatattttggataaatttatgcatgacaggctctggggtgctttgaattcaaagaggtgattttgggggtaggtgtatggggtagggtggggtgggggcacggtgagcacagcagctgtcattgccattcagctgatgagccaagaaggatgtgtacccccaagacagaggttacgtaagtattatgcagactgtgctgggtgatagatacactatccttcccctctgtgcttccagtatgggccggattttcattcctcagctggaatggggcttgcataatttgttcaaggtcagccaaggaaaggttgggtaggtagactggcaggctgtggaggggaaccagggactcctgtatcctggtgtgacttgctggtccttctcaaagtcttcagtgactgcaggcaggtctgctcagcctggccctgcccatccctctgtttcctaccaaccagtgggaacaaagcccccaggctctgccctgaagccatcactcaggcagagaggcctgtggttctgactcccccaggacgccctctgacttctgtctgtccagggctagctgctttgccgatgccagactgccctgcttcatgcgcagcctctagaggctcagcttgtgaaggcccctggggggtggatgctgcagagacagctgtgtatcagtagctaactgtacaggctccgatttggagcagatctgggtggaaggagtgactgggaggggtgggggccagggttcagccttcaagtcagcaccctggcagggtgttaagtgaaagcaggctttgttgccgacttttctttcctccagtcctcgccttagaaaattaatgcagattattatttctatcataaaattgtctctgaaatgggttcgagagctgtgtaaaaatgggcattttgggggtgctgtctgtagctgtaagaaagctgaacttctcggagcggcagagctgtctcgggccttccttagttccgtcagatcagtgcagcaggggatgggccgaagtgcacaaaaaggaggggaagctaccactacctggcagttgggggcctttagtgaaagggtgagtcatccttttgctgtcctcggtggtgtcacttcaggcccaggagtggacttgactccattcagccagtggtttctgtgagtcttccttgccaggtgctatgctggggagaatgcttacttgggggcccagaacgggggagattatgcttcattgtcggtgttcaaggagatggggaagagagcaagacacagatgagaaagccagcatccagtatgtttacagtgaggcattggatagggatatgttttagtgaaccagcaagttcacttgcgtgctgctggtaccaactacatggttgtgttgtggaaccccacagccccaaaagagcttggccgtgtcggagctcctagaggccccaggaggggtccggtctgctcttctgagctctgctctctgagtgccttgtccttgggtggtaatctctttagtggccttgtacttcaggctgatgtttgctgtgggtggggtgttttttgacaggtggctgtgcttgttggattttggggattagcgatgagagagggcatttggggaacatttaatggatgagtgctctgcctttatcctgagcggggaccagtccagatgtgaaggctgctgtgtctgggaggcgtctcttctgtggggtcaggggagagtcgtggggaaggctctggctcctaaggtccagggaggtcttaggtgacccacagatattaccactggactgcttctccttctgcttccccagcccccaccccggctgagtttgtggcccccctgggaggcatagcactgaagaggggtacttggttcactgatggtttgttaaccctgtcgggtggagaatgttctgggcccgttactgttatgttctgtgtctgcctggggttacattgcctcagctttcaatccagagttgttctcctaggaaggtgtcaggtaaagggtatttcttgaggttctggtgggtggtttcctggtctatcccggggggatgcacctacagggttagtttgggagggaggaacaagtggggagaggggagcccccagactggaaagagccagtggcgggcagtgtaaaatggatcttcccccctcatctctctaccctgatactaatgtgggctgacctgtccatggtttcagcctgatcatgtgcaagaaataacacagcagcgacaaaaataggacagagtaaacagctcgctgctcttctgtctgtgctctgacacaaaagtgagctgggataaaattaacaaagcatctggaaaaagtaaagtaggacctggatcacaacttcacaatttaaaattgtagaagtttatactgtttcttttacaacatactcaatgagtctgtggcctcctgcaatgcctttgaagttaaagctttggccaagaatgcaacttccattgatgatatggaagcatatcatgtcatatgacatgccaggagcatgtcatatatgtgtttatttgtgtgaatatatatacatgtaacttcagatggtatatatgcagatgaattttgataatttaggtatactgtattttaaaacgaatggaatggtccttctggttgagactaatgattctggggatggagaaggtgcaggagatgaggctttctcatgcatgaccccctctcctcctgggcagagcacaccatgtacagtcccagattaggatattaatcctgtgtacacagcatatacagcatgccaaagcaaagccttccaggaatgcagtgtggtccttagggcaaagactatttgagttactctccttccttgaacaccgaggtgcttaataaatgtttgttgattgacttagtgatatgcagcaatcccaagtagtcctttgatggttggttttaaaaataaagttacactggagctcaataaatatttgtttaatgtatttggaggatgtatttgggttttttccatgtgaagagctgccaaactggtttggttttactgtattctctatgagaaatatgaagtgggttcccataaagtccaaaagttttgtgaaaagttgggcccatcctggcatatagtaggtactccataaatatttgttgaatgaatgaaatcagagccacatggaaaatgatgttcccatgaaaagctctgatttctattcggtacatttaatgtcctagtagctgacattttgtaagatgatatgttttattggcaacagtcctacaattcagtaaagtcactggctcatgggaatgtgtctttgacagtttattcattaagcaaatatttcctgactcctactctgttctgggcctgggctcagtcctggggatgctgaggaggagaggtctaaattgttgatcatctgtcaacaaagactcattgagtgtctcaagctctggccacaaaatgaaggacaagacagcaagggcttcttggcccatctgggaggataagctacctggtagtcttagtgctaggtgatttttattggttgctaattacatctaataattgttattgatggaaagctaatttccctaattatcaatgcatttattctggtgattcttttatcatagcagaagatggctgtgccacccacgtatgccgatcttggcaaatctgccagggatgtcttcaccaagggctatggtgagtgttgcagagagggggtgcctttcagctcacagactgagttggcatgtttgagactttaccgataactgtttaggagacctgggtaggtcagctgttctgaactttcacgtgagggaaaaaagaagctttcatttgtgtggcaattgtagcaactttggttgtgcacccagttggacaggctcctgcattggtgctgtcaagtgggtattcttgttttcttttccaagtgtggagcagccctgtggaagctgctgcagtggagcgcggcttctatatttagcctgtgcttaggcacatgcccacgaggcccagtaactgtgtctttgccagctgtcaggtgtcttcttatcagaccctgctgggagtgcaggtgggacccaggtgggggtgcccattctgtctgctgctgttccatggcagctgagagctccccccacgagcagcagcagagactgggtgccctcagcccctgtggcaggagtgtgcttctttttaaaaaagcatcctgaagcaaccatgagggaggcagaggtgctgttctctagttatttaacctattgacagttgtcttcttctttctttaggatttggcttaataaagcttgatttgaaaacaaaatctgagaatggattggtaagttgtccaacccacatggaacatgagtatttatttatttttattttattttatttatttatttttgagatggagttttgctcttgtcgcccaggctggagtacaatggcgtgatctcagctcaccacaacctccacttcttgggttcaagcgattctcctacctcagcctaccgagtagctgggattacaggcacccgccaccatgctcggctaattttgtatttttaatagagacggggtttttccatgttggtcaggctggtcttgaactcccgacttcaggtgatccgcccaccttggcctcccaaagtgctggaattataggcatgagccactgcgcctggcttatttttatttttaaaaaagattttagattcagggtgtacatgtgcaggtttgttacatggatgtattgtgtaatggtgaggtttgggcttctagtgtacccattacccaaatagtgaccattgtatggaacgtgggaatttgttgtagatcaacaaataactgtcgtgacctggcccgcaaagccaaaagaaggtacttttttttttttattctggcagtttttgtggttttcacattcattccattttctgcatgatgggtggtccaggggaaccatgccagtaggcccccagttcagcagcgggtaatagaggagaatgggtcaggtctcagttttagttttccttgtgcttcttattttcaaattcacctgcattcaaccacataagtgtttttaaagtaatcttagtagtccctttgaaattatgtgtgcagtaattgttggaagaaagaagttttgggtttgaattaccgctgtgtcagctttagctcagtgctttttctctgtactgccctggagccaggatggaagggagatgctttcctgtccagactgaagagttacagggaggaaggaagctgtctgctgacaacaaattccccataagatttctttacatagcaggctcctttactcccatctgtactttaaatatctatttgaattgtagagttagccttggcccccccacattcagggtcttgcctcttgcagaaaggcaagtatagtgtttaggagtgaagtgaagccaagtgagtgctatggtgcaggctgtgactcttctctctcctttgaaggaatttacaagctcaggctcagccaacactgagaccaccaaagtgacgggcagtctggaaaccaagtacagatggactgagtacggcctgacgtttacagagaaatggaataccgacaatacactaggcaccgagattactgtggaagatcaggtaatggctgctgtgaaaagatgtggatttattaattcgcatctgccagcctgccttgtgactaaatctagtggcaaatttcttttctgttcagcttgcacgtggactgaagctgaccttcgattcatccttctcacctaacactgggtaagagtttcatctgttttctccacaaggatgttctctgatgttgcaggtggtggaagccctttgtgacaaaatgttttgggggctgacagcacctaaaatatggtctccgagacctggcgatttaagtcctctggttttgatttggtcccaggggtcgtatccacatctatgcactaacagactatgctataatgagcacttcctaattcaggactggtgtttacccaacaaacgatttctaagtgccacctgtgcttggccctgtgcccatctggagatctaagggtgcccaggccatgattgttacccgccaaggagctcactttctaatagaggattcagaccagtgtttagccgtgttttgtaataagattctgcattttgttagtgttctcctagtttctgccatggaggttgcaggatttctgttcagtaatagccatttcatgtgagttaggctgctggtgatgtaagtggctatgaccaaacgggagtgggtgacatttggaagcagggcctaactggtcactgttgccagcctcatttcttcaggcatggaagtccttctcccagcttcctgctgcttagggacactgagaccctgtgggtgtaactgcaaggtggctcctgaggctgcactttccccaggccttctggccacagatgtaataggcttgttagttcttgaccatcacttggcatgatagcatggtagtctgcctcaattcctgggtgcttttcaaagtgcctagaaggaattattcccttttagaatacacccttgtttttttccactcatattggtgggtcttccaaacctggggaagatgttttatatagtgatgttagggtcaagggcatgtactgaatttcagtttttaaaaattgtgggccgggcgtggtggctcacgcctgtaatcccaacactttgggaggctgaggcaggcaaatcacctgaggtcggaagtttgagaccagcctgaccaacgtggagaaaccctgtctctactaaacataaaaattagctgcgcctggtgggcgcatgcctgtaatcccagctacttgggaggctgaggcaggagaatcgcttgaacctgggaggcagaggttgtggtgagccaaggtggtgccattgcactgcaccctgggcaagaagagcgaaactccatctcaaaagaaaaaaaaaaaaaagagtcggatgcagtgactcatgcctgtgatcccagcactttgggaggctgaggtgggtggattgcttgaggtcaggagtttgagaccagcctgggcaacatggcaaaaccccatctctaataaaaatacaaaaattagccaggcatgatggtgcgtgcctgtagtcccagatacttgggatgctgaggcatgagaatcgcttgaacccaggagacagaggttgcagtgagctgagatcgcaccactgcactccagcctgggctacagagagagactctgtctccaaaaaaaaaaaaaaattgtggtaagatatacatataaaacttaacatctttaagtgtgtagttaaatggcactatgaatttttcagttttgccattcattttttttctttcttccttttttcctttccaacagatatttattagagggaggatctaccaagtgcagacctgtgctgggtgtgcagtgcacacaagtgactgggcacacagggttcctatcctctggagatgtcgtcttatagcttggctatagatgatctgaagagaccattgttacggggctgatttactctcattcctcttcgctgctgtagtttctcctgcaagagcactgcctttttgcagtgctgtgcactctccccccaggaactctgccatggtatcagggagcggttatctggaaagatcctgggataggatgagaggctggaggatgtgcccacatgcttgaatttgctgcctgggactttgcctgctgccctgggatagcacactttggaatttgtaggcgatttccttcccatgaccttagggagctttgcagaggtctccaggccatgcagtataaaacacaaaggaaagttttttggttttttttttttttgggttgagggggacggagtcttgctctgtcgcccaggctggagtgcagtggtgtgatctcagctcactgcaacctcctcctcccgggttcaagtgatccttttgcctcagcctcccaagtagctgggactacagacacgggccaccatgcctggctaatttttgtatttttagtggagacgggggtttcaccgtattggccaggctggtcttgaacttctgacctcgtgatccacctgcctcggcctcccaaagtgctgggcagattcatgtgtttctcctgcctcagcctcccgagtagccgggattacaggaatgcaccaccacacccagctaattttgtatttttaatagagacagggtctctccatgttggtcaggctggtcttgaactcctgaccttgggtgatctgcccacctcagcctcccaaagtgccgggtttacaggcgtgagccactgcacctgccccccttttttttttaatttactttttatttcaaaataattttatacttagaaaaaaatgtggcaaaaatagtatgcagagttctcctgtgttcttcacccagctcctaatgttaatggtttacgtaactataatgatcagaatcagcaagttaatgttgatatcatatagttaattaatctgttgtcacaatgacgtcttttttctgatctgtgatccagttcaggttcctaaattgcatctaattgttaagtcttctctaatctggaatattttctgactctgacacttttgaaaaagagtggccaattattttgttaagatgtccctcagtttggatttgtctgatgcttccttatgattaaatttaggttatgcatttttggcaactgtagttgttgtgttatattcttctctgcacctgatgttaggaagaatatatcagtaggcctcatttttggtgatcagttttgaagtggtgtctgccaactctcttcattgtaaagctactatttttctctttgtaattagtaagtatcttgtgggtagacactttgagattatgcagatattctatttctcatcatacttttgctcaaaaatagtaacatccattggtgattcttgcctgcaacagttacgcttggcaaatggtgactggagtgcagtggtgtgatcctggctcactgcaacctctgcctcctgggatccagcaatcctccttcctcagcctcccaagtagctgggaccacaggcgtgtgccaccaagcccagctaatttttgtatttttagtagagatgaggtttcaccaggttggccaggctggtctagaacttctcagctcaagcgatccacccgtctcagcctcccaaattgttgggattacaggtgtgagccaccacgcctggctacaaatggtgattttcttttcttttttgtttttatgagatggggtctcactctgtcacctaggctggagtgcagtggtatgatctcggctcattgcaacctctgcctccctggctcaagggatcctccctcctcggcctccccagtagctgggactacaggtgcctgctgccacccctggttgatttttatatttttggtagagacagtgtttcaccatgttgctcagtctggtctcaaactcctgactcaagtgatctgcctcccaccttggcctcccaaaattctgggattacaggtgtgagccaccacacctggcctcaaatggtaattttctattgccatccttccttcacttgttaattggtattctaccgtaaggaagagctattccttcttccccatgtatttatttaatcaattatttatttatattagtatagatgcatggacatttactctatgggctataatgcacagtgtcatttattttgtcgctcaagttgtcccagatatgggctttgggagaatacactctgtgtgctttttgacaaacctctgtcgtttttcagagcatgtctttatttctggttttagaaagtgtaccacgctcatctagtacttgtttttccccagtcctgctatctgccatttctccaaggagccttggttctttatgttggagaatgatatttagaaactaagattgtaggcctggcgcgggggctcatgcctgcaatcccagcactttggaatgctgaggcaggtggatcacgaggtcaggtgtttgagaccagcctggcaaaaccctgtctttactaaaaatacaaaaattagctgggtgtggtggcgcacacctgtaatcccagctactcaggaggctgaggcaggagaattgcttgaacccaggaggtggaggttgcagcgagccgagatggtaccactgcactccaatgtgggcgacagagcaagactccatctcaaaaaaaaaacaaaactaaaattctgggtgctagatgtacataatgctactgggtatttgaggaaagttctggtggtgcatcatggagattagaaacgaaagctggctttccaaagtgactgagggtacagcctgggaaaacacctggctcccaggaggagcggagtgtagaccacatctggatgaggccacagacctcaataaggaccagcacccacgctgagtatccatcacaaataaagcttgcttgttaaccacaaatcagtcaggcctctctcgggtgcttgtcaaattagcactactgttgaaatagcttaaaaataaatcccaataatatctgaaagaggaagactccacagacatggtgtgcagtgttagaaagagacctggagagaagcctgagccactccccagcactgccctttctcttggggattgtgggccctggccagaatccagtgagacagtgggtgggggtgccatgtcaactggtgcaggtggtgcacaccactggtcagaggccctgccataggcatcatagtttgtgatcatcagcagctttttattaaaaattgaaaaaggagatggttagaagatgcctgattttatatttccttttccctttgtaaatgtcagcctctcaacagctgtctaatcatcagtcatctcaaccagcctggtgccaatcacatacttggctgaaacccagacttctttccccaaagagcaggcagatgaagataggtttctttttcttttttcttgagacatcttgctctgtcgctcaggctggagtgcagtgatgtgatttcagctcactgcaacctccacctcccaggttcaagcaattctcgtgcctcagcctcctgaatagctgggattacaggcacatgccaccacgtcctgctaatttttgtatttttagtagagacagggtttttccgtgttggccaggctggtctccaactcctgacctcaagtgatctgccctccttggagtgctgggattacaggtgtgagccactacgcctgaccagttttggatttttcttattgagagataatttggttgttactcctttccttcaaaccttgccaaaatgtacagaagtaacttgaacaaaattgaggttccaaggcataagtttcattgtcacttgttctgttggtgagcaggtctgtgcacacctactcccaactgctgagggagctgagcagccaaagaaagagactgacaaatccagtttctcagaaagaaacatttaatagagacttacaaatagaagcgatgtctcaagcagccaagagacagtggatccctgcattcatcctccagaaagtattctttatatagcaagcttttagagtaaagacatgtgcatgtcttagaccatcttgcagaaaactcttgcaaaacttgtgaccaaagggaggttagataagcatctttactttttaaatttttatttatttatttttttgagacagtctcactctgtcacccgggctggactgcagaggcgtgatcttggctcattgcaacctctgcctcccgggttccagcgattcttctgcctcagcctcctgagtgtctgggactacaggtgtgcaccaccacacccagctaatttttgtatttttagtagagatggaattttgccatgttggccaggctggtcttgaactcctaagctcaagtgatctacctgccttggcctctaaaagtgttggaattacaggtgtgaggcactgtgcccggctggcattgtttcttttatgggattgtctatgatgcattccttggtcgtcatggctgtattaggctattcttgccaggcaaggtggctcacgcctgtaatcctagcatttttggaggctgaggcaggcagattgcttgagcccaggagttggagaccagcctaggtaacatggtgaaaccccatctacacacacacacacacacacacacacacacacacacacacacacacacacgctggtcattgtggtgagcgcctatagtcttgtccttgcattgctctaaagaaatacctggccaggcgaggtggctcacacctgtaatcccagcattttgggaggctaaggcaggcagattgcttgagcccaggagttggagaccagcctaggcaacatggttaaaccccgtctacccacatgcacacacacactagctgggcctggtggtgcgcacctatagtcagttctagctacctgggaggctgaggtgggaggatcacctgagctcaggaggtaggggctgtagtgagccatgatcgcaccactgcactcctgcctggacaacagagtgagaccttgtctgaaaaaaagaaaaaaatacctgaggatagctaatttatgaagaaaagaggttcaattggctcatggttctgcagtctgtacaagcagagcacaggcatctgctcggcttctgggaaggcgtcaggaagcttttagtcatggtgattgatgaagcaggagcaggcacatcacatggcaagagcaggagcaagagagagagagtggtggggaggtgccacacgcaaacaaccagatctcataactcattattgggaggacagcaccaatccatgagggatccacccccatggtctaaccaccacccagcaggtccaacactggggactgcatttcaacatgagattcagaagatacagcatcgaaactgtatcagtggtgattttgtttcaagacggtgtcactcttgccatggaacaggctattttcctacatcacttgggaggggtgctggctttattttcagctgtgacctctaaaattcttgtctcattgagaatttggaatttttaacctttatttttttttaatgagaaatctgaaacatacaaaaatatacagaaaaatatgtttaaccctcattctattcctatcacacagctttgatagttaccaacctgtggccaatcatgttttatttatacagccataaatataacactcctccacgcacatactattttaagtaaataacaacacttaatttcagctgtaaatattttattatgtatctttaaatggcaataatccattttaaaggagcataaccatgatattattattatattgaaaaaagttgatcatttctttttctttttttttttttttaaagatggagtttcactcttgttgcccaggctggagtgcaatggtgcgatctcagctcacgcagcctccgcctcccgggttcaagtgattgtcctgcctcagcctcctgagtagctgggattacaggcatgggccaccacacccggctaattttgtgtttttagtagagacgggatttctccgtgttggtcaggctgggctcgaactcccgacctcaggtgatccgcctgccccagcctcccaaagtgctgagattacaggcatgagccactgcgcccagtggatcatttcttaatattgtcaaatctctagtctgttcaaatttacatgattgtttcatgatttttttttttttttttgagactgagttttattcttgctacccaggctggagtgcagtggcgcggtcttggctcactgcaacctccacctcctgggttcaagtgattctcctgcctcagcctcccaagtagatgagattacaggcatgtgccaccacacccagctaatttttgcatttttagtagagatggggttttgccatgttggccaggctggccttgaactcctgacctcaggtgatccacccacctcggcctcccgaagtgttgggattataggcgtaagccaccgcacctggccttttgctgtttttaaaataacaggttggttctttagtctctaaagatgacagctatgtgatttgagcgttattataattcttttttttttttttttgagacggagtcttactctgtcgcccaggctggagtgcagtggcgcgatctcggctcactgcaacctctgcctcccgggttcaagcgtttctcctgcctcagcctcctgagtagctgggattacacacgcccaccaccgcgcccagctaatttttgtgtttttagtagagacggtgtttcaccatgttggccaggctggtctcgaacttctgaccttgtgatccacctgcctcagcctcccaaagtgctggaattactggcatgagccactgcgcctggccccgagtgtcattataatgcctagaataaacatactgtttaatatgtttcagcctattgctaatatttttcttattgaggctcacattgctccattgtcgaagcccttgggagcctcttcaggttaccttgtaagtccttttgcctccaccccagtagtcttcaatagctttgatagatgttttaggttactgtgtacatttcctgcctaagatctgtagttggccatttctccaaggagcactggttccatttaggaggaaatggtctaggtgctgaggatgaagcattaatctcaatgtgaataaagctagaagtgaacagtgctgtgtagtccttgaggctctgagtggatctggttcctcctgtggtctctgctgagaatgcagcttcctgtgggagatgtcgatcttgtaactgaatgatagagacaatcagataaaaatgatccatgttgtatttgttggatgtgatcttgttctccagtgtgtacttttggtaaaagacatggtaataataggtctgcaggtgacactattcacctgctcttcctaagggatgctgggtcttgaggaaccggcagtagagacactgaactgcttatagactcacatctggtatcatcaggttggacctgggatactgtctggctaactaacacttcctggcccccatgactgcagagttccaggttctacatcagtacccggttctctgaaatatgtactcattggggtctcatgaatatggaattgaaatccattttactgttgtactcacttagagggaacatagcctttgtttccttacttaaccatgtgagccacagagtaagaagaaaaccgtctctttaaaagctgctatttaggtagctgccttcatggcagataaatcttttccacaggtttggaaaatatcaaagatgcatctgtttcataattacatggtggctttctacctaatgaatgcctgtgtaggctgctacgttaagcatacaaagaggataggagaagaaagttacttcgtatttatttttcaggcttttcctgtctgtgttctcacttcgttattgtggggtttctgcagactgagtccctgtggaagagaggttgtgtcctgctcattgtggtacagcagtggcttaagggagaactggagccctgacttcacccccaccccactccctttatttgacctgggattaaaaaaaaaaaaaagacaacttgcatttcaaggtgagttagcttctgatcttaatataacttattttccttcaggaaaaaaaatgctaaaatcaagacagggtacaagcgggagcacattaacctgggctgcgacatggatttcgacattgctgggccttccatccggggtgctctggtgctaggttacgagggctggctggccggctaccagatgaattttgagactgcaaaatcccgagtgacccagagcaactttgcagttggctacaagactgatgaattccagcttcacactaatgtgtaagtgtacatgggggcagcagggtgggaggggtggggttggagcatgtgtggtaaggggattgcttttcactgtttttttttttttttttttaagaaagcccagtttttaaccactgtaaagtgagtttgttggcattagatgagccacatggcctgctgctatcttttgtttcccacctacccatttcctggagtgtcttagatcctttccactctgtgaacagtatatattgccacaggtacacaaagtggctgattaattacagcagggacatggtgtcagtccagagcgtgtccattccctgcagtttttgttttagttaacaaaacagctctctttctctgtctaatgcctgaggattagcctgctgggcttgatgacatgtagacatggtagacaaatttaggagctgattatctcagttacaaactatcttctctgtacagtgaagcatgtaaaagtaactattggacagtatggtgaagggaaacagtgattataggttaggagagagccccttgagaattgaagtagattgatgatttaagttaagggaaacacatttcattcatgaatcttgttttatccataaaccttgttttatttagtttcatgaggaattaacctgtgacaggcacaagctgggtgcagagttaccatgtttatttctttccactagaggtcactaaagaagtaacttcttaaacttaaggcaaatcagtgatattaatgtgtaaactaatatttccattaataaattttttgaggaatttttatcattaatttggaatctgttacagctaaaaagtcacaggaaaactatagagatggacaatctagtggttggcagggggcggggagggtatgactacaaagcagtgactgagggagtttcggggagggaactgttctatattctgactgtcgtcatggttacattaatctgtgtacgtgtgttaaaattcgtaaaaatgtataccaagaaaatatccattttggccgggcgtcgtggctcacgcctgtaatcccagcactttgggaggccgaggcgggtggatcacgaggtcagaagttcaagaccagcctggtcaagaaggtgaaaccccatctctactaaaaatacaaaaattagctgggcgtggtggcgggtgcctgtaatcccagctacttgggaggctgaagcaggagaatcgcttgaacctgggaggtggagtttgcaatgagccgagatcacgccactgcgctctagcctgagcaacagagcaagactccgtctcaaaaaaaaaaaaaaaaaaaaaaaaagcaaagaaaatatcaattttattatatgtttaattaagaagaggtgaaacatactaaaaagctataggaaacataccacatgcatagaaatgtttttgaacgtagaattctgattggcatgggaagtgttttccttggtttgaaattgggcattggcaccaattcttcagtaccaattctaggaggaacaatggctgttagccatttcccccacatatctgagcttcagcattttaaataagcaacaagtgggtatggtttatttttggaaccagcgtgaaggcagctgacacaactcatctgggttgccctggtgcttgcaggggcccaaatgcataacagaaattctttgtgcttcatatagatgaatttgaacagttccacctgtgtatttatttatttattattattattttttggtgacagggtctcactctctcacccaggctggagttcagtggcacgatctctgcagcctccacctcccgggattaagtgatactcccacctcagccttgcaagtagctgggactacaggtgcatgccaccacacctggctaatttttgtattttttgtggaggcaggatttcgccatgttgcccaggttgttcttgaacttgtgagctcaagcgatctgcccgccttggcctcccaaagtgctgggattacaggtgtgagccactgcatctgccttctgtttatggttttgaaagctctgtacaggaaggcagtattgtgttcctggttttaggatattctgaaaagtctggccttttttaaaaacatgtaagcccaagaaacttccccatttgaatatattactaaagtcattcaaaaatcttatttttgacaggctgctgttttattgtagcatacttgggctgtctacagaagacaggattctctgtgaatcaggcagtgcctgggtctccctgtactttctagaagcataatgtctgtctcgctgaatttcatggggaaacgaaaatttacaatgtgtggctcatacgtgtaatcctagctacttgggaggctgaggcgggaggatcacttgaggccaggagtttgggaccagcctggggaacatagaaatactctgtctctaagaaattttttaaaaattagctgggcatggtggcaacatgcctgtgatcacttgagcccaggagtttgaggttacagtgagctatgattttgccactgctctccagcctgggaaacagagcaagatcccatcttggggaaaaaaaaaaaagaaaatttagaatgtattctctgatttagggagagtgtcttgtgaagactagagtttttgttcttaggtcctgaagccctttgctggattccaaagtacgtgggctctgactcacagttaaccaatgccatttccactggaaatgcccacaatgatgaggcagaactcagacactgattttatgttaaagatgtttgagagggtctaggcaggcttgaagaccatctgatgcaaggaggatggtcattcctttttaaaaaattgcagcattaaaatttttcttaatttttttaatcaaaggagtctgaacccatggttgtaaaatcaaacagtacagatgggcctatgaaaagcagtgattccagcctgcctcagcctgctcatcccagctccgcagtggcagccactttaactgtttttgttttctgtggttccctccatggagaaggttgcttctgaccaggcaccagtatgcactgtgtgtataaacaacaatctgaaagcagtaatgagagacagtctatgatctgtgccgaccccagcccgacagaggacaaagtgtagactctgagctcttcgtatgcctttttaggggtggcagtgactgcagagtttgtataggctgttcagctgggtggggcagactttcaaattctgagagcttaagcagggccccaaaagaggaagaggagaatttgaatgactgaagaagggaaagggatattcccagcaactggagtcattcagtgtgtttgtaagagaggagggagcttggccagctggggtttcattctgaatgtttttgaaagagggagacattttatgatgtagcaaaaagctccctttcaaatcctgccaggcttagatgttgcagcatgggtgaggagtatgcacaggtggacgagatgaattgtggattaagctcttttgaagtgctgctcctccaagaggctgggtcagtgccaactgtatctccccagcagtggctgcagcaggttgtgccaagggctctaacttgccttctgaggcatatgtgcagccccacctttcttgccatttctggctgtgttctcttctcattttcttctctttccataacattttttatttttacttttattttttgagccagagtctcactctgtcacccagactggagtgcagtggtgagatctcagctcactgcaacctctgcctcctgggttcagacgattctcctgcctcacccccccaggttgctgggattacaggcacctgccaccatgcccagctaatttttatgtttttagtagagacagggtttcatcatgttagccaggctggtctcaaactcctgacctcaaatgatctgcccgccttggcctcccaaagtgctgggattataggcatgagccactgcacccggacttccatgccatttttctggtagaatcgtttataaaagtaataacatcagtagcagtaaaaataaatcactcagaatctcagtgctctacttgctgcttcttttttttttttttccttatagagacaggatctcgctctgttgcccaagctatatcctgggctcaagcagtcctgctgcctcggcctcccaaaatgctaggattacaggcgtgagtcaccacgtaccccctctcccctggctttttctttttttgtttgagacaatgtcttgctctgttgcccaggctggagtgcagtggcgcgatctcggcttactgcaacctctgcctcccaggttcaagcgattctcctgcctcagcctcttgagtagctgggattacaggcgtatggcaccagcccggtcaatttttgtatttttagtagaaacagggtttcaccatgttggccaggctggtctcaaacccctgacctcaagtgatctgcccatctcggcctcccaaagtgctgggattacaggtgtgagccactgtgcctggctaggtgcctgttccatacttatcagacttcctgtaatttagtacctgttttgtgaaatttggtgaacttctgacttcccttaataccagtattggttcagtccatttctgtcatccctgtcttctgggagacttgggtggatctgtctgggctgcagctcacctccctgggaagctcagcatctgtcctgtgcttgtttgcaggaatgacgggacagagtttggcggctccatttaccagaaagtgaacaagaagttggagaccgctgtcaatcttgcctggacagcaggaaacagtaacacgcgcttcggaatagcagccaagtatcagattgaccctgacgcctgcttctcggtgggtatctgtggaatcacgcatctcacaggcaggcccatctgctctttatgttggaatccttcaggtttgctggagtgctgtgcttcagcttactcaaagtgagagatgctgctgggcgccgtgactcacgcctgtaatccctgcactttgggaggccaaggcaggcagatcacttgaggtcaggagtctgacaccagcctcgccaacacggtgaaaccctgtctactaaaagtacaaaaattagccgggcatggtggcgtgtgcctgtaatcccagctactcgagaggctgaggcaggagaattgcttgaaccggggaggcggaggttgcagtgagctgagatcgtgtcactgcactccagcctgggtgacagagtgagattctatctcaaaaaaaaaaaaaagactccgtctcaaaaaaacaaaaacaaagtgagagatgttctcactttgaaaagagtgccaaatgagtacagtgatcatactactagtacttcttatgggtaccaggcactgtgcagagccttttgtgtagattactgtgtttaatcccatttgaaataggtgctttggttttttaatcatctctgggttttttttattttttgtttttttgagacaaggcccaggttggatgcagtggtgtaattgcagctcactgcagcctcatcctcctgtgctcaagtaatcctgccacctcagcctcccaagtagctgggactataggcacaccagcatgcctggctaattaaaaaaaaatttttagtagagacaatgtctcactctgttgcctgggctggtctcaaactcctgggctcaagctgtcctcccacctcaacctcccaaatgttgggattacaaggcatgagccaccatgcctggccaatcatctctgtttgtttgtttttttttttgagacggagtctccctttgttgcccaggctggagtgcaatggcacgatctcagctcactgcgcaacctccgtcccccaggttcaagtgattctactgcctcaccctcccatgtagctgggaacacaggcacccaccaccacacctggataatttttgtgtttttagtatagacggggtttcaccatgttggtcaggctggtctcgaactcctgacctcaggtgatctgcctgcctcggcctcccaaaatgctggaattacaggcatgagccatggcccctggccaatcatctctgtttttacaaatgaggaactagaaacttaggtgagtaacttgctcaaaggtacacagcaggaaagtgctgggagctggatttgaaccagactggcttactgttaagcctcttccattaataccagttcctgttctatcatgcggactgttaaaaggggcactctgaaatctagggttctaattgataattccccccgccccgcctcacttttcattctccttttcagctcctgcattgcatattaagaaatcaatagtcagttggcatcttgcagagtctctggcattgctcacaggccctcgaactactacacagtttttgcagtaaatcctattgggctcatttctgttgtcacagggcactggcggctgtatctctttggggtgaaatgagggaatctcatgttgcagaatggtgtctgtactggtttgtgtaatttatggacagccctttttaagtctcctaaactagaaccgaatttggctcccttaacagcaagcacttaaaaacaagagaaaaggagcctcattatttatatgagcaaaaggacactggcccctaagaggccttccttctctctgctttgttcttatgaggggtgtcagatctcagcacaccctttgaacagaaaggtatgcacctaaaattgatgtattttgtattgaatttaatgaatctcatgaacaaggtggtcatgaaaaattttgattctaaagtccaaggttggttgactaaaaagctctaattttggagatggaagtgcaaagtattatacttaatgttttctctgttttgtcatttccttgattaggctaaagtgaacaactccagcctgataggtttaggatacactcagactctaaagccaggtatgtgttgcttgtgtgtgaaatcggttctttatcttaaaaaaattgtggtgctggtttgctgatttatgtcattgcttataaaatgtttatataatacagtgggtatatataaatggatatatgtaaagtataattaaatgtttataaaggagtatggggtcattataaaacatttggagaatatgagatgtagcaagcaggaggaaaaaggctgaggctaacacatattctttgctattttcttccatccttttttccagtgtggacataatgcttgatacttatttctggcagattctcaaaactaacttataaatcagccccactgtaaaaagacaaagaaataggaaaagtggtttgcaggtttcctctgcacagttggctaggccagtccacggcgtattatagttctagtgtataaccacttttgaaccctggaaatctaagactaccagctactccctgaatcaggttattccagggaatgtcagtttgttgtgtgcatctgtggatgtacatgcacactacacatgtgtgtacactatgaacatgaacatgtaagaccttaggttggattcaggattgaggtttcatttaaagggatgattgccaaagaagcttactgcatgctaccagtgctatagactaattgtaccaggggaacagtgagaggaaaaaggaaagtggggttccagaagtagatttgggtaggctctctgggcggtgggataattatagttgttttataagcccactgtagtatgcctgttggtcagatagtgctaagtaacaaggattgaagggccatgtagtttggaccctgctgataatacctggaacaggttctgaatttggtgttaatctttcttgtcatttctttcctccattcctcctcctttcctctccctcatttttctccctgcaggtattaaactgacactgtcagctcttctggatggcaagaacgtcaatgctggtggccacaagcttggtctaggactggaatttcaagcataaatgaatactgtacaattgtttaattttaaactattttgcagcatagctaccttcagaatttagtgtatcttttaatgttgtatgtctgggatgcaagtattgctaaatatgttagccctccaggttaaagttgattcagctttaagatgttacccttccagaggtacagaagaaacctatttccaaaaaaggtcctttcagtggtagactcggggagaacttggtggcccctttgagatgccaggtttcttttttatctagaaatggctgcaagtggaagcggataatatgtaggcactttgtaaattcatattgagtaaatgaatgaaattgtgatttcctgagaatcgaaccttggttccctaaccctaattgatgagaggctcgctgcttgatggtgtgtacaaactcacctgaatgggacttttttagacagatcttcatgacctgttcccaccccagttcatcatcatctcttttacaccaaaaggtctgcagggtgtggtaactgtttcttttgtgccattttggggtggagaaggtggatgtgatgaagccaataattcaggacttattccttcttgtgttgtgttttttttttgcccttgcaccagagtatgaaatagcttccaggagctccagctataagcttggaagtgtctgtgtgattgtaatcacatggtgacaacactcagaatctaaattggacttctgttgtattctcaccactcaatttgttttttagcagtttaatgggtacattttagagtcttccattttgttggaattagatcctccccttcaaatgctgtaattaacaacacttaaaaaacttgaataaaatattgaaacctcatccttcttctgttgtctttattaataaaatataaataaacagggcatttgtttagatttattttgtcttcatgctctgtgtattatatattattcgttttcactcactgtacaacagattaccatatgtttagcagcttaaaacaacactcatttatttcacagttctgcaggtcaaagcgaggcaggtgtgcatgcctacctggactgtgcttagcttctcacaatgctggaattagggtgtcgaccaggctgtcttctcattttatctgggggcttggcgtcctcttccaggctttcagggttgtggtggaattcagttattttcagttgtaggacagaggtccctatttctttgttggctgagccactctcagtgctcagaggatgccagcattccttgccatggggtcccctccatcgccaaagccagaaacagaaaaactccctcatgtgaaatccctctcacacttccagtctcctccaggtagagccccaacccttttaaggactcacctgattaggttaggcccaatgagggtaatctcccttcaagttaactgccaggtaaagtaacctaatcactggtaatatcctttcatgtttgtaggtccctccatatgggtcatgggaaggggtgattttggaattctcccatatatttatatgtttttaataacttgatggtggatttttttttttttgaggcggagtttcattcttgttgcccaggctggaatgcaatggcgcacaatgtctgctcactgcaagctccgcctcctgggttcaagcaattctcctgcctcagcctccccgcctcctgggttcaagcaattctcctgcctcagcctcccgagtagctaggattacaaacatttgccaccacacccggctaattttgtatttttagtagagatggggtttctccatgttggtcaggctggtctcaaactcctgacctcaggtgatctgctcaccttggcctccaaaagtgctgggattacaggcgtgagccaccacatccagcctattgtggaaacacaaatagtaataaactctatgcatgatccagcttcaacaaatatgaacatttttttccattcatgatttttcagcagaattccttttttttctatgtttgaaagtgacattcaaaacaggaaccatctattttagcattttatgcaactgatcacccaaaaactgtgggcctcagtatttgtcatactgtcttcagggacttgcagctatttctaagtgaatgttcatagaatttatccagagattatggcacatagtggttgctgggtacatctagtcagatgtcaggtacagtattaagatattttacttttagagacagtcttactctgtcacccagactgaagtgcactgtcatcatcatagctcactgcagccttgaactcctgggctcctgtgatcctcccatctcagcctcccgagtacttgggattacaggcataagcctggccctaaaatatttaaaaatgtataaagggttctcttgagtatgagggaatatttccctcactagttacttattgtctgcttgttgcatgcagcatgttggaatatcattgtgcaaaatgctttgagttcataatatctcaccagttaagagaattgagacaatctggtatgaggacacaaatggacaaagtggacaatgagtcagggaagaggactgcagtgtgtttattatagattaactttaaagtcaacaagcagaaactaagattgagaagctcatttgttgaactgagtggttttacagaaaacttaagtaccgctcagagaagggaagctcctgggggactgggaggactttgcaccttggctaaagtggagagtttgcaataaggacaccattcagtctaatacgggcttctgggggatttcgggaaatgtgcagatgaatgacttcttagttttcttaacacagagtttgtgtgtttctgagctgtcaccagggtgagataaaagcttaggggaaaccagattcaggagtagaacacaggccctttagagagacagctcagctgtgtctctgggggataacagcaatcttcgcagggaatcatagagaccagaatggtgaagctgtgggcacaataaatgtcttgcttaacgtcacattgattttcctgaaattgatcaaatggaacttttatgaattgaagcctgtatctgtttattaaggagacatttacagaacgtacacacagagcaaagtatggcgccagggccctaggtgaacttcttggaagtttgtaagtttgcatttttatacactggggatttcaagtaacaaaatttaaaaagagaagcttattttaggaaatctgaaagttattttcaatggcagcccctcacctctacttcctagctaccttcctttcttttcctccataattttttttttttttttgagacggagtctgtggcccaggctagagtgcagtggcatctcggctccctgcagcctccacctcccgggttacagcgattctcctacctcagcctcccgagtagctgcgattacaggcacgcgccaccacgcctggctaatttttgtatttttagtagagtcggggtttctccatgttggccaggctggtctccaactccggacctcaggtgatctgccctcctcggcctcccaaagtgctgggagccactgcactagggccggtccataatatctttatcatcttgtatagtgtgtattttacaccatattcgccctcacaagaaaataaactgccaaggcgggcgggggggggggggttctttttgttcactgctgtatcttaaatagggagaggtgctaaatctttgctgaaaaaaaataaatgactgtcgggaaagatttttaaaaattacttataatcccatcaccgaaataggactacttaacatttgtgtttctttcgcctttgagagaggaagagcagttacttcgctttcgtgatcagtctgttctacagctggatcttcctttttaaaatggctaaaaacgctatttttggctgtatagtacccaatcatgcaggcggcagggaggggctcgctttggccctcttcagcacgtcacaccctacctttaatccgcagccaactgtgtggcggtccccactttcgcctagcggcaactccctcctccctgcaatccttccttcttattccggtttccagagcacgtctccaggcttcgacgtcaccacgctgggacgtatgtgccgagggccgcggcgtctgacctcatggcgtagagcctagcaacagcgcaggctcccagccgagtccgttatggccgctgccgtcccgaagaggatgagggggccagcacaagcgaaactgctgcccgggtcggccatccaagcccttgtggggttggcgcggccgctggtcttggcgctcctgcttgtgtccgccgctctatccagtggtaaaggggggcggcagtgtgggcttaggaaggctaggagggctcgggcgcagggcaggagacaggccgggccagggaaagggcgcttccaagtgtcaggagcagacggcggtgtctggttgggtcagggtctccgcgggcctgaggacggagggtatggtgtctgaaggggtccaaggtggtagggtctccaaggggcctgagaagcggggtccctgagagatgcaggaacccagggagcaggcagcagggtgtgtagatgggcggggagggaggagtggtgttagcgcctagagatcgttgaagaatgggctgccgcaaggaatggcggtggtggggtctccaaaatttcttggatcggaaagttaggagactctggaagagagggtggcgacaggggctgaggaggtggccggggctgggggtgtggtgtctggaaagggtcctgagtttgggggactcaggaatcttgcaggaccaaggaaaggtgggggttttccagaatgggagaggtcagtggtaaagaccgaggcgggcaggggcagtaatccagtgactggactgaaccaatggaatatttccgagagggaaagtgaaagggaaagagctgtcttagggtactggtgcatatttgaagactgggaggttctggtgtttgataaagattcagagtactggggcgttgggcccctgaaggcttgggaggcagagaggagtttggagacaagggagatcatgattcctcttccctgtgttccgagttaaccaggataaccctgcctcgttttaatgcatctgtaggatttgattgataaaatatttcatttcttgcaaatgttgcatggtgaaatcaagagattgaaggcttttattgagaaattaggaaatctgtaaaccagtgcctgatacttggtgggaaaaatccactattaagaacttgtaaggattaaacggtattttgtttagtagtcccatttttctttcaggccaagacacagtcctgcgtttctccctaaatttgaattttcagctgcaaaacagtgtgacctggtatagtgttttctttcttgccaacagggcctgtccagccctacattcctctgcgacagtactgtgggtacatacttatgtttcctcagcaacatttcagtgttgctaactggacgccctcccagaagtctttgcagtccctgaggaaggactgctgtccatttcctaaggcccttttatcattagtgaaatgtaatgaggatttccctggttgatgcagatattcccgttcctaaagtacttaagtagcttaattgttttggccatttaatcatctaagaaaaataaaacacaaacatttatatttcctgctggaatgcttaagggatatatatctggcaactgtagtttcagaaacagcttttttcccctaagagatggttgaaaattgggcaagaagtgaggcagaatgtggactgttaagtgtcctttagtctctgcttttatttgttagagccctataaatatttttctaactatactgagacattttagagaatctttatcttttaaattaagtctttacatacaccagtttaaaatgtcataaattcagattattctgtcctgaaaagaagctaaatgaaaacgaacatacatgtctttaataggcgagcagctccactgcactacagtgtagcttgggatataagtattttttgtaagcataccttataatttcaaagtagtcactcctgtaataagaaaattagtctagaatgtgttgagttccaaatttcaagtgagtttacaaaggtagaaggttaccacattagatttatttaaatttgttccatattaggttttaaaaactgtcaatgcttggttatatgctcgtcagtctgtaagaatttttgttttatgtttttgttttgatcaagtctaaaaaattaacataagcagtttggatcactgggtgactaattcttggtcatgccatttcaaaaatgcctggttctctacatttgccattatattgtccccaaatgatcacctaaacttaatgtataatgcatttcatttttaaggcattgtttctcaaaccagtgtgtgaatgagttctcggggtcctctgcattcttaagtttaagaaatgctgatatagttttattttagggcagtttttaaaaagggaccagtagaaggggagaattaaatttataaagttttgttttttgttttttttttgagtctgtcgcgaggctggagtgcagtggcgtgatctcggctcattgcaacctccgcctcccggtttcaagtgattcttctgcctcagcctcccgagtatgctgggactacaggcgcgcaccacacctggctagtttttgtatttttagtagagacggggtttcaccgtgttatccaggatggtctcaatctcctgacctcgtgatccgcccgccttggcctcccaaagtgctgggattacaggcctgagccactgtgcccagccttttttgtttgtttgtttgagacagggttttgctctgtcgcccaggctggagtgcagtagcacaaacttggcccattgcaacttccgcctcctgggctcaagcagtcctcccacttcagccccctgaatagctgggaccacaggtgcctgccaccgtgctcagctgatttttgtatttttgtagagatggggttttgccatgttggccaggctggtcttgaattcctgtgcttaagcgatccacttgccctggcctcccaaagtgctagggttacaggcgtgagccaccgtgtccggcctaagctttatttttaaaatgttaagcttcaagtagagaggtaatatcaattaggaaagggaagatttagaagtcttatttatatgctcatagaaggtcaacagttaaatccgtaaagtcagagttgtacctttgttctgaatactcttcatatctgacttaatcaacttctctgatttgaaggagtttgagtaagttgatagcctttgtattacatgtttcaggtcaattatttgttttttcttgtgctgtatttgtgtattacttccaagattttactgcttgactaagacattctgctcctacttggtgctaggtattggagttaaacaatgaatagggtgatactgggggtatccttagaagaatgagtggcgttttgctgagaaccatggcatgggctcttgagggagtgcagtaggtgcatagatgctatgtgggatgtggtgtgggatttgtggtgagagttgaatcgagagcatattcaataaatatttattgagtgcctgctatctattaagtaggtaatggggatagagctgttagggagattagtaagataatgagagtgaggtaatgggggccagatcatgtaggatcttgaaggctattataaaaattttcacttttgtgagaaatggatggccctagagggtcttaagtagaggagtaacatttgatttaagttttgacagaatgactctggctgctgtgttgagtatagacagtagaagttagggtggaagcaggcagattaattaggaggctattgtaataatccatgtgagataatggttacttggatgaggcaggagcagtggagggtgaaaagccctcaaatgctgcatatgtcagaataacagattggatgtgggatgttaaaaaaaatgacaactccaaggtttttagttttagtaactacaaagatgtagttgccattaattgagatggagactaagtagaacaagtttttttgttttttgagtggggcataggaatttatttaaacttattttgagataattatagattcacttggcagttgtaagaaataatatagagatcctgcatatcccctacccagttttcctaatagtaacgtctttcaaaacaatagtgcaatatcacgaccaggatattaacattggtacagtcaaaatacggggcattaccatcaccacaaggatatctcatattgcccttataaagccaccccacttccctcctacctcacccctcctgaactcctggtaaccacaaattatccatttgtataagttggtaattttgagaatcttacataaatggaataatacagtatgtaacttttgggattgactttttttcacttagcataattctctgaagattcacctaggttgttacatgtgtcaatagtttgttcctttttaaattttaacttttattttttcgagagtaagtcttgcactccaggctggagtgcaatggcacgatctcggctcactgcaacctccgcctcccaggttcaagcagttctcctgtctcagcctccagagtagctgggattgtaggtgcacaccaccacacccagctaatttttgtatttttggtagagatggggtttcaccattttggccaggctggtctcgaactcctgaccttgtgatccacctgccttggcctcccaaagtgcccagattacaggtgtgagccaccagtcctggttgtttgttcctttaaattgctgagtaatattctatggtataggtagactacactttatttatctgttgaaggatgcctgattgtttccagtttttggctattatgaataaagctgctatgaatgtgtttgtgcagcactccagcctaagtgacaaagcgagaccctgtctcaaaaagaaaaaaataaaatgagctttctatggacatcatgtagttgagtctgccagtctctgttttttaattgatgtatttaggtcatttacatttactgcactatggatatgttagagctgaagtctgccatttttattttttgtctttagcctgggatatatgaggtaaaaagaaaaacctaaggaagtcaccaccatgttgtttcacatatcctgaggtctctaactgttctacccagttctttccacctttcagagtgttcttgtgttattttatacataatgttcagagcttttagttgtttttagtgggagaaacagggaagagtgtgtttgtcttcctgaaagccagccagaattcattttgaacatattaatgtgaatgtcagacatctaagaggagatgtcaagtaggtggttggatttatgagtctagaattctggtcgttcttggaagttcttttaatttttctcagaaaagttaggaagtgatgtcatcagttgaaaatgaggataacagagaagacatttgaagtttgtggttagaggaaaatgtgattggtgtcctaagagagtagaagggtaaatggactaggaaaatatgattgccaacaattttaattgccaacagctttaaacatacacctgaatctttggcattgaatttaaaatgaaatgaaaacagtggcatggttgtatattttttctagccatgttcagctgctgggtgcagatgtgagtagtcagagagcttgatttattaataactagggatgagtgtagtctcaccaagtgaatgggtcaaagtggacaagggggaagggaattgaagatggatgtaagagagtgattataagcaattataatagctgacacagaattgaatctgaataaagagagaagagagtgtattgggcaagttttgatggtgaccgtaagggaatgaaaaggattagagggttgtaggtgtttatggattgagaataccagggaatgaactggaaggataggaggtcttgccagcaagtagaatgcatgaaattgagattatggaagaattgtgataataaataatgactctgggagtgagtggctgaggtaaagaggagggctagctcatgagaagagaggaggtcaaagattttgaaatcaaggcaggagtacttgtcttagatggagtgaactctagagccaggagctaaagatcattaagaattagggggcatgactttggagttggatgaaagtaagttagtgcattatagcttaagataagagaatcaaagctagaggcatttagggagaagaacgggagaatggtctgaaaagggcaatgaggaggagaactgtgcctccttgagattcagtggttcaaggatgtgggagaaaaaacagctattacttaaacaggctgaaaggaaaatgtgtccttaagggagagtcaggtttcagtaataacaagaaagcaaagggtgaaagaagggatttgctgatgactgtgaattctatactgcgtggtggaaatttctttataattattcccaccctatcagcttgtgtcctttaaaggtacttacccatggaaaaattgttcttttaaaagttaagtttagttagttggctcccacttatttcaattttaaattttattttaaaacatgttttttgtactttggcaggaaaattaaatgtatcagaaaataataatttttaaattcttgaattataactaagttgaagtgataaatgcaaaaattattttcagaaattcctgttagtagttttctgagtaatgtactgagttgtaggtcctgtttatttctcttttcttccagtaaaaaatttcaagg

SEQ ID NO: 1233 - DNA, 1806 bp, Homo sapiens
gccgctcgctcggctccgctccctggctcggctccctgcctccgcgtcgcagcccccgccgtagccgcctccgagcccgccgccacatcctctgagaagatggctgtgccacccacgtatgccgatcttggcaaatctgccagggatgtcttcaccaagggctatggatttggcttaataaagcttgatttgaaaacaaaatctgagaatggattggaatttacaagctcaggctcagccaacactgagaccaccaaagtgacgggcagtctggaaaccaagtacagatggactgagtacggcctgacgtttacagagaaatggaataccgacaatacactaggcaccgagattactgtggaagatcagcttgcacgtggactgaagctgaccttcgattcatccttctcacctaacactgggaaaaaaaatgctaaaatcaagacagggtacaagcgggagcacattaacctgggctgcgacatggatttcgacattgctgggccttccatccggggtgctctggtgctaggttacgagggctggctggccggctaccagatgaattttgagactgcaaaatcccgagtgacccagagcaactttgcagttggctacaagactgatgaattccagcttcacactaatgtgaatgacgggacagagtttggcggctccatttaccagaaagtgaacaagaagttggagaccgctgtcaatcttgcctggacagcaggaaacagtaacacgcgcttcggaatagcagccaagtatcagattgaccctgacgcctgcttctcggctaaagtgaacaactccagcctgataggtttaggatacactcagactctaaagccaggtattaaactgacactgtcagctcttctggatggcaagaacgtcaatgctggtggccacaagcttggtctaggactggaatttcaagcataaatgaatactgtacaattgtttaattttaaactattttgcagcatagctaccttcagaatttagtgtatcttttaatgttgtatgtctgggatgcaagtattgctaaatatgttagccctccaggttaaagttgattcagctttaagatgttacccttccagaggtacagaagaaacctatttccaaaaaaggtcctttcagtggtagactcggggagaacttggtggcccctttgagatgccaggtttcttttttatctagaaatggctgcaagtggaagcggataatatgtaggcactttgtaaattcatattgagtaaatgaatgaaattgtgatttcctgagaatcgaaccttggttccctaaccctaattgatgagaggctcgctgcttgatggtgtgtacaaactcacctgaatgggacttttttagacagatcttcatgacctgttcccaccccagttcatcatcatctcttttacaccaaaaggtctgcagggtgtggtaactgtttcttttgtgccattttggggtggagaaggtggatgtgatgaagccaataattcaggacttattccttcttgtgttgtgtttttttttggcccttgcaccagagtatgaaatagcttccaggagctccagctataagcttggaagtgtctgtgtgattgtaatcacatggtgacaacactcagaatctaaattggacttctgttgtattctcaccactcaatttgttttttagcagtttaatgggtacattttagagtcttccattttgttggaattagatcctccccttcaaatgctgtaattaacaacacttaaaaaacttgaataaaatattgaaacctc

SEQ ID NO: 1234 - DNA, 852 bp, Homo sapiens
atggctgtgccacccacgtatgccgatcttggcaaatctgccagggatgtcttcaccaagggctatggatttggcttaataaagcttgatttgaaaacaaaatctgagaatggattggaatttacaagctcaggctcagccaacactgagaccaccaaagtgacgggcagtctggaaaccaagtacagatggactgagtacggcctgacgtttacagagaaatggaataccgacaatacactaggcaccgagattactgtggaagatcagcttgcacgtggactgaagctgaccttcgattcatccttctcacctaacactgggaaaaaaaatgctaaaatcaagacagggtacaagcgggagcacattaacctgggctgcgacatggatttcgacattgctgggccttccatccggggtgctctggtgctaggttacgagggctggctggccggctaccagatgaattttgagactgcaaaatcccgagtgacccagagcaactttgcagttggctacaagactgatgaattccagcttcacactaatgtgaatgacgggacagagtttggcggctccatttaccagaaagtgaacaagaagttggagaccgctgtcaatcttgcctggacagcaggaaacagtaacacgcgcttcggaatagcagccaagtatcagattgaccctgacgcctgcttctcggctaaagtgaacaactccagcctgataggtttaggatacactcagactctaaagccaggtattaaactgacactgtcagctcttctggatggcaagaacgtcaatgctggtggccacaagcttggtctaggactggaatttcaagcataa

SEQ ID NO: 1235 - DNA, 79467 bp, Mus musculus
  misc_feature (4099)..(4369): "n" at positions 4099 thru 4369 can be any base
  misc_feature (5502)..(5521): "n" at positions 5502 thru 5521 can be any base
  misc_feature (10089)..(10620): "n" at positons 10089 thru 10620 can be any base
  misc_feature (13273)..(13370): "n" at positions 13273 thru 13370 can be any base
  misc_feature (20762)..(20781): "n" at positions 20762 thru 20781 can be any base
  misc_feature (30751)..(30916): "n" at positions 30751 thru 30916 can be any base
  misc_feature (46579)..(46712): "n" at positions 46759 thru 46712 can be any base
  misc_feature (77382)..(77401): "n" at positions 77382 thru 77401 can be any base
caaactccaaggaaggtaaattctaaatcgagtctgccaacggagagaagaaagtgtgcagaagagccaagtgggacttccagagctgaaaggcacactaatccagtaagtgctggaaatgacgtcccagtgggggcttagccatggcgctgagctggcacaggcaagagccggggatgtgctattccaactgagactgcaggctgtggactgaaagaatgagaagagatgtcgggagaggaagtaagggagcggagagcaagagcatatgcacagagggagggagggagggagggaggcagaggggtgctgaaaccattacagatgtgtaacccaatctgcaccaccaggaaaatcccagcaaactccaaggaaggtaaacttcaagagaccagcaacaaactgacctcacaaggagatatatcaaaagcagaaggtgggggtattaacccttgcaagggaaccccagtaacgttaacatctgaccctagaagcagcaactgaggcttgaagacagtatgtccaaagggcactaagaaaaaacttgcaacagacccctgtgctcaacaaagcttctttctaactcttagacgaattaaaagctttggcacagaaacaaaagccaagaatacgctgctagcacaaagaaccttcttgcgaggaatacaaggcaaaggcgggaatgctgggacagtaacctgcacctacaggaagcagcacgtcaggaggcaggcacgtgattttacaaggcaacatgcatgcatgttttcttctcatgactcacttaaaaaacaatcatataaaacaatgtgtgtatactgtagtgctttgccgatagcttacagaaacgcaacccaggtgtaagatgtttgccaataacaacaaatagtgtcttaagggactgcagaaggcaaaggaacaattcccacaatgcaccatgaggtttgtctgtatcgctttctgtaatgctgtagaacatcacaccactgggcaatgggagaaccatatagaaataatgcttctgtgagtcactgaaatggtcgcagggtaaactaaaacccagcatgaagtcacgtgtagctggcaaacacagagcagactctaagggatgctgcaaaccagggaagtaccttctcaccaaacacatcctgtaatgcaaagaaagcaataaagagactgagtgaaaggaacacggagaatgtagagagaacacgccaagttcaacttcattacctgaaactgaaatgtgaacagattaacattccagtcacggggcagcagtagtcaagccgaagagtcaaacattgtacaacttcatgctgtcttctggagataagctgtaggtggagaggtacacactcactaccaggacgggaatcatccatcatgcacaaagaaactccaggaaagccagagtggctgtgctgctgttggatgaaagaaaccaaaagtaaaaaataaaagtcaaagactgctgaattggatgctcagctccctccaagcctcgtgtattgaagacatggtccctagagaggggttggagccatggagagagggggaaaacctttgggcagtgagactacctggtaggaacccccatttctggagacaagcccttcatgaggttgatccccaccccaaacctcccttccttttgcttctctgctgagatgaggttgttgtgggctgtcccatggtcccactgtgataggctgtactgccataggtcctaaagcaatgggggccactcaataatggactgaacaggccaaaaaaatgtaaattaaaaaaaccttatttcttcatatgttaatcatctttgtgttttgttacagtagccgaaagctaactgatacagattaagagggctgcttcaaggtaactaaagaaccagtgtctgagagacagagagagagttctaagtgtaggtgtgcctaacaacacagttcccaaagagacatagcagagccagcaggtacttggtgaaagccttcagagtcagggcaggttgactctgtcagggggtgagcgtgactcagagtggcttcagtgacgaagtcccttgtggccacttcaggcaaaagatgaggaaattgaagaacactaggtatcaagggaagcaatttggtctttattctgatttccaggacatatgccctgggagaaagttattaataactgactgattaattgattgattgtggtattcgttttattttgttgttttagggctgtgtcaatttctcatcatgagacaaaataccagagacagccaccttaaaaggatgaaagcttatgttaagttattgcttccacaggctcttagctccactgcctttggacctatggcagagcagaacgttctggcagcagagcacactgtgggcaaagctggtgaccttaggcaacagagatggagtgtctggtctcagtatgcactccgagagcagtgcccatcccatgaggtcctgactcttcacaccccagcacaggacaatgctccatcagccagaaaacaggtcgtttgccatggccttcaagacttgggttttttttggggggtcaggggtgggggcacccaaacctttaggaaatggatgttgctctggttaaatcaaatcatagaaggcatcttcacttgtccagggacgagggagagattaaacaggaaccccaattctgtggtcctccaagataccccaaggtctgagagggagtggctgatgttgctgtaactaactcaacggcaactgtcaggcttcacttgactgtttttttgtttgtttgttgttgttgttgtttgtctgttttgttttgtttttgcttttgtttgtttgtttttaagcactttaaaagtaacctgactgggcaccaatcaatcagtaggcagcacatcaagccagggctttagcaccaatggctaaccaatcaactcaaaccagccaggtgtggtgcatgcctgtcaccctagaactgggaatattataagaggacctggagttcaaggccagcctgggctacctgagaccctttttaaaaaatgatgctcctgaattctggcctgttaattccactctcccaaaccggctctggaggaaggcccagtttcccagccttcccagtgcctcacagtcctgggcctcctccctgtgttgtggagtgaagtagatagatccagtcagaagccccaggtgaggtaacaggagggagttgcaaagtaaccattgctgtggcccacactgcagatgcagtgaggagatgtgtatttagctactgatgttttacatggtttacgtaagcaagcaagatgtacatgggtctggggcttgactgtacaaagaagccctccctagcctggtgcaccgtacctgcccacagtgcagtgtgtacacagccaaaggaggctccaggttgcaggactgagagtcgtgcccctagcaacacagaaccctgcttttgcactaaaagcccatcagatcttgttggggttttctgtgcccttgtgttttcacaccaggttagaatcaacaattgcctggctcttggaaactttgagcgctgggtggataaccaaatgtgccccagaaggaaggatttagcacccaaagacacctattggattaagcttctggggtgcatttgccccaataatccacagaagcaacagtaatctaaaaatagtcttgttttctgtcctaagctccttttaactttgttagtcatcgccaaaccttaaaataaaacccgtgtaacgtctctcctggtagcagctataaacaaacctcctctagaggaggccgaaggaagaggaaagaggcggtagggacacgcagggagcgcggccgcgggaccaggcttgagcccgaggtggccgcagggcctggcggacagctcagagctggccgagctcctgcgccgctgcctccggaactccctgcgcctggcgtgcggccaccgtggtcccggcaacggcattaaacagagggaaacaggcccgggattccgtcacccgcgggggataaggagggcattgagacagacaggaaagggcttttctggatggggtgaaaagttatttattggagagggaggggggagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctcgccgctgattcctccgcccagccccgccccgccccgcctggtccctgacaggggaagggcggggacggaaactcttcaggcaaaatcttggcgtgctggtctggcgacactaggactcactgaagaatgaatttgggggaggggggttggaggatggttcttgggtaatggggtcttggcaccccctagcggcaacctctttcaaggagagcagggaggcttccgcgcatccctgcaggttttgaaggtaccactttggcagccttgcccgacatcccagcatcttcactgagcattcagctacttaatagatcatgctccacacaccggtgtaggcacctccagcctagctatactctagaccacctgcgtgagtggctccatcctctcaaagccagaggtagagaggtgcgcgccatgcctagctctccatgtgagtagcaggccagtaggtagtgcgcctgagacatgttgggcactgcctgtggctatgcagcatccaccactgcgcttctctgccgtggtagaaaacaggatggcttttagttctgtggcgttgaggcaactagaaagagccgctagatgctgctggaagagtggatgggttttagccaagttttcatattgtttaacatcgagcccagttggccagctccattgctggttggatcagattctctaagtcttggggtgtgaagtactttggagcacctactggctcactacacgccccgcgcgccccacagtctcgccgccccacagcagacacgctttttttttttgcttttgagtttattttaaagcatatgaggtgtaggccaatagatttatgatttctatacaccagacgttctaactgcccaaccctccaatccgttccgtccaaagccaacaagaaaatatggtcgggttttggcagcagagttgcacccctaggagatgcggggagatttgaaagagaaaaagtgtgaagcgaggcgggacagaatcctcagaagttcccccagcaccagcctcctcctatgctagaaacctcacgtacgcgcctacaaagcaccctatggtccctgcactggtcgtccgcacccggggcaaagacccagaggaggagctgcgcaggtgggcgcgnnnnnnnnnnnnnnnnnnnnctggcccttcgtgcccgctccccgcgccccgcacccatctcgagtcctcctccctggctaagctgccagggccggtctgcgcgtccagggaggggcgcgggcgtccggccggacagcgtggcacacactgtgaagggtgtccccctggtgtttccccggcgcagcccagatttctagcgcgctttcttgccaataggtgtctcctcttctctagcgctgagtactcaaacttggtggggtcttggagataccacatggggaaacttgattcacgggggcgttgagatgtgaggatggggcgcagtgggggcgggagcgctagaagcgaaaacaaacaaccaaacaaaaacaccctgggatgaagtgaggcatctttggagagccgagttggtcctgcctttacctcaggaaggcaagcaagtccatgaccagaagtataagagtcctgcatcctcccaagtgagtctagccttagctgcttctcactaaaagtaagagcttggcaaagtggccccaagtggtccagacttctaaatgcctctcaaactcgtggccaaatgttgtatccagacaagagttctgccttagaaaatgccttgagaaagatcgaagacggactgccaggtttgaggttgcttcttccaaaagaatatgcgctgcaatctgccctaacctgtcagggtcacaacaatgacatgacccagaccttctgtcagagccctgcaggtcccctcaaaagagttagcaaaataacttctaaaacgtttaggctcctgcaggtgtctttgaaacaccctttaaagagtgactagcttttcagcagggataacttgacctatgtcgaatggaccccaggagccatagggctcgtaattcctttttggcaccaaagaagttacttaaaattactgaaggccagctggacccctgctgggctggggcactcctatttacaagggcggccatcctgtagacaagcacttggaaggaaaccttagcttcctgtgagagtctgatgagtgggtcagcaggcagaggcagccgttcccagagtcagccctggacacctggctcatctttagacttgagccatcggctcagcacaaatggatccagcttttcagagcccaggtgtcctgggtagagagtcttgtgtgaactttgaagcggagcagcagagattgttcctttcatgtcgctgacctcaattctaaaaggtctaaatgttgctaagtggactcccgaatgagctcttgcagcaaggaaagctacagtgtttttgttgtggtctgggtcgtgaatttcttgacatttatttccacacacatctgtcagtcacttttcttctccatcttcttctacttggaggccttaaagcttacgttctttacttgtagcgttactgttccattactcaagaaaccttctaagctgaggttgatggctcaccctcgtaatcctaggcgtaatctcagcacctgagaaactaaggcaggaggattgccatgagtttgaatccagcctgggcaacaaagcaagaaccaggcctgccttgggctacaatgtaagaccccaagtcccaaaacaaaacttttttgtctttcctttttttctttcttccttccttcctttcttttctttcttccttccttcctttcttttctttctttcttttcttttctttcttccttccctccttccttcctttctttcttcttttcttttccttttcttctcttttctttctttcttttcttttcttttcttttcttgtttttttgtttttttgtttgtttgtttttttgtacaaaagggaaaactattgggcagagggtgtaatcatttctggtgtaacttacctagaaaaggaagtttgacagtgtccccaatgaagcagtgagctggaggcaataatgaccgaatgatactggtcatattttacagagtgtgtgtggatgtaactgagctaactagaaactgtgacccagtcttgagacagccagacccaggcaggggaaaagaactgtatgccgcaggtcagtatctgccattgctgtgggccgtgggaaagcaccttgaggaggccttgatcgggacaccagccttctctgaggccttcttccagcttgatgggcatttggatggaagctcatgcggcctggccatttttgaaggccttgtgctgctcagctctgaagaactcagagaaacacaggcctgtaggtagtcacagcgtcagagttgcctcacacaatgcgccacaggctctccggagctgaacaaagctttccctgttctccagctgtatagcttcatggcactgtttcttaatccagattagaaaatgctgcagccatgcaccctgcttcatcacacccagcacccaccggggctggcccattaacatcttgcacagttaggaggaaatggtccaagctaaacacttctatcaaaactggagtgtctgctgaactggcagaccaagcttcatactatatagaggactggcaagggggctggcagaggcacagggtagcatttcataagtagttgtgttgactgactcctgtgttagagagtagacaaggagggaggcaggccagcctctgagagaaaggccttgtgacttctttcctattgtcccaacatctgggggcatgtggccaggggaagccaggtgctttgtaactttagcataaagctttcttcaaaaagtagacaagaagggctgttgtgtgtggaactgtgggaaaggtggataaagagagatcgaggtctcacggcagaaaacagaacttccatttccccgaaggtcagcaaaaaagaaaagtaaaacaaaacaacgctccaactcgcatctcaaagtgagaactattattagaaacgaaatcaggccagactgaactatagtttatcactggagaaaagcagccattgaaacagggtcctgggagaagtggtagcccacgtgatgctcaagttagcctccggaaaaagccatcccccagagtccagagctgcagggcaggaggacactggggacacttgcatctggtggcagatactgacactaatctccctcctcctttccttcctgcctccttccagggttgggttctgatactggtctcccctgccctggccaccattttcctgatattccagatgttggtttatgtggtgccaagacaccaggaaagttagaacaaaaagctgggagaaacaggaaaagatggttggggctctgcaggcccagccttttccttctgattgctgtgtgcatggtaccctgtctgaatgggtcacacccagcacctactcagcctttgggagctttgaaatgaccccctactgaagcaggagtgtgtggtggttttttttcggagctgaaagattaatgaggtcgttagtgcacgaaaacaagatttgctttgaggtaggtgcccacagagagaggttggccaccatgggcagacttgaatgcttcggaagcaactgtgctctggggtttgacctgcatagaggagaaggcgaccctcaggaaactccaccctcattctcctgaccctttcaggtaattttagtaaaagcagggctagaaaatgaccccaccccccagcgttgattgcttcaagttgcagcgctctgaggtgggctctgagatgcttccctgaaagtgggtttcctcgggcagcaacctggaggaagcctaagagaagccatgttgggaatatacatatatagatatatcagggttagtatatatttccctcttttcttttcttttcttttcttttcttttcttttcttttcttttcttttcttttcgaacttttgaactaattcagtagttttggtctttttcctggtgcagggaaacagcaagacccagggcacctccttcggctgtggactgcacaccacgctgaacaggaaccaggggaccggctgcggggccgggcggcgggtccaggacgcagctccagccccggtcagccctgtactgggtccgggagcgacggctcggcccggcataggctgctgcgctcccctggaggcggtcagctgcgcagaggttggggcgcggacgccagggctgctggcagggggctaggttcctgcggagcggggggtatcctaagggagagcgaagccccacaggaggcggaggcccgagggagctgtgcggggtcgtgcgggggagcgggcatgcgacagagggccgggggtggacctcggaccgcgcggtcctgcgggcacgagtggagcctgggctacgcttgggctcgcgcgcggagtttatttaaaactaggaagccggcggccgcgagccgcttgtttatgtaaacccggaaacacccggggggacaggggcgggaccggggcgggaggccggggaggggacaggggaggggacagaaggcgggggccgcgtcacgccggggacgcgcgcgagcgccgggcgcaccagtgccgcgcgaccccgacatgacggggctggagcaggacccggagttcgacttcgatttcctcttcgagttcgatcagagcggcgggggcgccgcggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagctccctcagcaggaaggctccaccacttgggtttccagtccacacctcagctaccagaacctgagagctttcgctatcttgctgtctttcattttctcttctctgtcaaaagtaaagcttccagttaggttaacaatcaatgtgctgtttccccaaacttgaatctcctaaacggttggcagcccattccttgcaccagtttccctcctgggcagtctggctcttgtctccacctgactttctgttccaagttgcacacagtcccggacagtgttctgtgctttccttggggtctgtctcccagccgcactgggacagaacagacatgacacttgtagagcatctccgatgatctgatcgtgtcatgtattccactgacgctcactactattttttttttaagttaaacatcctgttcgcttttgaaggtgaatgctccaacttggcagtcaccactcagcaactgtcatatgtccgcccataagacccctttcggataggttttccttcttcagggcacaggtgtcagggctccggggtcagtgacatgagggcaggcaagactggaagagagacaaccattgggaagagatctggggctagaagtggagggagacccttgacatctcttggtcctgccgctttgggggatttggatttacccgctcttagtgcatgggggcgtttttgagttctctccagaaccctcacactccaggcagaagagctgactcttgacttccccttagggtgtccatgttggatttggatgagtgtgtaccactgtgcttgtggttcccttaggatccgttagctcttgtctctttaagggggagggggtacagccatggagccttcctgggctgtccaagctacctgctgttgggatagggccccacgggcttcctgtgactccttacttacactgaatggacaactgactacagtcccaacactaggaacagacacagagatccaaaacgggtactttggtacctcatggtggcctgaggactgcttggggagaggagagggtatcagggatgctgcagactaggtagtcatctccacagactcagaaccttcgagggaagggtgctgcacttgttcaggtatacaccattcatggatctcagaatccagagttccactggagtcttcgactcatagctggacacagccgctctcaccgtgtctttctgaactgtattgggacacataatgcccaagtttgaggttcatctgggtccattcatggagggcacaaaaggaagtcagtttgggtgccaaaggagacactggtaggggctctggtgaagcctgggaagcaggtggctccttgagctttggatgacgtcctccccttacgcatgtgaggggccgtgctcctcagacatgcttgtgttggttatgctctgaagtagatgaggtagaaaggtgtcttgtgtctcactgcagcccaggccatttgtgatgataccagagtgcgtcgctgaactccctattgctgcacataggtgagtgctccctggagctccgagtgctccctgaactccctatggctgcacataggtgaatgttctctagaactgcacagagctgtagggacatgcctcttggatggatgtccctgtgaactgtgggtcactgcctcagcaaagccaagatgctacatctaagtccaacacctttagcttgcagggtgtaggccactggagagagcccttggcaaggggaccagccttgggaagaactttttctcccttctcttgtgttgacagaaggtgctagagaacattggacatgtacaatacatgttacacttctcagtttagagacagacagacagactgactgactgactgactctgacttttttctctcttattaccaatcccgttattacatttttatcccttgtccaattgcattccttatattacacagtcatctgaagttactaagctctctgctccccactgagcagtagaaggagcttcacattatctggaacgagtctaaacataaattcatgtaggcctgaccgattctgagatcagttgcaaaggaatatttgggttttgcagcttgtcctgagcacacaaaacccacatcatgaaagcggacatggctacctcagagcacagcttacctcctcaatgctgcatgaagggaccccagtatccccctccccaccacaccacaccactgtctcccagctgggtttcatccataggcagagacagcactccacaggcaaccccaactaccaacgactcttcacaactttcttcagatgaaagcatgtgagcagaaatatgactgcttcatctgtggtcactggggcatgtggccctggacacttcctcccagccagggctcttagcaagatggcaagtcttaaacttcagactggtgaaggctgcagaggcagaacacttccagaactgactgagaactacgagagcagacactgtctactcgccctcctggggacacaaagtcacattttggttattctgagactggcaacaattaaagtctagatggttacacttaaaaatcctgagctcaaagcctcaaagactgatgtcatcttgctctcccgagaagggggaagtgcactagttccgctttctttacagagtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagcagcttcactgggctcaggttctatagatgttttaatcaaggacaaacctgtctgtgtgagcaggatatgctagccccgtatcaggttttcaaaagaaacccttggctaagagggagcgccttggaaatacaacaagggaaaggaatgctttaatattcacctgggggagtgtcggaggtcttcgaggaaagatgtgggcccaggctggacacgggacccttaagcacgctgtagtgagcttatttgcggaccattgggtgacatttgctattgctccagcaagtccagctctctgccctgtaaatctccctttagcacatcgttgcatgacagtattgagaacctgttgctgtctgtcacttctcgggactgacccagtctccatacagtcctcattagggagcactatccaatgtgctaagtaaacacaagaacggtgctgcctgccccagaactgttttgtattcttttgtttcatccctaagtgtggagacttgcagcctccctcacaccctgcaggctctattgcatgtagaaagagcagggtgggcaggcattggaggccaggacctggctggcaggatctttctggttctatttctagcgcagccccaggaaaggctaaaggggtttgttccttaaaatgaaaggtgaaagttggctgtgatcggttgtgctctgtgcttgtgaacagtgagtttgggtggtgactccgaaggccataccgatggcagagggtcacatatatgtgagcatcacatacacgtggtgtggcagagacacaacattgtcttcactccagataaaataccaagtgccttaagctgaagcacctacaggggtatttcccagcgggtgccacagattgcccagtgggcagcaggctttctccacaagtcttaagaagacatagaccaggggctgtcatggtgtgcaatgccctggtacagctgcagtagtaccagcttgttgaatttgctgaggctggtgggagctggccagcgcagagagttctggatttgctcagcatcgcctgcctgcatctcatccatgtgaaatactgaatgccgcagggtgattgagagaaatgagctcagaggaataggaggacagacggatggacggcgacacctgcacagggtgaccgcgccttccttttgtattacatggcataagagaatgtgtgcgtgagaggtctttgcttccaattgtgcttttcttccctggtctcccacacctcagtttactggcccagtcagcaaaagccaggctgcggggcacggatgttgccccgaaacagcagcatatgatgttctctaatcagcctcaatgtctcaggattagtaaggaattactgggaagcctggcattcctgatagacccccatagagtgatccctttgaggaagtggaagttggtacaggtggagggctaccccacaggtccaggctttgcagcaccagggaactcaaccggactcagcagcctgccatgggatcagtgggcactcatgctctgaggactctgaggagaaggcagccagctctgatggctgtcacaaagcgagcggctctaggcatgtaagcttttgttttggagtttgaccaaggaaatccatgtgtaagctaattgcttttgttcttaataggttattttttgagaaagggtcgcacctagccccaggctggtctctgacttcaccatgtagcaggatagcatctaatacctgatcctcttgcctgcacttcccgagcgctgggctgatgggtgtaggcgtgcttatgtggacatagtcagtgtcggcattgaacccaagctccctgaaggccggacgagagcttactaactgagctctaccccaagctccagttctgttttcttaataaaccgtttatggattttcctttgccccgttgaatcatattgtattcaaacatttttggttaaagtaaaggccactcttgtaatgtcctggggcccacgtggtcttttccacaacttcctcttcctctgcatctggccgagccctgagtgagaaacctccttcttcctctttctctgggcttcagacaccctgttgctaaggcagccccaaggagacaagcagagatttgccatgtcgtctgcctgccactcagccatttttccccagtaccccaggcagctgaccccttggcctaaacactgcaggggtgtcaaggcaggactcagcttggcttgctgctaggactttctagaaaactcgaaaactcttccaattttctcttccttccaaaagaaggtggtctgctgtggggccaggactggtctggattaaggcggattcttgcacttaggggacagagaatagccaggccctgcctaactgcacgtgtgcctcctttgggatttggcagctcaaggccatgcaggactggtttgggtcttcagcatctggagacatgggcaggtgctgggctcaactttcccagtgtgtgcacagctgctgggatacccatgtttcccattagccttagcctcaaacttccttttcttctggggttgggttcccttaagatgaaaacataaaaaaaaaaaaagatgtatttattttatgtgtgagcattttgcctacttgtgtagatatacaccacatgtgtgctttggtgcctaccaaagtcagagaaggacatctgatcactctgaaactatagagttacaaatggctgtaaaccatcatcatgtgagtgctgagaactgaacccgggtcttcttgcaagagcgaggagtgatcctaaccgctaagccatctctccaaacttgaaagcccgttcttttccagtgttgtgttgttggcagtcttcagacagtgcacggagctctagagacatagggcagcatataacattggcaaaacctgacttcccagatggcttagctgcctgctcaggggtagggcctctgaggcctgggtgctgtctcacatggcctggttaccaccactctccagatgggttcctgaagcacctttgtttagaagtggtgcctctggtagaagttcgaattgctgtgtgatgtcccatatctgctggggactgtgccctgggctctagtatggaacccttctaggaccacagtggttctgaggcccagaaggctggagagagcatagatgatatcatcctgagggggccttttaggtgatgaacaggtgggggtcatgaaggacacgcccatctgggggtggcagtgagtgtgtgaatttctgaagaccttgggagatgctcagaaggggcctggttggatgtgagtgcagcgagaactacttcctgaccgaggcatgctgcggagggtgtagtatctcaggcagcaccaagccagaaatccaagtgcagaggtgaggctgagccatggcacaggcattcttcccggactgtgagattccagcatcaatgaaatcaattcctaaaactcctactctattagcctgtaatttcttcctcctttttatcattagcaataatgcagtgacattttggggtgcccactttccactcctcactgcctttgattgactagttaagacctgacttcttacccgaagatgagcagatcccggccatatcttctgggccatggaacattgaatgtgcctttccatagaaagttttagattgggaagtgctaggccagctaagggagatctctccatcagtatctttctctgtgtttgtcacctgtatgggattaaaaaaacataggatgcatagaaaaccctcttctctccttttcttttctcctctgtctcttcttcttcctccacctcctcctctccctcttcctcctcttccttccttccttccttccttccttccttccttccttcctgccccacctccttttgccaaaatgaatgtgtagacggcctttagtgagaacagcagggcagcacagctctggacatagccatctgttgtgctactcctgaatagggtccctggtaacctgttccagacttttctgttggtaacttcacagaggagccagaccgtctgttggtctcaccaaccagcctttggtcatcaggcttttccacctgaacctgtttcgtatcttcaccaactgggttctttaggattggtgttcttttctcaccatggacagtctgcatctcccatcagtcctccctggggctgcattttgggataccaggggtggcctgtgtctgctggacctgaagagggggggtcactggcagtggacggctctgccccttgtccagtgcttctagaaacaaacactctgagcctagggactcggcagaagtgtctgataagtcccagatgccgccagccacaagtcctgtctctccagaagtattgctttctctagaaagtggctttagagttatttaggacaggtggaggtcatttcagtcttcggctccggcctcttgagatctggattgtggactggggggtggtgcttccctatgacaaggctaaccacagccacggctgtaggctccacttggcagatgcaggttcttgctacgggttgcttccgatgcctcgagctgtaccccattctcctctttgtctcagctctggcctttccagcgcgtctctgtgacccagggattgaggactaccgatggcctcttactggacactggagtgggactctggtccatctcataaagaggcggctgtgtagccagagagggtttgtgagcccattaatggtagaagcctgggagagagcaatagtgggaacttcctaacctacctaaggactggcatgctccttacaaaccatcttagggtttgaccgctgcttcgagaccctttttctggagtttccccctgttggtttctgagccagcgctgtccttgaccacagtatcacgcagctgggcgctgaaccctagtgtggatctaggacttccttgggcttatttccattattcagagacctggaaatgcttgtctccagactcgtgtaaatgggctctgcgatgtggagagcctttctgatcagaaatccggaagcatggctttgctgtcgagtactaattataacaatgattttttaaaaagtgcttaccagagtataatcagcacacaatgatctcgaggtctaggggtgtcttaggagcctgtgttttgttttagacgctctagaagatagattcccaggcaccagctagcctcaggtagccataagagccacactggaatccacattgtcacccttcctctgggtgtgttctttgaagccaaacatttggcctgcttgatagagtcatttgcttgttaacacctatttaaacacctggctccctgcgtctgaagcacctccctccaccgataacaccgccactcttcctccctcccttcacagtctgtctgtccatctttccttctgccactgcccatccatcacctgccattcaggtgatggtctgcctagtcatgaaacaagataaacgtgtgatgtagaatctgaaatacccctgcctctctcagcctttgatatactagaattgcagaggtactgagctgtgttgtgcctggcaccgtctgaggctctgcagacagccgtgaaccacagggcaggctgtgaaagctggcttctgttggtcagagagatggatagataaaaattcctgttaaattgtgatatataccagggtggtggtgggggaggaggtaactcagctattgggtaaggatttgaaatcacaactggctagggaatgtgcattttgaatatagagaagacagtaagagccagccatgtgatgtgaggtggaggacatcttgcctgaggaatgctgttgtgctggtatagagtaaggtctatagtctagcaggaggccttgcagcagtctgacctcaggccattcccagaggctacactctgggcctggagtcctcagggctggccccaggtcttggactcactgcctttgtgatttatgtgtgtcctgctcactggcctcactctgtctttcctcttttcttccagaacactacagttatgtgtcccctagtgtcacctcgaccctgccccttcccacagcacactctgccttgccagcagcatgccacgacctccagacgtccaccccgggtatctcagctgttccttcagccaatcatccccccagttacggaggggctgtggacagcgggccttcgggatacttcctgtcctctggcaacaccagacccaacggggccccgactctggagagtccgagaatcgagatcacctcctacctgggcctacaccatggcagcggccagtttttccacgacgtggaggtggaagacgtacttcctagctgcaagcgctcaccgtctacagcaaccctgcacctgcccagcctggaagcctacagagacccctcctgcctgagcccagccagcagtctctcctccagaagctgtaactctgaggcctcctcctacgagtccaactactcctacccattacgcgtccccccagacctctccgtggcagtcaccctgcgtgtctcccaagaccacggacccggaggagggttttccccgaagcctgggtgcctgccacctgctaggatcgcccaggcactccccatccacctctcctcgggcaagcatcacggaggagagctggctcggtgcccgcggctcccggcccacgtccccctgcaacaagcgcaagtacagtctcaatggccggcagccctcctgctcaccccaccactcacccacaccatccccccatggctcccctcgggtcagtgtgaccgaagatacctggctcggtaacaccacccagtataccagctctgccattgtggcagccatcaatgccctgaccaccgatagcactctggacctgggtgatggggtccctatcaagtctcgaaagacagcactggagcatgcgccctctgtggccctcaaagtagagccagctggggaagacctgggcaccactccacccacttctgacttcccacccgaggagtacaccttccagcaccttcggaagggtgccttttgcgagcagtatctgtcggtgccacaggcctcgtatcagtgggcgaagcccaagtctctttccccgacatcatatatgaggtaagcagcctccgactggagttgggcatacggtaggggtgtggctggggttgagaagagcctaccctggcttctctctggagataatggtatgctagcattcatagcattatgacagtcccctctgtcccttcttctggtgatagctgtctccgcctgcttgttcctcttctaaggacaccttggactagactaggggacccttactttttggaggcgtgttcacaggtgtcaagggttgcagcacatgagttccgtgctgctctacagctctgnnnnnnnnnnnnnnnnnnnnttacagggaggtccccgcacacatgcacagctgtgttggtaataagccgagggaggcagctatcctcctgtggatgttctgcctgctgctcgcccacttcctctctctatgccttaatcgctatctatcaccatgctggggcagatgggcccctcagctcacagtccctcagagcagccagctcaccagcgtgctaccagcagcacgaccaccacctcccgtcttgctggccgtctgctatcagggagtgtgttacaaacctctggtcttaagccgttggtttttctttttaacgggatgcaggggctgcttgcgatttaccaggtccatcgaaccagctcagtgcttttatttttaactaaacagctttcctgtcagctgtaccgcttgcgacgcctggaaggctgctttctgctccagggttttcacttgaggcatgacaacatccactcaggcccgttgaatgtgcgtgtgaaatcagtagggatgtttccatgagctgaggcacctgtgatacccagggactatcatttggcagggacagtctaaggcctgctgcttcgcttttgcctcattcctcccccccccttctcctcagggcagactcaccccccccacacacactcttggggcatcaccacctggtatttggccccctgacctctagatgtagacagtgactatgaagctgttagctccatgcagtgcagccacgtggccgtgtcttgaggggtcactctgggatgtggggtggccagctgggagcggcactgctgaacctgtctgtgagtggcagcaaggggaaggcccaagcaagttgctaggtgctaggagcctgtcttgggcagagagactgagggcaggggtgtggaacagagctgtttcctgtcttgccgcataggcctctgtcgttctatcttgtgtccctccatctgtcctaggaggcccaaagggctagccaagtcattagagcatgtcaggatcaaagtttatctcaaagacgggaaccccaaatccataaagaactgttgtgcctgccatactgtcggtaagacttctagttaacgaaaaccgacttctacttatttcagctcggtcatcagcatcacgcttttgatttgcggtgcatggacagtgaaggtcactgttgctcacaaagacttggtggaacgcctgaggcctagggaagagtcatgtactaaaatatatctggaaccatagaagcaaaggcttcttataagttaagtgcagatacgcacatgcgtggtgagatacgcacatgcgtggtgagatacgcacatgcgtggtgtggggctggagtgagggaaccactgactggtggcctttatgccaggcacacgtggtcttccaggtcaggggctagaagcccaagctgaaggttgtgtggcagctggttcctcctccacgctaccttggcttgcgctagccatcaccccaccatgggccacagccattccttcctttaagtacttcagatctggatctgggctcctgctagtgacaccaacttggtcacctttcaaggtcctttctccagatcagttactctctgaggttctggggctaagagtccaaattagaactttggggacacagattaatatctgactgcctatattattttttttttcggggaaatgacaaaatgtcttcaaacataaaatttaccctttttcctttttttctttcttactttggttttttgtttgtttgtttttgtttttcgttttgtttcttggtcttgggtttttattttttattattattattttttgttttgatcttcacagagacagaggcatcctcactacgttgggcattcctggtggcctacagttggctatctgcccagcccaacctgccagtggcacaggtcctggaaagcagttgctgttttttcctctacttaggagcagtgaccatggcccagtggcctgtgatcccatggtctttatctcatgggctcagagcccctggggtttctgtgatgctatgacattcctatgagcttacacaaacaaacaccaccccatcctgggggttgaagttcaccttttcccactgttttggttcacctcgaaatctgtttcctggtccctttgaatgggtttctgtaaactccctaatggctgctctaggcagctgagagctttcgtggggaggtgacgtgtatggctgtgaccatcactgtgaagaagccagactccttcctcacagatgctcttagtggacaagtaccaggtagcaggaacttgaaggtatccctgaaaggctgtgttcccacatgtcctccagatctgggctggagaattcccacagtgtgaatctacctccactgcccagcctgggcacggtgcctcctccaggcttgtcgatccatcccggctcaaaagaacacactgcagtcgccttcccaagggactcctattgttctgtagccatttcactttagggatcttgtttgttgttttctggggtacccactccctctcctgttcagagcactccagtcggctctatgggacaggacaaagaatggcaccgaactcctgctacaaccgaagaaattgtatttgtgaagctaataaggacagtggaagggcttttactgttttcggcgcgggctttaactgcatgctgctgctggaaactggcaccgaagttgagagaacttgcttgaacatcaccgacagtgatgacaatggcagacaccttctgtgcaggtcgagccatcttatatgtccctgctgagcacggctaaggaaatggccaggagtgacagtgtgcaacagcacgctggcacctgtcagtgtgtgtggagggtgcacaccagaacacatgcctctggagatgacagtctccagtagattgttcctggatgtagttttcagatggtagcttttagggagttgtgtgtgtatacacattcatgtgtgcacttacacacacacacacacacacacacacacacacacacggaggttataagtcaactttgggtgtcttctctatccctcttctaccttcttttttgagacagcatcccttattaaatatgaagcacaccagcccagcgaagcaggtgggcagatgagcttcaaggattcgcttgttttcccacccacattaccgtggctacagatgtgttccacagcacccagcttttatgtgacatctggggatccaagctcaggtcctcacgggaacatacacagcaggcatttcaccatcatgctacatccacggcctctttagagggctttagtattaacccaaaggaactgaagtttaagtgactgtccctttagccattccgttctgagccaaaacttcacagagcaccagtgttgtgcgtcagagcttgggtcagctctgcacagtagcattttctttccttctaaaacagggtcatgggaagtgtgttaatgccctcagccagcctgacctctggacttgcctatagaaaggcaacgttacgtgaggaattcggataaagacgaactggtctggggctagcagaagcgttttaatgaagagtgttcatgacacggagacacatttgctgagttaggttgtgatggcttggccattgctttctaaagaatagaattcccaaggggtggggccgactcagcaaacagcttttgctcagagagacggcttggttcagaagataagaaatgggcactgcgttgaaatcagtttaggtcagaacttgtttctttcagggtttggctgtgatgttggatgccttgatgataccagtggctttgatgatatatacgcacaagtgttagcttcaaaaggtctaagaagtcctcttgcatttgaggttatcggaatagctcagagtttatcgtgagtgggaataagatacaatatgcctgtagatgggtcacaataaatccagctctcatcttctccacacttacttaccacgctcatcaggggatttttgcgttggacagctgttcagtgaatccagtgaccttgtagcctggggaaggcacggtgtcagtgaaagatagttttggttcctggttcctcaggagtgatggcccacctcaggactctgttggccaaattggcctgcccatacttcagacatctgccaaaaacatccatgtctctggtttttggtgggctcattgggtccgtgatggtcgtagattggttgcaaactcgagtctaggaaggccctgaccttctctacagcacaggagggcaagtgaatcggtggccacagtgtgtcttgttcagagataggtatcaagtgaagcttactgaccggcaaaagttagtatcgtgtgccgagaacccacatagactgctagccccagctagcaggtgacaggcatagacaaggtgtccaggcagaggccctggtaggaaagagggaggttgccacagatgagtccatggttatgcagtctgtgttctcaagagctatctgctgttttctcttggctttgtaattggcctctgatgtccctgccacagtttggggaacgcaccattagcctcaccaggtggggtgccatacccgtctttgtgctgtgctataggccccagatatccctggagatttggaggaggggagggaggggtaatttgggactggaaagaagtggctgtcacccaaccagatcttaaggaggctttgcagatagagaagcactgggccgggtcagggctccacacggccaactcatcactgacaaagacaaggaggtcccttgtgaacctgcccagatgctaactgataaagccaggacagacactcaagatgagttgactctaaggcctgaacctctgtgatgctcctgattcttagttgttctgtggagtcagccctggaatgtgctctgtgcaatatgggggcagcaggggcttcagattaaacccaactctccgtggaaagaaggacaccgtggggagcttcggagccagagcctgagagctaactggccccagaggacaggactgtcttctaaggcctttggggttgtgggtgctgcatataagacctgggaggtttgtgtatggaattctcaatccactctcctcgtgcctttgcggtggtacagggtgactgagatgctggttcatgtctgttcacagtttgatacttggaggatgggccttacctcatttgcatctgcctggaaagttagcctggtgtatcagttaggactttcaaggaggctgtgagagccgagctctgtcagtatgggggatgctggcctttggatttcctctgagtactctgtaaagaaagcggaactagtgcacttcccccttctcgggagagcaagatgacatcagtctttgaggctttgagctcaggatttttaagtgtaaccatctagactttaattgttgccagtctcagaataaccaaaatgtgactttgtgtccccaggagggcgagtagacagtgtctgctctcgtagttctcagtcagttctggaagtgttctgcctctgcagccttcaccagtctgaagtttaagacttgccatcttgctaagagccctggctgggaggaagtgtccagggccacatgccccagtgaccacagatgaagcagtcatatttctgctcacatgctttcatctgaagaaagttgtgaagagtcgttggtagttggggttgcctgtggagtgctgtctctgcctatggatgaaacccagctgggagacagtggtgtggtgtggtggtgctggtggtgtggatgggtgtgtgtgcacacatgcacatgtgtttgtatgtgcatgtacatggatgcatagacttgaggacatcatcaactattactacccaggcttcgtccacttttttctgtgtgtgtgtgtgtgtgtgtgtgtgtgagagagagagagagagagagagagagagagaggtgggggttctcttactggtcttgcttgccagggatccccagggatcgacctgttttctgccttcatgggtctgcctttatattttgccccctagaatgtgggttctggggactaaactcagctcctaggcttccaaagtactttgctaatggtgccatctccatggtcccctgtctttttttcatctactctgaaatcccttctggtgacaggagtctgagaggcaggcattgctgtacttggaagaatagccagggaagctgcagctagtgtgggattatgggaacacttaccacatctcctgaaggccatgtacacgggactattacagacctctgccaggtgaatcacctgtaaggcagagaggacttgcctgccgtgatagcttaggcaagacatgtgtcaccactgaccgcacctggccattggaaggtttcctttgggacatggtgatcatatgcacatattcttcagatgcaaacattgccaggaggtttgatataggagtggccatgcaccgcagccccggcccatggcattcctggatagattggccacccagctctgcctctgatttataagctgctgtttccagaacaggatccactcaggtcaccaagatgcgcatggtgcagacagagacctgtgcaaatgcctagcttaacccatgctaggtgactgtggctatgtgtccaaagctccaggccatctccaggtagtagttttctatgatgaccttgtttttgctggaaccagacctctagagccaagaagccctgggcagccagtgacactgatggcctgaaatccctaagctaggaacagagctgtggtgccttatgtaagtgtcagactgcagttgtcaattctacaggaggcagggtcttggctgcatgtctaggatctccaaccctgggccaaggtgtccagactgttccgtgtctcatgatcattaaggaatatctgccttgtgacagcacagggaatcatggctgacgggaaggagcttgcttcagacagtcataaatggcagtggcttccctatatgttgctaccatgttcaacagactgaaccaactttcagaacttgaccagcaactgtttggacatcaggctgtaggtcacggcagaagtgtgtcatggcagaagtgtcccgtggcttgcgtgtgctctgtcctgcgttcacttgtgcgacgtttgggttaccgtgtcagtttgtttcggttttcatttttcataagtaacgcatggcaggtgtggcctacagcatcctcatcattaaaacatcagtgatacgaatcctgatcagctgcagctgctgggcgtcactcggtggctagagaaaggcacagtgtggaagaggaagctgggtgcacaggggaaatgcagggtgtgcagatgtcaggcctgccccggggacagagagagctggagaggctagacagctcctttcccacaacaaatcctcctgagaaatattctccatctgtccttccttctttctttcttctttgttttccagtctgaaacaggtaaacagggcagatacccttctagagtctggctagagacccaggagcccagatctcctggaacctggagattcagcctatctcccgagctctgtcctccacccacccaggatgcaggtggtaagagtaaccctcacaacgatgagatacccaggcttggaacgcagttctgtggcttcagatgcacaagaggctcatgggatatccatgggccagggaggtcttagggtgaagggcagagtgccccaaacctggaagaagcatttccttggagatgtcctgcactctcactggtaagatcttgggaaacagccaatgtatgaggtctgtgaatctgctgttttaacacacacatgtagcatgcacaaactcacatgcctgctgtctggatcctgcaagttccagatttgtgactttgacttggtctcccaagccagtcatgcactctgctttctgttacagggactacatgcctttgaggctttgctatcttccttggcaagagtccccagtgtcccctgtcctgtgccccagccataggaccagtacagggactagggtgggtagagctcaggataaatggaacactcattatgattgttgctcttaggctgtgtcaggaccaggatagcagggaacgtcttgtactgcacagctgttgtggtagaggctggaccacaaaaggaagaggccagcagaggacagctcctttgtcccgagcctagctttaggtgggaaagttggggactgggccattttccttccctattcctgcttatgcctgtgggtggggcccacactgagcacccgtcttcctcgtagatatagaaaagtgccacttttagtaacatgcccaagatactagtccaacagacaaggatggctggtcacagtctctcgggcaggatggtggtgtgccagagcccttaaaatattccaaggtgtcctggttgctgaggccttgctcctatccccaccctttccatctgaagaggaaacattttgttaagggtcagcttattggcgcctgtggtccctaaggtcttcccaggttgctttgggaaaggtgggaactaagagacctggactaggcaaccaggaatcctgtgcagagatggcactcatgtgctgaccaaggaaactagcctgcatgccctgccccaccaggccagcccctgggctgtctgtccatcttggctgaggtggctaccagtcctcttctgtccaggcactgtctggacctctagaaaggccagcccctcttgggcgaggcaagcattcccaggctaagagtcctgtggtcagggggccacagcccagatgtgcactcttgacagtgttgctgggtggtcctgggcttggccctggatggatggacagatgaagcccttgaggcccaaagtttgcagaaccagccaagaagtgcattgatggccttccgcaaccctttctccttcctcatctccctgcctccctccgtccctccctcctcctcctcttccttcttcttcttcttcttcttcttcttcttcttcttcttcttcttcttcttcttctttttcttcttcctctctctctctctctctctctctctctctctctctctctctctctctctctccttcccctgttccttcctatttgactcttgaaacccttggtctttcttagttagaggaagacctttggctgctgcccccgtgttgatgtagtcgaaggtcttgtttccctttaactggcttccatttttttccacataagcagactttaggcttgggttaggtttgtagttccatggacctcagggtgactaaagcatagatggtcttcacggttttccttgtaagatctgcgcagagggcttttttaactatggatggttcagaatcgaaaggattctacccaaactatgtaagcaaatctgtcccctctgagttccagtgcacaggaattaatcttgtacctgtagctgggatgactttccatgaaagttggtgcagcctgaggaccggtgcttagctccccagaacacacataaagctagttgccatgtgtacccataacccctgaaggaagaagaaaaggagagataggcttctctttagaaattcatgggctagctcaatcccaaatgggcagcaggaaccaccagagagaccctgtcttaagtagggtgggaatggatggccaacacctgagattgtcttcacacatgaacacatacacacatgcacatgctgagttacaaaggataaacacactcaggattctttgttaatacaaacagggttcattactgtgaaacctttttcttcctgacccccaaatctccatcccgagacagggtttctctgtgtagccctggctgtcttggaactcactctgtagaccaggctggcctcaaattcagagatccacctgcctctgcttcctgagtgctggggattaaaggaatacatcaccactgccagactgccatctgccattactattatatatatatatatatatatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctggcttgccctctgcccctgtgtgctcattctgagtgcctgttggctttctgaagctcatctgcacatgttctgatgtgtacaagacgggaattcagccttctaaatgtattctgacactgttgcctcacctaggagctcacacaaagcgagccctgatctcaggccggtgtttgcggctccctaatttggaattttcttagcagtcgttgggcaaggcctttgggtggatcctttgtcagtcagcattccctccctcctgtctctgcctctttgcttccctctcctctctcatcctggcagaagctgtggggcactcacaccccggtatggatcttggtgaaggttgtttgacacttctgtgtgtcagattggtgtgagccctaaggcacgctgggttcagactgtggtagcccagtggtctttgtgtgtctgtggctgcagatgcctatgcctctctgtgggattcagcgacggctttaaccctagaggtcagtacacagagcgagcttgccctttccaacacctcccaaggcagcaatgaggctcctgggctataaattgccattccctggccccacccccaccccccagaggtagattagagtctggaaggcaggggaaactatgtggctttgatactctcagtccttagctgtcatctgcccagcctggctccgagctctggggcaggtaacacctatgcttcctgtggtgagcacacttctgagatgcctgggaccctgtggtcgtgaaaaggtgagaggcagaactcagaacaaacaggaagcaaagctttgtctcgaaagactctgttacccatgggtgttctttgagtatcacacagctgagatcggtgcttggttccagtaccaagatccaggtgcttggtacctgtatgaagggattaggagctgggcctggagagacttgtggcccctgagccggctggctgagctggctgaggtgctaatgaggctgtgcagaatctctgcttggaggagagaggaaactggcaactgccagcgacaggaaccagggaacgtgagcccactgtggcctcaggtttgggatctggtttggagttggtcactgtgctgtgacctgttcgccacagcattttcatgtttcctgtcagtcggaggcagagccctttctcatgggaacagtgattcaaaacaggagagctggtgggttctccctgcgctgcgcccacataccaagcactgtggaaggtctgactcgcccattatcaggagaagctgcccgtcattcccacgcagcctgtcctcccatccctcctcccccagcatggagggtacatcagcctggtcccttcagaccctacagcaggaggccaccctgctttgtgacccaaggaccctcaggaccccagaatcaaggaaaagacacacacacacccacatgggcacacacacataggtagacagacccatgcacatgtgagtgcatacacaccacacccacgtacacacacacttgctctcacacacacacatgtacatgtgcgcacacacagacatacacacacacatgtgcacacacagacccacacacatggacatgcacacacacacagacatacacatgcacacacactcacacacatagagacacactcatgctcatgcacactcatgctctctctcatgcacacaccattttcttgagtgaattcaggaaaaaaaatctaaatgtgtttagaaccgctgaatgcatgcttcgaacaggctgagaagggccgtgggtacttgatatgaagcttaatgagagaaaaagagggctggctcccagatctcaacatttaacaggctttagtcagcacacacggcccaaccacaggaggctcacctccagtctgcacatatgttttattctgcgatgtgtttcttttaattatttatttagtggttgtgtcatcatagtgcacacgtggaagtcagaggacaacttgcaagaatgaaatctcttctagcgtgtggggggtcctggggatcaggtcttcagacggggcagcaagtgtccatacctctggctccatctctctggtgcttagcgagggtttttttaaaaaaagatttattttattattttaagtgtgtgtgtgtgtatggccatgtgcctatgagtgctagcgaatagctataaagcctggtgatgctggctcctcctagatctggagtcactgatagttagcattctgacaggatgctgggactcaaatccagcttctctggaagagcagccagtgctctgactcaccgaaccatctttcaagcccctgtaacgtgtcttaggatgttggttgtatgtagttaacaagtcctgacactcagctctgacgtgagattgctcttcatagatggcagtttcaaaacaggttgggagaaggtgctagacacatgatatctgacagcgctggtggcaatgactgtgctttggtgtggccagcctctgctggggtggaggctaagccaggaaaagtgtcccgaggccttgcaaggtcttcagtaagacacgggaccgaaatcaatcagatgattaggggccggatgctttcagaggcttgcttctgggtcagcaggaagttcacactcagatcggttctttacagagcgtcactcctctctgttggagtcaggtgtcgggtggaggggcaaacagcaaggatgagaatgttctgaggggcggcctggggagtgaatacagtatacaaggctgacgttatgacacgttggtgccggggtgggagacttcctgatacttttgggaagcacgaggctaacacctcaggaaccccaaactgctgaccctgttgtcaggacagggtaaagatacagtccctgatttaattatgtgaacattaaatcaatggcgtctataatagcaatggactggctaataatcaaaggccagccataaagtaatattcgcctaatatttgtagtgctgttattaaacaaagttcttaccaatgaaagatgctcaaattttaacctttcttttaaataatcaggataccaaattatatgttttgccaagacactccctttctgtataaaatgtgtgcacatccacaagttctctaaattgggtcacacgtgatataagattttaaagtgtgtaggtaacttcagattacttcatttatacaaatcaaagggtctccgaggcctgccaggccagccgttttccaggttgcattgagtgtaactcttgacaagatggaactgaattgaagatgtgtttgaagtcaaaaccctgggtcactcctgagtgcacaactctagcaggcaaccacagcccctgggtctgatgtcagagaccctgtggcagcagaatcatgctgacaccctgcagtccagaccccagggtgttcagccaggtttccccctctaatctagtccccatctctgatctaaagtgaagtcctatgggtttggagagctgtccgagttaccgtgaaatttttcaatccgggttgacaatcttaaatgtgtaaaccacccttctttttgccccttttcattattctgtgcctgtctgtctcctatctgcctgtctgtctgtgccactcactttttaaagattttttcctctaggggttgaaactagtccttctcattgtgaagtttgctccccccagctctgtccacagccagtctttctgtgcagatataagaaacttgtgtgcatatataagaaacactgtgaaggtgtgggatgttttacagtgcctcctcccacaacacctgggtacccattctgcccctggctttgaggagtctggccccacagccctggaaacacaccctctccttgaagtaggagtctgctcagctcccatggcgtgccttccctggggatgccagcctcccttctggccaactcctcctctctgatgcccgccttccgctcagcaagctgctggaatcagggtatatgacacacacaggaaacggccctgacaggcctagcgtgagtttctaagtgcacggcagcccttccagaaagccttaccccttctgtaatgttactctggagtctctgtgagcactgcggatgggccaagcctgtgccgtcagcctgcctctgtgctgggcagatgcaggcacttactattgtgtgtttgtgagtcagattcctagagggatgacccagcttgtacccgaatggtaacaaacacaggtgcatcttgttaggactgggctggaaacaagggacgtggcagtctggagggaggagttctcttgagtctgctgtagctcggcactgcagagggaagttattcccagagccccatttggccaaaggtgcctctcagggctttctttagagaagggtgatccttcctgttcctggtgaagagtatccagagtcccattgctgattctcctgtctgcaagcaggctatgtctgcaccacttccatggctctgggaagtagattagattagcttttaaagactggctgacttctttaattcatgaagcactggcaagctatgaccacacacgattgcacagtaaccatggccttatgaagactttactcccctaccaagatgctgctggatggtatcgtctgacaactgtgagggctgatccccggatggtgccccaggcacagcatgggcaactctgtcttggtgtacccacacttaaagctcctctgttcctttgcagcccatccttgcctgcccttgactggcagctcccgtcacattctggtccatacgagcttcggatcgaggtgcagcccaagtctcaccacagggctcactatgagacggaaggcagccggggggctgtgaaggcttcagctggaggacaccccattgtgcaggtatggcatctgctctgaccagccaatagctcatacctaaaacagttttggattcacagctaaggactttactcagacgtaaaacacagtgacctcagagcctgctatgttccttgtcttcaataatgtcccagtgagtccttcatgaactggaaatgtccaaagtcaaagtgtgttcaccgtacctcactgaggatgcatcgtctcgcaggcactgcagaggcagggcatcagccactcttctcctcacagagggaatggctgagcaaatgcccaagtcaaaggatattttgtgtgaatgggtatcactttcatactaccatcaagttaaaagagagacagtatgcaggaccactgtgaatcaagggctgtctgtggctaccatataatgcttttcattccatctataatggttttaaaggtttgcccagagcagacttacttgtggagcaggcaccattacaccaactgttctgcaactctctttcaaaacatctctgcccctggagcggatgtgtgctctccacccaccccacaccacacacgtgggattggtggaagcaccaggtctcaggtctccagggcagcagcctctgcttctcagtgtgcctgcaggtgttaggaggtagggtctgagggagcgggttatgagatggagttctgagggaaaggtggctgtgatgggcacagtcacacttgtggcattttggggaaggaaaatagaaatccaactaacccaagtccaagaatctaggagttgctcggttccacgagactggttgtttcagctggtctgcagtagaagtaggttctaacagatgtgctggtatgtaagtgcaagcaggcaaagatatgtgaatcctccttcttccaatgtccttatgtaggcctccaacagagggttggcctaccacgtctggatctgggacttgctttgtcccaggctgaccttgaactcagagatctccttgtctcagtctcctgggattaaaggcaagttttgccttgcccggggcctaagcttttcatggccactatgcctcaagatctccgtgttaagatccaggttagaatcctgcgtgccctccatttcttgattgtacttcattccagatgtagtcaagttgacagccaggaatagccatgacactaagtttccctgagcgtttaaattctgggctgtgatatagtttgtatctggtacgctgctcaccaatggtggccaggaggcacactggaaagtcggaggcccagcaacgtcacaggtccagcttggtctttctccacctggacatcagtgtgacatcccaatgggcggggtgagtttgtcttggcttccctttgtcacacccgtccccttgtgagctttagatcccagacattactgttttaagcgccgccgtgaagtgctcactctccggctgactctggtcacatggtgttatggagagctctttaccccagtatcccaacatcataaacccgggtgcccaaccctgttatttcaggactgatgcaaactggaaggggtactcagcagggtaccctgtacttttattttattccatttaggtaaataaagagctggcaagggcaggaggccatggagacaaatggctgtttgccaacgcagcaatcagccacatggaatgagccgggcgaggtgcagaaacgaagcactttagcagcgcttgtgggtgatattaaggtgatatttgtggcctgtgtgctcgatgccaattaatacctactctgttagccgcttgaggtgataaaatgctgggggacatcagtacgcagcagctggcttgacattttaagtttctccccttcgcaggtggacgaggtcaggtagcctgccttcagctgtgttgggtaactaccggtatttacctctcctttgcccgctgtggttttcactgaatgaaagtgcattattgctgaatggaacagattttaataggagaggaaataagtctgttaaagaaaggcaggggagtaaatggagagataatgcctgggcgcctccacttacttggatcttacagccaagtggcgctgggtgagagcggggggtggggtgggggtgtgtgtgtgcaaataccgtgccctcatcagaaagatggagcttcaggtgcaggtctgtgccatcttgggcttggtggttggtggctgtaagaatcccagctgctttggggcgataaagccagaaggagtgtggggagccctgtgtttgggggaatctgtgtctgtcagccacagatccccactgtcttgtgtgtcagatgctgagccgaagtgctgcccctagagaaccaggtccaggtgtcttgagctcagggcaacagtgtatatctcagtgcagctgatatccaggaaattgaagcacttctgagggatggcaaaatctaaaacagtgtttaagaagcaccctctaaattatttaaggtggcgttaggggaaggtggcaaaaccaggccaggccgccgccactgccacagaacagccaccgcttctacaacactgttgaagggcaaaggaaaacaccccctagctaaaaaaacacccagttcggtggcgtttctcattgtgggacattagcaactcaaggggtttcctgggatattctcccaaagtaaactcacacctgtgcccgcgtgaggaaaacagctaaaacgagggaattttaggggatttgttttctcttttggccggtggaccacaaattagataaaaataggatttgcacgtaattatgaaacacacaaaaaatagaaaactctcttggttgccatgaaagtgctgtaaccacaaagttctacctcaggcttctgggttattttgatagacccgctagtgccttcagctctgatgtccaactgtcttgctcttggaggggcgaggccatgggccagttcgcatgcccggtgtgcggacactccacaagccagtttgtgcccagtagtctttgtagcattcctcactgttgagggcttctatctcacccgagaggtctggactcaccgttcaaaatggccacaggctctcactagccattctatggtcaccaagctacccaggcttcaaaaagtctggccttacagtctgctagcatttgaaaagccctatcagaaggcatagccatgggttatcctggaaccaaggaagggttgggcagggcttatctatagttttcctcgaagttcccaggaacgagctaccttgcagcccctaggtggacatggtctgcacaaagtccttatggagatatccttggggacacggtggctccattcagttaaccactgtcttctgtcagttactgagacaggggctcctacatctgtctagagcatgctgtggtcttgcttctgatgtcacattgtaatgtgagaaatggcctagatcttccttgactatgacacttgccttggtagagcagatgtcacaaatactctgactacaacaggggcatttggtcagggcttctccagctctctccagcaaagtcttcattgagtttcatccttgtccagcaaggtccctcgtgaccttgatctggcctctggctatcaggtctctgtgtctgttgggtcttagccaccactgactgaggatccaaattctccagacgcttggcaggggatgtgatatctaccttgtcctgggctatggtggccttacgggctcctgcctatagaggcccctactgtagcgcatgcaatgctttgtggtttgaggattatctcccatccgggggggtcatggactccagctctgtttaccaatcaccaaaatgacctgcctgatagcatctgcgcatcacacacaggcccgctctgcttgaataattaataggccactgaaatatgaacactcagaagctggtcagagcctaacatttaggtttgcagcatagggcttgccatttaggacagtgaccagcatagctaccgcccggccgtgaaggactcagatcaaagagacacagatagtgtcccagacaggtgaccctggactctgggtagaaataagcgacatgctctcagggcacagacagcaggtacctgaggatctgttggaaccagggcagagtcatagaggaacccatgacaggccctggcttgtgctcctgcaccggggccaggcagtggccagtagggactcatgacattagggacccttctgaggttacatagcttgcccccaccccatatagattcatggcagggactttttctatcgtacagtcctttgacagctgaggacatccactggaagatgacttgaatttctcaggttgttcaaattgtctttgagctaagcccttgttataattacttttctttcttggtagtgtcttttcccccaggtcctatgaggagatttagcatgtcaaaaatactgtgagaagtcagttccgaggggtttctgacctgtggccagaaggtccctcgtcatttggtttagtggcctggaatgctctgtcccgtgcgagcctgcatcaccccggattccaggtctcatctctggaggctaacacagagccagggtccctcaaggtgttctggtcagagcaccagagcccaagggcgagcttggaaaggcagcatttcactccggctgggtctgcaagctggtaaggcatgcatacagcaggggctaacctgcaggcctgaccccaaagcaggagcatgctgcccagagtcagccaacctgcatgaggtctggattaattttttatggatcagcctggacactgcatggagtcctctctcctttcaggactcttcgaggcaaacctcctttccctgcctgtcatgtacagggtaactctcctgtccacttggatgctgcccctgccttcttcacccacactcagcaccaaggtccagtgttcagaaaacgtaagggtctcagggaattccatgagggaagctgcagtctcccaaacacaccacagctttgcttactgtccatggcagagctaaggctcgacagacaatcggtagtaagagacgagccgtcgttccaggaagacatctggggtcagctctcttagcggtgggagagtgaagcagacagagatggccgttcgcttacacagtctgcagcagcatccctgacggcctctgctaagccgtactgacgtcctcaaggctggggtttcatgtggctgggctctctgtgagctcatttcagagccttcccactcagcagagtgggaagcagggagggtattatgtggactgtgggaacaaagacaaggcagggctacaagcagaagcctccccaaatgaagatcctgcaagtctgtcaccaaccccccccccccccagacctgactcagaagctatggcttctttgttccaggctaggaagagtttaagtgatgctagtctgagatacagaacctactggtggttttctagtcataggcccacagagctctgacttagttagggttcagatgagctaggtcagtccggcccctcctctaccctaccctccttggggacaggtgagatgagggctgagtattggagacaaaacaagaaccggcattcgtgccaatagccacggcaagaagtgagccacatgtctccagctggcctgtgaccatgcatggaccttcttcctggtaactctgtggctttccttggcccagaggacccatacgtatcacaagtgtccctggctacccatgggcagctgttcaaatgtagaaaagatacaaactgtagagtgttctcttgggaggctcggagggactgttgtttgctctctgggtctgtttgtgcaactggccctgcctcatcatgggaggtggggtgcagacagactactgttgtataccttgcctggcctaaggggcttcctttcatctcctggggtagcactgggctccttgcctatgtggatggctgcagtttgccctgtagctgcaggatggctgcaggccttgcctagccaggcccagaaccatgacctcactggtcatgttggtagatgccctcagcaaggacctcagggctgagagaagaagcagatgaagggccgatgcccctctggtataacacacagggtctggggtgccatcgtggcatcagtacaacaggtagcctttgtgagcttcaagtgtttttagtccttcatcttagattcccagccctgtatcctcagcgttttgggctctagtcagacagtaagggtcaggttctctttcatacactccatggatgcttgatgcatggccactgagccctgtggtccacgatgttaacagtaaaaacccaccagaacgctgacagccgcaggccggaccctgcaaggtagaaggaagggctggagttcaggacagcagcactattccctgggcgttcccctacatttctgggcttggcatcaccatggtagcacgttgtgacgtactacatggcacggctgctcctgagtggcctctgccctgtaacactagcctagagtgtcaccacggtcaccgccgcgtcgggatgattcccaggagagtgtacaggtggcggcttcctgagtggcctagtctatgaggtactgagggaggcgtctgtgtttcgagtgtctgtaccttcgtggcagttttacagaaggagtctgctggcgttggtgcctttttccttggatttgggtgggcagagagtggatgaacgctgccatctgcagggccagcctcagggatgctaaatgtcagagatgatccgggttgacatgcgtgggggtaactaggctgattcctggccatgccaacagttcctgagagcactgagacccctggggccttaaaagctctctttgccattgccagtaggtgggtgctaagatctgtcctacctgcgtgttgctcgcatttgtgcctctctttctcccctggcccctttcaacctctcaggcttggtgggaatcggtcccttgcaactggaccattgatcttgtgcagaacagatggaccctggttcagccacgtgcccctggtttaaaattcccacaataccatgcccaggtattgaaggaagggtcccattcattttttcaagtaaggggtcgaggaggttccagccctctcgagtcagcatgcaaggcaggaaagtggccctctgggagaagagcagaggtgatgctgggctggagacatatagagcctccctgaggagcacagagcaggcctgtgttccacacccaggtgccgtggctgtgagcagcgatccttagatgtccactctgaccttgtggcaccacaggtcatagaactcacatctgatggaggtcagaggctcagggataaactgccaggaaactggtttctccttagcctggcatctcccccttccccactgcctatctgcctcagccttcctcagtctaggaggagaagcacagactttgtgagtgagctgttttctgggatgggacggaagctccctttccgggaccctatgagaaagtgagtctggactctgacctccggaatggcacaagatggccctcggtgcatctgcacatgcgcagagcctcaagagtacgcgcgcttcccagataaagacagatctagggttctcaactctaataggtccgttcaattggcaggagagccacggagctcgcagtccttttcagaaagccacagagcgtggcttcctcctggaaaacctgcaccaggaccttttatatgagaaactgtgccagctgctggggagggacaggctccaggaggtgggggtggcttgcaaggcctttgtaaggaaggaagcgcatgtttgagcccagtgccaagccttttcctccgtgcttcaggaacatcagactttctccacaggagactgttcgctgtgttggggatgaagcttgggtctttggggatacaggcagacatgctaccacttaagcccccaagagataattttgaggtaaattaaacagctgattactagaggcctggaacagcttcaggcccccagcaaggtggagtgactttgccagtggaaatcaagtccccatgaaggtgctctcagtgaatgtctggcaggcatcgccaatgtatgtggtctctggcatttatgccctggtaatatttacatggatacaacctattttgtttttattctattttttatttgtctgccttcttacaaaggtagaggaggtttgtacatgaaagacccaaagttcctacgtgcagtctctcacagctcccctgtgctgccctcggcttcagacttctggaaggcctcgtgtgtactcgtgtatcttagctcttggggtctgagggacgtcactagacctagttttgcctgtgcctataaacctgagtttgatcatgggtacaatagttgtcttcataggaagagtcttcagaattacatgatataaattaagtactgttgtgggctcatgacacatatgtgcacacacaaagtgctcacatgctcataaacacgtgcttgcccatccaggcacacattcatgaagcaaatgcacagactctaaaatacatgagtgctcatacagtacaagcacaaatgcagcacacacacacacaccatacacacacacatacacacacacaccatacacacatacacacactcacacacactcacacacaccatacacacatacagacactcacacacaccatacacacacaccatacacacacacactcacacacaccatacacacacacacacacacacacacacacacacacacatacacgcgaacacacacacacacacacacacacacgcccatggatgttcatgagataaacctgtacactgttcccacataggtcatatttataccaattcataagtgcatacatgtataaacacatgtatagttatacataaatggttgtacacatgtcacatatagcaggacatgcacacacacatgcatacctgtggcaccctgaaagccaaggattttttttattttcagacagagctaatcactagcataaattctgtgggtagcagattccactgaagggcagtgatagtaactccttccttctgtcctagggagctatgcccagaagctcagcctctgcctgtctcgtggggaagccctggggccttatgtcctgcagcctgtactcatttgctgcaacacagccgctcacacagtgagagcctagtagtcagcgtgcccctcctggttatgcagaactggacaagccctgtctgtttgccatccttccaagtgctcctgagtatggaaaattggttttgttattggtttggtttggttttgcagtatatgttaggcaagttccctaccactgacccacgctcctacggtcaatcttacctcttcattttgaaatgtcagtcttttctttgagttgtccaagctgaccttgagctcactctggaacccactgagcctttgaatgtgtggcccttctgcctcagcctaccgcgggctgcgattataggcctgcaccacacagcctagttctcagtttgtgcttaaactctcctactgagcatccatgaggggtcctgccctcgatggtcatttctttcctaccagacaggcacacagtgccatttggagtgacagacagttccacagctggtaaggtcttcatgctggttgttctgaggaggtcacccttactaacagcagccgctccccagggtctgtgcctctggctaaggctggtgtgagagccccagttcaccagaatgacagttggctcctaccctctcagattgtggggcaggaagatggatcagaattagctcctgtgggtacagtgaggcctccagggcacagtggtgagttcccaagatgcccctgtaccctgccaggagaccagcactctgcagtctctaggagagggaaatagaacgtccaataacagaagacttcccgtgtctgggaagagatgtctccaggcagcggcgtttgtaatgaagaattggggctgaaaacaatctgaggtaatgagagtccaacacaaactcttaattaaccaagtagagggaatttaggtttaaaaaatagtgaaacccaccctgggtgccatccccagccaggaggagggaaagtgagaccaatgtgtgagccgatttctcttgtcttctgggatatatcacgggatgctaatgttactcggggtcttaaaagcaaatttccctttaagttgattgtttcaagtgtgcattatgtcttggtggaaggatgtcacgtgacaatgtcctttgcttagtaaccaagtcagaatgactcgctgaaaggcagatggttttcatcagttaattggctctgttaattcagaccttccttccactgcgtatgaaggtgtgcgtgttggcccaactccagcactgaataaatttgtcctccatcagtctgctggcctgtcatctccctgtgtaagtgctgaggtggcacaggagctaaaaacaaacatttttaatgtgcaggaaactgggggacgcttacaccttgcaagtggaataatgtgttttgtctcgtttagaggaagcagagaagacttgggtctgacaggtaactttataaatgttgttctgacagacactgtgagaagccagaggcagaaggtctgtgcagggggatgtgtgaagtagcttagatttcttttcttaaagtgaacttcgtgccttaaataatagatatttacctcccagggtaagctttaaatattcctattttcactgaaatggcatgtttctaatggataaaattataccgtatacaccgccttccatgcctaagaagcctgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncataatttgtctctgaatttctatctttattttttttgttacatttcatattgtaaaactattccaatcttatatagactagtggtttctgagtagattcatcacactgcaagaggctcccaggtgttgaggggtctggaccaaccaaccttagttgttaaaccctgtttgcagtaacttgtgtgttcacacagctttgtagtccctgcagattaagacagtgttagatgtgatcactggccagagagtagcagaggtggctttctgcgctgatggcctcagatgggggattgcaatattctttcagtcagccaggcccacagcaaatgggggagtttgaggggaaatgccctgtgctttctggctccacccaccagccttaatcaaggctgctgttgtctcaggatgcccggggacctgtggtcagcaggcaccctttacactcacacgtgtgcccttggcacagagcacacataaaagctgcacgggtgaatctgaagcgatctagctcatagatgctgtgactatggtacaaacagggagcaggtgcctggcccaagcccagagagaagtcgttccatgctcacttagtatacaaaacacacggggtgcgtgtctgtgagtgcgtgtgtgtagtcacgtacaacaacactgccacctgcacctgccccgcagactgtctctctctctcacacagggatcctccttgatacccgtacgtgctcccaacccatgatgctcagagtctctgctggctgtgccctactcatccacggctcctcacaggacacaaacattaattttaaacattaatcagcagtacctgtaatgctgcccagaggcctggggaggcaaagacctcctggaaccacctactgatgtcagggagtgggttggctgcatattcaggacactgtaagggccaccaccccatctttgcaacacagattctcgtgcgtacagttgtgacacctgcgtggcgtcagccgcggggaccactgggctgttttgatcagccccttcatcatacagtctgctgtgagctctttattccgcactgccctgtctggtgttctcagatgttctctggtgtctgtcagctttccttctatgtccagaagtgaacgggggtaaggctcatctccaacccttaacttcctacccatcaggaatgggccatccaacaggattatttcctgggaatgcaaattcagagatacagtccctttaagggaatcagatgagagtctgcttctttcaataacagggtgtggagagagagagatgtttcctgtggattgagctgtgctgtgggttctggataggcgggcccaggagtcgccagggcattcttactctcaagtctaaacttcgtgtctgtactgaggactctcttggtctgggagggagtttgagggctcacagaaagttgtcccagcttgcctcctgggctttgaattgggaaaggagaaggttttcgctgaagaaaaatgatgggatccagggtctgcctcagacaggctctcacttttgccttctcaaagctgtcagtgtctgtcaccttgtgccaagtcggcaggaagaggacagagttcctcccaagcctgtgtggaggtctgccaacctccccgtggaagcggtctgctttcatcccagccatcagaggtgagcactgctccacctggccccttagcttattaaggcaacacagcccggggcctctgccccattaacctctgactagtggggaacacatttttcttgctgccgctcaatgaacttgagcattcgggctgtacctgtttgaagtacagtcctggtccccagccctttcatcttgaggtaggactggcactgactgtgtgtgtgtgtgtgtgccacatgctggtggatcacaggacataatgaaagccgtgaagtgcccatgcctctcctaatgagcaactggcatggatcaggccagaggcggtggctgagacctttgcacgagggacatgtgagaggccccgctgccttgtaaaaccccgatacccacggcccacatcaaaatccagcagtagctaattgcactgtctgattttctggtccccacttctaggtttcattgcctttttccaatgctttaaaatgaaaggcacaatcccctaccatcccgaaaggctggaattccatcggagagactagtagtaatggctggaacctggtgtcctctgcactcctccctttccgggtacctcccttccccccctaaggatctgtggggctatttcttgcggctgaggctccctccccattcccaccacagaccaccttctttgctgcaggactcttgaagactgcttggtgctttcttatggtgccgttcaccatcctccttgctaaaaccaattacctagcaatcccgcaactcatcacagggctctgagttccatgttccagctctcctcctttctgcccaccttctggccaggccattcctttgtggtcggcatgaggggctgggggcttatccattggcaaagtggatgacagcaatcggagaaggctataattgtcatcgactgagtcctggcagccacctgtgtatcctggcatcctacagtgtatctcatccaaccccggcttcccccaaggcatcagggagctatggggcattgcaagcatggtgcatgaggtgggcggatctcaggattctaaatagaatgatggggtgggggtagggcttctaggagtgaggcagaggaggtgggaagggcggtagctaccagcatggggcagtttcactgcgtcttatcctgtgggctatatactctgtccacaagatactctgtggtagggtaagcggtgcaactggcattgataggacgtctgttcacacctctttctcttcctgaaggagaggtacacagggcagtcatgaaaggatggcctagacacagttgtgtgtgtgtgtgtgtgttgctgtgtttatggtaaatgcatctatgttaccaatcatgagtgagcaactctcactctgctaacttgtgccataactgaatgtaagaaaaataagcctgtctttgggggacgtgcaggactgatgtggggaagccagaaaagccttacctctccaaatctggaggtgagggcgccatgagcagtccagccacctccatctctcctttgctcacctggcttggaaggacattcctttctcagaggccagtcagaaagccccacaggttgggtgtgggctgagatgccatggaccatcaggcttgctagagttttgtggtcctttctcagcagcttctcctggagagaagtgagcgtatgagttctgctttgtcactggcacttgtagcatgcaaatggtgtgaaagctgcctttgtgtgtgtgcacatgtgtaatattgtgtgtgtgcacatgtgtaacattgtatgtgtgtgactgtatactttttgtatgtgatgtgtgtacaatattttaggggagtgtgtgcgatggggtgcaagtgtacacatttgcacattgcctctaggtgtgcctgtgaacccatgtgcacactacctgtcttgttacacgtgtgcagaggcatgtgtgaggtgtctatttgtacattggtgcatatatgcaaacatgtgtctgtttgaaaatagaactaagagtgttcagatcctaatctatattttgggggcctttaggataatgaggctttatttatttatttattcattccgatagtgtctcattgagtagtcctggctgtcctgacactctgtagaccaggctggccttgagctaagagatctgcctgcttctccctcccaagagctggtactaaaggtgtgcgctactatgcctagctgcattttatacttataatttcaagaagtactaatattatatcacatgaaggtgaaggtctgggcactggacactgggcactgggcacagttctccttttgagccagtctgttgacaaacagttggttcccaggattttatgttcatggtgcctacttactgcgagtcttctgttttcttgccagctacacggttacttggagaatgaacctctcacgctacagctgttcattgggacggctgacgaccgcctgctgaggccccacgccttctaccaggtccaccggatcacggggaagactgtctccaccaccagccacgagatcatcctgtccaacaccaaagtcctggagatcccgttgcttccagaaaataacatgcgagccatgtaagccaagtgggggctgtgcccgaggggtgggctcctgctgctctgcccagcacccagtgcttagccccagctcctaggccccaggccctgtggctctctagagcctgaagaaactttacagatatttacgatgacagatttgcctctttctgggttctcaggtgctgtgtgttatggcaccaaaggtgtctcagtcacacagctgtaaacactgcccccagggcccaaattaagttcctaaacacaatgcctgtttacttctgaatgcagccccgttcattcaaggaatagttggaataaagtgaaaagatagggcgggcaacacctctggattgttttcactcagagctgactatgcacgcggctgacatggccagcatggtgcgcaaagcccctgtggcacacgattaacttagaaagggatttattagatgctgcctgcacatcacagaatatcgaggtcatcccgtgatttgagtgccctgtgttttgagtggagaagctgagaaaacacggatttccatacttcccatgggagacacattgtactggacccatggcgagcacagacagtagcacacataagcaggtctccaggcagaggatgaggcagccatgatgaaagcacacagacaaacgagacccagattagactggaaggcctgatgtcactctgcggtactctgtctctgaggtgactcgaagctgagagctgtttgcaggaggggctgtaagggagcctgggctatgcacgtaaagactgcagtacatgattgagtttgggggacaggtgaagtgcaggagatgaagttggtgcaggagatgaggttggtgcagggggctgtgccaagctgcaccttgtgtgtcctttggtaatttcttcgtaactttaagccttttaagtcaatgaccaaagggaaagcattctgcgtgtctcagcttctcaccagtctgagggactcgccctccagggctccattgcctgcccttgggttttcttcctcagctatataacccaactttcctaaggacaggatagaattagagaaaagctcttttattatatcaagattttttttttgtaatgtattgaaccttttaccagactatagatttgaatgaaattatgaagtaaaatgattgtgaaaccctggaagaaaagttttacaaatcataaaaggtattaaagtaaataagtgaataatttcggagccctgaaccacattggctggagagccgcaggacacacaggaggcacagccttgaaggctcttcctctctgagctgctctgacacatctctgcagggtccgagatgtctggtcccaggaggagactacagcctgcagggctactcagatgtgtgggtgctgtaatctttcccataggcatctctgcggggaggtggggctgggatgcccagcaggaaggctgagtctttagttctggtccagcagaccagctgggcagagagtcaagccatggtctttgtttcctgcagcatcgactgtgctgggatcctgaagctcagaaactctgatattgagctgaggaaaggggagacagacatcgggaggaagaacaccagggtgaggctggtcttccgagttcacatcccacagcccaatggccggacgctgtctctccaggtggcctcgaaccctatcgagtgttgtaagtagcagaccatgctgtaactgttgcacgaactgtcccctcgaaggtctgtttcagtaggcttcctggaagataggatccctctcaggagacctgacttccacgtctggctgcgttacgcattcccacacacagctgggtgctggttagaatctgaccaacgtacacagcactcgtggccttggcaactatattagtaaaacgcaaagcctgtcatgaagcagagttattctgactgtatctttatttattccctgcttattttgagggaaattgagaagaggaagtttggatttgcagccaccagactggacaaacccaaacaattcctcctctttatccttctcttccgattctcttttcccctcctcttctctcgttcctacccagttcctcttctcctttcccctctgctcttctccgcagctttatctcccatattctccttctcttttattatctatccctcctccccagtttgtgtgaatgtgtgtgcatatatgtgcacatgtggtgtgcatgtatgtgtgtgcatgcgttcaggtgtgtatgtgtgcacacatgtgtgcatgcatgtgtgtgtgtatgtgtgttgtatgtctgtacacggctacagatggaactcatccctatgcatgttaaacaaatgctctgccagagatccatatggcctgtatctgaattttgtaactcaccacgactgttcatcttccctgatggtgccaagttatgcctttaatgtgtgagatggcaacaggacatggctaagggttcctggtcctagaaagaagctggtatggatgaagctaccaccttcctctgtcctgcttagctggttccttgtcactagaaacatgtcaggggccatcctctcagccccctgcaccctgacgccctccccaatctggggactgcattcatgtggggtcatccagaccactgaggggacagacagtcttggctagcccttgctcctcatatcccagcactgtcaaactatgtcccttctccagctattgtggcttcatctcctaagagactctcaccatggggagatacactcactggggctttcagttccatgctgaactcctgagttctgcaggccactgtcaatgtcccctgggatgtgcagcaggtccccttgcatccactaactgatccttgcttcctctggaacaagctgagtcttagtcacacacacacacacacacacacacacacaccacacacacacaagcttgtggctctgccctctgtccctacctgtctcagtcccctggagacctgactttctgaggctgaatcctctcccctgccctggtttgtctggctggaaggagtctgaggaaactcatctgacacaggtgcccagaatgtcacccctgctcctagcctctgtagtcccccttgcaggaccacgctcatgaagttgctgataccctactgggtctctcccagctgcctgtcaagctttctgctttgcctctgcacccaggctcaatctgtcactgggactcttcctacccagctcttccaaggcccttcctgcccttccaggccaggagccagcattagaagtcagagttgcctattgctggcagcttctgaaaagagtgttccgttcttaacgtggaatcatgtcctgatgggtttgcctcaatcctgacacctacggtcactatggtttgagaccctctacaaagttcagggttggccagtccccagagaatccgaagagttatgtcaaatggcagcacccggggcccagcacctgagctgcaaggcatcctccaggccgcaaagacaaggtttcactcactcttgcctcctctgacacagcccagcggtcagcccaggagctgcccctcgtggagaagcagagcacagacagctacccagtcatcggcgggaagaagatggtgctgtctggccataactttctgcaagactccaaagtcattttcgtggagaaggctccaggtatgttcttcaggctggcccggatgaggtcctgtgctcagtgctggtgggagctggctcctggttggcaagatatggaccctccccctgcatgagtgcgtttggtcatagcatgggcaattgtctgatagaggtagccgtcagtccacaggggctctgaagagctcatgatctcatcccctttgagtttttgtattgctgaaagtcaggtcaaagttcagctttcgggtgcacagggccagacttttgaaagtgtgtgttaggaaagcctataggctggtgttggaaaactcctacttgctagagtcatctgctcacctggagtggtcatcaggcctggcacctgttttgagctctgcccagcccttcattctggcttttcctcttccccctccatgagggagagcactcccttggcttctccaagaagccagtcccttaaacaagtgccagctagtaccacagtggatataagtctggacctgttgaccttctgtattcacctcatgcgagtcactgggaccttcagtgtcacagccgtgtgtgtgtgtgtgtgtgtgtgtgtgtgtgtgtatgtgtgtgtgtgaaagagtgtgtgtatctgagtgtgtgactgtgtgtttgtattaatgtgtatgagtgtgtgtgagtatgtgagaatgtgtgtgtgtatgtatgtatgtatgtatgtgagtgtgtatgtgtgtgaatgtgcatgaatgtatgaatgtgtgtgtgtgtgtgtatgaatgactgtgtatgagtgtgtgtgaatgtatgtgtatgagtgtgtgtatatgtgtgtgtgtgagatctccatctccacagacacccccccataccccacaaagatctccatgagaagacagagcatggcactgccatgctcaactgtagcttcctgctcacagtagcccacaatgaaactgtctcatggtttgcagatgccaggggtgagcttagaagggccggtgtcctgaagagctgtacattttctttacacctacggccattgtgtctgcatgccattgggggccaggagtgtggccccaggtcacttcagttagacattggtcctggctgctcttcctttctggctccaacttggtagagctgtactgaccagagaggcttttgggctccagaacacagggaaggctgagcaacagccgcttcggtggctgtgggcaggcgtgcactgacccggaagatgcctgccctcagctgcagtaactcctctacaaagggtgtatggagtttggaattttggactcaggccttcttccagatggggatttttttggggggtgccataccctatccacaagggtattggggtagcatctactccaagctagtgagctggaggctttgcctgcttttcgttcttaccagctggccttttctcggaggtggtcagtccacacttagcctaatcattgcggagtgccgaggcattcagtggcctccatagtggggtcttgattttgtaccattcacaggaaacataagcacttcaatcaacacaggctttgacatttaactcggcctgcctccgtaatcatgcatgtaattggaaaatatgttgtaaattataaagaaagcccaactaagtgcagtgataaagagagcagtgcccacacccttctccggggaggtaaattctgaagtcatttgaccttctgagcctcaggcctgcctccctgtcagccaaggagcactagacataactaaggctccgcactctgcactgtaagatccctgtactccaatgagggagccccaggcaggatccagatagcttccctatctgtttatggtttgttcaagatgggaagacctacagaagtgcctgccccacaagggaattggccacagctgtaaacttggtagctcgcacctgccgcagctgggtctgagcctgggaacagtggcaaaatgcatcttccggactacggagtgagcagcccactgctgaccacaagcccctgccttactctgctggaagccccatcttgccttcattggattattcctaccataaagctaagctcctgaggctgcagaatgggtccctgacctacgttcacaggttacaagtgatgtctatacgtaaggcctgtaataaatgaataacagatagacagcactgagcgctttgaaatgtgagaactccacggttctgtgtctagacaacaatgtttcggggtgttttttttatatatacatataattagattatttgcatatgtgctcaggtgtgtgcatgcaaatgatatttttctgaaggaaggaaaccaatatctgcatgagtcttcctttgcctttggttttctaagcaaatatcgtccctgacctaccacactgtgtgagtcgggacgagctttttctagttgtttctttctggcaagccagaaagctcaatctgaattgcaagcacaaccggaccctcagtttctgatagcgtgcctggtccaagttccatttttaagctgttggttacagaagccaaacatttggatgagaggagaaacagatgtgtggaagctgtggtctgggcatgtggggctggcctttctggaaggggccatccctatggctctgactgttgtggacattgttgagtcaggcactcaggactagagccaggggtttggctccaatgtatcttccctgtgtaatgcagaatatctgagtcacaggtacactgtggaccatcatccagtgctccgggtcacaatgtgcaatgactcaaagggtcctctgcatctgttgtcaaagagtttccctgccaggagggctgtgggagtggttgccgctctgctagagtggcttgggtaggcacgggtagcagagccagaagttagctcctacactctacacactgcaccctgccatttcaccgagcagctgaggaaagtcactgcaatggcttgcagagctagctcctccctgggtcatcaactaatgatctccaggtgggggtgagggtggtgccacagggcatcaagcagcatggccctggcttatgcataatggtgaggttaggacttttctctggcctcttcctcctcctgtcaggagtatccattgaggactggctggaatgagactgtctttcaggggatgaaggtcaaaaagaagtgcagccctgagcatcagggaacactgactgataacagacatccttggagaatattttttccaggaagcagaggtagtcagtgaggtctgagggtactcgccacacagggccacacgtcccgtcagatgctctggcggcgttttggcctatccactccaagtgccgcaggcgtctggcatggaagatgacaggtcagctctccccaacacccccactccccacctcaagtatggcttcatcttcagctctgcaggctcgatggcgtgtttgtatgtgagtgagagcacgtcggtgtctgagcagtgggatcagttatcctcctgagctcagctccgtcttctttggagactgacccaaggtgaatgaagaatagaggacactggtttctaagggaacgcccagctctacatgttggcattgcaggtagctctgtttgaaagagtattgaggcctatttgggtgtctgttactgcagtgaagccaaaaccgaggtgccccaaaccccagtacggacaggtgacacccgaccctccttccttcatcttctacacttgctctgcagtcacaatgctctctggtgtcctgcgtcaagtctgccctcaaaacacagacctgctgtgctttgctacccacagatctgctttcctagctggcccttcctccctcccttcctcccttccctctccttgggaagggacacaggagtggatgggtgggtattggggcatacaagcagaaggtggcagagtttgtgaagcaaaggcgtcactgggcataggaaggcaagagtggccggtggatccctctgacctcaggcaggtgcatagatggagctctcacgcctttactctctgactttccttgtacttgaagagtggggcagattgaacactctcggaaatgggctgccatggcagcgagagagaaggtctcagggtcaaagggcagcctcagtcaggtctcagggcagaagagcagctgaggagcctcctgactatgaccgtgtgtagcaggaagtgctctctcaacctagctaaggggtcagggagacacctgtctgatatggagggtggggcacagacacttcattgtcggtgtgtctctggggacacagctggtcccagagcttgccagaggagaaggtgctaagctgtggaggagggacctctggacagcagaagacagcagggctgagagggttggggacctagactctacgtgcggcatgtactcggggtctccctaggctttcagcctgtttgttaattgttaggagtttcaagggacccctgcatggtagcacttgcccctgacaagagcatagcataggatagcatagcataggatagcatagcataggatagcatagcatagcatagcatagcatagcatagcatagcataggatagcatagcataggatagcatagcatagcatagcatagaatagcatagcatagcatagcatagcatagcatagcatagcatagcatagcatatccgggaaccctgggtctccagccaagtgcagtatagctgacaggtctttgctcatttctgcttttgttgtttgtttgttttattttgtttttgaagtgtgagcctattcatgagcacaggcttcagggcatactgtcccaggactaggaagcagtctacagagagatcaatagcttcaagcagcttgggtgggggcgcaggtggaggtattgtacagagttgtatccctgcatggggcatgtgtattgtgtgtgtgtgtgtgtgtgtgtgtgtgtgtctcagtgtgtttatgtataactgagcataggtgaatgtgtatgtatgtcaatgtgtcatgaggtatgcatctatcaatgtatgggcgcatgtgcctgtttgcatattaatatgtgcttatgtgatgtgaccaagtaatccactggccctttgtagaatgtccctgccccttgcagtgctgagcaggggcacctcaagtttcccgaaattccaccatgtggccgctacagttagagacaaccaactttacctcccgtggggacaggagtgagatccccacagtgtcctattggtggtcagtctcctgccttggataatctatgtgccttgggccatgtatacacagaagcatcttctcagctacgtcctcaagaacttgtgaagtccccagatgcagctgcctcaggctctataacccaacgtgtctcggggtcagctgtaggagcacacatgccctgaagtcacaaccagctgtaggaaaatgctttctttcaattccctggccatggtctggggtgggccagaaacggacagtgtctgctcccaggctctgtacgccatcagccctgcgcacacatgctagttttcatcacgggcataaaaataccaccgtgctgacctggtcaggcgaggttccatgtggctaccatgcaccctcactcagcaagatttggggagagcacacccttgaagttccacttacagacgtgcccagctctgcatggttcagaaatcactgacccagtgagagacataagctggggaccggacccataatcccttttgcagaaggcatttcttcaagtcttagaaggaaataaatttggaaaggcagtgagagacccaccctgggcattcagaaagtagacttggcctgaaggcctgcaaggtaggagaggcctgcctcggatccgggtgctggcaggctgagtcttgctgtgagcttcacgagcagctaaactcaccatctcaagatggaagccacacagggtccctacaaaggagcagctggtccttgccagtctggttcctcttcttcctagagtgtctcaggatgacattcgacagtcgcagtcacaatcccttggatggcacctttctgcctatttcctgaagtgtattcacagatttctcacagggtgcagttctagcggctttgcgactgtttggtctgtgcccaggatactttgatctccatgaaagaagtcccttttccacaagcactggcacagtgaaggtgtggctgggtgtggccctgaggttccagtactggaagtactcatcagagtggccatgtgggagatgctggggctttctgggtggagtctagggagaagggtgaggtaggtgtgtgtatgtgtgtgtgtgtgtgtgtgtgtgtgtgtgtgtgtgtgtgtgtgtgtgagagagagagagagagagagggggggggtgaggagggaaggaaaggggggcaggtcactctgcaagagaccagagtgctccttagctgagcgacctgttgtgaagggcaagcctggccctccgccctctggcatcctgcctaacggtggaggcttttccacatactcctaccacacggtgccattgctaccaagcccccctcctccccagggacagagtggttgctgaatcatgccctgcttcgggcattctattttagccacaaagagcaagagaagccgtcagctcttcccttcctcacccagatgcccactgtcgcctctccgaaccttgtggatttccctccttgggatactatttgtcggtagaggcagacagtgtctgtgctttgctctctggtgcctttcacaaaatggcattttaatccctgttagtcgatgccagtgctgttcatttctgtgactgaccagtacccccatgtggccagggcagatgggcatgggttgttctgttctctgtgactatcatgaatgaaggtgttgtggatgttcatagacaaggttctatgcatgcccgtgtcttcctcctggcacgtccctggctgtgaatctgtcctcagctatgcagtgccaccaggctgtttcccaaaatgctgggggtatggatggcggggggggggtcttgttttaccttggggttcttctgaggggtgcaaagctgccctcctaacctgggagaagcaggcctccagggcaccacatgcacaccaggctggcgaccctcagagcccctctgcagtccagccctgcagagcctgtgttcatctagccccgtaacacagccatcccagtgcctcacactgatggggtgtctggacctgcccctcccttgaggctgatgggatgcagactcagggctagaaggaggaagcctcctgctccacccctaggagggggcgaagcacatctcagaggcttctccactcctgaataaactccagctgcttccacgtgtggaaacagtggctcagcccctaccctggcgtgtgactggcctgtgggcctgtggtggcagcggcgtcctgcagccagtggagcggcttcagacctgcaggctggctgtgtggaaaccttgggcgggtgtggtggggaagcctttctgatgactcacactgcagggaattccctaatgatttggaatatttttacttctgaactggagcacagtttcctactgggagcgtagggagctcctgataagatgggacacaaaggcccttttaggatggccggctggctccctgcctgggagaggctgagttctgaacagcacttggttaactggcctctgagcagggaggaggggggtctgaactgaggagtctgtggacgcatccaatggtctagggcccccctcatggccgatacctgatgattccctcaggagtatgaaggactatctccacgtaatttgccccccaccaccccatcccccgtctcctgccagaagcaacctgctaggtgtacagtcagaagtccattcagccaccgtcagagcgagaagagtgcagcagagtcactgtttcgtctatttgacaactgcagctggaggacctgggtctggatgggaccagtgctttgaatgcctggcctgggataagcacagaccttggagaccccaagggaccatattttcaatgggaaacagaagccgatgggtgatctgtcttggtgcaatttagaagacaggaatggagttctgtcttgtctggtagtggttggcatgggaatgctggattggagctggccagtcttggcttggtaaggcacagtggccccttctcagccactctgctgggacaggggaacaatccgtcacaggcagcaccttctccccatggttctgagccttggcaggaacttttgggatgacgggggccacactacagttggcacacctatgtacaggcaaagaaactgtagattctcagggacgagaggcagagagctgcctctcccttgtggagggcaaatctaacacagcatgcagcctgactacagacccagagcacggttaaagaaccgcatgtgggtacttccagtttgacccttgtggctataggtggcccatgtggctgaggttgagggtgcttctcggctgtcatccctgagctaccagagcctaggggttcactgtttctgacattccggtgctctaggggtatcttgttgttttccctgaggggtaaggataggaatgcagttagacccccttcatgggctcacctgatggcatttgctcaaggcctggggtatctggggagctggtgtggcctggtgaggctaggtggctcttggagcctctggtgactcacatttccaccccgtgcctccaccctccgcccaccaccctgtccagtgctgagggaaggagctggtgtttgatttatcagtaatgtagggttagtgacagacaaatggggtgtaagcagaaactgagcgtgtgcctaaagcggctcatctcaggaactgacttcattttggaggagataaaggccaggatggatagccgtcaactcagtggccacccagttgtccccaggtcatgagcctgtcaccaggactggggactcagagcctgtgagtggcagacacccttcctctaatcactaggtccacacctcatcgccagctgagaacaatacgttctttcactgtgcctatgagagccttttaatatttttttttaacatgcaaacagccactgggctaaggttaaaaataccacgtgttttgcatttctaggtcctgatgtggcatgaaatagccaaagaaaggcttctcttatctcctcggtgcttcctctgggcagaggctgggactttgccctggcttcccccaaaacacataggaggctggtgcgacttaccaagtggcagagccaggctgcgctcaaagcacagtacatgttgtgcattgctgggttatattttgggggtgcatgttgtggattgttgtttttagggggtggggtcgccctgcctctctctgcttttctgtcccttgggagagactaaggtgtaggaaaccttccctgatgtgtgttgtggcagacaagatgaatataaacctggacacagggtggaccattagaaacactcttgattatgtgggcccctcctaagaatatacactgggcatcgtctttgaactcaccaagtacacagggccagtactctagagcaggtcagcacatgccatccagtgtaggcggaatatctaggggacacagagcactgccctatgacctcaccgtttcttcccactctcccctccatgacccttgatttctgggtcacctggaacattttaaagatatactatcccccaaacagagtgacagatttcttcctgccctttgttccagatggccaccacgtctgggagatggaagcaaagactgaccgggacctgtgcaagccagtaagtacttagaatcctgcagcagggacgagggaaccagacgggggctcctgtttgttaaaataaaacagtgcttaaaaaaaaaaaaaagacagaggcattgcccaaatcccttggccaaatgagagccactagaatagaatggaggcagtaaggaggggcaggaggagagaggctggagagagcttgaggcctctttattctgggtgtgctttgctttttaaaggttccaggttctgtctcctctcactaatggtgtagccccaattgagtggctaccccccgggagatcttggtgttctaagcctcattcatgggcacccagcacctgcctggacatgccacccagcctgtgtgacttgccaccaccctctccagagaacgcctcagctacctcgcgctcttgttttgaacttggcgtggacgaaagggctgaccgaactggatagcttagctcagctggttgggtttgctgaggagcggtggtgaatgtgtgacatcgtctgtgggtgacataattagtctgtctccctcccgcgtacatacgcacctgctcgtgttccctcttcaccatcatgtgaggtcattattggttgtgattggctgatcttgtctcatatacttgtgctggctatgtctgcggctgtgacatgtttctgactgttggtgtggtcttgtcatctaaagtggctgctattggagacctcgtggagtcagggtcctctttgctgactgcagtctgtcttcgccatccctacggtttcctcccttgcttgctcggcttttgcagtactggaagttgaactaaggaccacgcataccaggcaaatgctctaccattgagctataatccctacctcaacagtgtcttttaattggacattaagctgtggatggctaaacaaattagagtactgtcgctgagtcctgtgcgaattcagtctagtctcagaagagcataacaaaatgcagtgagtaggtttttgaagacacccaaaccctccctaactctgtagctcattgcacagacttcgtcacaatagtctgggcagcgtgcttgtgaccacagggcatgaggagcctttggtgcgctcccagtgtatggaagtgggatttaaatgaatgagagagctttttttggttttgttttgttgtgttgtgttgttttgcttgtttgtttgttttggtttttcgagacagggtttctctgtatagccatggctgtcctggaactcactctgtagaccaggctggcctcgaactcagaaatctgcctgcctctgccttgggcatatgagaaaaggactttttctatgaacactgggcaggcagcaagaatcacataaatggggcatgctggtaatggggtccacagagtggacaggcagtcatggctcccgtcagcagagcagtcaccagggtgtctgcttcagttgcagcaggcacaggctgcctccttgtcttctagctgagtcaatgaggatgggggaaaagaaatcctttcctgcttaggttcctctcaggcactgagccactctcaagaaacctttccaagtacttctcagaggaaaggtcctctctggccagtgatactgttcatgtagatgaaatcttaaacattcactcacagtacccggctccctccctcccactgaagagatccttctctgcctcagtcttgtctcttgacttcatccaagttgtccttaaggaaatattgaaggcagtggcacatacacatgtacatgcgcacgcgcacgcacacacacacacacacacacacacacacacacggaaacatacctgcacacacattgcatttatagatattttaaagatgggtttctgctctgtatgtggttatgcatcgcccccactcaagacggtgggtttcctcaggcctgtgctggctgcagcctttacagtctctgacaacactgagaaactcccaacacttgatctcagggcccacttcctccagcttccttcctggttttgagagcagagctcctggggaaggaagaggcaagcttgtaataggatctgtctgtgcatagtgttgaagtgcgttgacttgtgtccgtatcaagatgtgaccctctttggtcatttgggataagcaaacaagccagggatagcctatccctttggtcctttctgcgttccttccacggacctcagatatagagaccaccatggggtagcctctttcccttcacctgactgaactccaacgtcacagccaggccacttaaagctgggcacaacccaggcctgagtggccacagtttggggctgcttcctgcaaaggtgggcatgtagcataggcaccctttacccgcccctcccccacccatctcttccaaaggaagtgaaggtagatgacacagcttcctcaggttgatggagcccaaggggatggagcccagaggggaccctagccagtcctgccctggggctggcatccaagggctgtcagtgccaggttctctctctgataaaaagaggctggggctgaagttcttctggtttctgtttctaacgctgaggttttattattaacataactcaataaagtttgctgccatcgatttactaccattataacaagctacgtatggttaattactttaacaaaagaaatggtaccatggatttttctgacacatttcccctggcctgttagactaaaaccacacgaggaaagaaacggaatgaagaaacttatggatctgaaatccccagcagaaatcaggtgtagcactcagaagtactgacctccctccctccctccaggcagctgcaccatggggcccggcacccccaggactatctccccccccaacttgggtgttcccactcagttccaagtattcatggcttgcattcttgtttgcccttgaaagaacgtgtaacaaacaaaacaaaaaaagaaaaaaaaacttgcatatttctgtttaaaaacaggaaagaaaacagcagccacctcggtgttctcaactgttccaaggccctgggctgagctctgctctgccttcattatgaggaaattaaggattctgatggaactccgtgaccattgtcacagtgccactctggacaatgtccataaggaattccaccatgtgtaaccacaaagtgcctgctataagtaggcagaatgcagccttttgtctaaaggtcactgggccttagatactggggcaggagtaggccttgaagtcagctgtaccagtagcatcgaggcagctctgctctctgagagatgcccataagggtgtctcttcttgcattagttcaaccacaagggtctcccagcctctagctatgtgagaaatgagggtgccgcttccctgaggagccggtgcacgctacctccggccaattcacaatcaaaacacgtgagtaggtcacacacaagagtcaccatcagaggccctctcagtggccatagacagccgtttgagtggacagtgatgtctggacaaagcgttcctggtctgtaaggtcctgactgttccctctttgctgttttaccaccagaattccctggtggttgagataccacctttccgcaaccagaggataaccagccccgtccaagtcagtttctatgtctgcaacgggaaacggaagagaagccagtaccagcgtttcacgtaccttcctgccaatggtaactctgtctttctaaccttaagctctgagagtgagctgagaggaggtttttactgagcagccccccgaggctataagaggatgttgttgtaaacaaaacaaaacaaaacaaaacatacctgtagcctcttcacaccacgtgatagccctattcacaagaccaagtcgcccaccccctcaaagaaaagcgaagcctgggtgtgttttcctgtgactggtgcatgctggggtcatcacttgctcgccttttgcaaatacagcagcgcggccaaccaagcagctctgctgcgctcaggggctgatgcggtctgggggtgtatatctaacctctgtgagtctttgggttagaagaaagtatttgtcaacgcagttttgtaagtagcttcgaaaataagcctgccgtggtcactggggaacatacatgatgttgtcctcatggtgacgcttctacacagcgtgcggtgtgtctccactgaataatgctgtcccctggtgacgtgagactttcagatggaagctcttctgctcgagtttactcatttagggaatggcttctttcattcagaagtgatcggctcgccttttcaactttctagggtgttttatttacgaaaataccgtttttaactgctccccaccccgaaagcttctagaaaggtgtgtcccaggcgtccagggtttcctgtgtggtgcaggccattctcctgcagcaggatgtataaacagagagcagagtcggttgttatcctgagttctattgtattttgagtaagctaggctatgtcaacaacctttttaaattgctactttttttttcctctaaaaacttaagatagtcatgtaatttaagagggaagttatacaataaatactagccatgaaagcagccatattgctatcttagtaaaatcaaggtggttttgttgttgttgttttgttttgttttttgttttttaaggtttcaaggttttttgtttttgaagtgtaaaggcatttggaacagtttagacagtacgaaaagttggtattaaaattctgaaaccaattgtcttatcaggaaacccctagaaatgccctttaaaaatgaggacaatagctttgttgcattctcaaacaaggacatcagtgaaagggcagcaactgtctgtgctgtgggtgaccccagaacagcggcccatcccccatcccgtctctgctcttcagattatttcacaggcctcttcctttcgggaaataatgcacactctctcttacaaaaaaaccaaacatttggtcttttattttattttattttattttttgaaagtgcaatgattgtgtcctacctatacttcaagcatggttgatctaagatttttgaaaggtctaaacgttataaagaaaaaaaaacattttctaaaacaatgtggaagcatcgtaaagattaacttccccttgttcaatgcacatttgagtccgtgatgaaggtttcatagggtgctcagtattcgtaaagagcaccgtgtcagaggggtctgcggagcaggcgtcccgtgaggccccaggctctggtggctgagtgtacctctgcctcccatgctgccctcccttggtgatgcagtatccaagcatgccagcggctccacagtcatttgctctgcaccagtctgcctcccacagtccacatagcctcctgctggaaactcccagctgcaaaccatccttatgtggctcaggtcttccttcctcggcccttctggcttcacccatttgctccagacccctcttcagccctttcatcctgcttccctgactctcgtccccccaactccaagatggctgcccaccaccattgtggtctcggggaccaaccgtatttccacaccattagactgtgagctccttcagagagaccttggccacagtagggttgaatgctagcattactcattgcctgattcctggctggctaccgacatgtgttgttgttgttgttgtttaaataaataaacacacagatggagaaccccagctcctgtgttccgtgttctgtctggtgctccccttccgtgctccgtggcatctgttgctctggggtgtatctctgagaacaccgatgctaatgaatggatgcctgtgttcatagctcccctggtctcagattgctgcatttgaatcctagaaactctccagggcacatgagtggctcttaattaacctgactccatgatccttcagtttttctccttggacactggctgtgaagttccgagcctccccttgagcctttctgtattattaagtgagtttcatgtatactagtatttcacgtatctgtgaccaatacggacacaggttcttatggtcatcaaatatgctgtgtttgagaaagtaggaataaatccttttaaaccctccctgtgaaattcatttttatctgtagatatacaaaatcgagactcatttagttttccttcagacttaggtgtgaggatgtctcaagggcgctgcatcagattcctcctctcccttacccttgtgaaagggcccccactcttgcacaaaaccgccccttgtcccaggccctttgagattcagggggttggaagtcaaagtgtccaaggtattttgctgagtataaggcagggggatgccagctttgtgcgttcctttgtcaccttcgctgtctcctgatacctctacagcagattagctcacctggttgacacccacccggggccatcctcctttcttattctcagttaactgtgacagcaatcaggtggcaagaaaatagagcaagtgactgggacccttgggttctgggtggggtggggggggtactgaagtctttggtgtgtggtctgtgatgaccctggaagggtagcttggcctccttccctcctactcgtgtgtgcctaacagggaaagtctccacttaaaggaaactcctgggcttcccgagactcttgtctgccactaacttagctttactccctgaaaggagactgtactatcttcttcactgagctgtgggggctgggcagcacaccttaaagccagtgcttctgtacagtgaggggacaagtcaccgtaacctatacgattctgagagcctgtcactttgtctgaaactgtttagctagctagttaggagtcccccggccttcccagccaggacaggactgtgaaggtgggagtgactcttgtccagagaccaggaacacgtactcccgagcagatcttgcacaactcattggaaaccctacagcgggctctgcaggtctctgggatagtcatcagacacagatgctaaaagcacctgccgactgagaagagacttcagagtgcccagtcccagccagggagggcctcccgggcttcctgagactctcacttgacactaactttgctttactccctaataagagactgtaatatcttcttcactgagctgtgggggctggggtggacatggtcataagaagagggctatgccaggaatgtctgggtctgagcccttattccaacatgtcaattataattccagaacgatgaatggatatagaatgtctccggtttgggttccaagatgagcatctctgccagtctgagacctcagactagctctttcttccagtcactcgtggcaggaactggtacctgctcacaggtgcaggggtgcttataaaaagaagagtcagcttattataacagcacaccctaaagtcagtgtttctgtacaatgaggaaacaagtctccacaaactataggattctgagagcctgtcacttcgtctgaaactgttttagctggttaggagtcccctggacttcccatccaggacaggactgtgagtccaggaacacctactcccatccctgacccaacccctagcactgggcactcgtgtgagaacagagactgacctggtgacagagaccagtacatgactataggacaggaaaagcattgcagtggaaccaatgtcagtcaagcaaccccctgagcacacaagacctataaggataggttgccccaagggccagaagtctatgaacctctaacacccctccccctcccacacacaggcacacttctttgcatggactctggggtggagccatgagtgatctggagaataaaataccataaggaactttcttgagcccttcctgattattattagtaagtacgtctaagatatatttccatctcagaggaataagaggaacgcaccacttctgccggattcttggttgtatcaccagagtccggaatcttagagactcgtgtagacttcagcagacgacctgggtcctgcctagaagcagagcccccaccttataatggatccctgtgcctcatgggctctgtagcttagtcactgccctgactacaactctactgaagatatcaggcctcaacttgtaactgcctgggtacagagaccgtgatggcatggcagtactgtgcacagcccatggctgtctgcctgggcacccacttcctgtcctatgagaagcctggccctggagagagaggctaaggtctgccctactccaagggtttcttatggagaaaccatacaacatagtggcttgttgggattaaagccaggacagtttcttccacttaccatcattcagcttgagcctttccttccttaaagagcccatgaaggcttcaaatggcagagaacacaatgtggtgtgtaacggggcaaagtgatgttaattctagggaccctgcttcttgattttcttcttaaaagctagtgaagaccttgcggagtgaggagaggtcagggtgggccaaggagcgctgtctctggcgcctaaagctacaggtggtacctaccttcaactgccaatgacctcagcaaccaactggccattgtagctgtgtgccttcatgttcaaatgacaccggtcagtagacatttgggagaatggccaagggctgtctagacctctggatcaaggagtcctggctacttaaactctcaaatctatctccagggaggagggagtctgtttctcataccgacactgatgtgccgaagagaaggagctaacacttgcacccaggccagccctgctgcaccacgaggaaggttaggcatcagaagaggccatttctgcactatgtgatctctcaggtcttcccatgtgttagaaggcctcaaactgaagtgaacacttgtctgggtgctaatgtgacagctccaagagatgcaggcctctcaagcctaagctgtgtccatgtgcgtgcacacaccttgtgcttctgtggactctccattttcacacagggaaggagatgaagggtagaaggttgcctggagataattgagacagagagagcaaaccatgtggcacctggagtgcccgcagaggatggctgtgactgggacatttgaggaaccatggaatagaaaacctgcaatttacaagggcccgagagggaggccaatgtcttgtggagcgatcacagaacacaataggccattaggatgaagggcaggaaggtagttttgtttagaaatctaagggccatgtgccaccaaaaacaaacaaaagcgtgagtcagagtgagctgaacacccaaggaggctgagcacggaggagacatgcatgggcgggagggagagcagatagctccgcctgtgatctgcccatagaattcatgccatatgtttgccacctgtgaggtactctcaggtccctggctgccccacccagctctgtcctaggcagtatggcagccccagagccccagctgctggagggggagttactgtcaaagcatagagattggcttcagcagctagtggatagaacgccactgatgtgtgttttctgtgtgtatggccttctgtgccatccaccgccatcaaaagtaaatggtgtttatcattctgcacctggatgggtctcagccggttggtttgggctgtggactagcgtgcacaggcagcaaagccattctcttccttctctgggtcggggcctgctctgtagctgggagttaggaccttgtggcacgactgacctctgtgctcactttgatacctctggaaagggcatattcccagctctcacctgctcaccacagatgaaaaggcctagcgaggtcctgtaagaaaggccggagccaacaagtccttggtgtgtgctgtttccagtccccggcgggctgagcttccgcctcacccttcaggatttcgtattctgcctgaatgtacctccacggatcctcccgctgcactgaacacatccctctgtagatgctccaggtctaagctgtccaggagacaacccttacgctctctcatccccagggagctgggaaccacacatctgcaccgccattgtgaatgctgaatggcagatgtgcccttccattcacaggctcacaggtcctgtaggatctgaggtcgcttggcaggaagatgtgtgaagcctttctggcctgggcttgagtggctctctgtgctcttcacccctggaatcctctcttgcccctgacttactgctggctgtctatgttgatcaggagacttaggcttcaatgtcactgccatgaagacaatctgacttttgtttcataggagttttagactttgaacaaaacctcttctgtccggcactggaaacagctggtaaaataattcaagccacgacacttgagtttacttgaaaatgcaagtgtgaagtaacagggcatggacagaagacatcctcacttgtactgagcatacgtcctgtgaaggctgtgggaaggggacaagtgcccgcctctgcctgacagctctcactgtgcacaagaaaggggactgataaaggtgcttcccacctgctccactagaaggacaagatagatgccatcagctggctacacatcagtcaccagcaaccctaatggtgaccttaaagacccatctccagttgtcttgttggggattggtacttcaacatgagttctgcggcatccaggttctcccacattctccatatgcacagcgtagagggtatggtacaggctgtcattgatggactcgcagaggtctgataaagcaggctgtatcctcacagctctgcctcagaatcttcacacaggtcccactgactcatagctggcaaagcctaggctgtaggaatgaattaacccagtggtcacacgttagtcatacaggctctgccatgtgtcatgtgtgatgatgccgtgtctgttggtaatgcatctgagtgagggctgcccactcagcatacaggagcactcttcacacttaggactgagctgggcaagaacacttagacagaaacccaacataagtaccatctacacaaccgtgtggtctctcttcatgcagccacactgccttcgtgtgtcagatgctgggcagtcctcggagcaaggggattggaggcacaggtgtcagatgtcggtgaaacttgcctggcaaggttgctcaactgtttatatatttttagcaagttgtcataactccccccaaataagatggttggatgtccgaggtgctgatagctgctgggaccttgagctgatgccccagaatgctgcatttacaatgggaaccatgcggtccgtctgcacaaaggtccatgggatgtttgactgatcccaggcaaagaaggacagggcctgtctgcatggctctggtccacagtagacacattcaggctccctcaagcacaggcacatggcccgtgtatcatcaggctcattttgtgggcctcacaagatagccacattactccaggagagagtcaccttcttccacttgccccacttaaaggaaggtcattctccacccattccctgtcctggcagtcaaacctaggctgtcctgcaccctaggcaagcactcttaagcactaagccatattccagcctagctagaagttatagaagccagagtgagtctctgtggctgagccttactagacttcgccagaagatgtgcactgttagtctgaatgggatctgtccttgcctatctttcttatctaggagatcagacttaagattcaaagccaaactatgaatcaagagcttccatcttttcctgggtcctagtgaggaccctctggctgctcctctctaatccacccaatgagagttggtgaaacatacacccaaattcctggataggatggaggtggcgcgagtcagctgtctaccagcaagcttggatgcagggcagcagaggcagctggggtagctatacagaacaaactacttctagactcatactgttgatggcttcagaagggcctgtgacagacagagaacagtggaattcccccaggatccttctgtgtgcataaacttatagcccagccccagtacagcctcagcacagacttaatccttagccacacactggagagggcctcaaatcagaaccacagagaccctggctctcacctggaccttgtgcacagcaggcagcctttggagagtgcctataagccattttagaagtatagtttcccagaaagagcttcccacctaacctggaaggacaagccccagagatggaactctgtgaggcccaggagaggagcgtcagccaagcacaacctgcccagtggctcacagatgaatggcctcattgggaggcatcctcacctggtgttggcatgtaggaacagaagactatttgctaggcttaagtctcaagtctagagtcaaggaatgctctttaaggctccttggcccatagactatcattgcaggacctgcaggagatgggacggagaaggagccttcccccatcacacaaccgagcatgtgccattgacggtgtcagccacacttggctggagaaatcctggaggacagtgagccccaacctgggacacaaactttgaggcgactccaggtcaaatccctcagccgtccttagactcttcgaggagtgggctcaccacaccagcacttgtatgtgatccctgcaaggcgctgccgtgtacaaggttgctggactacggtgactgctgtggctgtcaggtgcacacagtgccgggcatgcacgatgacacacatctcccatggccgcacagacccagcattgtgctgtgctgggtgtgaggatcagtcacagcaggagccagcagcccaccttcttcatgagggcttgctttgtctctgacagctggcccaaaagattgccgttaatccttcatgtgctcgctttccataataaactctgtataataaactcacgactgggctcatgtgctgttttcaatgtgctagcattgcggtgagctctgnnnnnnnnnnnnnnnnnnnncccagtctagcacggagacattgcgtcacaccccctgcctccctctggcgcaggagacagaccagcgcctggggcttctgtggagcccaggtcccatttcctgactaataggaaacaagaggccccatcctacaaggctctcagctccacatgagaaatgcagacacaggcagtcttgagttgtatagccctagggtttctgtagacagacactgtgaggggtggcatatagcttcagctgaggagacacttacagggaacctcagagaagggccatcagaatccgattcttggatcactcctcctctgccagatggacaagctgctctgtctccaagcgttcctcagctgtgctgagtgaccatccagtgatcaggggcctctgtctttgagtggaactgcctccgtcaggggtggaatccacatcaagtgtgagactgtgacagggtcccctgcacaggaagcagaggcttgccaccttggagtcatcaggtggcaggagacataccctgtgtcttctttccctttgcgctgacctgtgtgacactgccccctcccaagcactgagctctgaaggtgagggacctgagcataagatagtgacattgggctggcaatgtttaagtctccgtccccatctatccaatcaaacaggcttcctccccaagagtggcagcgtggtatccttgagtggagctgctgcctcagtctcagataaccagacagaaggagccagaggatggagtggaaagggctagccaggacacaacagaggctgcgcagggtctgccccaaaccccaatcctggttcattttgtacctcctgagaaagaaacttggaagtccaacttagaccatcaggactcatgccctcgtgaatgtgcagaacttcaatgcactcagctggcccaggtgaccattcaaatgccaggaagagtctgaggtggttagcaagatgggccggggtactttaaacaggtcctaacaacagaatctacagggttccccagagcagccaccacacccactccctgtctggcctctggattgctggcccaggtccaaccaacgctccaagtccctgtccctgtgtggcaggtaaattacattctctgtcatttactgggcagctgtgtttgggactgtgcctttcatgtcatgctgggtagttagggctgggttttacagatcttataggctgcatcgtgggagggttgcgttggccttgggacctggctggggacccagagcagctcagcctggaaataattcaccttccagtcatggacctttttttttttttttttttaatcacaagctctgaaaatgaccactctcatttagaactgaaccttcacacacagatcctggctttgagcagagcgactcatacccaggattcttctcggtgtagttttgttcttagcaacattgctgcctatgtctttctggtcaggcctgtgatcccagaaactggctggacacggttctgccccaggtgcctctcagggtctgacttctaccgggttcttgccaattctggatttacagtgtggttgagccagctggactgatactggatgggggtcgtttctgaagcatggcttacccccacagagccgtctagacgggctcgtgcctggagctgagttagtacctgtataacacatttcattgtaagctgtagaacccagatggccaggggcttcctgttcctcgcagctcctgggagatacagccctcaggaagggcgggacccagagctgatctcatatattcaactttctaatgtcagagggatgggtttcccttccttccgtttttgttaaatgccaggatgtccacagtccttctcattattagcagagcatcccgtcccacaaagcgatctggggacctgcccagagaggagcctgctacctgcctgcacctatgattcccacggcttaggcaacaggacagatagggtggttggtgaactgaactaggtcttcactgggaggcttttctcagaggcgccgtgtgcatggcgtacttgccttggggctcctattcctccttgtttc

SEQ ID NO: 1236 - DNA, 3435 bp, Mus musculus
ggcccgacatgacggggctggagcaggacccggagttcgacttcgatttcctcttcgagttcgatcagagcggcgggggcgccgcggccgcagaacactacagttatgtgtcccctagtgtcacctcgaccctgccccttcccacagcacactctgccttgccagcagcatgccacgacctccagacgtccaccccgggtatctcagctgttccttcagccaatcatccccccagttacggaggggctgtggacagcgggccttcgggatacttcctgtcctctggcaacaccagacccaacggggccccgactctggagagtccgagaatcgagatcacctcctacctgggcctacaccatggcagcggccagtttttccacgacgtggaggtggaagacgtacttcctagctgcaagcgctcaccgtctacagcaaccctgcacctgcccagcctggaagcctacagagacccctcctgcctgagcccagccagcagtctctcctccagaagctgtaactctgaggcctcctcctacgagtccaactactcctacccatacgcgtccccccagacctctccgtggcagtcaccctgcgtgtctcccaagaccacggacccggaggagggttttccccgaagcctgggtgcctgccacctgctaggatcgcccaggcactccccatccacctctcctcgggcaagcatcacggaggagagctggctcggtgcccgcggctcccggcccacgtccccctgcaacaagcgcaagtacagtctcaatggccggcagccctcctgctcaccccaccactcacccacaccatccccccatggctcccctcgggtcagtgtgaccgaagatacctggctcggtaacaccacccagtataccagctctgccattgtggcagccatcaacgccctgaccaccgatagcactctggacctgggtgatggggtccctatcaagtctcgaaagacagcactggagcatgcgccctctgtggccctcaaagtagagccagctggggaagacctgggcaccactccacccacttctgacttcccacccgaggagtacaccttccagcaccttcggaagggtgccttttgcgagcagtatctgtcggtgccacaggcctcgtatcagtgggcgaagcccaagtctctttccccgacatcatatatgagcccatccttgcctgcccttgactggcagctcccgtcacattctggtccatacgagcttcggatcgaggtgcagcccaagtctcaccacagggctcactatgagacggaaggcagccggggggctgtgaaggcttcagctggaggacaccccattgtgcagctacacggttacttggagaatgaacctctcacgctacagctgttcattgggacggctgacgaccgcctgctgaggccccacgccttctaccaggtccaccggatcacggggaagactgtctccaccaccagccacgagatcatcctgtccaacaccaaagtcctggagatcccgttgcttccagaaaataacatgcgagccatcatcgactgtgctgggatcctgaagctcagaaactctgatattgagctgaggaaaggggagacagacatcgggaggaagaacaccagggtgaggctggtcttccgagttcacatcccacagcccaatggccggacgctgtctctccaggtggcctcgaaccctatcgagtgttcccagcggtcagcccaggagctgcccctcgtggagaagcagagcacagacagctacccagtcatcggcgggaagaagatggtgctgtctggccataactttctgcaagactccaaagtcattttcgtggagaaggctccagatggccaccacgtctgggagatggaagcaaagactgaccgggacctgtgcaagccaaattccctggtggttgagataccacctttccgcaaccagaggataaccagccccgcccaagtcagtttctatgtctgcaacgggaaacggaagagaagccagtaccagcgtttcacgtaccttcctgccaatggtaactctgtctttctaaccttaagctctgagagtgagctgagaggaggtttttactgagcagccccccgaggctataagaggatgttgttgtaaacaaaacaaaacaaaacaaaacatacctgtagcctcttcacaccacgtgatagccctattcacaagaccaagtcgcccaccccctcaaagaaaagcgaagcctgggtgtgttttcctgtgactggtgcatgctggggtcatcacttgctcgccttttgcaaatacagcagcgcggccaaccaagcagctctgctgcgctcaggggctgatgcggtctgggggtgtatatctaacctctgtgagtctttgggttagaagaaagtatttgtcaacgcagttttgtaagtagcttcgaaaataagcctgccgtggtcactggggaacatacatgatgttgtcctcatggtgacgcttctacacagcgtgcggtgtgtctccactgaataatgctgtcccctggtgacgtgagactttcagatggaagctcttctgctcgagtttactcatttagggaatggcttctttcattcagaagtgatcggctcgccttttcaactttctagggtgttttatttacgaaaataccgtttttaactgctccccgccccgcaagcttctagaaaggtgtgtcccaggcgtccagggtttcctgtgtggtgcaggccattctcctgcagcaggatgtataaacagagagcagagtcggttgttatcctgagttctattgtattttgagtaagctaggctatgtcaacaacctttttaaattgctacttttttttttcctctaaaaacttaagatagtcatgtaatttaagagggaagttatacaataaatactagccatgaaagcagccatattgctatcttagtaaaatcaaggtggttttgttgttgttattttgttttgttttttgttttttaaggtttcaaggttttttgtttttgaagtgtaaaggcatttggaacagtttagacagtacgaaaagttggtattaaaattctgaaaccaattgtcttatcaggaaacccctagaaatgccctttaaaaatgaggacaatagctttgttgcattctcaaacaaggacatcagtgaaagggcagcaactgtctgtgctgtgggtgaccccagaacagcggcccatcccccatcccgtctctgctcttcagattatttcacaggcctcttcctttcgggaaataatgcacactctctcttacaaaaaaaccaaacatttggtcttttattttattttattttattttttgaaagtgcaatgattgtgtcctacctatacttcaagcatggttgatctaagatttttgaaaggtctaaac

SEQ ID NO: 1237 - DNA, 2112 bp, Mus musculus
atgacggggctggagcaggacccggagttcgacttcgatttcctcttcgagttcgatcagagcggcgggggcgccgcggccgcagaacactacagttatgtgtcccctagtgtcacctcgaccctgccccttcccacagcacactctgccttgccagcagcatgccacgacctccagacgtccaccccgggtatctcagctgttccttcagccaatcatccccccagttacggaggggctgtggacagcgggccttcgggatacttcctgtcctctggcaacaccagacccaacggggccccgactctggagagtccgagaatcgagatcacctcctacctgggcctacaccatggcagcggccagtttttccacgacgtggaggtggaagacgtacttcctagctgcaagcgctcaccgtctacagcaaccctgcacctgcccagcctggaagcctacagagacccctcctgcctgagcccagccagcagtctctcctccagaagctgtaactctgaggcctcctcctacgagtccaactactcctacccatacgcgtccccccagacctctccgtggcagtcaccctgcgtgtctcccaagaccacggacccggaggagggttttccccgaagcctgggtgcctgccacctgctaggatcgcccaggcactccccatccacctctcctcgggcaagcatcacggaggagagctggctcggtgcccgcggctcccggcccacgtccccctgcaacaagcgcaagtacagtctcaatggccggcagccctcctgctcaccccaccactcacccacaccatccccccatggctcccctcgggtcagtgtgaccgaagatacctggctcggtaacaccacccagtataccagctctgccattgtggcagccatcaacgccctgaccaccgatagcactctggacctgggtgatggggtccctatcaagtctcgaaagacagcactggagcatgcgccctctgtggccctcaaagtagagccagctggggaagacctgggcaccactccacccacttctgacttcccacccgaggagtacaccttccagcaccttcggaagggtgccttttgcgagcagtatctgtcggtgccacaggcctcgtatcagtgggcgaagcccaagtctctttccccgacatcatatatgagcccatccttgcctgcccttgactggcagctcccgtcacattctggtccatacgagcttcggatcgaggtgcagcccaagtctcaccacagggctcactatgagacggaaggcagccggggggctgtgaaggcttcagctggaggacaccccattgtgcagctacacggttacttggagaatgaacctctcacgctacagctgttcattgggacggctgacgaccgcctgctgaggccccacgccttctaccaggtccaccggatcacggggaagactgtctccaccaccagccacgagatcatcctgtccaacaccaaagtcctggagatcccgttgcttccagaaaataacatgcgagccatcatcgactgtgctgggatcctgaagctcagaaactctgatattgagctgaggaaaggggagacagacatcgggaggaagaacaccagggtgaggctggtcttccgagttcacatcccacagcccaatggccggacgctgtctctccaggtggcctcgaaccctatcgagtgttcccagcggtcagcccaggagctgcccctcgtggagaagcagagcacagacagctacccagtcatcggcgggaagaagatggtgctgtctggccataactttctgcaagactccaaagtcattttcgtggagaaggctccagatggccaccacgtctgggagatggaagcaaagactgaccgggacctgtgcaagccaaattccctggtggttgagataccacctttccgcaaccagaggataaccagccccgcccaagtcagtttctatgtctgcaacgggaaacggaagagaagccagtaccagcgtttcacgtaccttcctgccaatggtaactctgtctttctaaccttaagctctgagagtgagctgagaggaggtttttactga

SEQ ID NO: 1238 - DNA, 96597 bp, Homo sapiens
  misc_feature (9428)..(9725): "n" at positions 9428 thru 9725 can be any base
  misc_feature (13303)..(21086): "n" at positions 13303 thru 21086 can be any base
  misc_feature (30929)..(31963): "n" at positions 30929 thru 31963 can be any base
aaggccctgaccggtttataaagagcacccatcttctccggcaccagacggccccagcctggcatctcgatgagtgaagcgtaatgagccagaattgcaggattaagcttcacttgaaactcactccggttcaaaacttaatggaaaaaatgcctggcaaaacttgtttggagctttattgaaccaaaacactttagaaaccgttggggaagctcagtgaacccaggctgtggtccagccccacgctttgtctagggcaggttccgttccctcaagcaggtgatgggaatcccggactggagcctgaggctgagcagccagaggccacaccgccagggccaggccacaccaccagggccggccacaccgccagggcaggccacaccgccggggccaggccacaccgccgcggcaggccacaccgccggggcctgcctcatcgccccacagtctggaatgctctgcacacgcatcagaaggagagtcgctgagcatcacaaaggaaaatagaaagcgcagcctcactgcccaaggccggggcagagatgacttgccttgtgttactgcctaattaaacagatttgggtaaacagatttgggtaaaccaagtagtttaaagaaaaatgttggaatattgccatttgaaaagtattattattttgcaagaggaaaacaattgtgagttcacagggacaaacccaaactcttgccagaaactaaaaatgtgatttatttacctctcgaccagcgttagcaaaaagagcaggcctgcaggatcaggacgcggctctgggccctcctgcctcagccctccggcactgtgagaggggcacacacccggggtgggtgtgcttgtcctgcgaagtgcagaacagagaagaggctccgaagcacagagcgcctctgccctgggctttgcacacattcctgacttcttaagacacagctgtgcaggaccattgcatctccgtgaagctgtcctcattggcctcaggctgacccgggcccctggcactcgagggccagggaaggggtcatgtctccctgagacacacatgtggcatcctttccccgcccccgtgcacaccagtggagtgtcagctcagccctgtttgtgctttctaagagaaatcgaggtttaaaggggacttttttttgcctagcgtggtgtgtgaggcccagatggctgcagcagctgtgccgggcttgcccggcctcctcaccgggagcttccctctggctagagttgctgtttcatctgcctgtgtccctgcggccccacccccatggaggaagcgaggaccctgttcagccatggccttcctgtgaattaggcctccttcaggtgcaagtgacagaatccacattaaactcgattgagcagaaaagggaagttgcttcctcaccaaggtgaagaccccaggggaggctctcaggtcccactagactcaggggctcaagcagggcatggaatcggcctctggagtccctgtctccatggcagccccggggtccacatcttccccaggagggcactcttcaggccccggcttcagaggaagagaacgccattccctgcggctgtggggcagcagcaggcacacctccctggcctcgggtgggctctgcccctgcgtgggctatggcgggagtgggaacattcccgtgacccccctggagtttaggccaggcagtggaggtcctcgagcaaaggtcatcccacagggagtgctctgtccagtaggagcatggcgcccatgtcagggcactggcctggaagggagcgtcttagtggaggctgtgggtgctgccaggccacctgagaggggacatgcattgtaggaaaggccacagcgcactgtgacaggtgtggtatcctggaaggaatgaaaaacactgcccggccaggcgcggtggctcatgcctataatcccagcactttgggaggccgaggcaggtggatcacgaggtcaggagatcgagaccagtctgaccaacatggtgaaaccccgtctctactgaaaatacaacaattagccaggtgcgatggtgggcacctgtaatctcagctactcgggaggctgaggcaggagaactgcttgaaccaggaaggcagaggttgcagtagccgagactgtgccattgcactccaacctgggcaacagagcgagactccgtctcaaaaaaaaaaaaaaaagaaaaaagaaaaccactgccctttgggttggtttcctggggctgccatcacaaatgaccacaaagtgggtggcttgaatggcagaaacatgtcctcagttctggaggccagaaggcacagtcgagggtcagcaaggccaagtgccctctggaaccggccacggaggtcccttcccttcctcttccagctcgtggtagccccaggtgctccttggctcgtggagccatcattccagtctctgcctctgtcggctcaccacattccctttgtctgtcttctcctcctgtgagggcaccagtcatcattggggtccccttaactgacaccatcttaactagttacaactgtagagatgtcacttaccaaattaggtctcattcccagagaccaggggacttcaatgaatcgttttggaggacgcagttcaattcacaacagcattgttctgaaataatgattaagctgtcttgagccattagcaggtgcctctcattgatctaccctgagaggtgaaggccgttactattggctcccgtaggtgtaccggggactggaatccaaactcgggctgtgggcaagcgccttctcacacgagagctgacgtgctctgtgaacccgtccccgggaaactggtcaagttaaaaacccccagccattgacagtctctggaaatggtcctaaggacacgcagcaagtgaagacacatctattgaaaaagacctgattttttaaaaaaccatctttactaggaaaggtgaatgtatttggtatttgaaccaaagccaccccctcctcccctccccctgccactccaccagcaggtctgctgcagctgaggacacaggtgggtgggggagagtgactctgggagggcgggatgtcggtgtttctcatcctgccccatctgcctgttgctggggctgctaggtcctggggagtctggtggaggggtgggggctcccttcttcccggtccccacactcatgggtgggaggctgggccttgggtgtggctcactgagaagacagggtgcaactacccttgcccccgctgacagggcagtgattccaggccaggggaggccagtggggtctcaggatgctgcccccgtcagcactcaactcctggaggtggaggcgtcactcacactgaggctcggcactgtccccatccccagctccaaagcattggctcagagattttgcctggagtgagaagcagtaagtaaaagagatagcttctaatctcctcccaaaagaaacgacttcattttcagcagaacatgggagaaggtgaaagcttagggtcccctcgaaaacatggaggttgtcatcaatggcatttgggacattcatggatttaatgaagatttagcctagatttaggaatgtgatagctgtgaggggcctccaggggtcaaaacaaatatcacacatggacatcagaaactcttgcttcaaagaaggcactatttagttggagtagtttgtagagtaatttatgcctccagatattgttaaaaacaatagagcaatccaatggcagccgtggaatttaacagctgggtatggtcagggaaagagaggaagagatctctatcaatgtggtcggggaaagagaggaagagatcgctctcaaaatcctgcattccagggtgactctgggcacaggtaagactcctctccctaaggagcaagccagaggcataactctgctggtggagggggcagtgtgtggaatagcttcactgcagtcatctcagaagtcacaagacaagtaaataagcaaataacaagccccacacagggggaccagtatccagagctgctataatacattgtctaaaatgcccagtttccaacaaaataggaggcatgcaaagaaacacaagagtatgacccccacatttaaattttttaaaaagcagacaacagaaactgcctggggaatgaccagatattggatttaatgggaaaaggccaaaatatcccttatatgctcagagaactaaagtaaatcttgattaaagaaagcaggacgacaatgtcacatcacgtagagactgttgatagaatgtataaaaaataaccagtggaaattcaggagttggaaggcgcagtcactgaagtgaaccattcactattggggctcaacaatcgatttgaactggcagaagaaagaaagtgaatttgaagatacatcagtagagagtatgcaagccccgaacagagagcagatagaatgaaggagaccaaggggagcctcggagagctgaggggcaccagggacgccctccagggcaccagcccacacagggggttcactagaaggaaaggaaagaggaaaaaagggatgcaaaaatattaaaagaaataatggttgaaaatatcgcagattagtttaaaaaaataacctacaaaaccaggaatctcaatgaactccaactggggcaagcctagagaggcccacagaccaacacattatgagtaaaaatgctgaaagtcaataataaggagaaaatctcaaaagccaaaataataaaataaggtatcacttacaagggaaccccaataaggctaacaagtgacttctaagcggcaacgatgtgagcctgaggcagtgggataacagccaaaggaaaggagagaggaggagaggggaggggaaaggagggggaggcagagggaggcagggagggaggaaggaaacctatcaatcccaaatcctatgcgcagcagagctttctttcaagaatgaaggtgaaataaagactttttccgacaaactgagagtttgttgccagctgacccaccttacaaaaaatactaaaggaagttcttcaggcagtgagcaagaaacttcagacagtaatttgaaatcacatgaaaaaaacagagtgcctcttaaggtaattacgtaatttcataagacagtacgaatacatatttttctctttttataactggtgtgaaaagtgattgtataaaataatgtatataaaatataatgttgggcctataacttatagcaatgtaatatatgtgtagtgtattgctaataacaatacaaagaaagggaatgagaacaaagctatattggactaaagaaataactacagatggtaaaataatggttatcacaatgtattcttaggtttgtaacattactgtttacaatgtagaatgtataaaagcgggaagggaatggagctagctacatagggatagtgtttttgtgtgtcactggagtcgaaatgtatatggtacatactagagcaatcactaaaacagtaacaaaaaaagtttaaaaactcagtagaaaataattcacttaatgcaaagaagtcaataaagaaataaatgaggggaagacataagaaaaatagaaaatgaaaagtaaagtggaatagaaatgaaaagtaaagttcaataataacattaaatgtgagtggatttaacaaccaatcagaaagcaaaggctgtcagactgaattaagaaaacatgacccaactttatgccgtctagaggagacatactttctactcaaagctacacacatagactacaacgatgggaaaagacgacacaccaacagcgacttcaggaaagctggagtggctgctaatgttagacaaaataggctttttaaaaaaggttttattaaagaggaatgtttcgtaatgataaaagcactaatctgtgagaaagatacaacaatgataaacatacgtgcagctaataagagagctccaaaatctatgaagcaaaaactcacagaatgaggggagaagcagttctacaacagagaatggggacttcgatactccactttcaataatggatacaacaaccaggcagataacaaggcaacagaaggcctgaacaacagtataaaccaattagacctaccagatatctatagctagcacactccacccaacgacagcagaatacacattcttctcaagcgcacaagtaacatcctccaggatgggccatgttctaggccatcaaacaaactcaggtggtttgaggccagaggcctctcttttaaccaccacactagggccttcggaggaggcaagcagagagttgtcaaagaggccctcaggactgggtgcagtggctcatgactgtaatcccagcactttagaaggctgaggcacaaggatcttttgagctcaggagttcaagaaatgagcacttatccactgggcgcggtggctcacgccagtaatccagcactttgggaggcttaggcgggcggatcaagaggtcagaagctcaagaccagcctgaccaacatggtgaaaccccgtctctactaaaagtacaaaaattagccgggcgtggtggcgcacacctgtaatcccagctacttgggaggctgaggcaggagaatcacttgaacccgggaggtggaggttgcagtgagtggagatcacaccattgcaccccagcctgggcaacagagcgagactccgtctcaaaaaaaaaaaaaaaaaaaagaaagaaagaaaaagaaaaaaaaagtgagcatgtattttgccagagtctggagattagaattaaattagcaaaccagaattatagaaaaagctatttacttttaagtaaacagctgagatttttttttttaagtcagtgtgaatgaagctcacagccatggttggagctgagaaagaaggatttccctttagttatgcacctgtgtcagcaccttctgactttccttctaaagtctggggtgttcctgaggatccgtaagtttggggttcagggtttctacagcatgctgttacttgtgaaacatctctttaaccatgtcccagagttgcccaggagtttaagaccagcctgagcaacatagcaagacctcatctcaacaacaacaaaaattagaaataaattagccaggtgtggtgacatgtgcctgtagtcccagctactcagaaggctgaggcatgaggatcacttgggcccaggaagttggggctgcagggagccctgttcatgccgctgcactccagcctgcaagacagagcagaaaaaaagaatcaggatcctgggcagagggaggagaggggaccggggtccagcaagcacttggggattgactgaatggcgttggggagagatgactccaaagtcctggagtgggtgagaatgactgcgagtggcttttaggtggggaggttcctgcctggccactccgggaggggacgtggggctgaagggtatcaggtgccgtgctgagcagtttggccttgatcctaatgccctggacacacgtctagggtaggaaagttgactgatccattggtgatctgagtttttagacatggtggtagtccatgaggtgggtgttcatgctaagagtttagacagggaaacctatgaagcccttagcaaccctccagggaaggggcgtggttaaagagatgtttcataagtaacagcatggtatagaaactctgaaccccaaatgtatgggtcctcaggaacaccccagactttagaaggaaagtcagaaggtgctgacacgggtgtataactaaagggaaatccttctttctcagctccaaccatggctgtgaggttcattcacactgacttaaaaaaaaaaatctcagtttacttaaaagtaaatagctttttctataattctggtttgctaatttaatcctagtctccagaccctggctaaataaatgcccatttctccagatggtctcaagagtctctggacatcgtgggggcccttccctgttggttggaaggtgcctcaggaagaagggggtggattctgagttgagtcaaaacctcaaagacccctgatgggaaaagctctcaagtgaccaccgctgtgggccagaatgcaaaactgcaggaacagaacattcgcaggaacagaacacagtcgtattaagtgattttcccgagcaggaagtggcatctggcctgcggttcagtagggggaggaaaagggtgggcgcacctgcccctggctggcgcacctgccaggtagccccacgcggcaccgcgtgtgccgagcgcccctgaggatggaaagccccacgcggggcaggtggcacccacccctccgaagacgggacgggatggagcgttgagcttcggggcagctccggcccggcccgcgctggagacgcccgcatctgccaggatggcgtctcatagccctggtgctcacacatgacgccaggaagccccagcaacagtgaccgcccaggctctagaaaatattggacggggtggatgaacacccaagtgcgctccaggagaagggatttggcaccccaaggggcttttaaaacggtaagcttctaggggtgtctttgcccccaataatccatagaaacaacagtcatctaaaaatagtcttgttttctgtcctaagctccttttaactttgttagtcatcaccaatcctaaaataaaacccgtgtaacgtctcccctagtagcggctataaacaaacctacgaggaggcaggaggaagaggaaaggggcgcagggcgctcggggagcagagccgggggcccgcggtggccgcagaggccgggccggggcgcagaggccgggcgagctggccgcgctctgggccgccgcctccggaactccctgcgcctggcgcgcggccaccgtggtcccggcaacggcattaaacagagggaaacagacccgggattccgtcacccgggcggggggataaggacggctttgagagcagacaggaaaagggagcttttctgcatggggtgaaaaaattatttattgaaggaggaggaggcggcagcggaggaaggggaggggcgggaggaggaggaagagccggccgcccccgccccggccccggctcctcaggagccaagggcagcctcgccaggtcggtcccgggctcgaggaccgcggctggggtcgaggggctcagtctcccacgtgaccggctgggcgcgccccgccagacccggcctcgggattccctcctcccggcgagtctccgcccgccccgtcctggaggtggggagaaggagggcggggcgggggggacggaaactctccccgccaaatcctggccccaggcctggggacactcgcggcgggaagatttggaggggaggggagggggaggggcgtgggggcgcggcctcgctggagtccccctccccccccgacccccgcccaccggcctgggcgtcctcccgcggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttattgaaggagaggggcgggcgctcggcgactcgtccccggggccccgcgcgggcccgggcagcaggggcgtgatgtcacggcagggagggggcgcgggagccgccgggccggcggggaggcgggggaggtgttctccagctttaaaaaggcaggaggcagagcgcggccctgcgtcagagcgagactcagaggctccgaactcgccggcggagtcgccgcgccagatcccagcagcagggcgcgggcaccggggcgcgggcagggctcggagccaccgcgcaggtcctagggccgcggccgggccccgccacgcgcgcacacgcccctcgatgactttcctccggggcgcgcggcgctgagcccggggcgagggctgtcttcccggagacccgaccccggcagcgcggggcggccgcttctcctgtgcctccgcccgccgctccactccccgccgccgccgcgcggatgccaagcaccagctttccagtcccttccaagtttccacttggccctgcggctgcggtcttcgggagaggagaaactttggggcccgcgccgcgcgccggcggcaccatgaagtcagcggaggaaggtaagccccgcgcggcctccgcccccggacccctgcgccccccacggcccgggccgcgccccccgaccccgcccccgtcgcccgcacggaggggtccgggccagagaacgaggtcggccgggtctgtgcgcccagggaggggcgcggcgcggaccgggaacggcgtcccccagctcccagcagcccggttccgagcgcgccttctgccaataggtgtctcctctgccccagcgctgagggcgcgaggcgaggccgccgcgggtcccgccgaggaagcggctcgcaggccggcgatttggggacgggcgaggctgggccgtcaggaccacagagggcacgtgggagggaggaagggaggcttccttgggagtgaaggatgccccgtgtcttcctgagcgaggcagagccaccctctggcgccaagatcgcggtttgggggttctgcgccccccacccccaccccgagctcgtggcggcgtctccctcgcgccgcgcccctgaattccccagggccgagcccgtcacgccggctcctggacctgcaggaccaaaagatccaaagcgcggccgcagcacagccccgaatttaagccattttgaaatcctataggcaggagttccagccagagaagatgtttcaggcaagtttgaaaaggaaccgccaagtttcgagctgcttctttatagtgaaaaaaagatggcacagtgtgggtccctgaaacccggtgtggggggcgctgagacccccctgcggcgcatctcacattccagtcccccaccttagcccgtccccggcacacacccctggcgatgccgggtgggctcctgcaagtggctttgaaaatacccttgcagaggtgtgagcatacgagttagggattagggattgcaatgctaatggaaattggaagacgcttttccaaattccttaccagctctgaaatattttatataatttatttaaagagcgccagcacacctgccaacatatgtacttcataagggcagacgtccttccgagcgctgccgcttcctgcgcgaccctgataactgcggggcttgcttgagaaccgggctcccccagctctggaaaactcgctggtcttagcagagctgagcacagggccgtgagctccacggaggggggtccgtgtggtcggtgccctgacgcttcacgggacgggaggtagacaccacttcatcccaatgttagaaaatgttgacatgtttaaaccatgtcccgtgtcagtgttttacacaatgtgctcttgctagtagcagagtttaaaaaatttttttttgttggagtttcggttttaaatcctgggacacttacgccgcagtgttcattatcactccctttagaaaggcaggtctttccaagttcagatctctgtacctgaagagccggtggccgacctgtagtaaggagcccctttcttttacgcaaggaaaaaacacgacggggcagtggctagttttcgtgtttcctactgaagaaaataagctcgaaaaggtccctgctgcaaggcagtgcgccgggcagcgacgcccgaccgacatgggtgtattttatgagggctgcagaactgggccagccggaaagtgtgatctagtccttgatacacacaggccggcagcatggggacacgcgtggtttccacaccagccatcgctgagaccaccgggaagaactctgagtccttctgagtaggccccacgaggccattcctggcccatctgaggacctgggcgcctcccctgcgtccctcgggtttcgggaccatctgggtggaagctcattaggcgtcgtggttcctgaaggccccgggcttgcttcctcatggagaacgcagagaagtacaggcctgtaagtagccacccagtcagaagtcgctccagacacaatgccccacgggctggggccaaacaaagctcaccctgttctctgccacttaacttcacagcgttgtttcccagctcagattagaaaatggcagggcgctggcaccccgcttcatcacacccagcggggcttctgtctccgcagacatccccagcctctgggaggatgcgtccaagctaaacatttccatggagacacccagtgtctgtggaacgggcagctttgaatctggaccaatagctctgaaccatttgcaggaaggaagcccagcactggggcgggggaagggggggctcctaggagcagcaggggagccgccccaccgaccccttctctgggatggagaccagtgcagtcctaggacagcagcagtgagcctccatccctgcagggcccgcggcctggggccaccagcaggcgggacagtttagcaaaaagttttagtctaaacagatgataagggctgtcatttgtgtataattttatggtgggggtaaaaaggtggctggagttttaaaaacaatgtacaggccgggcgccgcggctcacgcctgtaatcccagcactttgggaggccgaggcaagcggatcacgaggtcaagagatcgagaccatcctggtcaacatggtgaaaccccgtctctactaaaactacaaaaattagctgagagtggtggcgggtgcctgtagtcccagctactctggaggctgaggcaggagaatcgcttgaactcggaaggcggaggttgcagtgagcagagattgcaccactgcactccagcctgggtgacagagcgagactccgtctcaaacaaacaaaaacctgtacaatggaaagagaatgaaacgttgtggcttctcaacagaaaacagaacttccacttgcccaaggtcggcaaaagcagcaaaactacaacaaaacaacgctccaacatccatcccaaagtcagaagtattattagaaactaaatcaggccacacggaacgatggcttatcactggagaaaaccagccagtgaaagggtcgcgggagaagcccggggacgaccctgggactggagggtttctcgcctctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagcctgggggcggggggcacagtggatgccagtgaacatgggtggtcagtcccagagctggcgtcttgcagctggggcagatcctggggatggtgtgtgtgtcctgaccagaggccaggctggaggctggaattggcgtcaggatgcccagctccagctccaccccagtccctgcctgtggctctggggaaagaaagacctccttattgatttattgatttattgatttgacagggtcttgctgtgtcgcccaggctggagtgcaggctggagtgatctcagctcactgcaacctctgcctcctgggctcaagcaatcctgctgcctcagcctcccaagtagctgggactacaggcgtgcgccaccatgcctggctacttgtattttttgtagagatagggtttcatcatgttgcccagattggtcttgaacttctgacctcagatgatccgcccacctcggcctcccaaagtgctgggattataggcgtgagccaccgcgcctggccacctccttgatttattgacattactgttctctctccggtgcaggagactgcgtggctcccgtcctcttgagggcatttctttacgatggggaaggcgggactggggcctggctagcaccatccccaaggcgctcagcctcagcggaggggcccttcccatacgaagacatcctgagcaggtctcacctcccacccctgagagcttctggtcgcacctgtgaggtgtggctccatcgcagctctgtttcttttctctttgttatggctctgccccctgagtgtctggaatttccagaaagcagctgtgactcctgggattgaggccacggtgtgtcctcttaccaggctgccgtgccgtgtttcccacctacctggggcgctagaaccatttctgttagtaaatacagtgggtttgtattggtattttgagaccctagatttttttggcatttatccgtgttggtttctgaaccacgacttagcggaaagacagcactgtccttgaataaagtatcttccagccagtgcagttgcaccaggagatgaatatagaatttccatgtgcttgtttgtattatttagaggcctgggaatacccacctctaggcatgtaatcatgaggttccaagatgtcataaaaagtcttttcaaatcagaaatccagaggcacgtctttcctgttaaaattactgatttccctaataatgattttaaaaaatattttattgagtgtaattaacacataatgattcttaggactagctgtgtaccagaatcttctgttttgttctaaaagatggattcgtaggatatgagccagtatcagaatctccatgagggggatttcacagtctgtgttttcatccaatccttgaggagttttctttgtagctggtgattagggcaccttgacagtgataagcctgttaaaatctgtttacatatgtaggtccttagatctaaaacacatccaccatccatcatcatccatccatcatcaaaccattattcctccattccctatgcatccatgcatcatcatctgtccattattcctccattccctatccattcattcatcatccatccatccatcatccatccatccatcatcaaaccattattcctccattccctatccatccatccatcatccatccatcatcatccatccattattcctccattccctatccattcattcatcatccatccatccatcatcatccatccatcatcaaaccattattcctccattccctatccatccattcatccatcatccatcatccatccattattcctccattccctatccatccatctatcatccatccatcattatccatcatccatccattcctccattccctatccattcattcatccatccatccatccatcatcattcatccatccatccatcatccatccattattcctccattcctcgtccatccatccatccatcaccatccatttatctatccatccattcatccaccatttacctatcatgcctccatccccaatgcatcattcatccatccatccgtttagctgtccatccatccatcatccatccattcatccacccacccataatccatctctttatccctcattcctcccttgtttgtccatcaccatccatctacctactctccatctacccatcatcccttcaccccccgtccatcatgatccatccatcagtttctttacctgtctatccatcatccattgtccacccacccaccaaccatccatccattaaacaaattgaacacattttatgtgccaggcacagtctttggctctgaaaacagcggtgagcagaatagactaaggcgtccagatgttctgtcttcatggaacttaggtttctgtttgtcaaagagatgacagtgtgggatgaatgagtaaaaacaggctgttagattgtgatacgtatttaggagaaaaaataaactagagaaggatggcccacgtgttgagtttggggtttaaatgaagatggggtggttgaggaaggtggtttttgaatgaagagtggaacccgtgaggacccagtcgcctctctctgggaaggacgttcggatgaagatggggtggttggggaaggtggtttttgaatgaagagcggaacccgtgaggacccggccgcctctccctgggaaggacgttcgggggcttgtgctgctgttaggggaggaggggaggtgggcagtgaggggctcacgggagccttgttggccaggtgggactggggctgtcactccaagtcgcccggagctgtccggcagcgtggtctcagggacgtttgctgaggcccgctccttggggtccgttggtcgaggccgggggttgctggccggccctgagttcatgggtttctgctttgtgatgcccagcccctcatgctcccatctgcttctttttctctctagaacactatggctatgcatcctccaacgtcagccccgccctgccgctccccacggcgcactccaccctgccggccccgtgccacaaccttcagacctccacaccgggcatcatcccgccggcggatcacccctcggggtacggagcagctttggacggtgggcccgcgggctacttcctctcctccggccacaccaggcctgatggggcccctgccctggagagtcctcgcatcgagataacctcgtgcttgggcctgtaccacaacaataaccagtttttccacgatgtggaggtggaagacgtcctccctagctccaaacggtccccctccacggccacgctgagtctgcccagcctggaggcctacagagacccctcgtgcctgagcccggccagcagcctgtcctcccggagctgcaactcagaggcctcctcctacgagtccaactactcgtacccgtacgcgtccccccagacgtcgccatggcagtctccctgcgtgtctcccaagaccacggaccccgaggagggctttccccgcgggctgggggcctgcacactgctgggttccccgcggcactccccctccacctcgccccgcgccagcgtcactgaggagagctggctgggtgcccgctcctccagacccgcgtccccgtgcaacaagaggaagtacagcctcaacggccggcagccgccctactcaccccaccactcgcccacgccgtccccgcacggctccccgcgggtcagcgtgaccgacgactcgtggttgggcaacaccacccagtacaccagctcggccatcgtggccgccatcaacgcgctgaccaccgacagcagcctggacctgggagatggcgtccctgtcaagtcccgcaagaccaccctggagcagccgccctcagtggcgctcaaggtggagcccgtcggggaggacctgggcagccccccgcccccggccgacttcgcgcccgaagactactcctctttccagcacatcaggaagggcggcttctgcgaccagtacctggcggtgccgcagcacccctaccagtgggcgaagcccaagcccctgtcccctacgtcctacatgaggtgagccggcagcgcggggcgggacggggaggcgaggggaggcgcggggcggggcggaacgcggggagcgggacggggggcggcgcggggcggccgtgtctggggacgagagtcaggacctgggtgggcaggtgggctcctcgtggagctgggaggcagagtctgtccccatgtctgcctcctcatgcagacttttccttgtgcgcctcgcctctgcctccgtctgcgcgtttcccatctgaagtctccagatcctctcgggccctgctgatggcctcgtgttcgctcagtctctgcaaacacccatttcaaagagggtggccctgctggcggtcagggcttccacgtgggaattccgggagacgccatccgcccctaaggagggctcacacacgcgcagtttcttcctcggggaattgcacgtgcctggcccccctcggtggttgcctgctgctcccgcttcctcccctgcagtaattgccttccctgcctcgggtgcagatgggaccgcagctcaacagtgccccagagcacccagtccgccacgctttggaacagcacggcctcctgctccccagagacgccggctgtggcatcaggctgggggagctcacgcgccttccttctttgggtcccaggttgttggtttttctttttaaccgtgtgaggggctgctggaattccgctgggtccacttaaccagcttggtgtttttatctctaacgaaacagctttcccagctggtgggctgtgagtggcccctgagagtgctttctgctctgggatttttatctgaggcatgaaaacgtccgtgcaggaggtcgagggcagtgccccatggcccgtgacgtcagggctgccgctgtgtcctcaggaagaggcgtttgccacgcgcagcccggggtattccaggctgggtgttttcctgtttttgtttttttttttttttcgtccctccccaccccccactccttttttattagcgagcactcagggggcgagaccccgcagagcggagggcaggtgcagcccccatgcctgcagggtgaggaaggcaggcagtgagggtgctctgggaggacccgtctctgctctgcagtctcaggccatgcttcagccatggctggagcacgcatggacagaattagagctacaagcagtaacaagcctccaggctgggaacgaacccacccaaacctctctgaaggcttgtggcaaagaaacagtgttagagctgacagttctttgagcagccccatggctgattctgcctttctactggcgtgatacttagaatcgtcgtcagctgaggtttcgagagaaagcaaggattacccctgatttttcttgacttgcagtgggcgcatttacctttctatcccaacttctgtttttaatacattaaggtttaaaaggctggcgtattctaggtgatcacaacgagcctgtgtcaggacccggattgtatttacaataaaaatcccattcagttggaggcattgggaaaatttaagaactgtttttgcctgctgtactatcactgttattgtttaagtaaaagtacaagcgtagtggcactgactctccagcccacagtcatgtacaacgcgcttcatggtctccaggcttacggacggtgacaaagtcgtccatcaccgcggaacttcactgaactggcgagataagggaagagtgatgtcatcaaggtcccaagactgggacttggcatgaggagtgtcgtaatgcagttgtgaacctttgggtgaaccccacgtatttgtttcctggggctgccctgacaaggtcccgcagacgggtggccttcatagcaggaaggttttctcgcggggtcctgagactggaagccgagatcaggggctgttcttttggaggctgtgagggagcatctgcctgacctgtctccctggcttggaggcgccgtcttctccccatgactcctcatctctccatccaccgtgcatgtctgtgtccagatgtccccttttgtgaggacactggtcctgctgggttggggccaccctggtggcctcatttgaacttgatcgctctgtaaagaccctctctccagacacagccccacgctgggcaggactccattatgtgagtttgcggggagcaccgttcggctgcctcagccccggtcttactgtcgcagtaaaaatggcaggcagcctttgaaagcgcaagctcgtcctggttccttcttcgtctcctgggcggcaaggtgtccgcagggatgtcgtgttctggcaggcacagcccctcctgtccaccttggacctgtgtttggtgtggaggttggaaagcatgggtggctgtttattttttcctctgcttgggggtttcaggaagaattccgtgcccacgtgaccctgttagctttatctcctggctgcagagcgcccagttaggtgtgatgcctgtaacatttctgagtgttcacacaaacaaagctcagtaaatatgtcccaaactcgctcctggggtttgcagttaaccttttcccactgttctggttccacatcaaaatatgtttcctggttccttgtgccctgtttccaagtgacctcgtcagcgggtgccctggggcagctggaagccacggcagagatgaaatgttagttttttaccagcgaggtggagaggccagacttccttccccaggaatgcctctccgtcggtcacatgcagcagctctggcaggcgtggaaaatgtcaccaggatctcaggctgcacaactagaaagctgtatttttaatgatctccaaagtttgggatggagaatgcacgacatgcccatcttctccccaccgtggtacagaactgctgctccattaatcctgtccctatgccagaaggagctttctggtggaaagtgtgctgtgtgcatccttcccagggaccgtctaggattgttgtcctttgaggccttttgttgcttgttcagcacctgtggcccccagtgctatgcagagcctctgagaggcccacaatggtcaaagaacgatactgaattcttgctgcaattgaagccatgataatgtttgtgaagttagtaagagtaggtgatagaaccttgatagttttagagtttggagccattttagagctcagcggaatgatgtgtctattgtcaaagcttggggggactggcacaggaatcacaggccacctgctataccccctaaaaattagaatcttaagctgtgaattctggcatcagaaaggagtggttttcttcccgccttgcttctttccaggggtaatgacggtgatcatagcaagtggcctcccagggcacctttccgtgtgctgttgagggtgcaacaggaggcgttgccgggctgcgtctggaggaggccagggcgagagtgcacgttgaaggctgtgcgggttatttataaatagtggttctcaaatggtagcttttaaagatttcatattgaccgacaggaactaaagtctacgtgattgcttcctcattccttcatcgttcggcctcctccacctgggcacctgccacaggccatgtgcgtccatgtccaggtctgtctgtgccgacatctgctctttgggcatcagcctctggaaagtgtccctgtcagagtctccacgtgtctcactctccgcacccagacagtctctggagttgcctttgtagaggcaaggttgtaggggaattggaaaggcggaggtattttgactgaatttattggtaactttaacagcacaattcttgaattcaatttctttttattttatttatttattttttttgagatggagtctcgctctgtcacccagactggagtgcagtggcacaatctcggctcactgcaagctttgcctcctgggttcacgccattctcctgactcagcctcccaagtagctgggcctacaggcgcccaccaccgcgcccggctatttttttgtatttttagtagagatggggtttcaccatgttagccaggatggtctcgatctcctgacctcgtgatccacccgcctcggcctcccaaagtgctgggattacaggcatgagccaccgcgcccagcccttgaattcaatttctacacatgaaacattgcctcttagaactgaatgtttaaaaagaatttctaaggagtgaggtaaagaaaaagaattcctaaggggcgagataggctaataaacaatgtttacttagagtccgcttggtttcaatgatcagaaatagccgctaggttggtgcaataacgtatattcaaatctcttggccaggcgcagtggctcacgcctgtaatcccagcactttgggaggccgaggcaggtggatcagctgaggtcaggagttcaagaccagcctggccaaattggcgaaaccccatctctattaaaagtacacaaattagctgggcatggtggcgggcgcctgtaatcccagctactcagaaggctgaggcaggcgaatcatttgaacccaggaggcggaggttgcagtgagctgaggtcgtgccactgcactccagcctgggcgagaggagcgagactccgtctccaaacaaacaaaaaaaccctgtttatttcagacattaagttttgggctgcaatattgaagattttagcatatcggtcacttttctgctatgcatagtattagtttcaaaaggtctgagaaaacgttcactctcttgtgtttcataagttatctgaaagtttcacagtttatcacaatttggaataagatcagctaacccccagcacagtaacaggtggactctgtcttctctttcgcagacacgagtcctctgccaggctcagtagcgattcctcctgcgtttgaatgccctttgctcttgtggctctggtacctgaggggttcgggccccggcagtgttgggggaacagtgcaggcttttgacagctcccaggtcctgtagtggggccatctctgggctctggagccagactgtccgcgggcgctggtgggccctttggggtgatggtgaacatagtctctaaggcgttgtaccgaaccccagcatagcgagacgtgtaaggtggtagccgtggggtcttccccgagcttcccgctgccatcacctcctgggaagacggatagcaaagaagccgagggtgtcgagttgccccatggtttgtaaaacactggcatgggctggaacggctcaggactgactgccactgcgtctccctgtaagcccctccctttctggggagggaagccccccaacaacccacagccagcctcgaagccacgtcgccctggctctggttcccgctaacccttgctggggagtcccccgcacaacctgtcctgctgtttcctgctgtttctggagctagacaagcctcagctggcctcctggctcccggcatgggtgtcaggccctggggagtctccagtccctcctgtgggtactgggctgggctggctctgaagggtcttgaagaacgtggctgtgtgcctccctggcattcgcggtggtggctctggagcttgcgtttggctgagcaggccagcaggtgactcgcgcaagccagacggtccccaggaagccctcagctgtggtgggagatgggagatgggctatggtgggagatgggctgtggcgggagatgggctgtggcgggagatgggctgtggcgggagatgggctgtggtgggagatgggagatgggctgtggtgggagatgggagatgggctgtggtgggagatgggctgtggtgggagatgggagatgggctgtggtgggagatgggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgggctgtggtgggagatgggagatgggctataccaggagatgggctgtggcgggagatgggctatggctgggcctgtcctctgtggtgctgtggatgcgtcctattcaggagctgcctaccaagtttcattgcgatgttggaatctgtccttggtccctgccaccatggggtgggtggagcccccagcaccctgccttcttcctccccttcctgtgggtctgcagggctcggggtgttgatggagactgtgggggtcgggggagccagcagtttcgttgtgtgatggcaggaagaatccgcgtgctgccccaccatgccttgcgacgctctgtggtagggagctgtcgggtcacagtcaggcgcttaacggccacccgactgtggacgcagctgaggccatttgtccagggtggcctagtcacaaccaacagaactggactctgccatgatgagcagaccccgcaacctacactccagactccaccggtgctgggaccccgactcccaggagacctggcgagctcagccctcttgtcacaaggcctgtacggggtgggggcacgtgtcacggggaccctcggcccagactggccttctgctctcgtcaccaagatgtggagccttctggggtcagagcccagtcgaggggctttacgcagcctgtggtgtccttggagccacagctccctggagaaggcactgcgtctgccagcctccgctggtgaggggctcagagttgagaagatcatgcctcctgattgcacgagcaccctggtcttggctcatttgctccttcttgagccgcttcggtagcatttggcagcccacggttttctgcctgcgttgtttagtttgtttctgctgttatggagttcacagctgacacttggagggcggggtttgcaacaccagtttctgatgggaaggactggtgtgagggtgtgaggaggctgcggaggccgagggcctgtgcgttctcccaggcgtgtgtggaagggctggggcatcttctccctggtccttctcaatgttactctgtccatgtctgttgttagccatgaggaggagaaggcactctgttcctggaaaggagaaaacaacgtggctttttgctcagatatttttttttgagccagggtcttgctctgttgtccaggctggagtgcagggtgtcatcacagcttactgcagcctcgacctcctgggctcaggtgaccctcccacctcagcctgccgagtagctgggaccacagacgtgcggcaccacacctggctaattgtttaagttttgtggagacagagtcttgccgtgttgtccagggctgatctggaactcctggcctgaagcagtcctcccgacctgtcctctcaaagtgctggcattgcaggtgtgagccagagttttacagtcagatcatggagatctgaaatgttgccccatctcaccgaagaccgagtgcccgggagcccccctaggagggtcagaacctgcccgggagccccctaggagggtcagaacctgcccgggagcccccctaggagggccggcacctgcctgcccgggagcccccctaggagggccggcacctgcctgcccgggagcccccctaggagggccggcacctgcctgcccgggagcccccctaggagggtcagaacctgcctggttagctcagatgcccccgtggagacagcgtgagggcggcagggagctggaaaccttcccaggttcccaattttgagatttcctaagctgcctgtggtccagctgggaggaagtgtctggtcctgatgtgcgtcggtgaccacagacaaaacaggatttgctcctgcgccaacgttggcttttgagcagcgggataggtgggcctggtggtaggtgcttcggcagccgggcagccgcagggacttcctccctcgggattaaacctgagtcgggagttggagggcaacagttattcacattcaaaaccagatcttaagtgcaaattaacgttttttggattcttgagcaaaatgttttctacattatgatgggattttcttttttataagtgcttctagaacatctctggaagctgggttagacgcacagggcttagtcggctttggggagagacagtagttgtaaaggccacaccggacgccgtgtgcacctcccaaggtttcccatgtgagaccatgtggcctgcatgctgcgttccatcagcactgggctgtgcgacagatgtgtttccaggcgaggttgctgcagaggggaagagggggacgtgtttccaggcgacgtcgctgcagagaggaagagggggacgcgtttccaggtgacgtcgctgcagagaggaagagggggacacgtttccaggcgacgtcgctgcagagaggaagagggggacgcgtttccaggcgacgtcgctgcagagaggaagagggggacacgtttccaggtgacgtcgctgcagagaggaaggagggtcgcgtttccaggcgaggtcgctgcagaggggaagagggggacgcctttccaggtgacttcgctgcagagaggaagagggggacgcctttccaggtgacttcgctgcagagaggaagaggcagacgcatttccaggcgaggtcactgcaaagaggaagagggggatgcgtttccaggtgacatcgctacagacaggaagagggggatgcgtttccgggagacgtcgctgcagaggggaagaggtggatgcgtttccaggcaaggtcgctgcagagaggaagagggggtcgcatttccaggcagcatggctgcagagaggaagaggaggacgtgtttccaggcgacgttgctgcagagaggaagaggaggacgcgtttccaggcgatgtcgttgcagagggcaagaggggaacgcgtttccaggtgacgtcgctgcagaggggaagaggcggatgcgtttccaggtgacattgctgcagagaggaagaggaagatgcttttccaggcgacgttgctgcagagaggaagagggtgggacgcatttccaggagacgtcgctgaagaggggaagagggaggcccctccagcagggccacctagatgtttgctttgccccgcgtggagtcatattccaggaacccccgaacccacctgcagcttgattctgctcctcagggccagaggttctagtttatgggaggagtgttttctcactggaaacatggagcccacacacacttctacgctggaagccgtgatgtgtgtcaggaacgtgttctgatgttggtgtgcaaaatcagtattgtgcctttgtcccctctgacccccatcacggcagttctgaggcttgtggggcaccccagctcctctccctctgcacaggccactgttcccagaactcgagggttccctgacaccaagatgacatgtggcacagacctggaatcacgaggaaatgcccgtcctcctcccacgggcagacaggtcgagtgtgtttccagagaccgggccgtccgtggggcagtagcgcctggatgacgtctgctttcgcctggagccctggctgcaaggggcggtgccgggcaagggccaccccaggggtctgggagtgcagtgtcgggcctgtggaggtggagagcagggatcagcctctttttgtggatgaggaaatggagacacgtggaaacttctggtaagaagctgtcaagcctccaggtttcggttctggacaggtgcggggcaggtattggagcactttgggctctgaggtccacgtggcccagcggcctccaggagtcagctgcaaggcggagtccctgtccacaagctgcgttgcaggcacagagaccaggagagggctgtgaagcaactctgtgtttactgggctgaagcagcagctcttggcagtgccgccaccatgggctgtgtcctgtccccgtggcgacatcacagctgagcgcgaagctggaagcttgggcacgtcttggtgctgggtcttctccgaccccgagggccaagggtgctctgtagctccaggcgtcagagtctgagcatcctttgttttggcaacatccaggacaggagtctttggagagtaacacatccttattttgaaagagccctttaggtgatttgagaaaccgctgtatttgttgtagctccaagtattacccgtgaatcacctaggctgctcttcagtgaacatccagaatgccgtcagttcttgtgaaacccccaagtttcccgtaggtccaagctgagaagattgagtgaactctgagagctgagccgggccgtcttggcaccactagaaacggaatcagttccatgactgatctgtgccccaccccacattaacttgtgcaatatgacatttctggttttggtttttgttttataagccatccatggcaagtgcagtcggaggccccccactgccaaaacttcctgtgagtaataatgacagatgggccctgaccctggagacgtctgagaaggtgtttggggtccgagaagagtccgcgtgtgcagtgactggaacctgtccctggtgtgaacttggggatgagtgggtgacgggggtggtgggggcctggggcacttccccgccctccggaccacactgttgctctccagccacgagaagatgcagcggcccccggctgcagcagctactgtcccggagggcaggggagtgagggagagggagggtgtacggcatggggcctgctgcctggggcgctgggatcccacagcgaggccctgttcccactgcccaggggcactgagatcccacagggaggcccggttcccactgagcttgggttcccaacgggctccttttgcttcccaagcaccctctcccacccttgagctgcaaggaatgtttcagagccatggaaggtgctttctcccatctgtagtttttctgggagggagaaaggctgacatcgggggctttgtagaaagcgtgctctggcccacacgttaacatttgggaggaggcctacagggagctgtcggctctgggcgagggctgggggctgcctcgggggcgggggttcagggtcttgagctcagcttctcacccatccggggcagggcagggcagatagaggggtggggacagtgttgggggctgctgggcctgggatggcagggcctgtgtccaaagctgttgtgaggctcacgagatacaggggtggacctgggagggttggggcgcgtacagaggggatgacttcgatttttccaaagaacagggaagggtctgtgtcctggtcgtactccaatcccgtgtggtggagccacgggacgccatcagtttttatgaaatccccaaatgtgtcctttaaaacaaaacctctgcactccggcctcacagcccagatcccgcgcgctcccggtctgtggctttgactttggtttgagttcctgggctgggcttacctggctggcagggccgcagctgtggcactccctgtctggggacggaggctgcccatgcacccggctgtccaccttcttcccaaaggcggcgtcctgggctccctcccatgcggacccgggatccacttgcccagccttggggaggacagatggggacagcagatcctgccccagggtcattgcccgtggccacatcggtcctgggaactgtgggtaggccatgggccgctggtgcctgcaccactgtcctggtggaaggggctggacctgggactgcctgggacaagaggccaaggcacagatggctgcaggggctgcccctgcatcctgagcctcacccggcgggcaggagggccgggctgggtgtccccatctttctgttcccaccctggccccagtcacctgcttctcatccaccgattccatctttcctgctggcttgtgaggcccgtgccctcctctgggccgccttccctcccatgggcacagagcttgggtcccacgtggagaggaggccctgcccgcagcctcagagtcaggcggccttggcttcagggagggttggacgggagccagcccattggacagtagcccggggcctctgggtgaccctccagggtgggacagcagtggtcccaggcccccctctgactcctgaaatcctaaggttgcccgggccgccgagccctccctccactccccggcctgctgggcaggattttgtgaaaggccttgtcttgggtcgtggaagaaaaccacgtggtctgtggggtcatccctggggcaggctgtgggagggtgaaggctgcgtccagcggccaggcccagccagaggtcgggaatcatgtcgggggtgacgcacagatgccgccgcactatcaccgagaaacgcggcgtgtgcgggcccacctggcctctttaggccgggctccgggctgccctccaggaaggccgacctctcctgggcgggcaaaactttctcagggccgagttctgccggcacaggtcagggggcaaagctggcctccgaggagcctctgaccgctggccactgtgtggtcttggggcagctccagacacacaagcccagaagacccagaggctgcctcacgtcggagaaatgcgctgatcgtctctctctctctttgtctctccatctctgtctctctccgtctctgtctgtctctccatctctgtctccctgtctctctctctgtctctgtctctctctgtctctgtctctccatctctttctctgtctctctctgtctctccgtctgtctctctgtctctccgtctgtctctctgtctctctttccgtctctgtctctccatctctgtctctgtccctgtctctgtctctctgtgtttctctgtgtctgtctctgtctctctccgtctctgtctgtgtctgtccctgtctctgtttctctgtctctctctgtctctctgtctctgactctctgtgtctgtctgtctctgtctctctgtctctctccatctctgtctctgtttctctgtctctctctgtctctccatctctgtctctttctccatctctgtttctccatttctctgtcgctctgtctctctgtgtctctctctgtctctgcctctctgtgtctgtctctccgtctctgtctctctgtctctctgtgtctatctctgtgtctgtctctctctctgtctccatctctctccatctctctctccgtctctgtttctctctctgtttctctctctgtctctccatctctgtctctccatctctctgtctctgtcgctctgtctctctctgtctctgcctctctgtgtctctctccgtctctgtctctccatctgtctctctgtctctgtctctctgtttctctccctgtctctgtctctctgtttctctccctgtctctgtctctctgtttctctccctgtctctgtctctctctctgtctgtctttctttctcactctctttctcttttaactaagggaaaagccgtcacacaaccaaatggccatgaggcccgcggctgccggctgaggagggctgcgggaggaccctgaaaccctcgccctcctgaagctgctcctgtggagtcctgtgggcgggtgtggccctgccgagttcagagtctgtcgcttcgtctgtctggaaactgcaggagtcatgagcagccttcacggttttcacctaagcaatgagcacgtgcgggctttaaccctcggaaaatcagaattaaaggattttacccaaaccacttaaacaaaggaactgcctctgctctgggcttctgctgccgagggcgcgattccgggattctcatcgttcaccggcggagtcggggcgactcatgaggagagtgttttcagatgctggggacgtggcctttctaagggagagggacatggcagggcctcaggctcagctctttggaaactgaagcccattcaccaggtgggcgggggaggagctgggcagaggttgagacacaagacctgagagcagagcaaagtttctcatttttttggttgtacaaataacaaacaccgttcactgtagaagacttttaaacacagataaaccacgataaatgagtcctgcaccagcgtggcagctcacacctggaatcccagcgctttgggaggccgaggcaccaggatcgctggagcccaggagtttgagaccgccctgggcaacatggagagaccccatctctacacaaaatataacaattagccaggtgtggtggtgcgcctgtggtcccagctgctcgggaggctgaggtgggaggatcccgtgaggccactgcactctagcctgggtgacagagcgagaccctgtctcagaaaaaagaattcgataatcctgcgattgagaatcagacagtgatcatttcaggatatgtctttttttttttttcctccccctctgtcccagcgcagacggcatctctgtcgcgagctttcggctgaaaaaaaatccctcacgcccttcccaggcgagggagacacaggttcaggggcatgaacggctcctcccgtggaaaggactgtgtggccggctccccaggccacgggggccactgtcctccatgccacgtcccatgccgcttccaccgcagcgtgaggacagcaggacctgagccacgagccacactgctgtgggacccgtgtcgggactcgcagggcctggcaggtgtttccatttgacctgtgggctcacactcggcagttctgggccccctggtgtccacctccatgggagcaccgtccccggacccccagaggggcggcaaacacaggagtcctggggagtgttgccggggcgggaagcccggacccccctgtgactcagctgcagcctctctgggtgttgctgcgggtgtggaggttgcatctggctcagtgagaagcatttttaaacttgattctgcagccactgcagattcgcgggaagctggggggaggcaatgccccacccggcccccggggctgccccatagcagccaccatgccctggccccaggccccaggaggaggatcctgccgggagcgccttgcattttgcctaggaccttcttaactctccagactcatcagggaagctctgcaggagctcaggataaacaggtccttggcttgaagcctgccggcatgggttgggaatggtgggggctccatgtctgcagcagccacggcagaagctgtggccacatgagctgggctctgggtgcggctgtggccattgaggagggagcatgtcccgggttcttaggttaagtgcgtcttggcaggggggcccggggctgcagcccttcgtgtacccacgtgtccgatgtctctgtgccatgccgtgacgttgtccttcacgtaaagttttcaagacccacgtcccattgtctgtgaaatcacaaggttttactttatggactgtgtggaatggacccagggaagggggaccagtatatgcccaatttgccagcatgtgcaacagtgaacttccctggacagctggccttggtgtggcagtgggtgctgtacggctggcctctgtgcagtgggttggggggagctggatggctggcctctgtgcggtgggtgggggggagctggacggctggcctctgtgcggtgggtgggggctgtaccactggcctctgtgcggtgggtcgggggaagctggacggctggcctctgtgcagtgggtggggggagctggacggctggcctctgtgcagtgggtcggggggagctggatggctggcctctgtgcagcgggtgggggagagctggacagctggcctctgtgcggtggaggctggacggctggcctctgtgtggtgtgggggctggatggctggcctctgtgcagtgggtggggttgggggggtgctggacggctggcctctgtgcagtgggtgggggggtgctggacggctggtctttgtgcagtgagggggctggacaactgccctctgtgcaggggtcggggggagctggatggctggcctctgtggggtgggtgtagggggagctggacggctggcctctgtgcagtgagtcggggaggggggtggctagacagctggcctctgtgtggtggcagggctggacagctggcctctgtgcagtgggtggcgggggggtgctggacggctggcctctatgtagtcggggaggctggatgactggcctctgtgcagtgggggcaggcgctggatgactggcctctatgcagtgggtcggggggcctggacagctggcctctgtgcggtgggttgggggggcctggacgtctggcttctgtgcggtgcgggggccggcctcgggccggtgggcaggctggaaggtcagccaggccctgtggtgtctttagtgagaaacaggaaataaatcaaggggatgttgtagaagttttaccgctgctggtttagaagtgtttgtttttattatttgtatataatgtgttgttttcagtcttgcactggtgtttttaactatcgtgtaaagatgcaaacagcaggccagaaaactgccttgatatatcacattggcaaagaccaagcgcaccccggaccctagtgggtgagccggacccattggcagtggcctttgtggtgcctccagggagcctcacgatgctcacgcctctgaccagtggttctgcgctcagggcatgaccggagatgtggtctgggagttggttgtgtggatgtttgcgttgccagcgtttacaacaacagaggggaacagcccacagcccagcagtacaatgaggatggtccttgtgataaatgggatgctgtgattagattgtttctgaataagctaaaatgctcaaaatgtgatctttcttttataaaaaggccaggtatggtgatacgtgcctgtaaccccagcactttgggaggctgaggtgggaggatcccttgagcccaggagttggagaatgcagtgagctgtgatcacaccctctagcctaggcagcagagcgagaccttgttctaagaaataaaaagagaaaaagaaaagacaaagtaccaaattatgtgtctcattttcttaagatgtatcattttgtaaaaatgtttatagaaatacacccagtgggctgggcacagtggctcacgcctgtaatcccagcactttgggaggctgaagcgggcggatcacctgaggtcaggagttcgagaccagcctggccaacatggtgaaactgtgtctctactaaaaatacaaaaaattagccggtgtggtggtgggcacctgtactcccagctactctggaggctgaggcaggagcattgcttgaacctgggaggcggaggctgcagtgagccgagatggctccactgcactccagcctgggccacagagcgggactccgtctcaaaaaaaaaaaaaaaaaaaatggagagagagagaaacagagaaaaacaccctttggctctgtgggcgtcggtcaccgtccagaccgggtggacgttcgtcggtcaccatccagaccaggtggatgttggatgcaaatttcacccgagcttttttttttattttttcagttgtgttgagtgtcacttttttaaaaaattgacttatgttgaagatgagtttgaagttgttggaattatctcagtcctgagcttagggcttcagcaagcgagttgccgttccgggggatgggctggtcagagacccccgactgaagcacgcctgcccgaggctgccccaggcgtcgtcccccagaaggaagcacgcggagtggagtggggtggagagcaggcagcagcggtcccgtctccgcagcagtgcaggctcctttcccgctcatttgggctcttttgtctgaaccagagacacagatttgtagagctgccaaattcatgctgaaaatttctaaccaaaaccaatcatcttaattgtctggattatgatatttattttgtaaaccattcttgctgtaagccatgcacacactgtgtcactaaatctgcaaatgattccagagccaaatgcagtcctgcaccgcggcgtcgggtcaacggcggacttcacctatgagggttctcgtgagatcgtgagagcgtagttttactgcatcttttccatgtttaaatgtgtttagattcacaaactgtgaccgctgtggggcagtcacccacggtgttcagtgcagccacatgccgtgcagacgtgtactggggagccgtgggccacgccacgtggctagggtgtgcactggacacaccgagtcggttcacacgagttcccacgacgacaaaatggcctaaggacgcgtttttcagaatgtgtccttgtcataaagtgacacgtggctgcgtttacacaaacttattcttatgtaatagtcagctgcagagtggtttagactgccttatctttaggaaatgtgtctgcctttaaccagaccagcggtggggggaggcggcttttcttttcttctttcctcctctctcctctctctcgctgtctcttctctgtctcttaactttcctgggaatccagtgagcccagttttttcactgtgaattttgtttttggtttgtttgttttgagatggagtctcactctgttgcccaggctggattgcagtggtgcaatttcggctcactgcagcctccgcctcccaggttcaagcaattctcctgcttcaccctcccaagtggctaggattacaggcactcgccaccatgcccagctaatttttgtatttttagtggagacggggtttcaccctgttggccaggatggtcttggtctcctgacctcaggtgatctgtctgcctcggcctcccaaagtgctgggattacaggcatgagccaccacgcccggccatgaattttgtttttcatttgtttctttttcaattcatagcaaaagataggtgcaaggtgcctgagacgggcaccgcctcgcatcatctgcgactttgtttggtgcctgcctgtccaggagcaggtgtggccactgcagaggggcccttcattgcccagccctgcagctgccccctctcccttccccagaaactcacagctggccgcgagctctgtgcagagaagtctttctctggaggctcttgtccttcctgtgtggaggcctgggtccagccgcctttccttctgcctggcagcgttagctgatactgggtgtccatgctgatcacctcacgtgggaaacagctctgacagtacagcccatgaagctgcgtcttggagattcctctgtcagggaagctgtcgtggctgagttggggtccagcaggcacccgcagggcccaaaaccccacagagcggaggtgggtggtgagcctgccaggtgcatctttggataaatccatttctgagttttcaaattactatgaagcttccaatgtcacaaaatatgtagtcttgttcttgctaaggaacattttaggtgtttgtatttttaaaaattacgtagttgattccattcaagctgcctcctgggctttttcctctttaaacgagtcttctattctgcccatcgtttttagtttgtttgttttgagacagagtcttgccctgtcgcccaggctgaagcacatgcgatcttggctcactgccatctcaacctcccctggctcaggcgatcctccccgctcagcctcctgtgtggctgggatcctccccactcagcctcctgtgtggctgggatcacagatgtgcaccaccacgtcctgctcatgtttttattttttgtttcgtagagatggggtctctccatgttgcccaggctggtctcgaactcctgagctcaagtgatctgttccccttggcctcccaaagttttgggattacaggcatgagccactgcgactggccttgtttttgttgttgtttgttgtttttttttagatggagtctcgctctgtcgccaaggctggagtgcagtggcgcgatctcggctcactgcaacctcctcctcttcggtataagcaattctcctccctcagcctctcgagtagctgggactacaggcctccgccaccacgcccggctaatttttgtatttttagtagagacagggtttcaccatgttggccaggatggtctcaatctcctgaccttgtgatccacccgcctcggcctccccgagtgctggggttacaggcgtgagccaccatgcccggcccttgttttgtttttaagtcactttgggttcacagtgtgtcctgaggtgtgggggccttcggggggctcgggaggcagtttcctttaacttgcagatgcccctgctctgcgactgcatcgcatggaacctgcccttctcgagaagctgccccgcatgtcccatgtctctggggcttgtacttaaaactgacgtagaatgatggtcagcagctctaggcaataattgagtcctggccagaggggctggttctgaagatgggggagtcacaggccctgtgtggagggtgacctcaggagccccggcccacggtgctcggggtgagcctgtgtggtgaggacagtcggcgggccctgggtctctgcccacacggaggtgaggacggtcggcgggccctgggtctctggccacatagcggtgaggacagccgttgggccctggactgcctctgcccacgcagggtcttgcacctgatctgatgagcagtgctggtccagggagggtcccaccgcatcctccgcctgccttggcccctgcagtaggcagtgctggggagacagactgagcgggagaggaggctgggccggggctgcagcggccacagagccttggccctcccagaaacggactctgatggcagaggcgccggcctcttgcacagggtggaaggtggtgcctgcgtggatggtggtgcaccggggcaggccaccccctagatgcaagaaccccttgggtgcaccgtgtggcccccaggagtgttgagacagtctgcctgggcctcctacagaacacagttgggaagacacgccgagggcacgggcaggacctcaccttagcctttcacaccaaacattcatctcctgaaaagacaggggccgtggggcccccagctgggctgtaggctctgaggacagccccagcacctgtcacccgccaggtcatgcagctcgtgtccctctgtgcaaagtaaccgaacagcctcccacagccctcaccgtcgtaccccgccctgctgcgtttgctcccaccgccctccatggacgccgtgtccctcctcctggccctcagtcagggccttctgtttgtcttgcagcaatcatggaatttgggggctggcggcgctgcgcacatcacaacttccaaacccactattttataaagggcccagtcagtcacctgtctcatggcagccacacagctggttcatagcgaggagaggtttgagcttcctggttcttaggccacagcccatccctcttagattttaaaacagattttcaatgagttctaaaacctgtcttactggagggttaagtaactgatagaagcctgtcatgaaggaagagaagcgtgttaaggttgtgcttggaaaatgtttccatcttagagaactggccgggccgtggccacaggtcacgatgagtaagcactgcattgacacaggcttctccatctccatgtcaggacgtgcactcgccgatgaagtgtccacccaagatggcgacgggtgagcacgggcacgtgtggcccgggcgaggtctgtgtggtgctgaacgcctcctctgctctgttcccttccagcccgaccctgcccgccctggactggcagctgccgtcccactcaggcccgtatgagcttcggattgaggtgcagcccaagtcccaccaccgagcccactacgagacggagggcagccggggggccgtgaaggcgtcggccggaggacaccccatcgtgcaggtaggcactgcggccagactcgcacgtcacttggtgcttttgtggtcaaaaagtaactttggagccacagctaactgtgcttagactctcccagccaggccagctgaatgctctgtcgtggttagtcccgggcggctgctcaccgcctctgagctggaatgggagcatgccacagctcctcctgcttccacacgtgcaggccctctctcgttgttttcagatttgcccgaagcagctctcgtatccgtggatgctgcctgtggtgtggatgttttgggggttgattctcccctctctaaagcctctgaacttggaggcaggagttctcaccagcagcaccagcctcgcctggtgggggaccctcagaaatgcaggttctgtggcccacccaggcttgcaggatcccatactctgggcttgggtgctggggggcaccagggctcaaggtgctccccgaggagaggaggagtggcttccagagcgggcctgggcctggcagccacatccctgccggggtaggcctgggcctggcaaccctgcagccgcgtccctgctggggtgggcctgactcccccgggctgtggtgtggcttcctcaccttcctcacaccttgcgggaaagccacgtggagttaggctgtcgagggaggggtgtaatgaccgcgccagggacgggcagcgtctgcacagagccatgctccctctgcaccccaggtgttgatgtggatcccgggtagccgtgggtgttggcattttcttcgttccacctgttacctcgtcagctataggccccaggccctagatctgctgctttggcagccacagagcagcaagtgtgtccagccccagggctccaggctacgcggcagcacagaggatgttttccgagcacaccccaacagcaaaaaaccgggtgccccagccccgttatttagggaatgatgcaagccggaaggggtgttcagcagagtgcctcgtatttttattttcttccatttagataaatagtggagagaaggtggccgcagggacaaatggctgtttgccaacgcagcagccggcggcagggaattagcgggcagggcgctggggtgaggcgttttcgccagcacttgcagatgatgttaatgtgatgtttgtggcctgtgtgcttgatgccaattagtacctccctcgttggtgcttgaagcaaggaaatgcgggagacacctgagcgcacagtggcccgtttgacatttaaagtctccaccctcccaggtgggaaaggtcagacagcgctgcaccacgctccgtcactgcaggcctgcacctccccatccctgcctcggtttttactgaccgaaagcttgttattgctcagtgggaaggatattagataggacaagaaacgaggctgtgaaaggaggagtggaaataaagcaatagagaaataatggcccagtccaccctatttgctgtaaattatgtcggtgaggggcactgacgtcgcccttttcactgtatctggatgaggggcgggtgtaggaatcgaggctgttacttggagggtaaagcaggaccatgagtgtggagagagctctgaggtttctgtttgttttgttttttggtttgtttgttttttttttttttttgagacggagtctcgctctcacccgggctggagtgcagtggtgtgatctcagctcactgcaacctctgtctcctgggttcaagtgattctcctgcctcagcctcccgagtagctgggactacaggcagccctgggttttaatggatgtattttcacctgcctgtgagtagcgccggtgcctggtgccgcccgtctctgcggacacagctcagtgcttgggtactctccctgcgtcttctggaatcttctggaatcccgtctctggttctgccatctgggtgtcttgggctgagggtgcagaaatctatcaatacagatgccactgagaggatccaggtgttctggaggactcaggaaacttgaaacagtaattaaaaatatctttaaaatgtaccctcaacaattattccaaatcaagtggcccgtgtgtgcgcagcagcgacacgggagaggctggctctgcgtttccacagaaggagccctttccattgaaacgcgggagaaaacggtcccctgcacggagaacgtcaggagctgtcagcatatctcatttgtagaaattagtaatttaaagagttttgtgatgtatctgtggcagagtggatttctgtctctgcaagtgtgaggtaaaagcagctaaaaagagggggttttgggggttagttttctctttcagttggtggaccacaaattggataaaaatagaatttgtgcataatttaaaaacaaacgagaatagaaagctctcagttgccgtggaagctcctcgtaaccgcagacgtgccctcggtgccgtcgggttattttagtacatcctttgacgcggcccctttcccgcttttcagaaacgaggctcatcgcactggcctgggggcgcgaggacgaggccgtgggtagtgggcgctgcgggcggctggtcagagccactgggagccgttgggaacaactggcgcgggagtttcctgcatttgagaaatgctgttctcttcgttgtgaatcgtctgtccgctgcatctcaaaaagcttgtccagaaaattaaagcccgctgtctcctgcagtgcagctgagccctggagggtggcggggggccgggggatgtgggtgtcagctctcgcggccaggggcacgctgtgcccccgcgcccggtatccccgtcctcccgcacccggcgtccgcgtcctcccacgcccgctgtctccgtcctccccatccccatgtgtttcgcagttgggaagtgaagcacgtgagcagaacgcagcaccttctctccaggaagcattcggagcatggactctgggttaggaaagggtgtttgctcctctggataggtgctcgctcttacttgtgggtgctgaggggcgtgagggggtccggcatccgggtacctgtgggcgctgaggggcgtgagggggtccggcatccggggcttctcccatttagggcctttccttcagagggaaggaggccagccccctccagtgagcactgagcgtgccccctgccgtctctgtggggatgtcattgttcccacgccggggagagaccaccccaggccagcccctattcttctggccacattgccatgatcacaccgtccgcaccctgaggccacccccattacggctgccacggcgctaaaaacaccagcatcaaagcaacagggccgtggtttagcctggaagagcggggccctggagccgtctgcgagggggtctgggtggttcaggatggccggcagcccctggtggacgtggtccctgcggggtctggcgggacctcggccatggtgatgggtgcgccccctctgcagggtggggcctgcgggtaaggacagtcccgccccctgtgcgtgtgaggggatagtggagagaggggtctggcgtgggcctcactgctcctgggaaaccaaagatgaagacgcctgcttaggactcaccttgccctggtagaacaagtgactcagacagagcctcccagaggcttctggccaggcagggagtgaccagcagcgcagccagcctcagctcctgcccacacagcccccttgtcaccggctcctcctgcccctgctccagcaccttggccaccagttctcggtgggccggtctggatctgccgatgccgggacctcgccaggccgctggttgcaggggaggctgagggggcgtccgcctgctgtctgcttctcaccagcatttccagtgaggcatgaaagtgatgcgtggcggatgtttccctctggcctcagctttcccccaaatcccagctcacactgagtgtcctgatggtggcacctcgggcagccgccaccctctgccctccaccctctgccctgacggcaggctctgcctgagggggagggtctctctgtacacacagtctcctcaccctggagggcctgctctgctctcaacggagctggaaccaggagttcgcgagtgctctgggtggctgctggcttttctccttgtctcacctcctcatccgcacacagcctctgccctcagcgctgctcacctcggtatgtaggcagccggcatcaggatggtctggggtgagacaggcagtgttcttccccttctctggccagggagggtggagaagcacccgggcacagccattgaggccttttcgtgcaactcattgcctttctgggcgtgaaggtggaggctggtcctccacctgcgtgttctccatctgggggactgtggtcccggaggagacctggagtccggctccccgctccgtccgaggaggagctgagcggcgtgagcagtgcccgccctggtcactctgccttgctttcctcctctctgtttctggttgtgcctccttccttccctcctgctctctttgccgtggactgcagccccctcgccagatgtgttcctcacatgagtcaacccgtccttggcctgcgtcctccactgctcgtggcagctacactctcccggaggtggccgggaagggcccagggccttgagaagatgtctttgcagcacgtccccggccctcggcctccacctccatggcacccaccatcccacgggggcacgtggacctctgtgggatatagcctgacctctgacccaggggtcaaataactcaggtctgtttaccaagtcaccaaaataacctgcccgatagcatctcacccatcacacgggaggccgggctcgtgtgaataattaataggtcactggaatgtgaaacgagaagcctcggcccgttctgaaacagcattttaggtttgcagcttataatattgtcagttaggagaagggccaactgagtctgcaaagaggtgagggcgggtggtctgggatcctgcctcagccgcgcgggtgagaggggcgggcgggtcaggcgaagactcagagtcaggaggccagactggccccagggagggctcctggccataccccaagctcaggacgcagggtggggcgggcccgctggtgcccacagtggccttggtgggcctctccttccattgcccagcttgtaggtcaactttgcctccacagatccgtaacagacgttttttctgtcatgtaagaaacttgacagctgaagaccaaggagtggagcctcccgtgaggcagctcttcttttccggttgttaaaatgcgcgtcgggccagtggttctgactaattctcactttgtgtggtaccttcagctggcaggggctcggggagtgttcagtaccgtgaggagcaggttcctgagagcccgtgaataccgtggacagattaccacagcacgcactgttccacgcagggcctcatccacgctttcttaagtggtttgccacacacaggagctcctggttctccatgtcccctgccaggcagggctgttaaactggaaagccggggagggacgtcgctgggacacattgttatctgatcagagctccgaggccccaccaggagctgtgctattgcagaacctcaaacagcagccgctccggccccgccccaggagccacgcagaggcccacgcacggggaggacgccgtggggtggaaactaaagtgcaggtctgaccacaaaaccacacgccacggcaccgctgctgccaaatgccggaggcctgcaggaggcacggattaattttttatgagtctgccttggaacctagacaacagccctctcctctttcagcacaatttcagggcgaatgaccgtcacttccctggactgctaagcgcataaacgcacagggaatttcctagttccacatacgccgttgttcccgcagcccatgcagctgggagagcacacatggttgccgtcgggctgtgtctgttttcccaggagcaagaactctcagaagtgcagtgttgaagcccgagccttccccgtgtcagcttttatgatgaacgaggattcaccatttatttctcccctaaagcaaagcccacgggctctgttttgagcgatggggacagatgctcggtgctgctgggaaggtgttcacggggcagattcgctgtgtcaggagaccaacgtggaatgaggtcggcccagccagtcactgcttaaaaacagtaatgacaatatttgagaaaatgggtggaattttgtggagatttactggcacggggaaggcgtgtggcctctggcaggtctgcgacactgatttctaactacctgttccacagctccactgcctggaaaaactggcaaaaatgtggcctgggtctcctgacaggcctggccattggagtgggggtgtgcagctgagacaggaaatacgaggcgcatgagtgtccccaagcccagatcctcagcctccaaaatcttctattagtaatttcagagctttggcttcttggtgctttgggaaaatttaagatgacgcgtgggctctggcacggccgttgctagtgacctctcctaatagcgcagaagggcctcccaggaggctttcctaggtagagaggggtctgcacgcccactggaacatgctctatcccagcctcagaaaacccacatttggtgcaggtgggacaggaggagtggacacgtcacctggagaccacatgagaagcggccatctgcagcagcaatcaccccgtggggaggcggcgccctggcagctctcatgtggggcctggtccttcctcgctgcctgagcaatgggccctgcttccccgcagacaccgtggtgcccctgggccacacccagcaggtgtccagtgaccgagggtggtgttggccatggcaggtccctgcccgtttctccgaggacctggggctgtgacccagctgggttctcccgggaaggagcggccactgtctgcactgtccagtgctgagggtggcagccatttctgaagcctcccaggtttgtgccctgctgtgtctgaacagctccggagtgcagggtctctgtgtcagtgccggttctaagaggaacgagatgtggtttcagagacactcctcttctctgaggagctgctgggcgggacggctgcttgctttctttgtctgtgacgttggtggctgttccttgcccaggccctgcccaggccagacgtgggagtggcggctgggagcacccatgggcgtgtgcccgtctgggctgggctcgtgtccgtggacctgcctcaagccacacctccctcctccaggcaggacaccgggccttgtctgtggacagaggcgctttgctgggaacagcacagatggcccctgggccctgcggagccgagacgcaccatcatacacacttggagcacatagactgaccaggtctcaccctgcgaggctccctgaggccatgtcctagggaaatagaaggtttcacccggagattggggagtgcagggctgtggcgctgcagggtgcgggccctgaaggaggggcaggggtgctgctggatggtggctcttccaccccaggattcctcgggcccttcacccctgtgtgtctggactgggtatcgctgtagctgtcgggctctggaggtgcacatggctgctgggcgggcagcgctcctgggcctctctcccccgtgatttcggttttgatgtgtttgagccactgaccagcaggcttaggggccattctggagctgggagggcttgtgggggaggcaggatgaacaggggctgcttgccggtcctcaggccaccctgccagctccttgatgtgtctccctgagatcagccagggcatcccggctgtgggtgggctgtgacctgagcccgtcaggccctgctggggtagactggggagaagtgctgagcggaaaccacctcacttctgacaaatgacaagcgctcctgccgcttggtgtcaggcgacgcgactctcagtggcacggatgtctctagaaggttgccgtttctcccttcgtggccgtgggctgtggattctgtgtgcttctggccctggggtcacggggttgcggcgtttcccacttgcctgtttcaggagttgcattctagatgattctctctccatagaaggtcgaggtttctcagcatggattaattgattagatttaattaaatctaaacgtggtgtttccgggcagaatcttcttcagccaaagtgagcgtggccgtctcttctctgggcgcttccaggtgcgttggggcccctgcaccctccacgtcagtgccctggctccgtggccctgtcggtgctctggtgagtctggggttcgtgccgagcgccattgcctccaggtcgaggtgggaagcgcgctggtggggcaaggtggtccctgcatggcacaggttgggagagcagccgggagggcagcgggccgaggcggtgggggagggcaccagttctccacggcaagcacggcctctggggctgctcttccggagagacgtggagacccgcgtgcacgtgtggagactggcacgtgtgaggggcccacaggtgtggccgggcggcctttctcctccccacctctgtccaccctcgccgaggcgtcggtcctgctgagcagcctctgctgccttcgtgcaggtgacagcgcacgtgccattcacgggcgccatgtctccaagaagaggggctcctgccgcgtgcctgttctggggttgccactcaacatccttccagcaccttctctgggcttccggtttgaatgatctttctccaaagtcggcggaaggggctagaaaagtagggacctgggaagaaagcccagacaccttggagccggggtccgggaaacaggccctggcagctcagcgctgcttctctggagtggggatacaatgttggttcacagacgtgcggtggcggcggcgggtggtggcagcagtgtgcggttgttggcgccacgtgctcacgctgggtccctcctggggagcttctgctccggcgggccacgccttgctgtagcctgcaggtcatctggttggtgtctgggggaggtctggggccccagcccggagctcagctctgagcatcaagaaacccgagtttctccccactcccacccagacagctccccactcccacccggacagctccccactcccacccggacagcagcagctgtgtttggaaggggacacaccagagcttcccttgtagcaagtgaggcacgctcagctggagcctggcagtcctgcagctccgcctgcccccttttgaaaaccaaaaatcccaagagacttatgttgaaacagcccttcccggtcaggactgagcctgtggctgagtgcagtttttcagtcgcggctggaaggtccctgtgcggggcggcgagtccctctagatttgctttacagccacaaattcagttttatctgtggatctgaacacgatctatgaatcactaggaaagcaactgtgttcacgggaaggattctcagaattgagctgacactccgtggtgtgaactcagtattgtcagcttgtgcaccgcgcgtatggacacacacctgcacgcactgtcacacacacttgcctcgggcccccacacacaccgccctgagagctaggaagacgaatcggtcagtcacacggattctgcagacagcttccttcaccaggcatggtagtgagggcagcgcccactactcacccagggcctctcgtgcaggaaactgcatggacacgtcgtcctgttcctgtcatgggaaggggcctggagccgtccctcggggggtggggaggagctagtttcccagtcggcgcccgtgcattcaccggtctgagaatccactcagcaggcttgctatgtaacctccgccgttcaggcctcagcatgcagcaagcccgtggggtcccgtctgcccagcctctgcctcggttcctgccgggcacatggacgcttcccttgaatccttctgccgacggcatctgtgggagggcaggtacgatcgatcctggtcctgtccccctagccctgggcgggtgtcccggcacctccaggcacaaggccccttccccaggctgcccagagaccccagccccgaggtgctggtccgcccaccctctctgggaagggctgtgccacatggcgaaagctgctgtgggtcctggtacctggtgtccctgcctgccagggctcatgatgccaacagtgccaggtttgtgggatttgggggtcaggagggcctggccctgctcctgcaaggccgagatctgttcccttggagggttgagggagtgttggctgtagggttcctggaggcctctctcatgcactctgggtctgtcaggaggctggcaactgtggccaaacaggtagaaataaaacctgaaatgagaaaaaaacttttttctagaacttcccagagagcagtgagctggtgccagtgggtcagaggcttgtcacatgtggtgtgtgtgtgtgcgtgtgtgtgtgcacgctctgggggggtgtgcacatttcccagtgtggctgtgcgtgtgtgtgtgcccacgtgtgttcacagaacaccaggctttgccccgactcctggctcaggcctgagtctccagccatggcgtccccgttcctcccgttccttctctgcactgcacactgggaaccaggacaagaggtgtgcggcgtcaggctgtgtccttcccccacccaccccgagcccacgctgctctggagggagaccccagcttcccccgcctaccccgagccctcgctgctctggagggagaccccaggcccctcaggccctttcccgcatctgaaggggccagggcagggcgtccggcagatgaagctgccccttaaagccaggtctgggccggtttacagggaagcactgctcacgtacaacctggcagaccacaccagcgccgcacacacaggcacccctgtgggcacccacgtgcccgaccccgcagaccacaccggcactgcacacacaggcacccccgtgggcacacacgtgcccgaccccacagaccacaccggcgctgcacacacaggcacccccgtggccacacacatgcctgcacacgcacacttctggtgcacacgcccacactcacggaggcttctgcacaccacacagccagcaggtgaggaagtggacgctgcgtggctgtctcttggtggcttcacctggaatgtcaccgtggaccccagagcccgaagccccggcaagcacagaaatcacaccggcagcctgtcccacttcgggcaggtgaggcctggctgagaaaagggggaaggagagggaggatgcgggggtgtgtcctggtcctccacccgtttcgggtttggggtgctcccttcgactactggctccatttttgatgtcttttacttttgtttcgatttttcctggtatcttgagtaaagtctccctggagcatcaaattggatttttcttacaagtaccgtgtgctgttgactcatctgctttggtgtgccgtgggtcacgtgggcctgggctgtgggtaaggtgggcctcgttcctgcaggaacacctggctctgcagcagtggctgccgtatcatcctggccaggcccctgtaccgagggtggagccacggggtctctgatgccttccttctcgtgctttggtggagaatgtggctggacgtcctcccatgacagatgcactctcctgcctggttccctggccccgggcccagccctgagagacgcaccacggccttcacctggaagtgtcacctctggctgctgttgtgggtgatgaggattccagggctgagaagaggaccctagacgctgttcacacagcgtggcaatctctcaaattaatccagcatggggggaatcggggttgaaaccggtttgtgagccggattttctgtccctgtgtacttccttggggcaatttgaaaaatgcagattttactcgtaggccctaaatggataatttccctttaggctgacggctgctcctgtgccctgcctggagagaagcctgactccaggtcgccttggctccgtttctgtgcagcagctcagactatggggtggagggtgagacattcccacccgtgagctgcctctgtccaccccacacctccctcccctgggtgcacgcagctgagttccacgttgaataaatttggcctcaatcatccactacccaccatgtcaccgtgtaagtgctgaggtcagcacaggagctaaaaacaaacattgtaacgtgtaggagactcagtagctcttatacctcggcagtggaataagaataatacattttgtttagttaaggttgaggcagagggaggtcattgttgtgacagggaattttataaataggattctgacaggttctgtactgtgccagaggcagaaagcccatgcagtggggcccgtgacgtatttaaatgacttttcttaaaatgaacttcatgttttaaataatagatgtttacctcccaggtgaaaccttaaatattcccattttcactgaaatggcatgttttttaaaggatacagtcataccccaaattcacagcattccacacaccatcagagaactgccacagggatcctgggggaattttaaattgtagttttaagaccacgtgaccctggagctgccccggtgcccctcccccaccccccgaggtggttttggtcagcgactcatttacatttttttctatgtaaattaaatttttaggtattaaatctcggaaaatggaatactgcgtggcagaatccgcctcttaatctgcttttctttttacatttcccatcataaagatgtttgagtcccacagagagttaaggtatctcgggaagttcattaacttggcaaacggctggagtctctcttccgaggagctgagggctggacaggcaggtcccagcgtcccccgtcctgactgtttgtgtggagacactcatgtattcatatgggaaggggggctctattggaaagggaagggctttttgttctgcagagttacgtggtcttagcagtaatcactttggagtgggctgctggtggccttgggtgcagagactcctgtgggcatctgcgcacatgggggctgtgtcctcatccctgtctgtggcttccccaccgtgttcccacgtgatgccttcgttcagcctctggctttgtgtttcagaccccaaacgccccttcgatgtctcagctgggacctgggtcccggctcagcctcacgcggcgtcccagtccctgcccatcagtctgggcctcacggtcaggccctcagtgacagcagccgtcgcttcactgtggcctcgtccctggagggctctgagttcagccgtcgcttcactgtggcctcctccctggcggggctctgagttcagccaccggtgagattggtttgttctttactgtggtgaccacacggcggctgaggctaagctggagccacggagcaagggccgcctcttcgcctgcccgggcccctctagccccatcttccctctgcccactgacatctgagaatccgccgtcccctggcccgggctcccccgccttctccctcgcctcgctggccctgagtgggcagcaggcatctgcgtggtcaggggcaggcgtcgcattttcctgtggctggaacgtgcctgcaggagcccaggcctggactctgcacgtggtcatcgtgctgcagttgccgtctgtggtcaaagattttaaagttagtttagtgagaaaatcgactccaaacgtgatcagaggggtcgacgcgtcccaggatgagtggttcccggggctgggcgttgccacgggccttgcatggattttgctgatgaatctcagggctctgaggctggcgctcatcgggccccacttgggggatgcagaagggaaggcactctgaacgaggggccctgtgggaggccccactgcgcaaagggtttgactcctgcggcctccctcaaggcctttgtgcttgctttgagaatcaaacgttcctgttccaaaccaaacttgcctcttgcatatggaatcagactatagtgattgtaaatggtagcgttaaagataaaaacaaacagttctaaaaatgactcactgctgaaggcggaaccacgcgtggtgcagagaaggagggtgagagggaacggcaccacactctgtgtttacctctcaagacgctgatgagcaactcatcccacagaacagctggtcctgaacatgtgtgtgccctgccgtgaggcgcacaccttcccagaggcgtgagtggggcccggccactagtgtcctggcggaagcaccggggctgctccatttgtctggagtcctgtcccagtggtgtgggttttgagtctcacccacacggcgccggccgagaagccatgagcggctctgcagggtggtgcggactatagacacctccatgcatggttgccctaggcagtgtctgccgccagcgtctgcctctggacactagctgctcagccaccaggacggcgttgagcgctcccctgcctctgcaggaggagaggggcagggagccatcaggaagggtgctggggcctggggcccgtcgtgctgtgtgtgtgcaaacgcagtgtggcgtcccctgatcaggagtgggagctgcgcgctgcccggttccaggttaatggaacacaggaaggtgggtcatgtcctgcggggcctcatctggatttattggtgaagcgagccttgcacatggctcagcgagggctccgctttcctgcacacgccccctgccagcttcactgtggcctcagaatgggcacacacagcaagtgtggatgcatacgtgcaaggcccgtttcaaagcctaaaactcagtgcccaggtccattgggataacaaggcattttctaatctgatttacaaagacaccagtatgacatggcagagaaataaaaagggggcagggcagggggacacaggcctcgaacccgccgcaggttttctctgcgttccggtgactcccggcggtctgtgctctgggtgctgagcaggtgttttctgttctctcgccagctgcatggctacttggagaatgagccgctgatgctgcagcttttcattgggacggcggacgaccgcctgctgcgcccgcacgccttctaccaggtgcaccgcatcacagggaagaccgtgtccaccaccagccacgaggccatcctctccaacaccaaagtcctggagatcccactcctgccggagaacagcatgcgagccgtgtaagccgcgggggacctccggcctctggcagggggcggtaggagggggcgtgcctccctcccagtcccggggggtctggccagccccccgcacttccaggctgcgtggccaggacacttttggtttaacagccaataagtaaacttcactcttgcttttgacaatggatttgcttctctctagggtttcagccctgtgtatattgccacttaaaatgtcagatatgcagctataaatacctccctctgcatttagcttctaaacaggacccctatttctttccgaatacagcagtgtaatgagaggatggttaaaacgtgagcatcaaaaaattaaagcagtcagcacatctggatcacgttgacctttaggaggttccgacaacacggataggcctgtgctgatgttctgagtctaatttgacactgtaatttgtttaaaagtgaattttttagtaaggtgaggacgaaacatgtaacttccaaataaggccttactcacttaatcctagcttgtgctgggcacgctggccctaacctgtgaaggcagccgaggaggaggactgctggttcccgagagattgatgtggtactgtggggggaaccgaaaacagacacatctgtgggtgaatgagtgcaggttgagctgggacggctggaacgtgcagaccagcaggatggagccaggccggagggcagggacggcgtcctgcgagggtgacccgcaggctgggagcccgtgtgatggggaagctgtgtgtggggtgccccatccaggtggagccccgggggtgggtgcagaggtcctggggctgcaggagtggggaggagtcccgcacggtgagggagagcgtgtaggagatggcggcggggggccacgttggggattttaataagtgattcaaagcctgtaagtcaaaaagggaaagctttctctccacgttgacttttcaagcactgggaggaatgtacgcacctgggaattcattccaaatccctgagtttgcctcgagagctgtaatccaagtttcccgcagacagggcacagtcaggtgcgttccacagccgtagtaaacgtcctggcttcgctggcggctgcgttcaccccaccatgatgtggggcagaaagggtggccgggagacgcccgcagccaggaccgcgctccagccctgtgctggctgccgcctcgtgggtggtcggggagtctgtgtttattctcattctcttaacttactgaaaaatactgctttttagtgcattgagaatgtatacatggaatgttttactggagtctagttttgaatgaaattgttaagaggttatatgaaaccatagaaaaaatgggttttacacacaaaaaatgagggcttttaaatatagtggaaataatagaataatttattctaattatgatttattatatattttatataattataaatatataatatttaacctaataatatataatatataattattgtaaatgataataataaattgagctttttgggaactactccaagataagtgagaacagcaggtgcctctggcccctcccctgggccgctctctgccgctctggtgacatccccgtatacgtggccagcgtgggccctggaggcagccaggacttgggacagctccgactggacccgcttggtcaggggtggagggtggaggctggaggctggaggaaggtgggaaggggaaggtggaagtggcttttctcggggctgcctctgcttgccccctcgcctgcgccaatgtcagattctctcctgcactaggcaagggcctcacgtcgctggcttcaaggtcttgttttccttggggaaggggagagtggccagctgcctggcacgagctcgtggggctgggatgagggccagagggtctggggggccaggcctttatgctcccgcgtcagccattgaaagaaaagctgtgggcttttgttttgggcagcattgactgtgccggaatcctgaaactcagaaactccgacattgaacttcggaaaggagagacggacatcgggaggaagaacacacgggtacggctggtgttccgcgttcacgtcccgcaacccagcggccgcacgctgtccctgcaggtggcctccaaccccatcgaatgctgtaagtggacgtccacgcgcccacaggggaggaaaccgtcccgtcacatgcgcttcactgtctcaccctctctcagcttttcgttcgtgtagacttgggactgaacggttcccaccaaacccaccacagtgtgtggccacgaggggtctgagttgatcatggctgagttattgcctgtggcctcccgggggcccctggcgctggctcctctgatggctgagcatggccagggaaagcggtgtgggccggggcttcccctcacgctgcgctgacctttgcgtatttgtgcgatgactgtgatttgagtgaaattggctgagtcttaggaagatattttgatgacttcttcagaacgaggtggagaccatcaggatgaagtgtgcacggcttctcccctagaagtagtggcatccgcaggggtcggcccgcaggtcgtggcggtgcttgctctgggtgggtcggctcacgtgtgacctgctgggtgccacacgtgtgccccaggccgcccactcaggacaggccctcactgcccctctccttctgatgcagcccagcgctcagctcaggagctgcctctggtggagaagcagagcacggacagctatccggtcgtgggcgggaagaagatggtcctgtctggccacaacttcctgcaggactccaaggtcattttcgtggagaaagccccaggtatgctcttcaccaggggccatctgcggcctgggcttcggcgctggtgggaaccggttcccagtcggtggagcaggacccacctgtgcacggtcaccgggacggggcttatggggtgtggcacggagcagaggctctgcgtggcccgtgtctgcatccggctgtgggtttttgtgtgagccgacagctgtgctgctgaagggaagaggtggatgtttatttctggggccgccggggccactgcactcacatcgctgctgatactcagggagcccacgggctggggacgcagaggagggcaagacgcatttgctggctttgctggggtcctccatctgcagagagtggacgcttcgggggtcagttagcagcagggcaggagggagctcccctccggggccttcccctcccgccagcattcctggggtcggaggcagggatggggtgggtgccgcagacggcgggagctggggtggtctttaatgccacagccgtggtgtgtgtgaggctctcgtgccccaagggcacaggtcacccctgcctccaggtgttgcgctggcccagcctggaggctccggggctgaacttggaagggcagcaggggtgtcctcggagtgatgttcctcctggggccgtcacgcctgtggttctgtgctgcccacgggagactgtcctgcggggattgggctcacagagtggctcccagcccaggtcagttccatgcagacgccgggccccagcactctcatcccagaggggtggcctcgccggctccgagcagagtgtgtgaagacagtgggctgcactgatgggaaactggcattgcagggagagtgggcaccagtgtagctgggcacagggaccctagcccagccctcaagggggttcaggcagagtgggcctggctctccgcaaagcctgccgtgagctccctggttttgggggttcctggtgccttgctgggcctctgcccagggtgcgccaggtgaggggcatgcccccacaaggcctgttttgtgatatttttttccttttgtacacttaccaattggaattcttttgcacttactccaatccctggaaaccgcggaggcattcagccttgataatggggtcttgatttgtacagtttgccggaaacttaagtgcttcaatcaaaatcggctttagaggtctttgactctaacttggcttcctatagaatcagggcttaattggaaaacatgttttaaattacagagaaaaccaactaagggcagtgaccgggaaggcatttgcattgcccgtgccttctcgggaggaggctaattttgaaataattttcccttcagagctttcggtgtgtgtccacgcgttggcggagaaacacttcgcccacagtgtagggcctcgcttgggccaagactggccagaaccgtggctcccagcttctgcttttcaaagcccagacctgagcagcctccttgctttttcttctgcccagagaggcctgggcaccttggcagagcctccccccgaatgcagtccgcagaggtgccccagctcctgccctagccaagttactgtgctgagttggtgccacggcgccatgggtaagggcagccaccagcctgcgagggccaggagccaaggggatgcaggaccagccctggcctcatgcggccgcccctacaggcagcccctcctgccttcatcatcactgtgagctgtggggtcagcaggccggaggggtacctgttctgcccttaagctcggctgccacagccacacttctgggcaatgccagtttgtctgcccatgtcctcctcttgtcccatgaggtcagggtgggtctctgaccctctgccagcaccagccggcgtctggtatacagcaggtgagccataaatgaataggtgctgtgctcgagagcacgtgaagctgtgaatactgcagggatgaagccagaccacgttgataattttattctttatagttgaataagataatttgcatattcatacacacacaagcacattccatgttttcaaaagtggagaacaaatgtccacataattttcttcctccacttccggcttctcaggcgggagccgttgcttacaacacgtgctgatgtgcagtgacaggttggtgcagcagaaagccccacatcctcatcctggcaacgagagaaaccactaaactgaatttaaattaaaaacacagttgccctctcgttttctgatgggatcgtctggtctgtttaaagttctgttttagactgctcttgcagatggaaccagggccgggtgtgagctcaggaggggaggttcctgctgaggaaatccgtcagtagggcagttgaagtggcttctccaggaagggcccctgcgtctctcgactgtcctgctcattccgagggtgcagatggttgtagctgttgggaatgttggctctggacacaggccagggtcggctccaccctgtccttctctggagtacgtaggaagctcattgtccaggccagctcagcctctgcgtatcagccaggccaccttcagctgctatgggttcacagcatctctgagctttgggaagttttagatggagcggctccactgccctggaaggctgggagaagctggtgttggcctcatgaggaagggagtccccgcagcagggctgcattgcggggagccggccgggcaagggcatggctcgccgtagcctgggtgccgggtccctctgggatgctccagcagggcaggaggagggtgggtgtttgagtctcagcctgcgctccacggagcttcctcccaggtgtctcagggcggcgcaaaaggccgggagcggagtcagcctttctctgaggacttagtttacagcttcctcggaaaacgacattttccgatgatgaaaatctgtgaggaatgttcttccaggaggcaggttggctgtggggagccgagggccgggtgttggtttagaagcccctggtagcatcacaagaacccccagtttccaaggctgcaggggttcagctgcaggaagtgggaaccacacccctctcccacccacacccctccccaccttcacacctgcacccctcccgcctgttaaagatcactgtgtctgtgttccgatgtgaggcacctctctgtacacgcgtgaacgttgaagctgctgagggacacactaacgttcaacataaacgaaacgcccgaagaacgcccgcgtgaaacgtgagctcgggctgtgtctagagcctggctgagatgagacagaaggcgcaaggttctgagatgtggatgcatcaaacatgagccagttctcgatgctggagctgaacaacctccttttcttaagtcacgcgtctgttctggtgccgttttttaaaaacatcagcgaagcctgttttggtgtcgctgcgcggaagccacactacgacgccgggggtgaagactcccactccgtttgccagcgatcgcgcagcgggcagggctcagcgggtggggctgcacgggtctcgtcagtggtcgtttctgtggccgccgtgactggcaggccagctggggcctggacggccggcgtctccttctccaggtaatcagggcccctctacgtggcctcccggggcccctctggggaggcagcctggcatctcacaggcggccggggctcccgggaagcagagacgggctgtgccagggctcctaggcccaggcctggacccagtgccgtgccagccaccaccccaggggccctgccctggttcgcagggagacacacagaaatgtgggaggccgggtggcctgcacggtgggagcgagtagacagagcccctcccggaggcccccagcccagcacatccagagccctcccctgagaaaccccagacagccaggttcgccccaaacccaacatggtgggaccccagctcgccccccatctcatggccgccccatcccacggccgccccatcctctggccctggatgttaccacgtggagaagacaggcctgtgggcaggcactagccacactgcaggagacgcaggctaggtttccagatttctccacacagcagcaggcggagggcctgcctcccacctcactgggagggccaggactccaaatctgggccaaatgtatgttgttatttttcaaataaagggaccaaaggcccgggcctttccaaggctgccctgccatgggaccgtgaccggtgtggttcccaggacttccacaagctctgacaggcacctggccgttgttttgggaggctccacccagcagccacagagcttagctggcagctggcaggacacttgcaaggacacggaactgtcacggaaccaccgtggctttgggctgtcacggaaccaccgtggccttggcagctgctggtcctatgccgggacacacacattcaccgcggcgagtgtggggtgcatgtccccaggcagaggccatgtcatccaggtgcaggaagcgccaggcaaggaccctcctgtccgcccagagagccgggtcagaggagtccccaggcctgaagccactccctccgggctcaccttcaggttccttcaaggccagggggaggttcacccaccccagggtgtcgcggaagccccgaggcccctgcaggccccgatttccccagtgaggcatcagtgcccgctggccaccctgcccctctcctcctccagctgcccctgctccttgttttcctagggtctggttctttctcgcgggcggggaggaggtgagggtcagggcccctgtaaggcagactagtggcactgcccctttcggcccttgctgtccctcctctgtcccttgtggaaggtctcggcctggggcagaggagcgggccgaggaggaaggtggagtccaggtgggtggtggggtctgtgttctgttttagtcgtgcgggatgtaggccgagggagatggacccgggggatggctgcctctgtggcatctccgtggtgtgccctctgacggggctgggtgagcaaggaggacacagctgggaattcccagctccagcgtccgcggcacgggcagcctccctgtgtggagcagctcagctgtcacctcctgaagatgttggatgctggccccgaaggcagcatcgcaatgacaacaccttcagaggtgtccatcccaacagtttaaaggccaaatgcagatctttcagatttgtgttttcagggagaaggtgacattgctgggcgcctgtgagtgtggacagacatcactgtcgccgtgtgctccgagagaggagagttggggctgctttgtcaccacatggcgtctttgggagcaggacaggtggccgggctgaacccccaggcttctctgtttgctcccagagaccacacagggaaggcaaggagggcagcgcccggggaagagacacctgcccgtgtcttcctcatgccctgaggatggctcagtggcccagatggtccaggacccctagaattgagtgatgaccccacagttctcatcaagccgcattctggatagcgctaggggcgactctcagactccccctgcctgggccccgctggtgtggggaggccacgcgtcacgtcagtccccactgcaggaggaggggccgggcttctggctcccctccctcctctcccttctcaggccttttgggatcatacacgacaaagtcacccatggtcatgttggctagtttcttttttatatcagctttatcgaaatatgatctatacaccatttaattcactcaaagtgtataattcggtgggttttggtggcttcacataattatgcggccaccaccaatttcagaacattttcttgtccccagaaagaaacccttgcccatgagtggccacccctgctctcccttcccccaccccggctccgacaaccccaatgccccctcgccgtggcctcgcctggtctggctgctccctgctggcctgctggggaaccccatcctgccggctgtggtgcctggcagcttctgtggagcgtggcatcctccatgttccctcgttggtgtgggtcagggcgtagggtcctcaggtcccctcgttggcacaggtcgggacgtggggtctttctgtggctgagggaagcccaccgtgtggctgcccacacctgtctgtcgatggcactaggccacgtccaccctgtggagatgatcgtggaaaagccgccatgaacctcagtgcgtgagtcctgtgtggacgcctgcctgtctcctgagcacatgcctcggtgtgaaagggctgtgggtcacagggtggctccgtgtgaggccctgcaggcagatgtgcagcagggctgggtggctgtttcccctccagaatctcctctgggagccaggctgggacagactcctgggggagagccggggatggatgagacgccccagggacgctcgcttctgggcatgaggatgctgtggggtgcacggcacgaggacgccgcggggagcagggcacgaggatgctttggggagcagggcaggagacgccgtggggagcagggctcgagggcaccgtgggacccagggacgctgctgcttccaccagcggccctcgtggctttctttgtggaaacagtggctcagcatcagcaccggcgtgggggtggcccggctccgggcggcgggtcctggccggtctgggaggctcctgggcccgcaggcctgcctgtgtggaaacctcgcgggtgtggcagggaagcctcccgatgactcagactgcagggaattccctaatgatctggaatatttttactcctgcactcgggcagtttcctactaaggactcggagctctgataaggctgaacacaaaggccctttcaggaccggctgccttccttcctgccaggggctgagttttgaacagcacgggggccggcgctgcccgtccgggcctccacggagctgggagccgccatggcgatgctcttgccggcgggacgcggccctgcgtctcctttcctgagatgcgaggttatttccatctttcagcagtctcggcgctttgtcttgttctggaagcaattgctagatagacatttctggccgtgaatactattgcttttgaaagacaattactttatgatccttaagcagaaacagaaagcctgccctcaccctcaccctggtcgacctgaaacggccacagacgtcggacaccacggggagaggccccacctccaagagggaaggccacaggcgctggctcagccggggtctttgaggaaggcagggatgtttgtcggttccccgcacttttaggggaagtctaagcgtatctgctcccacctgcgcaggaattgcagggtgcgggtgctcccaggtgtgcggtggaggctgctccatggcagctgctgagctgggcctggctggccacgcagacgtggctccccttggggccgctccggcaaggatggttccccacaggcccacgaggcacgggtgggaaaagacgcctccatgccgtcgttccatttgcttttcatggactcaccgctgcggggcagccacctggaggaggccgcgggggagacggctggagtccctcttgcttctcgggacataaagagaggagcaggctgtgttggcctcggctgcaaaaatggcgtcccctcggggtgtcattaaacgcgacatcctggccccgtgtgcgcctcagtgtccctcctgctcagcacagtcactgaacctccctccccttgccagtgccaaaggcctccacagcgtcagggaagttcctagggaagctgaagttgtgactctgagcttcctgggctgggcgggaagcaaactatagcctgttgcgcccgggagcttcagaggaccacagccttttgtggggtgtggacggggcctcaccccaaagatggactttgtcataagaaaagttcaaaagtcattttcaaaaggtgccaaacaaccagaagacttagttacacacagagtgatttggatttttatgaagtgggggtggaggggcttctgagtggtgcatctgggctgggggcttctgggaatcctgtggcatcagcacctgtgctggagtgaaaacgcctctttcttcccagctcctgagctttccagggcctggaggacttgctgcttcatgaaactcagatggcttcaagcgcaactgagtgtactttttagtttcctgtaatttttttcctagaggagagagggatgccaggctctatcgagtgggttcatctggtgggtaatttgcgtggggacctcgggcctcccgggctggcatggccagggcttggctgggcggctctggggtcctgtgtgactcacatttcctctccaccctccacccaggcagcagcccggcactgtaacagagaaaaaggagattttgtctgatttatcagtaattgagggtttgtaacagacacacattttcttctttggagacagagcataaggataaacttaagtgtgtatacctgtaactgttcattttgggaacagactttattttggagaagataaaaggcaggaagagactctgtaggagattgacatctgttaatttgagataattgccccaaactcagcccatctgaggggccaggccgtgcacacacccaggctgtggtggggccgccttgtccgtgtgcgcctggagcccccactctgccaggcctggagcagagagcacaacgcgtcctttcactacacctctgggagcctttttattttttaaaaacatgcaaatggccactggggaaatgccaaaaatacctcgtgttttgcatttctgtctcctgatgggcaagaagttgtcagaggaaggctcttctcatttacccagtggttcctttgcacacaggcagggccagcggccaggccctcatccaccagagtagaccccagcacgagcaggcgtcgcaccctggcgtggagcccccggccccccgtcactactctcacacctcctgcatccctgggaggctgggctgggaactgcagagccgggtcccaggtccacgcacagacgccctgcacacgctctgctgatggggtacctgctccccctcacacctgctctccctggagaggacgagggcatagagaccctcccgtgacctgtcctgaggctgtgagaggccagcagatgcagggccaggacggattcctgaggatgcccctgccctgtagtccctcctacgccgggctggggtcagaacaagccctgagccgcgtgtcctcagcttctccaggctcccagggcaactttggtgtcgagctcggggccctgccagggcacgtggctcctgaggtgctgccctcgacaaagccctgggatgggcctacgtgggtctcctgggacaaggcgccctcctggctcagggccctgggtctggatcacgtgggggtgtctggggagggggctccccaccacacagagtcacagacgtttcctgctcctttcttccagatggccaccatgtctgggagatggaagcgaaaactgaccgggacctgtgcaagccggtgagtgcctttggcgcagctggagctactgtgggtccccagggcttgggaggctggggtctgctggagccactgcgggtccccaggccttgggaggctggggttcctgtttcttagaatgaaacaaataaaaatagtgcatagagtaacagaaccagtaacaaacaggatcaccaagtactcgccaaagcaccatgtgctgtcacccaacgtgtcaggtcacgtcagagccctggcggccggggacggtgctggacaggctgagggccacctcacacaccctggcgctgagacagcccagggaaggtcgtctcacacggaccctcccgccctttgctgtccccttgctgtcaccatcacctggcacagagcaggctcctgggagtcagtgctgtgctgagttcccggggggtggtcagcacctgcccagacccgctcacagcaccgagggcagggctctgcggcatccccagtggggactcctcaccccgtcctccgaggccactgattgcgccgacctcccctgtgatggtgtcccaagcacaagagcctgggcgtggctcctggactcgcgattggccacagcctgttagcgggcggtgcatgtgtgcggggtcgtggcagacgcgtggctgggtcacacttctgctgtcaccgggccgtttccaactcccccagtcacctgccacagcttccctggcaccgcgtgcatacagccggtgcctgaggataatgaccgtcctcggattggagatgaccttttgtgtggatggctgtagctgctcccacatctcctgcacggcaccggttgctgcgtgcatctctcccatccctgcgcttctgatccatgtgctcatgtttaaagtggtttcttggaggcaacgtcttcttgggtggtgtcttggatcctctctgacgctgtcttgtaattggcacatggagaccattgatgtttaggtctttagttttgtttgtttttgtttttttgaaacagagtttcgttcttgttgcccaggctggagtgcagtggcgtgatctcggctcactgcaacctccacctcccgagtagctgggattacaggcatgcaccaccacgcccggctaattttgtaattttagtagagatggggttttgccatgttggccaagcaggtctggaactcccaacctcaggtgatccgcccgcctcggcctcccaaagtgctgggattacaggcatgagccaccgtgcccggcctgatgttcacttattattgatacagttggattgatccctacgttggattttttgagtgttctgtttagtcctataaaagcagtagaaatctctaggccaacataagatgccacatggctcacaagggagttttgaagacatgaacatgcttctgagctcagcagtgtgtgtccctgcgggtcagggaagtcttgtgcacccactcagtgtgtgtccctgcgggtcggggagtcttgtgcacccactcagtgtgtgcagttggaagctggtcccttcagaaacctcagggaagagcccatctcgggcggctggaggcaggtggacaggacaccggggaggagtcttgaggtcgtctcctgttggtgggacgatcggtggcctccatggagagcggtgctggcaccttcactccctgtcccaagaggtggctctgtcagaaagcagcgtcttccaccctgcgacttcagcgcccttcccccaaggacccatccccttcccagaaccttttccaagtggttatcagatggaaaaggttcctccctggccctgggtgaagtgagctcacctgcaccttcagtggtgctcaggcctcccctgaagctcctggcactcacagggttccagttcaatgctgtcgcttttcttgccttcacctgagaagccccttgaggaaagctggaggccccagggcaggccagtgttcagaggaaggagtcccggcctacacggcccgttgtccgcagagccagtgagtcagggtgctcagaagggtcctgggaacggccagccacaggcaaaggcagctggagctgctgtaccggcctctcctccccgcagcctgttcccgtgtccataccggcctctcctccccacagcccgttcccgtgtccataccggcctctcttccccacggccatttcctgtgcccataaggtctgtggctccccgctggccgggcgtttgcaactgcccagggggctggcagccttcgtccatggggtcattgccaggcctccccacctactgggtgtctgattcgttcctccccactgggctgcccttgctctgctgtgcgtctgtgctgggtacactgacatctggctctccgtccctctgcctgcaggcagtgtaccctggtgcctggcctcgtgctgcctaccctccctagccctggctccgtcggggtctccacaggcttcgccagccccgcacatgcacgcgggttgcgggatgcaggatgccggagctgggctgcccagccgctggcctgccctgtccccctaggcagggagagcagccaggaggagccgtgagcctttctgcactgaaaacaatcccagccaagctgacatccacattctctgtgattttctgttttacttttgacactggcatatttcgagggaagcttaacagctgtatgttttaaaagaaacttaagagcacatgtgaaaaattgtgtacttcaagtttactggttgttttttgtttgttttttgtttttttgagacagtctcgctctgtcacccagattggagtgcagtggctcgatctcagctcattgcagcctccgcctcccaggttcaagcgattctcatgcctcagtctcccgagtatctaggactacaggcgccggccactatgcctggctaatgtttttgtattttttttagtagagacgggatttcaccatgttgtccaggctggtcttgaactcctgacctcaggtgatccgcccaccgtggcctcccaaagtgctgggattacaggcgtgagccaccgcgcccggcctgctgtttcatttttaatctcttaaatggagtttgctttaatatatatattttctcatcataaaggaacttcatactcatcgtggacatttggacaatataaaaaaggaaataaaacctagtgtagtctcaccaactgagacataaccactgctggcattgggcatgcgtcctgctccatttgctgctgtgtgtggatgttcacgcagacacacacacacacacagagtacattatattgtggatatatgtgtttgtgtgtgtgtgtgtgtgtgtgtatatgtatgtgtatatatatatatttatttatttatttatttttttttttttgagacagggtcttgctgtgtcatccaggctggagtccagtggcttgatcatggctcactgcagccttgacctcccaggctgaagcagttctcatgcctcagcctcgccagtagctggggacacaagtgtgccctattctgcccagctaatttttaaatttttgtagagatggggcctcgcggtgttgcccaggctggtcctgaactcctgggctcaagcaatcctcccacctgggcctcccaaagtgctgggatgacaggtgtgagccaccgtgcccgcctgtgcatattttgtgaacaaaatgggatgtgctgtgtctacggtttttgtactttctataagtaagtgtatgagcttcatctcaacagtggagtttaaagcaggttgcgtaggtgctggtgccatttggaacccgtattttttccggtacagacgagtttccctctcccttcctgttcttccgtgtttcttctttatcgcttccttctgtgtgtatttaagtggcagtgctcccacggagatagtatttttgtcatataatttgtctatttagagagttgaagtgggttggcctgtgcccacatcaacataggcccttccagtcaggtaggacttaggaaaactggcatgcaccgtccagcatgccccacagggtcccacctccacccatccagcctgcctcacggggtccccgcctccacccagtctggcccacaaggtcccgcctccgcccagccagcctggcccacggaatctccgcctctgcccagccagcctggcccatgtggtccccgcctccacccatccagcctgtcccacagggtccccgcctccaccccagcctgtcccgtggggtccccgcctccccactcctcgctgctgcctgtgagtgcctcccggcccgttactatttcagtctcggcttccatgagacgtttccttcttgtctcttccctcagctgcttctgctctaaagacccacctggtgtagctgctgactccatcgcagctgccctgagcactgctgaattcagaaaacagccttggaggaagcgtctctttatcccccgtacaaatgccgagacaggctccgggtggccagagcttcccgggtcagcccaggagatggcccagacccacagtgctctgggggcagcccaggccccgcccactgacagcactcatggcccctccggcggcagcttcagctcccctggggcagctctgatgcggggcaaaggcaggaagacgcccatgtgccatggcttctgcttcttcccaatgaactgcagttaattaaacaacacagacctgctgccaggagaaagtgtggcccctgggcacagggcccagtggggtggggagcaggggtgcggggagggcatggcccctctgcatgggtgtctgggcctcagctgtttcattatttgtaaatgaaagagcctggacctcaagttgtcttcagttttctgtctttaacactcttaagatttcattgttaatgtgattcaatcaatttggctaagttaggtgctgagctataattaattattttaacaaaagaagtaatacaatggatttttctcctgcttgttaaactaagtcatatgattataaaaatgaaactttatagatgcgactcccgccaaccctctccccagataccaagtgccgccctcggcagggatgcctgcatcaccccagtcatttagggtcatcaggggcccgagtaacgctggggcctgagcacgcggttggggtctccgtgtcccagccccccacccagccccgacctctgcgaacagcgccacacgtcccatggcttgtgtttcatgtgtatacttgaaggagcatgagtttcgtaaacatgctgctggctgttacattaaaaacatgagaaggtaacggcagcctccacacgccgccctctgctgtctgtgcctccgtgcccttggctgttcccaccccggggtctgcgggggtcagggcctgcctcctcttcctcagttggagtgaatttggggtctgactgagggcctcggccatcgtcaaatgtgacaaacacaggccctccccagagaccgcgtctccaggaagcacctgctcctctgggtttcgctgcagtcacctgagcaggtgctgggccaccgagcacttccatcacacagtggctggcggcggagccttgggtcgttttctgaaggtcaccaaccctttggcatcagagcaggcagagccttttgcatccccgccagtccccttgcccaggtggccccgggcaacctccaccctcaggcacccggtcccagttctgtttacagcttctcttttcctggcttctttccccatattgacaagatttcagtcttaggttggtcttgtctgctgtgctgctctgaggaagcctctcggctcctgggtgtgcaagaagccaagggcagccccttccctgtgagcgtgcgtgtccacacgcgtgtgcaggtggcacagagcatccagggctgtcatcagctgcttctggaccgcccaggtggctgcttgggagtttaccgtcacggcagtcctgtgctgccgtggaaacgcggggttgccgtgtggccgccgtggaaacgcggggttgccgtgtggccgccgtggaaacgcggggttgccgtgtggccgccgtggcgcggcagccatcgcctgcccggtgctgattgtgcctcctgtgtgcccttctcctgtagaattctctggtggttgagatcccgccatttcggaatcagaggataaccagccccgttcacgtcagtttctacgtctgcaacgggaagagaaagcgaagccagtaccagcgtttcacctaccttcccgccaacggtaacgccatctttctaaccgtaagccgtgaacatgagcgcgtggggtgctttttctaaagacgcagaaacgacgtcgccgtaaagcagcgtggcgtgttgcacatttaactgtgtgatgtcccgttagtgagaccgagccatcgatgccctgaaaaggaaaggaaaagggaagcttcggatgcattttccttgatccctgttgggggtggggggcgggggttgcatactcagatagtcacggttattttgcttcttgcgaatgtataacagccaaggggaaaacatggctcttctgctccaaaaaactgagggggtcctggtgtgcatttgcaccctaaagctgcttacggtgaaaaggcaaataggtatagctattttgcaggcacctttaggaataaactttgcttttaagcctgtagtcctgatgtggtctttaaggatggtgaatgagctttgtgctgggcggacgtccccgagacacttctccaggggtaacttcatctcctgggaccacgggcatccaggctggggcaccttctcctcaacctgcctgcccctcacccgccgtgggaatggctccttttcactcatacaaaaaaaaaaaaaaatcatcttacctttttaacctttagggtgttttcttaaagaaaataccatccagtttgtttcttcagtccctgaaccagtagaagagaaaggcgtcccccacgccatccccggcttcctttgtgggtacaggccactccccccagctcggagaggacagaattagcagtcatcctgaattttactgtattttgtgggtacaggccactccccacagctcggaggggacagttagcggtcatcctgaattttactgtattttgggtaagcttagctaacatcaataatctttttatattgctttttttctaaaaactgcagagattcctgtcatctgagagggaaattacacactgggcgctaattgcaaaagcagctgcgttctcttagtaaaatcagggtgttttggaaggtttccattttctctgaatgtaaacagcatttgtaatagaccagatcctaaggaagcccttgaatccccacgttcacaccaaactgttgggactccttgtttttatcaggcaagctctggaaaggcctctcaagatgtggaaaatggggttttgctgtaaagtcgctgtaccctaagagtgtctgtgagacagagctgcaggggtgatgtgcagcccccagcccagccctcgcggggaagagcctcacgctctgtgacccccaggattgtggggagggcctcatgctctgggacccccgggattgtggggaagagcctcatgctctgggacccccgggattgtggggaagggcctcacgctctgggacccccaggattgtggggaagagcctcacgctctgggacccccgggattgtggggaagagcctcacgctctgggacccccgggattgtggggaagggcctcacgctctggacccccctggggtttacgtggtctgtgccgcccacacttagtgagtccagcccattcttggaacaaagtacaatatatcttacagaagaaaatattttatctttttctgaaaatataatgattgagtcctaattaaacttcaagcatggttgaccagaaattgaatgttttaaagaaaacctaggccttatagagaaggattgctttccagagcagtgcattaatttttttcttatttgctcagcatgcggcagtccccaccgtgggtttgagcagcactgactttagcacagatcacgtatctcagaggcagaaggggcgtgcggggagcgtgcctgcccttcacaggtgggaggtggcggcccccaggaccgtggccacagcatgaagccggtggggctgagccgctcctgctacctccagtccacaccccacctggcagccggccgtcctgtcctaccagccacactcctgcctcgattggccccggctcccctctcagcattgtgcccagcgtggacatctctcctgcaccccctgcccagtgtctcggctgcaccctccaccccccatctgctccagcatggctcaacgcaggccaggttccccaggctcaccctgggcaccagccttcgcccgttctccctctctttgcctccgtcgtctcttctctcctggacgtagcaccatagtccctgggtgaccatcccaggtccccacaagcacactgaccagccccaccagcccccaggggctccccggctccctgtcaccccacctggtcctgggggctgcgaccgcaacctgcaccagactgtgagcccctcaggcagagcccccaggctgccgcagggcgagatccccagtgttgacgctgggcctacctcgaggccactgtcagtgtggttgttaaataaataatgaatagaaaccagcacccaggtatccgtgttccgtcccgcgtgcccgctgcacttcctgcctctgcaaccccggctgggtctgaggacgccgaggccgctccaggacctgcgtcctccgtgctgtgcatctgtgtcttggggtccagctcagatggcttctgccacgtggtccgagagatagttgccagctctgcttctgccgaccctggaggtggaggcaggacgggtgggtgtgggtggaagacagctgcttagcaagcaccgccctgactcaaagctgctcttggctttttcccttttctacaccgtcatcatggggtcgttagcagtctaggtttccgctgtgccgatgagcttcgggtctgcatgcccgggggtcacggcagtgaggggcggactcctagggttgtgaaatgtgccgttgaaatgcacaaggtgacaacagtgaacccacttacactccagctgtggaattcatttcacgtacatgtttgtaaagtcaagtctcattgtaggttttccttcaaaattgccatccccacaggcagcacagggaggcccctccgagagctccaagcatttggaatccaggtgcccgaggtgtccggtgcttgtggggggcgggctggggacacgccttggccaccagccgcccgcactcctcgtctcagtgccaaaggcatcctccgatgactcggccgaagatgagctcagtccgcagcccctgtcccggccccgcctcccgtcttcagggggcctcacgtctccttttgagtcagaaggtcgcagtggtcggcctccgggaatcaggcatctgagtgcagggggcccccgggctcaggtggggctgacacctctggctgatggtctgtgatggggcccagagggagagttcccttcaccctccctggggcggggggcaggcattaaatggggagaagttcccagcagaatgtatgagccccatgaacggagtgggcatagccctcggggagtcctgccggccgcccctcctgacatcccggggtgctgcccggtgaggaaagtgaaaatgttgtctgcagttagaggctggaacacacatgcccacagagaggcttcctgagcggcttgtctgtcactgtttttgtgtaactgcgcctgaatttaatctcccggaaggcgcgttaggagggctgagggatgatctggtgccaggaaggttggcagttccgagaggttattccagcacgtcagcattaaaggagagaggcgaacctggaacgtgggaaccctgcccaggtctggttagaaaggcggcgtccgcgtggcctggggcttgtgtgaggggtgcacttgtgcccccagatacaagcaggcagggccgggaatctgtctcgtggggggctgcgggcactttggagaaagaaaaccaagttacaaactcaaaattacctaccaaagtcagtatttttttaaacgagaaaataaaacatgacaaatgccaggtctttttgtctgaagtcgttttagtcggttacctggaaacgctcccagggcccctgagctggggacacggagctcttcccccatcagtgcccaggagaagctgctcccggccctaggtccctgtgggaacacacagccagccctgcctctgtgggggtccctttcgtggccagagcccccttcctcaggggacacgcggtccagctgagggtcatcccgtgacaaggagtggctgctgtgatgacccaggcacagaaacagctttgaccacagaacgtgacatccagggtgtgaaggtgtcggaacagatctgcctcgggatctgggggtccttcaccaggggtgggcgtgggccccgagcccagacaggagccagctggagactcaaacgtcacgaagaagggaagacgcgcttccctcccccggtactaaccagcccttctgctggccctgcaacgatgacctaggcttgagaatctgtttctgcctcaaggggtagaaaggggaatagattccattacttccctgtttgcaatggattattaaatccagcaataactgtggcatcggagaggtgttggtacagagggagccggggtcctgtggccttgggtccaccccagcgatcatcacgggagagagctgcttagggtgtgagccgtgggggggcggggggcggctgtgaaactgaggtccccgtgcacagatcccaccacccagggtcgacagctgggggctttctctgctggcacttcccaggcagcagaaccggcccctctaggaagccccctccaggtggcgtggcccaggccctcagtaagctcagctggggctgtgtgagctgaggggctcagagcaccccacaagggatccgcctgattgcagacaagcagttctgggccgccgcccgacctccatgcccttctgctcagcccggcagcctctccttcccaggggtttcccattctgccttttccctggactttccaactcactttgtccaagtccactgcatgtaaagcttgatcctgaaacagtgaagttcttgaggtctctgcagatgctcagcggccccaaatcaccctttcgctgccattggccaaaagcacagcctgggtgggccttgaacacctgtggcctcttcccctccccctcccctcaccccacacacttggagacaccctggggctgggcctgagctcggctctcactgcagagtaaacctgcccacctcagacacccaggcatggctcccgccttccctcatctgatcctgccaccgtggcggctgcctccaagctcctgacaacgtcaggtcagccctggcctcgcggcgctctgggtttcagccttaagagactttccatgtgtcggctgtgggcgccttgacgcaccagggcctggtcacaggttctcaaagcagagattctcctggcacccctcgtgcgccctccaagggcctaaaacgcagacgacccacactccatgccatgtcctgcacaggaaccagggtggcctcccctttctgcagcttgtgggggtcaagccgggacccctacactgatgtttcagcccagctctgccgcagcttagaagtcctacctgatttcagacagagcggatgatgctgacatttccagcccacagcgtggcctgcgccacgctccaggtcgccacaggggtgagaattctgggagcccagctgccgagtgcttctggggttggagctgggctggccccacctgtgaacagcggcctgtgggcccctcatccctgttctactgaaggccccacaaccacctgagggagacagcttttattaaatttcagtttttgtcggttgcctcgctcttcagacggcaagtgagagaagcgtgttctcacgcttactgtcaacgttgcgagggaagcgtgttctcatgctcactgtcaacattgtaaacctgagggaagcgtgttctcagctcattgtcgacgtaaaccccagggaagcgtgttctcacgctcactatcgacgtaaacctgagggaagcgtgttctcgcgctcactgtcgacgtaaacctgagggaagcgtgttctcgcgctcactgtcgacgttgtaaacctgagggaagcgtgttctcacactcactgttgacgttgcaagggaagcgtgttctcgcgctcactgtcgacgttgtaaacctgagggaagcgtgttctcacactcactgtcgacgttgcaagggaagcgtgttctcacactcactgtcgacgttgtgagggaagtgtattctcacgctgtcgacataaacctgagggaagcgtgttctcacgctcactgttgacgtaaacctgagggaagtgtgttctcacactcactgtcaacgttgtaaacctgagggaagcgtgttctcacactcactgtcgacgttgtgagggaagcgtgttctcacgctcactgtcgacattgtaaacctgagggaagcgtgttctcgcgctcactgtcgacgttgcgagggaagcgttttcacactcactgtcgacgtaaacctgagggaagcgtgttctcacgctcgctgtcaacgtaaacctgagggaagcgtgttctcacgctcactgtcgacgttgtaaacctgagggaagcgtgttctcacgctcgctgtcgacgttgtaaacctgagggaagcgtgttctcacgctcgctgtcgacgtaaacctgagggaagcgtgttctcatgctcactgtcgacgttgtaaacctgagggaagcgtgttctcgcgctcactgtcgacgtaaacctgagggaagcgtgttctcacgctcactgtcgacattgtaaacctgagggaagcgtgttctcgcgctcactgtcgacgttgtaaacctgagggaagcgtgttctcacgctcaccgtcgacgtaaacctgagggaagcgtgttctctcactgtcaactttgcaagggaagcgtgttctcgcgctcactgtcgacgttgtaaacctgagggaagcgtgttctcacactcactgtcgacgttgcaagggaagcgtgttctcacactcactgtcgacattgtgagggaagtgtattctcacgctgtcgacataaacctgagggaagcgtgttctcacgctcactgttgacgtaaacctgagggaagtgtgttctcacactcactgtcaacgttgtaaacctgagggaagcgtgttctcacactcactgtcgacgttgtgagggaagcgtgttctcacgctcactgtcgacattgtaaacctgagggaagcgtgttctcacgctcactgtcgacgttgcgagggaagcgttttcacactgtcgacgtaaacctgagggaagcgtgttctcacgctcgctgtcaacgtaaacctgagggaagcgtgttctcacgctcactgtcgacgttgtaaacctgagggaagcgtgttctcacgctcgctgtcaacgtaaacctgagggaagcgtgttctcacgctcactgtcgacgtaaacctgagggaagcgtgttctcacgctcgctgtcgacgtaaacctgagggaagcgtgttctcacgctcactgtcgacgttgtaaacctgagggaagtgtgttctcacactcactcgacgtgagggaagcgtgttctcacgctcactgtcgacattgtaaacctgagggaagcatgttctcacactcactgtcgacgttgtaaacctgagggaagcgtgttctcacgctcaccgtcgacgttgtaaacctgagggaagtgtgttctcacgctcaccgtcgacgttgtaaacctgagggaagcgtgttctcacgctcactgtcaacgttgtaaacctgagggaagcgtgttctcacgttcactgtcaacgttgtgagggaagggtgttttcacgctcactgtcgacgttgcgagggaagcgtgttctcacgctcaccgtcgacgttgtaaacccgagggaagcgtgttctcacgctcactgtcaacgttgtgagggaagggtgttttcacgctcactgtcgacgttgcgatggaagcgtgttctcatgctcaccgtcgacactgtaaacctgagtgaagtgtgttctcacgctcactgtcgacgttgcgagggaagcgtgttctcatgctcactgtcgacgttgtgagggaagcgtgttctcacgctcactgtcaacgttgtaaacctgagggaaaggaattctctctcacatgctgtggggtgctggccccaccaggcctcccaggagacctccccaaaagtcagaagaagggctccaattgaaagggaggtccgagatgtgctcgccaaaaccacccccagcaagacgccaggcatcctagccacccgacgctcaggccgtgcgtgtcctcagagcgtgttttaaagcaggagggatttggggtggaagattgctcctgcagaaatcagagatgaggggagtaaattagggaaccagcgtcaggatccagacttctgtgaaagagccacagggctcagcatccgacgggcgcacctggggctgggcgagtctggctccagaaggggggtggggccgggagcctgagatgggatgagagggcgggaaggggcttgttgagaaatctaagggccacgggccaccaaaaacaaaccaggaggtgtgagtcagtggggaggctgggtgccaggaagcctgcgctctgggacatgcgtggggcaagaggggcgccctgagcttggcgacgccagccgcgcgcctgggagggatccgcctgtccacgtgcagccgcctccgggcggcgtcggccatgctgctgccccaccgtggctctgtggctccagccggaatggcaaagcctggctccacagctgcctgggagcgtgagtcacgcgccccacagaacacggcgggcagcgcgggcgaggattggcgaaagccgaccgatgtgttttggcttgtgtggtctgtgggagcgtcctttgtcatcagcctaattgggcaacagatcccacctcactgtgccctggagcagcacggggccaccacacagcctgaagccccacttgcgcttcccctcgctgccgtgctgtcctggccccgtcgctgccacctgaggcccccatcaagtacctgagctctgcgtctgttttcacgcttctgtatgtgtaggaagccccccaccgatgttgctcggggtcgacgtgataaacctgagggaaagggaattctctcaccccgaccgacacacaggatgggtgtgggggcaaagtgagatcatgaacaaaagcatctgggcccgtcctggacacatggccagggttagccacggttgtcagcctccacggagctgcagtttcagcctggaggtctgtggcgtgcatggttggaatactcaccagactcacgtggtcgtgactccggaagatcatgccttcctggaaaccttggaacgcgcttcagcagaaactccagtgaagagtcggtgagagagcacaaattcccaaaggcggatggagttcggaaggacccttctctgtctcccacatcaggcggtgcctggttggtgcagatttaccccatggtgggccgtggatccctcacctgctctggaaactgatcttggctctgaacaaggagaaatgatgcctctcagcctcgagggatgggtgataaggcagcttcatccgctgttttctttcattgtttgagaaaagtcatgccccggaggtgtcattcctggttgtttatgttgatggcaaaacttggactttcttgtcatacagcaaacagaagacaatctgatctttgttttccaggggtttagactttgaacaaaacctcttttgtccagtactgtagtgcatccctggtagagtaattcaagctgaacacaaggttgcataaaaatgtgggcatgggggagcagggaactgtcttgggatcattctttgctgtgcacagcagctgcagcctgcaggcagctcagcgttagatctccccacccccaatgccacctggggaccagatgttactgttggcggaagaagggggtccggggcactgtctcagtctttggggcttccatggtggagcactaccggccgtactgttggtggaagaagggagtccggggcactgtctcagtcttcggggcttccatagtggagcaccaccggccgtactgttggcagaagaagggggtccggggcactgtctcagtctttggggcttccatagtggagcaccaccggctgggcaccttgtaaacaacagacattgatttctcacagctctgggggctggaagtccgaggttgggactggtacggtcgggttctggtgaggaccattccaagttgcagacagccaaaatcctgccatatcctcacatggcaggacaggcgatttgtctctccctccctgtgggacggcagtcccgttggatcagggccccaccctgatgacattgtttaacccccagttacctcctgcaaacaccactctcaagtagagtcacgcggacgggggttagggcttcaacatgaggttgaggggacacgagtccgtccatagcagtgaccccacttgtctaaagccacagggctgagcctgccccctgcccccctgcctgcccatccccaggcccccgttcttgcccccaggcccccccccgcccacccccaggtgctccctgtgctgcagacagagcccccgaggagccaggagctgccgggcaccaaccacacaggaagccaacaggtggggcaggcttgtgcctgccaccgtgttgctcatgccgatttttattctcagatcttgtcacctctgtcttgtagcagaagggggccctgatctgggagccgtgaagaccccagctgtcccccgggagccaggccacaccaaggcagccaaggggactacgttgggaggaggatgtggtccgggccattaagagctgtgatgagcccccaggtctgccctgggtgaggggctctgcctgccctggggctgcatagacccggctggggctttagaacaggaaccgttcgaggggctgcggtgggtgaagcccactcatgtcctggctcctgttaccgggtagggatggcagcccattttccaggcttgggggttctttaagaggccaggattgtgccgaatgctctttggctgacgatggccgtggcgggggctttgggaggggaggtcctggaggagaggcttgcccagctcactgcctgcgtctgtggccagaattggcacctgcatggggcctggaaacgtcgtgctcacctggggcggaagcccccctccaggactcagctcccaacgtcactgctaccgaggcagagactctgcagcggcatcagagagaagctgggccccagaacagcaccaggcatgggacgggccctccgtgccttccacggaggatgcaagcgtgaggcctgggtctgcggggacggtttacctgtcagctctgcacgccgctgaccactgcgcgccgcctccacagacagtccccatggacgctggggctgccgtggacgatggggcagccatcatggacaacgggactgccatggacaccgcagccagcctgctctgtgggaatatgctttgtaaagccagccggccctgaggccagcactcgccttccacactctgctctttgtaacgagtttcataaactcaccctcaggtgattggtgtttctgttgcaccgttgcttagcctgaaaatgagctgccctttttctgagcccatcctttcgccacctctaccccagcccctcatggctgatatcaggaggtagccagaggccgcctggtgcagggtgagcccggaacacgggcaacagcttgaactgggcctgtgcggccccctccacgggcgacagcgtgaactgggcctgtgcggcccccctccacgggtgagactcccaggcgctcttgcagacgctcactcactttctcactgataggatgcgtcttacgaggctctgatttacagagcaggcatccatcttctctgaaacccacacaaaaagcacagtttaggccaagcccaggtgcagtatgttcgtgtgtttaagcttcttagatgctggggtgtggaagcagccgtgtggctttcctttgcttgtgaaggtgagtttgcactttccagcttctctctgtattgggaaggctgcagctctccaggacatgacttagcagagaacatcccgctgcatcctcataggccagcgggtcaggcggggccattctgaaacgtcccctgtgggtgccgggtgcctcgcgcatccctgccgtccaccgccctttgtccctggctgtgcttcgcggcagtgccccttagggcaaggacagggagatggggcagtcgcctggggaaggcccggtcccagtgggaggcagcctcagagcagctgggatggcacaagacgccgctgccagggctgagaaaccatccggccaaccccagacttgagccagacttcatgggcaaggctgggagaagccgcgtggagaccccagcccagggaggggcactgtggcaggaacagggcccgcacctgcagggtcagcccaggccaccttccaagcacggtgaccacgtcgcagctcatgctgccagctccgggccaagggacctggactggctctccagactcacaagatgccgtcgtgggtggggcacgtgcggtgatcccaggtttcaagtagctgcccccagctccctgcaaatagctctgggcggaagagaagcagtgggcaggcacacgagtttattcctgagaggagcgtgttgccacagcctctgtggactggagccccaggcttcagaaagagagggagcgcctgcctgtgggtggggggacaggagctgccaacctggcggggtcccagcgaagcgtccactgggccttctgcttgcccctgggggtggtggatgcatcagtgctgggcctgctccgaacccgcagggcaagcagcccgtgcgtcccgatgccactgccggccgccagcatcctggggaggtgggtcgcgtgtcccagagccctgtgcccctcgccaccaccatcctaggtcaggacttccccaggaagaatccaagtggctggagagatgcgggggttaatgccggtaccaccgcggttttaaacggggccgtgtctgagccgtgttcttgacgttctccagccagcagcagcagacgccacccggttgccccagccccagcggctctcgggcatagccggccttggcccgtggggcggctgatttacaggacagctgtgcacggggcctctagtgtccgccagagctggtgggtgagagtttttaaagcgctcgggacacttcacagaagaggcgcactggcccccatgcctggccatgtttctgggccctggctgaaaatcccgagcagcggagagaggatcccaacagggtattaatttaaccttccagccatgtgcttttgcttaagatctaaactctgaaaattaccagcctaatttagaatggaggcttggccattcgggacaccagcatcttctgagcgggagagatgtgggtgcccaccggcgtctcactcccacatctgggcctgtttccagtgacccctgcacctctcaaaggcgcaggcctgagttcacagagagcacttggccaagccctgcctctggggctccccatcgtctggctttgtcgtggactcatcatttctggatttaccacatgcttcaagctggaacagcaggaaggggcagttcctgaggcccagctgcgtccgcagagctgggggcgccatggcctaaggcaagacgcgtgccctggatgaaaatgactccagctctgtagtctccagacagcggttagagccccaccctccacggacaccgcctcctgccaccccttcaaaaaagtgttgcagcccagggcccagatattcaattttctaatgtaaaacgaggcgggtagggtttcccaatcaacatgagggcgccgtgtcctctgcagccccctgacttgcacaggcagtcctggggctctgccccatctgtgaaccctcagctgaagagggcagccccagaggcagccacattcaggtggctgaaggcagagtcctcctcccaggaaccgcctcggcgctgccaaggcctgtgcaccttcttcagcccgaactaaggagaatgtgcgggactgagagccatagaccctcgtgagccaggcttgagcgttgtcttcagatggggcccagtgggcctcactgttgtgacgactgaatgtgacgtctggggtgtaattccagcgtgacctggtcctggggtgtcactccagcgtgacctggttcctgaggtgtaattccagcgtgacctggttcctggggtataattccagcgcgaccttgttcctggggtgtcattccagcgtgacctggtcctggggtgtcattccagtgtgacgtggtcctggggtgtcactccagcatgacctggttcctggggtgtcattccagcgtgacctggtcctggggtgtcattccagtgtgacctggttcctggggtgtcattccagcgtgagctgtttcctggggtgtcattccagcatgacctggttcctgaggtgtaattccagcgtgacctggtcctggggtgtcactccagcatgacctcgttcctggggtgtaattccagcgtgacctggtcctggggtgtaattccagcatgacctggttcctggggtgtaattccagcgtgacctgctcctgaggtgtcactccagcgtgacctcgttcctggggtgtaattccagtgtgacctggttcctggggtgtaattccagcgtgacctggttcctggggtgtcattccagcgtgacctggtcctggggtgtcattccagtgtgacgtggtcctggggtgtcactccagcatgacctggttcctggggtgtcattccagcgtgacctggtcctggggtgtcattccagcgtgacctggttcctggggtgtcattccagcatgagctgtttcctggggtgtcattccagcgtgacctggtcctggggtgtcactccagcgtgacctggttcctgaggtgtaattccag

SEQ ID NO: 1239 - DNA, 2935 bp, Homo sapiens
gaattccgggccgggagaaccgaacccctggcggccgcgaccccggctcccgccccggccccggcccgacccgccatgacggggctggaggaccaggagttcgacttcgagttcctcttcgagtttaaccagcgcgacgagggcgccgccgcggccgccccagaacactatggctatgcatcctccaacgtcagccccgccctgccgctccccacggcgcactccaccctgccggccccgtgccacaaccttcagacctccacaccgggcatcatcccgccggcggatcacccctcggggtacggagcagctttggacggtgggcctgcgggctacttcctctcctccggccacaccaggcctgatggggcccctgccctggagagtcctcgcatcgagataacctcgtgcttgggcctgtaccacaacaataaccagtttttccacgatgtggaggtggaagacgtcctccctagctccaaacggtccccctccacggccacgctgagtctgcccagcctggaggcctacagagacccctcgtgcctgagcccggccagcagcctgtcctcccggagctgcaactcagaggcctcctcctacgagtccaactactcgtacccgtacgcgtccccccagacgtcgccatggcagtctccctgcgtgtctcccaagaccacggaccccgaggagggctttccccgcgggctgggggcctgcacactgctgagttccccgcggcactccccctccacctcgccccgcgccagcgtcactgaggagagctggctgggtgcccgctcctccagacccgcgtccccttgcaacaagaggaagtacagcctcaacggccggcagccgccctactcaccccaccactcgcccacgccatccccgcacggctccccgcgggtcagcgtgaccgacgactcgtggttgggcaacaccacccagtacaccagctcggccatcgtggccgccatcaacgcgctgaccaccgacagcagcctggacctgggagatggcgtccctgtcaagtcccgcaagaccaccctggagcagccgccctcagtggcgctcaaggtggagcccgtcggggaggacctgggcagccccccgcccccggccgacttcgcgcccgaagactactcctctttccagcacatcaggaagggcggcttctgcgaccagtacctggcggtgccgcagcacccctaccagtgggcgaagcccaagcccctgtcccctacgtcctacatgagcccgaccctgcccgccctggactggcagctgccgtcccactcaggcccgtatgagcttcggattgaggtgcagcccaagtcccaccaccgagcccactacgagacggagggcagccggggggccgtgaaggcgtcggccggaggacaccccatcgtgcagctgcatggctacttggagaatgagccgctgatgctgcagcttttcattgggacggcggacgaccgcctgctgcgcccgcacgccttctaccaggtgcaccgcatcacagggaagaccgtgtccaccaccagccacgaggccatcctctccaacaccaaagtcctggagatcccactcctgccggagaacagcatgcgagccgtcattgactgtgccggaatcctgaaactcagaaactccgacattgaacttcggaaaggagagacggacatcgggaggaagaacacacgggtacggctggtgttccgcgttcacgtcccgcaacccagcggccgcacgctgtccctgcaggtggcctccaaccccatcgaatgctcccagcgctcagctcaggagctgcctctggtggagaagcagagcacggacagctatccggtcgtgggcgggaagaagatggtcctgtctggccacaacttcctgcaggactccaaggtcattttcgtggagaaagccccagatggccaccatgtctgggagatggaagcgaaaactgaccgggacctgtgcaagccgaattctctggtggttgagatcccgccgtttcggaatcagaggataaccagccccgttcacgtcagtttctacgtctgcaacgggaagagaaagcgaagccagtaccagcgtttcacctaccttcccgccaacgttccaattataaaaacagaacccactgatgattatgagcctgctccaacctgtggaccggtgagccaggggttaagtcctctcccaagaccatactacagccagcagctcgcgatgccacccgaccccagctcctgcctcgtggccggcttcccgccctgtccgcagagaagcaccctgatgccagcggcccctggcgtgagccccaagctccacgacctttctcccgctgcctacaccaagggcgttgccagcccgggccactgtcacctcggactcccgcagccggccggagaggcccccgccgtccaggacgtgcccaggccagtggccacgcaccccggctcgcccgggcagccacccccggccctgctgccacagcagtaaatgaaataatacgaaatgacctctccagcacgagcacccactcctagttgccacattggagcactcagttcagcaggggtatgctgacttcagcagacaaagacttttgaataaataaactgaactcacacctggtaccactcagaacctccaactgactgaatgccaggagctgaacattaatatgtgcaaagattggctctccaacaagaaggaaagcagggaggaagggagaccactgtgtcgcctggaggagaagtcatctcatgacaacagaagggaggtggccgggctgagcacggagacccaccgtgcaggggcctttcatgggaacggcccacacgcagtttgaccccacgcccagcccttctggcacccctggggttcaatactggaagtgccttatttaaccagaccatca

SEQ ID NO: 1240 - DNA, 2439 bp, Homo sapiens
atgacggggctggaggaccaggagttcgacttcgagttcctcttcgagtttaaccagcgcgacgagggcgccgccgcggccgccccagaacactatggctatgcatcctccaacgtcagccccgccctgccgctccccacggcgcactccaccctgccggccccgtgccacaaccttcagacctccacaccgggcatcatcccgccggcggatcacccctcggggtacggagcagctttggacggtgggcctgcgggctacttcctctcctccggccacaccaggcctgatggggcccctgccctggagagtcctcgcatcgagataacctcgtgcttgggcctgtaccacaacaataaccagtttttccacgatgtggaggtggaagacgtcctccctagctccaaacggtccccctccacggccacgctgagtctgcccagcctggaggcctacagagacccctcgtgcctgagcccggccagcagcctgtcctcccggagctgcaactcagaggcctcctcctacgagtccaactactcgtacccgtacgcgtccccccagacgtcgccatggcagtctccctgcgtgtctcccaagaccacggaccccgaggagggctttccccgcgggctgggggcctgcacactgctgagttccccgcggcactccccctccacctcgccccgcgccagcgtcactgaggagagctggctgggtgcccgctcctccagacccgcgtccccttgcaacaagaggaagtacagcctcaacggccggcagccgccctactcaccccaccactcgcccacgccatccccgcacggctccccgcgggtcagcgtgaccgacgactcgtggttgggcaacaccacccagtacaccagctcggccatcgtggccgccatcaacgcgctgaccaccgacagcagcctggacctgggagatggcgtccctgtcaagtcccgcaagaccaccctggagcagccgccctcagtggcgctcaaggtggagcccgtcggggaggacctgggcagccccccgcccccggccgacttcgcgcccgaagactactcctctttccagcacatcaggaagggcggcttctgcgaccagtacctggcggtgccgcagcacccctaccagtgggcgaagcccaagcccctgtcccctacgtcctacatgagcccgaccctgcccgccctggactggcagctgccgtcccactcaggcccgtatgagcttcggattgaggtgcagcccaagtcccaccaccgagcccactacgagacggagggcagccggggggccgtgaaggcgtcggccggaggacaccccatcgtgcagctgcatggctacttggagaatgagccgctgatgctgcagcttttcattgggacggcggacgaccgcctgctgcgcccgcacgccttctaccaggtgcaccgcatcacagggaagaccgtgtccaccaccagccacgaggccatcctctccaacaccaaagtcctggagatcccactcctgccggagaacagcatgcgagccgtcattgactgtgccggaatcctgaaactcagaaactccgacattgaacttcggaaaggagagacggacatcgggaggaagaacacacgggtacggctggtgttccgcgttcacgtcccgcaacccagcggccgcacgctgtccctgcaggtggcctccaaccccatcgaatgctcccagcgctcagctcaggagctgcctctggtggagaagcagagcacggacagctatccggtcgtgggcgggaagaagatggtcctgtctggccacaacttcctgcaggactccaaggtcattttcgtggagaaagccccagatggccaccatgtctgggagatggaagcgaaaactgaccgggacctgtgcaagccgaattctctggtggttgagatcccgccgtttcggaatcagaggataaccagccccgttcacgtcagtttctacgtctgcaacgggaagagaaagcgaagccagtaccagcgtttcacctaccttcccgccaacgttccaattataaaaacagaacccactgatgattatgagcctgctccaacctgtggaccggtgagccaggggttaagtcctctcccaagaccatactacagccagcagctcgcgatgccacccgaccccagctcctgcctcgtggccggcttcccgccctgtccgcagagaagcaccctgatgccagcggcccctggcgtgagccccaagctccacgacctttctcccgctgcctacaccaagggcgttgccagcccgggccactgtcacctcggactcccgcagccggccggagaggcccccgccgtccaggacgtgcccaggccagtggccacgcaccccggctcgcccgggcagccacccccggccctgctgccacagcagtaa
